United States Patent 9,328,346 (POLYCOMB-ASSOCIATED NON-CODING RNAS) - sequence listing, part 136

SEQ ID NO: 191861 - RNA, 79708 nt, Homo sapiens
ucuuaaaaauccuucuacagugauuuuauuauaaauauguucuuuuggaauaaacaaauauugcauucaagacuaugggcaaacuugcucuaaaguaacaaacgaggaagaaaggaaccaggaaccauuuagaaguggagaaaaacacagcaaagacaccugcaugccacgcucagcgccuuucucccagggaguaacagaagguuaacagggaacaucacauugcccaugagcccauucuacucaaauaagcuuugaguuugguaauuugcacuuguuuuguaaacugaacugcuccucuccucagccgcaagaagcagauaggaagacagucuucagaccccgagcaucagcaagaacacucuugauuguguaucuguaacucuguuccagggcaaaacuguucccuauuugcuggaaguaaugucagaguaauccuucagcacuccagccaaguguucguuaugagucuuaaagcgucgcuuuuucugugaagcaggcuuuuuccuucucugaauaggggccuaaaggaaaagguaaaaacaauuagaaacaacagcugcucugaggggugguguggccaggauguucugagcaugcccagaugccaguggcugaggaugccagguucggacccuucuccugcucugccacccagcagcacacauggggcacagcacacgcccugaccagaccccgggccuuuguuccccugagaugcagaugccaucgggaaugaaggagcaggcacaaaaaccugccaaaaugguucuaggcacuaagucaaacaaaagggacgaugaagcccuucagcucugucucugucaucagguuuaaaaacguauccaccauuaccgauuuuaaaaagaucugaagaaaauauggcaaaauccugagaaaggaggagcacaugaaggucuguaauauucucuauucuuuucuauauacuugaaauauuagcaucacaugaugaaaaaaauuaacaaaugagacaauaauaggaaaucaugaagggcugcaauuacacucauuuguggaaagagauugacaauaaagcuucccuuuaggugaguccuaaaaauucaccaaacacacaugcccaccccacaccccagaaagacacaggugacaagcuaugaagcaugacgguggauaaggaaaggggggaggagcacagcacugcuaacaagggugcuggugaaucauccccccgggcuuuguucuuagacuacagauuuuauuugcuggugcaaggcaauguaaaagucaucauuuaauuacuaacauccccugugagcaggauuuagagacuauacggacaaaaauaucugguuccuagaggaccugaaaguuacuauggcagaaccaggcaccaggacggcgaggcucacggagcaggggagggccccguucaagucugaaagguugugcagaucaaggcacagcaucccuuuaagaauagggagaagggcuuguagcagcuuagagugggagaguggggaacacacaggcccuggaagguuccauauggcuauaccucaagagcaggacugcuugggaggagcuggguguagaaaggcacucacaggccuggagcagcaccgagggcgggucugcaggccugcaauaccucagaugugaccugggcugcggacacugagaaacaauggcgggggaacaacucccagcucuucagagggcagaaagcggagcaggcuaacaguucccagggcaggggauuaagcugcuuugcuagagauuacgcaccacuuucuuugguccagauuccugcauggaagaaauacccugucgcuucagauauucuucaauuuucuccucguccauggaaucuacagugacacuccuccacaguuucugaaauucuguaucaaacagacacuaguuauuuuacaauccauuuuuacaaacuauagcaucuugaucaaaauccagguuucaguguuaucuccucuggauccaaaugagcacaucugauaugucaucaugaaacaagucagggcagaacauccacaugugggacacggugcagggaaaggccuggagacagaacugcacccacacagccccgacaguggggcuguuucuugaggccagcaaaugagggcugccacaaugaagccgcccugcuuuccugggccgucaacacccuccuuuaauuccucuauuuagggcuaacagcuuauuuccugcucagcuccccuaagcaugauauacucauuccucucucauugauaauagaaaauaagaaacguguagggagacgggaaccgaaguuucacauggaaaugagguuauucaacaauuuaucugcaaaaaagacuuuugaaaucaaauaaccugguaacuggugacuaaggaggcaugaaagggaaaggggggauggcugaaauagaaacacugucucaccuccucucuguaauacaaggagaaaggcgacaguccugccugcagcuugucuucagaaaccuguagucccucugccacaucacuauuuuugcaaccaagagagaccacaauugggaagcauuccaaaugaacauuauuuacaucuuacauucugcuccugaagacagguucugaucacugguuucacuuaauuaucagaagcuacuuucagacacaaaauccuaagacuuacacgcucaggaacgaaaaaaggaaaagcucucugagccccgaggcuucacagagccucacacucacaacugccccacgcacugaggggaugcaccuucccuuccuuucuucccaccccagacccucacccagcgccgcccuccuuuucuuccagagccaagaacuucccacgguccguuuacaaaugauaaaugaaguaggcaucugauacugugcuaggccagauuucuuuccuuuuccccuuuuccuuccuucccccuuucucucucauuucaguacacgcugcauaaagcaaaugaugcccacauaggcaggacucuggugauaccauggaaaucgguuuacugccaccuacccugaagcuuuucauugcaggugaccaauggcaaaaguggcaaaaucuacuacaaagaauucaaccugagcauaaaguuauuuaaauccaaaaugucucuaaauaagauuuuuuaauuuccauagauacauuagggguucuuucuacuacacacccacugaacguucaucugcacacauuauggacaugaccuaacugauaacaacugugugcaugauugucucggccucucuaagcuccuugagagcagggagcucuauuuccaucuuguuuccaugauagucggcguauuuccaucucguuuccaugacagucggcacuguaccuagcacaugacagguccucagugauuugacuacugaauguaugaaacaccaucacugucuacuacagccuagacaagacuucaacgauuugacuaccgaauguaugaaauaccaucauugucuacuacacccuagacaagacagacuguuuucuuuuuuuaaaauuuauuuauuuuugagacagggucuaguucuguugcccaaacuggaaagcaguggcgcaaucucagcucacuguaaccuccaccuccugggcuuaagcaauccucccaccucagccuccugaggagcugggaccaagguacacaccaccaugcccagcuaaguuguuucugggggggugggggguuguguagagaugagguuuuaccauguugccuaggcugggcucaaacuccugagcucaggcaauccaucugccuuggccucccgaagugcugggauuacaggugucgagccaccaugucuggccuauauuuuucuuuuuacauuuuuuagacuuuuaaaaaauaauuuuacacuaacaaaaggguuacaaaaugaguacacagaguuccuauaugcccuuuauccagcuuccccuaauguuaacaccuuacauaacuguauaauuauugaaacuaacauggacauauuacuauuaauucaucaacaggccuuacugaaacuucacaaguuugaagugaaacuucaacuucaccgaugcucuuuucuuggcccaggauccugccugucacaucucuuuggucuccuccauucucuaaguguggccagucuuuguuuccccacuggucaguuguuuuacagaaacuuccauuuggguuugucuaguauuuccucauuacuagauugagguuaugcaauucuggcaagaacaacacaguaacgagcuugugcccuucuuggggcacaguagcaagcuacauagugucaacauggacccgguaaacgcugaccaucaggcaagguguuaucucucagguuucucugucaugaagcuaucaguuuuuccuuuguaguuaauaauuaauggagagauauuuucagacuauauaaauaccguuucucauauuaucacuaauuuuauaauagcauccauugguagugcuuaccuacaaaaaugacuacuuguaaguaacuacugacaaauuauuuccaucauuccuuccauauguacuaauuagaauucuacuauaauaggcugggcacgguggcucaugccuguaaucccagcacuuugggaggccgaggaggguggaucauucaaggucaggaguucaagaccagccuggccaacauggugaaacugugucucuacuaaaaauacaaaaauuagcugggcauggcaguggguaccuguaaucccagcuacucagaaggcugaggcaggaaaaucacuugaaccugggaggcggagggugcagugagcugagacugugccacuguacuccagccuggguaacacagcgagacuccaucucaaaaaacaaaacauaacaaaaaacacaaagagcugcucuuccuucaguucacuguuuguuuguugagacagggucucacuuugucaccuaggcuggagugcaguggcacaaucuuggcucacugaagccucaacuuccugggcucaaucaaucuuccucccucagccucccaaguggcugggacuacaggcacauaccaccacaccaggcuaacuuuuguauuuuuaguagagacaggguuucaucauguugccaaggcuggucucgaacgucuagacucaagcgauccaccugccuuggccucccaaaguacugggauuaccagccugagccacugugcccaaccuccaacuuguuuuucaauuauuuaauuuagcagacucauggauauuacuguacagauuuauaucuacauauuuauuacacagauaauccaugacgaucaguauuuauuuauuuauuuauuuuauuuauuuauuuuauuuauuuugagauggagucucgcacugucacccaggcuggagugcaguggugcgaucucggcucacugcaagcuccaccucccggguucacgccauucuccugucucagccucccgaguagcugggacuacaggcgccagccaccacgcccaguuaacuuuuuguauuuuuuaguagagacaggguuucaccguguuauccaggauggucucgaucuccugaucuugugaucugcccgccucagccucccaaagugcugggauuacaggcgugagccaccgugcccagccgacgaucaguauuuauuuugugguucaaacaucccagcucuaaucacuaagauuuccuucauguugguuccuaugucccugacuugcuucccuuuuuuuuuuuuuccuccaguuuuucuucuuucucucacuuucuggcgguacuaaaagauguuccaggcucaucuuguauuuccccucauuuggaaucaaugauuucuucaaggauuccugacuuguuuuauuauagaaugguauuuaaaaaccaagaucuacauauuuuggguuuuuaaaaauagcaaucucuuuuuugaaaacaaaaugaucaagggacaucaaauuuaaaggcagacacuuuauuauggcagaagacagccaaguaucaugaaagucaggcacacucuaaaccguaaggguaaauaaaaucagaacugauuuagaaaucuacucucuuagcagaaaagaggagaaaacagacuagaauuuaaaagcucagauuugauccuuucauuucaaaagacccuuccuugucccacaugaguuaagaauaaaaaacuguguaacugccauagaagggaagaaaaugagccaacuuaccaaugaggcuuugcuuaaaauucccaaauaacgcacucacauuuugucugugcuuagcccuuucccguaaaugcaaaaguagcacaacaguguggugcaggccucagagccagauggccuggcugugaccucaguuaccacauuuccugcacaaaguggugcaaacaucuuaauuuuucugccuccauuucuucaucuguaaagugaggauaauaauaauaccugccucgccgagcgugguggcucuguaauccaagcacuuuaggaggccaaggcaggcggaucaccugaggucgggaguucgagaccagccugaccaacauggagaaaccccaucucuauuaaaaauacaaaauuagccaggcgugguggcacaugccuguagucccagcuacuugggaggcugaggaaggagaaucgcuugaguccggaaggcagagguugcggugagccgagaucacgccauugcacuccagccugggcaacaagagcgaaacuccgucucaauaauaauaauaacgauaauaguaauaauaauaccugccucauagaauagugaggauuagaggaguuaauaaagcaccgaaaauaaugccugcaaaugaaacagcauuaucuacaccuauuacuguuaucaucaccaucuaacacccaucauaauuuucugugugcuggugucuuuaauaaaggcaauauaaaacauuuaagaagaggaucagcuacuagacacaaagugaucucauuuauguaaagcagaagaaacaaaacuucuaaaaauuucuuaaaaagcaaaaacacauacauauuaaauacaucguaaagauguggaaaauacacaccaauagguauccccagagaaaagaauacaguuugcuuagagaauuuucauuuuuuuguucugcagacuugacaaagguuuuauuaauaauaugcagaaauauuuguguauugcuaguguaaaauuuuaaagaaauaaccuaaaaauaaggaggaucauacuuacuaauaauucacgcacuugccacuuuuucucagccccacauuaggcuaugguguucuaguguuagcauuaagguacaucuuugcccuuuaaaaaaaaaaaaaaaaaaaaaaaaaaaaaaggccaggcccaguggcucaugccuguaauuccagagcuuagggagauggaggugggaggacugcuugaacccaggagcucaaggccagccugggcaauauauagagacaccaucucaaaaauuuaaaaaacaagccgggcauggugguguucacuuguagucccagcuacucaggagacugaggugggaagagagcuugaacccaguuugacguugugagcuacaauugugccacugcacuccagccugggagacaaagagagacccugucucuaaaacaacaacaacaacaaaaccaaaugcagaaucucaacgagcaacacgccaugccuuccucccuuuuccuuuaacaacacguguuauuaacgugacuuuuuauccucaaaagugucauuauauccacuuugcaguuccagaaaauaggacauuucucaauuuaccucaucuucuagugaucuuacauuugagaccuaucaaaauaauuucuugugugcuacacagaaaaaugcacccccacccaagauguccacaacguaauccccagaaccugugaauacguuaccauaaaagagacuuuggugacuaagaaucuugagaugaggagaucucaagauuuggauucugaauuggaagaauuaauacuguuaaaauguccauacuauccaaagugauccacagauucaaugcaaucccuauaaaaauuccaaugucauuuuucacauaaauagaaaaaauaauucuaaaagucuaauggaaacacacaaaaaaacugaauagccaaggcaaucuugagcgaaacaaacaaaacuagagguaccacacuacuucaaacuauauuacaaugcuacgguaaucaaaacagcaugggacuggcauaaacaaaagcccaguaaugaacccaugcauuuacaauccgcugaucuuugacaaaggugccaagaacacacaaugggaaaaggacagucucuucaauaaagggugucgggaaaacugaauauccacaugcaggagaaugaaaugaggccacugucucacaccauauagaaaaaucaacucaaaauggauugaagacuuaaacauaagaccugaaccugugaaaauacuacaagaaaacacagggaaaacaacacaacacuggucagggcaaucauuuuuuggauuugaccccaaaaguucaggcaacaaaagcaaacauagacaacugggauuacaacaaaccaaaaagcugcagcauggcaaaguaaacagacugaagagacaaccuacaaacugggagaauauauuugcaagcaauacaucuaauauggguuuaauauacaaaauauagggcaggugccacaacucaugccuauaaucccagcacuuugggagggcgaggcaggaagauugcuugagccuaggaguuugagaccagccugggcaauauagugagaccucgucucuacaaaaaauguuuuaagauuagccaaguuuggcaguacauaucugcagucccagcuacuuaggaggcuaagaugacaggaucacuucagccugggagguggaggcugcaguuagcugagaucaugccgcugcauuacaaucugggcaacaaaaugagacgcugccucuaaaaaagaaaaaaaaauuauauauauuuuccauauauauggaacucaaaauaauagcaaaaaaaaaaaaauaaccugauuuaaaaauuggcaaaagaucugaauauugucugaaaauucagaaauccugaaaugucagaaauauucagacauuucucaaaagaagauauacaaaugaggccaggcacaguggcucaugccuauaaucccagcacuuugggaggccaaggcauguggaucaccuaaggucaggaguucgagaccagccuggccaccauggcaaaaccccaucucuacuaaaaauacaaacucagcugggcaugguggcgggcaccuguaauuccagcuacuugggaggcugaggcaggagaauugcuugaacccaagauacggagguugcaaugagccaagaccgcaccacugcacuccagccugggcaacagagcaagacuccgucuuaaaaaaaaaaaaaaaaaaaaaaccacacaaaugaccaacagauauauugcucaucauugcuaaucauuagggaaauacaaaucaaaaccacaaugauuuccaacuggggcagagacuuaaaggaaaaaggagaaagagaaguacaaugagccaucacuucacaccugugagaaugguuauccucaaaaagaggaaagauaacaugcacugaugaggauguagcagagggaacaccuguacacuguugguggaaauguaaauugguguagccauuauggaaaacuguauggaguccccccagaaaacuaauaacuagauuaucauuugauccagcaaucccacuucuggauauuuauucuaaggacuugaacuuaguauguugaggagaugcuugcacucccauguucacugcagcauuacuuacaacagucgagauaaagacucagucuaagugucuaucaacagaugaacggauaacaaaaauauaauauauauacacacaauggaauucuauuagccuuaaaaaagaaaggaauucugucauuugcaacaugaauaaaccuggaggacauuguuaaaugaaauaagccaggcaccgaaugacaaaaaccgcauguuuucaccucuacguggaaucuaaaacaaucagaacucaacagaagcagagaguagaaugauggcuacuagaggcuaggagaaggggaaugaggagguguugguccaaagaaaaaggaaucuugaaaggcagguuauccuggauuauuugagcagaccuaauguaaucacaaggguccuuauaaaggaaagaggcaggcaagagagccugagucaagguggaagcagaggucagagugaugcugggacacaagccaagaaauucggguagccucuggaagcugaaaaggcaagaaaacgaauucuucccaugaguauccagaagugcagcccuuuuuacccauuuaagacuucugaccuccagaacaguaagauaauacguuuguguuguuuuaagccaugaaguuuguaguaacaucuuacagcagcaacaggaaacuaauacacacugcuugaaaauuuucuuuuuaaaaaaguacuggccuggccgggcacaguggcucacgccuguaaucccagcacuuuuggaggcugagggaggcggaucacgaggucaggaguuugagaccagccugaccaacauggugaaaccccaucucuacuaaaaaugcaaaaaaaaaauuauccgggcgugguggcacacgccuguaaucacagcuacucaggaggcugaggcaggagaaucacuugaauccaggaagcagagguugcaguaaccaagaucgcacuacugcacucaagccugcugacaaagcgagacuccaccucaaaaaaaagaaaaaaguauuggcauggugcaaugacucacaccuguaaucccaguacuuugggaggccaaggugggaggaucacuugaagccagaaguucaagaccagucugggcaaaagcgagaccuccaucucuaccaaaauuuuuaaaauaauaaauuggccagacauggaggcauaugccuguagucccagcuaagagacugaggugggaggauggcuugaguccaggggaguucaaggcugcagugaccuaugacugugccauuacauuccagccugagcaacagagcaagacgcugucuuaaaaauaaaaaauaaauuuuaaguauaacuuaagcaggcaggauuauaaagacaagugccacuucauccucaacauuucaacaaguauuucuugagaauucugucacuaccacaguaugaccugcuaucuggacaucuguaaagaacaggcaucgucugcccaaaucugugcagcagaggcuggacagaaugagaagaacuuggcagcacuugcuguucuuggugauccugcugaaaucuacacugagcaauugcacuuuuuacucgggauaaacaccagacaccaaaacaagaaggggagaagccgugggguaacucuuuaccuugaaaacugcuuuacaaugggagaaacaccauauucuuuugaacaacuacuuuaaauuguccuuuuauuuuacuaagguauaauuuaugaaaauuaaaauccugcacauuuuacuguacaauuccugaaguuuugacaagcauauggucaugcuaacaccaccaugauaaugauauagacaguuccacaaccgcaaaucacccuaugcuccucugcagucacucucuccacgggcagccccugaucuguuucuaugguucuguuucccaggaauaucauaaacauauaaauaaaaucacacagcaugucccuuucgaaucuggcuucccucaugaggcacgaugccucugagauucauccauguuguuggaaugucaguccuuuguuccuuuucauugcugaguuguauuccacucuaaguaugugccacaguuaaggggaaguuaagggacaguuaaaggaugugaguuguuuccaauuguuggugguuaugaagaaagccaguauaaauacccauuaauuuaaugugaauuuggguuaacacccaagagugggauggcuggguuauacaguaguauauauuacaauguagagaucuauaccuacuauuuagcuuucuaaaggacacuggacccacgucucacaccauaaacaaaaacucuaacuccuagaggaaaaaccccuaacuccuagaggaaaaaacagagguaaaucuucaugaccuuggauuaggcaaugguuuagacaugacaccaaaagcacaagcagcaaaagaaauaaagauaaaggacuugauugaaaucaaaaacuuuuuuuuuuuuuugagacagaguugcacucugucacccaggcuggagugcaguggcgcaaucucagcucacuacaaccucacccucccagguucaagugauccuccugccucagccucccgaguagcugggauuacagauggggaccaccaugcccagcugauuuuuguauuuuuaguagagacaggguuuugccauguuggccaagcuggucucgaacuccuaaccucggaugauccaccugccucggccucucaaagugcugggauuacaggugugagccacugcgccuggcccaaaauuaaaaacuuuuauaccucauaagacaccaucaagaaagugaaaagacaacccacagaauggaaaaaaauaucuguaaagcauguaucucacaauggccuuguauccagaauaaagaauucuuacagcucuguaauaaaagcacaaaacaauuuuuuaaauggacaaaggauuucaauacacauuuugccaaaugaaauauacagauggaccggauguggugguucacaccuauaauuccagcacuuugaaaggccacggcaggaggauuacuugaggccaggaguucaaggucagccugggcaacagaguaagacccugccucuauaaaaaauuaaaauauuacccagguaccguggcacaccuguugcccuagcuacucaggaggcugagaagggaggauugcaugacccuaagagcuugaggcugcaaugaguuaugauagcaucacugcacucaagcccaggaaacagagugagacccuguuucuacaguaaaaaaauaaaauaaaaauaaaauaaaauauaaaauggccaaucagcacauaaaaagauguucaacaucauuagucauuagggaaaugcaaaucaaaaucacaguaacacuucacauccaccagaauggcuaaaaucaguguuggcaaggguguggggaaagcagaaccuuccuaaguugcuggugagaauguaaauuaauguagcugcuuugcaaaauaguaugacaauuccucaaaaaguuaaccacagaacuaccauaugauguagcaauucuacuccuagguauauaccuaagagaaaugaaaacacauguccacacaaaaacuuguauagguauguuaauagcaguauuauucacaacagccaaaaaguggaaaaacccaaauauccaucaacugauacaugaaaaguguauggccauacaauagaauuuuuuuuuuuacuauaagcacuuaaugcucuuuauuucccuauaagcacugcuauagcugcaucccaugaauuuugauacacugugcuuucacuuucauuuaaugcaacaauguuuuuaccucccugugauuuccuccuugaaccauagguuacuuaaagguauuuaauuucaggcugggugugguggcucacaucuguaauccuagcacucugggaagcugagguaggcagaucacuugagccuagggguucaagaccagacugggcaacacugcaaaaucccaucucuacaaaaaaauacaaacauuagccaggcauggugacacacaccuguaguccuagcuacuggggaggcugagauaggaggaucgccugugcccagggaggucaaggcugcagugagcugugaucaugccacugcacuccagccuauacagugagacucugucucaaaaaauacauaaauaaaauaauuuccaaauggacagucuccaaauauagcuacuagcucuguuauugauuucuagccuaauuccauuacggcucacacacaucguucacguauagucagccuuugguauccaugggggauugguuccaggacucauacagauaccaaaaucuacagaugcucaagucucugauaucaaaugguauaguaucuacauauaaccuaugccuauccucccaugcacuuuaaauaaucucuggauuacuuacaaugccugguacaauuuaaacaccauguaaauaguuauacuguauuguuuagggaauaaugacaaggaaaacgucuguauguguuuaauaaagacaaaauuuuuuuccaaauauuuucagucuauaguugguugaauccacagaugcagaaccaaaagacauggagggccaaugauacuuucaauucuuucaaauacaauuaaagcuuguuuugugggccagaauaccauccaucuuggugaauauuccagaugaacuugaaaacauacacacagggccaggcacaguggcucacgcauguaaucccagcacuuugggaggcugaggcaggcgggucacuugaagccaggaguuugagaccagccugaccugaaaccccgucucuacuaaaaauacaaaaauuagccaggugugguggcacgugccuguagucccagcuacucaggaggcugaggcaggagaaucacuugaacccgggaggagguugcagugagcugagaucacaccauugcacuccaaccagggcaacaagagugaaaccugucucaaaagagaaaaaaaggaaaauacaugcacaguauucugcugcugcaggacagucuguucuauaaaucccaauuaggucaaauuaguugauggugcucuuccggacuucuauaucauaauuuuccaucuaucuguucaaucaacuacugaaagaggaaugcuguagucuaacuguggauguauguauuucuccuuuuaguuucauccauuuuuaauucauguauuuggaaggccuguuguuagauauauagguauuuaggacuauuauguacucuuggagaauugauacuuuuaccauuauguaacguccuuuuucuuuuugagacaggcuguggcuccgucacccaaacuggagugcaguggcacagucauggcuuauugcaaccuccaacuccuggguucaggugauccucccaccucagcuuccugaguagcacuacgagacuacaggugcacaccaccacaccaggcugaguuuuuauuuuuuguagagacgagguuucgccacguugcccaggcuggccucaagcgauccuccugccucagcuucccaaagugcugggaucacagguguuagccaccaugcccggcccauguccuucuuuaauccuugguaauuuuccuggcucugaaaucuacucugucugauauuaauauagccacccuagcuuuccugauaguguuugcacaguauaucauuuuacaugcuuuuacuuuuaaccugucuauauuuauuuuuuauuuuuuuaucuuucuuucgagauggagucuugcucugucacccaggcuggagugcaguggagcaaucuuggcucacugcagccuccgccucuugggaucaagacauucuccugccucagccccccaaguagcugggauuacaggcgcaugccaccacacucagcuaacuuuuguauuuuuaguagagaugaggguuucaccauguuggcuaggcuggucuugaauuccugaccucaggugaucugcccaccucggccucccaaaaugcugggauuacagcuaugagccaccacaccuggccuaacccaucuauauuuaaagugaguuucuuuuuuuuucuuuuuuuagacagagucucccucugucacccaggcuggaaugcaauggcgcgaucucagcucacugcaaccuccaccuccccagcugaagcaauucuacugccucagccuccugaguagcugggcuuacuggcacgcaccaccacgccuggcuaauuuugguauuuuuaguagagauaggguuucaccauguuggucaggcuggucuugaacuucugaccuaaaguggccuacaguggguuucuuauagacaguauauacuagacagcugcaggaauggaucuuuaaaaaaaaaaaaaaaaaaaguggccaggcacgguggcucaugccuauaaucccagcacuuugggaggccgaggugggaagaucgccugaggucagaaguucgagaccagcccaaccaacaugaagaaauccugucucuacuaaaaaauacuaaauuagacgggcguggugguguaugccuguaaucccagcuacuggggaggugaggcaggagaaucacuugaacccaguagguggagguugcggugagccgagaucacaccacugcacuccagccugggcaacaagagcaaaacuucaucucaaaaaaaaaaaaaaaaguauauacuagagucuugcuuuugcacccaagcugaaaaauaguguguuuagaccauuuacauuuaacacaaugauuaauguaguuggaauaaaggcuauaaucuucaccacuguuucuaucuguuccaucugcuccuuguguuuuccuucugucuccguguucauuuagauuagcuggauacauuuguaugauuccauuuuaucuccacuauuggcuuauuacauuuuuuucaaaaaauguuuuuagugguugaccuagguuuacaacauacauauuuaauuaaucagagccuagcuuagaguaagucauagcauuucauaugucauguaaagacauuagaacaguauacuagaccaauuauugaucccuucugaccuuuaagcuaauuugucauaaauuuuauuucccauaacacgcccuaaacacaaaauauauuguuaauauuuuugauuuauggucaucuuucagagaaauuagaaaaauauuuuuaaauaauaaaaacucuaucuccuagaaacguauuuguauagauccaaaugucuaaugucauaccucuucuuccugaacaacuuccuuuaauauuuccaguagugcaggucugauggcaaugaauucucuccauuucuguuucucugagagagcauuuguccuucauuucugaaagauuauuuuugccggaugcaguugcucacacccguaauccuaacacuuugggaggcugagaagggcagacugcuugagcccaagaguucaaaaccagccuuggcaacauggugaaaccccaucucuacuagaaauacaaaaaaauuagcuagauguaguggcauguaccugcaguccuagcuacucaggaggcugagaugggaggaugaauugagcccuggaggcagagguuguagugagccaagauugcaccacugcacucucgccugggccacagagucagacaagaaaaaagaaaagaaaggaaaggaaaaggggaaggggaaggaaaagaaaaaagaaaagaagagaaaagaaaagaaaagauuauuuuugcuguguacggaauucuggguugaaaggauuuucucccuuuuggccauuuaaagaugugcugcauuaucuuucggucugcauggguucuaauaagaacucugcauucuuuuuuuccucuggaauuagucucuuuccucugacugccuucaauauuuuccaucuuucauauucugcaauuugaauaugauaugccucgguguuuuucugucauuugccugguuugggggaugaucuauugguguucucugagcuucacagaucuuugguguccaucauuaauuuuagaaaauucuuggucauuacaucuucaaguauuucuucugccccguuuucuuucuuuuccuucucagacuuuacaaauucagaccacuugauauugucucacagcuuauggguucucugcccuauuuuuuucacacuucagcuguauucaaguucacagacuccuucuuuggcuacaccaaguuuaauaaugagcuuguugaagacauuuuucaccuauguuacugucauuuucauuuuuagcauuuauuuuauuuucuuacagugucuaucucucugcugaaauauccuaccugaccauacaaguugccugccuuuucuacuagagauuuuaacauacugaacaguuauuuuagauuccaugucugguaguuccaaagaauuuggucuuaaaaauguccugucucaauuccaugucucguaguuccaaagaauuuggucuuaaaaguguccugucucaauaguguguuguucuuccuuccuucuuuuuaugccucaaaaacuuuuuugaaagcaggauauccuuuguaagacagcuaagacugagguaaauaguuuuuaugccugggaaaugggcccgccuuuccuucugccagaucuuuaguguguggagguugagucaaucuauugucagaacagaagcgugguuuggaauuuguugcugccaugguuacccacaauguaccaccagcuucgaacuguguuaggguaguggcugguuugccagaggauguuuuccucagugucuguucgaccuucagcuuuuuuggucuuccuuuuacgcugcaucugagcuggucugccuccacguucuugcgccuuacaccgaucuccagugucaccugucaguccacagcuguuagccucguaugggugggaagauucucugacauuaggauuaagccuuggucuugggcaaacacugucuuccuuggugacugggguguggccuucucagugcuccugcccuuucuccuccacuaaaguucugggccuagcacauauuccugucccucgccaaggacgaaagacuuuuuuucuguucucuuuccacagugguuuaaggcucuuaucucauaggagcaaagaagggaagaaggacucagacagggcuucgugucuuuccaaaaggaucuacugucccucuccuccagggggaacaguaagggacacuuucucaguacccacacccuugccucaaucuuuuuuguaagcauccaaugaaaucuguggagaagagccugugaguggauacaaacucccccugugucugcagccccccaggcgaucucuguuuucuugcugguccacacuaaguucauuaaauuuuaacugaauucuccugcgggauguucacuuugucugucucagguaaacaagugcucaggucuuaccuuuccaagggggugccugucucuccuuacaguuuggguugggagguuguccugcaaccucagcucacugaugaauucaagaagauaucagcaugcagacuucugggguuuguuguugcugucaagguaggaacgaugcucucucuagcuuucuccauucuaaguagaagcuaaaaguccccaacuaucugcuuuucagccaaacuuuaaaggcuguuuaaugaauguggcuagcuuugcucacuauaggcauauaugaaagaaaauaauuucaggucaaacuuccaacucagcaacaaaaauaucucuguaaucccaauaaagcaugcaaaauuacuguuuuaaaauguaggcaauagccagaauuuuacaugucaaacuuauuauuauagcuguuaaagaaacuauauccuaccaaagaauaguucugguauuuugaucaucaauuuguuaaguucuaauuuaucaacaugugaaaacuguauccauuucuuuagaauauguauuacauaucuguccaacaagucaacuguguacuucucuuuguauaacaauaaaggcaaaaugggaaagaaguacauaggaaaaacauaccuuuuacucacugguuaauuucauucaauacacuuucuaccacugcaaaauuucaguuccuugaaaacagaaauuucuuugccuuucuaccugauaugcaaagaagcuuacauacugcggaccucuuaugacacaaucgcagagguaauauuaccuacuuaaauaguggcagcaauggucuggaaagcugaucuguauauuacuguauagaaagaacacacaacacuauaaauuuucauggcacaauagaacugaaaguacacuuuaaaauuuuuaauuuaacuaguuccuuuuguuuaaagucacuugagcuauuuucagagaaaaacccugaauaaaaacucuucaauuuuuuucaauaaaacauuuauacuuaaucccugccuuuccuuagcucaaugcuguugcaauauuuaaacaugacaucuacuauguaaauguaaauauaugacaucuacuauguaaaucauuuaaauaugacaucuacguaaauguauuacagcugcauaaauacuuaagaugaauacuggaacacggguauuuuagagguacaaucucacagaaucucaaauuuaauuacuuuuuaaaacauguggggacaaaauguucaguugacaaagagaaauaaccugguuuucuuuaauuuuauaaaaugcgugaaagaaaaugaauuuuuaaaacaagacaaucuuuggcugggcaugguggcucacaccaguaaucccugcacuuugggaagccaaggcaggaggaucguuuggcccaggaguucaagaccagucugggcaacaaagcgagacccugucucuauuuauaaaaauuaauaaaauaaaaaacaagauacucuuuauguucuaugagguuggcaaagucaacuaaaaacacccaaucaguauuuaugaggacaugaagaaauaagauuccuucucauuuauuacuguggagguauaaauuggcccaauuuuacaacagacauuugguaaggcauuaguauuuucaaaaauaugucuaucuuuugauccagcaauucaaccucaagaaaauguacacacagcacuaucuguaacagcauagagcaaaaaaauaaaaccaaaaaaauaaauaaauaacuggcugggcacaguggcucacgccuguuaucccagcacuuugggcggcugaggcaggcaaaucacuugaggucaggaguucaagaacuagccuggccaacauggugaaacccugucucuacuaaaaacacaaaaaauuagccaggcauggugguacguacuucuaaucccagcuacucgggagucugagacaggagaaucgcuucaaccugggaggcagagguugcaguaagccgagacugugccauugcacuccagccugggcaacagagcgagaguuugucucacaaaaaaaaaaaaaaaacuucccaucuguggaguuuguauaccuggaaaugggccagaaaaaauuguuuuagaguauaucaacaaaauagaauaccauguagccauuuaaaaaauaacgaucaggcagggcacgguggcucacaccuguaaucccaguacuuugggaggccaaggugggcagaucacuaggucaagagaucgagaccauccuggccaacacugugaaaccccaucucuacuaaaaauacaaaaauuagcugggcgugguggcacccaccugcagucccagcuacuagggaggcugaggcagaagaaucgcuugaacccagggggcagagguugcagugagcggagaucacgccacugcaccccagccuggugacaaagcgagacucugucucaaaaaauaaauaaauaaauaaugaucuaaaacaguaugagagccccagagcacagacucaaaagugguagcuacuauaagaauccugaauucuuaagauaaaggugaaacuguuuaagcuuccaguaaguaaaaaaguugccagcaaugaggaaaaagauuguccauuagaauucucaucagaaacaccaaaaaccauaacguaacugcaaaaaaucagcacaaauguggccugagacugcuaaauuggcuuucuuugcuaucuguuuaaccaaacacaaaacuauaaaaccagugagucagugacagauggauaaauaaauaaccagguuaaguaggauuaaaaugacuagcaccauggguacuauuuuauuuuuccgauacuaauaauaguuaacauuaccauguucuuacuuuccaccagauucuguuccaaguuccaagcacuuuuauuuauauucacucauuuaauccucaaagacaaugagguaacaauacuauuauuucuauuuuacagaugaggaaucucagagagagguuaagugucuugccuaggcuaguaagggacugagcuaagauaaaaccuacauggaaugaauaaaucuuuuuuuagaguaaaaaauaauaauaaaaaauaaauuaaaaaaagauaaaaccuacaaucuaacuccucagcaccagccucuuccccaucacauuuauacuaccuuuaaaugaauaagcuucugacuuaaggaaagaaaugccuuugaaaaauaaguugccugccuagguccaacuacucuguguucacuucuacacuggauuaaaaaauuacuacaccaucaacucucuccuugagcuaauucucauuuuaggacaagugcuucuauuacagacagaacccucugugugccugaagugugcgcacucagaguuccucucuauggcuaagguugccaccuaguggaacgaaacgaaaaucuucacacaaagcauaaagcauucugaggcuagagaugaauguuaaaacguguccguuuucaaugggucuucccuggaaacacacauuccuuauaucauuaacaaaaacuuguuuuguuuuguuuuuguuacugauuuacguaauacuggcacuuucaacuaaaagacuggugguaccuuacccaagguuccuguaaauggcuguucccucuggugucucuacagcaccgugugaacaccaaaaugacaaaaugcaaacagcugaacuaugcuuccuaugccauucuacccgcucagccuggaaggucaaggacagcaaccucauucacugugaucuucuuccaccaccaagugugcggaaugacaggagccaggaaaaggaaucugaaaacagugggucucaaucuuccucuauucuaucaacauaaacuggaccuuuaaccaaguucccaacaaggggaauuuguucuccaggugacauuugauaaugucuaaagaaaguuuugguugucacacugcagggaagcuaagcuacugguaucuaaacaagccaaggaugcugaucaaugcccuacaaggcucaggacacuccccacaccaaaaaaaaacuacucaaccaaccccaaauguuaacacugccaaggucgaaagcccugcuuaacccccaccauccuucuuaagagggacacagaucagugaaaaauaccaguuuauaacaauaagcugagccuacaaacccaauucuauuuaacauauauaaacaaaguauuuuuggcacuuuuaauaaacuuuucuaggaauauacaauguauacuguacacagaauauagcauuauuaaccuugauaaaucacagaagaaauguacuuuguauuuucagaacuuuaccaagaauccuuuaccacuuaaggaagagaccaguuaugacaucuaaguugccaauacaucguaacuauauuggcccauugguggcuaucaucuucauggugacucuacaauagaaagauauacaacuguuucaauuccauuccauuuacauucuaggguaacugccugagcacuuauacauuuuuuaaucuuuuuuuuuuuuuuugagacagagccuugcucuguuguccagguuggagugcaguggcacaaucuaggcucacuacaaccuccaccucccagguucaugcgauucuuguguuucagccucccagguagcugggauuacagacacgcaccagcauguccggcuaauuuuuguacuuuuaggagaaaugggauuucaccauguugaccaggcuggucuugaaauccugaccucaagugaucgccuaaggcaggccucccaaagugcugggauuacagucaugggucacagcaccuggcugaaguaaauuuuuaaaccauaaaaaauauauuuuaaagaauaaaaauauauuuucauucuuuacauuacacuuaggguauuacacugacuuuuuaagaaaguauguguaucaguagguuauauuaucuaugaacuuaauuucacaaaagcaaagaugacguuacaaaucauuuguuauaagaguguucacugacuuugggaggccaaggcaaacagaucaccugaggucgggagucugagaccagacugaccaacauggagaaaccuggucucuacuaaaaauacaaaauuagccaggcgugguggcaugccuauaaucccagcuacucgggaggcugaggcaggagaauugcuugaacccgggaggcagagguuguugugagccaagacugcaccauugcacuccagccugggcaacaagagcgaaacuccgucucaaaaaaaaaaaaaaaaagguguucacugaaucuggugaaacaaaagccacucuaggaaaaaaacuaaaguccuucccacaaucuuugucuuugcuauucccucugccuggauacucgccuuacagucccacacguggacacuauucugacccuuggcaaggcuagcuccaccccauuuuuccuguuuuggcuuauuucaccuuuuuucaaagguuguaucugaacuucaccacccacaccuuaccauagagcucauuuauuuucuuccuagcauuucauacaauccgcaguauuuucaaauuuuguauauuguccuccacuucagaauggaagcuccauaaagacagggacuggucuaucuuaccucuauauuuagcaaaaugacuagggcacuuaggaggagaccauuaaauauuucuugaauaaacaggcuuacgaauaaacauuaauaaacuguaacaaaaaucccagaaauugucaacaagggaauaaaaagacaacagaggauaagagaaugaaaauaaauuauaccauuuccaaguaaaugauggggagauuacaacauauaauaaagacgguaaauguaaaaugacagucagaacugauucaaaaguuaaagccagccauaugccaucuagaaaggaaauacuuaaaacaacaacaaaaaaauacagacagaaaguaaaagaugggaaaaaauauauaaaauuuuuaaaaagccagagguuaugacagucagaugggaauaaagccagacaucaaggaaaagaacauuaaauacaacaaagggggacacauuauaaugauuuugaacacaauucuuaaaauaaacuacgacugccaagaacguuuauaaacuaaaaacucugcaugaaaauauaaaaagcaguaacuacaggaaaaauaaacaaaaacauaaaaguugugagagauucugauguuugcucagucacugcuuagaucaaguagucaaaaaauaaauauguauguagaugaugaucugauaagaauauuuucuguuaaaaugaaaacacaacaaacaacagagauaaaauaaguaguucacaaagaaauaaggaaagaacaaauacaaaagugcaccauagagaaaauaacagugagaaaauuaaguccgagggccacgcucugaaaaaccgcacacuauuaaauuugaaauuuuaaaaagaaugguuuuguagaaaaacacagaauuaucaaaauugacuugcaagauagaaaacuuaaggacauaagcaaauaaaacauuaagaauguugccaagaaagcaauuagccagauacauucauggguauaugccuucacauuuuuaaagaaucuacuauucucauaaggaaugagggggggagaggaagaaaaacuacuuuucuuuuuaugaacccagcauaauaaccauaaccaaaaucugacaaagcacacaaaaaagaaaagugaccauacugaaacaauuguccuaaauacauuaauauuaaaaauuuagaaauacaugaagccaaagaaagguuaucuaggaguguaagggugguuaaauauuaagaaaccuagcaguacauuucaccauauauuaaauaaguuagcaacaacaaagaucugaaaagaugcaaaaauauuuucucaauuuacuucugcauuaucuuccugauuucuaugacuacuucauuaaaauaaaaaauacauagccaauguguaagauauguaaagacauuugcuucagcauuguuaacuauuuuaaaacucauuaaucagguacacacaguggaauacuaaccagccauacaucguuauggaauauuuguaaugcugagaaagcaaacuaaaagaauaaacaucaaauuauuuacagaacuuguuccugauuauguaagauuuaacuaccaagcauauguuaucacaagacacggaacacauauccaugaugcauguuuaauuucugcaucacauaugcuagaguuuaauauuacuauuuuacucuauguauuucuagauuguuaauguuuucuaggggggaaagugaaaauucucauuuuaccccuauaagcuaugcaauaaggaaauagaaaagaguuuaggccaacaaaggccauauaaaaugacaaaugaaaacggguaauauuaaggaaguauagauaaaagauacacaaacaggaaaaagcaaaguuaaaacaauaguauccacagaaagagcacacaagggccagaaagugacagcuuagcgugcagauuacaagaacaucugggcuucccacugcuaaacacacaguguacuccuaaaauaaccccaaagaaaugcuauuaagaaauucuagagcuucauguacacucuuacagagcuacugcaaucucuuuccuaucaaccacccgccucaaguuaaacaucugcuuacacaacagacaugcuacacuaugcugccaucugcagagcagacuuaacacuaaaauucccacugagaacauuuaaauauguuuguugaaggcaucaaaguaaaugacggagaaacuaaaacuuaacuagagauacaacuauauugggaggagagagauagguauaggaaagagaaaugacaguaagucacacaauguuuaaaguugaaaaaaaaucaagaaacaauagcauaagcauauuauuagcaauugggaaaaaacugaagaauccaaaauaaaacuaguuaagcagcugccacaaaagaaagggacugcagcuagagaagggaaaggcacaucugccuuuuaguauaggcucuuacucucuaucugaacuuguaauacuugugauagguuuuuuuaaguacugcaaauauuuuucaaaaugauuguuauuauaccuaagaauaaaggaaucgguuauuucuuagauuuuuuuuuuuuugagcucagaaauaucuuaaaugguuuuuaacuuucuuuuuuaaaggcagagucucacucugucacccaggcuggagugcgguggcacaaucagcucaccguaaccucuaacuccugaguucaagcuauacucuugucucagccuugugaguagcugagaccacaggcaugcgccaccaagccuggcuaauuuuucaguuuuuaauagagauagggucucacuuuuuugcccaggcuggucuugaacuccuagccugaagcgauccucccaccuuggccucugaaagugcuaggauuagaggcaugagccaccaugcccagccuuaaauguuuucaaaagcaagaaauauaaaaauuagcauaaaggcaacauugcaaguaacgaagacugaaagcaauauaaaaaucgccaggcaguacugaagucuuuguucaacaggcaccuaucacuacaauggauagcauaaguucacuacauacuugcuuuguuauauaaaagcuuauuagaaacaacaacaucaaagaacuggaauauucugcacauuuuuauuuaauuaacauuuauugugaaccaauuacauguaagauacucaauugggauuuucacaaaaauacaauuuccuaaaacaaguucagggaaacuaaagcccuaucuaccagaaccacaagccuggauaucuauagacagauaacaaaaggaaaacuuaagguuacugcacaaaucacaaaaucaauuaaauugauguccaauuauuuuccugccauuuuauaaaacuucaaaaguaauacaaauuuacaguaaaauaccaccaacacuugcuaaaauggcaauugguaaacuugaauaauacauuuuucaucacuaaacccuuguuuaaugacaaauuauugacaaaaauuuaaaacuaaaguccaaacauacguaucauauacuuaguaagagauucaauauacagcuuagcauccaacuccacaauuuccagaaagaaaaacaucaucuccuuccuuauucaauuugauaacugaaagauucauaagauaagagaacacuauucaccaauaaaaguuuauucuuuuucccauccuguaucaagcuuuuguaucaggauaugaacuuacauuuguaaaagucuaaagauaaagaaauaaacccguuugguucaguugagcuauaaacauuaagaaauccugaacugcgauuguaaguauaauuaaccuaaaaucuuucaaaucacauauuucaaauugcauucuaagcaacaauauguuagacacaggggccacuggcuguguucuaagaaaugauaaugcuaaaaaagcaauauaagauuuaaauuauaauuguauuauaaauauuaauuuuaccacccuaaaauuguaauauacuugcaaacuaaaguauaauacagaaaagcucaccuucauccacagaaaacugacagcucuuaucauugaagaaaaguauuuucuucuuaucgggacgauuuacaaauaguaucuggucccccaaagccuuaaagauagauaaaauaaagauuuuucaguuaacuccaaauuaccucaccaaaaaaaaaaaaaauuuaaacaauaaaggaguuucauuuccuuaacacacucaguauaccaccauaggguccuccaccauagguccacuggacccaauuuuaguuuuaguuuuguuuuuaagagacuccacccagacuggagugcagcucacugcagccucaaccucccaggcucaagcaauccucccaccucagccucuggaguaacugggaccacuggugcauugccaccacgucuagcuaauguuuucaauuuuuuguagacaaagggucucacuauguugccagggcuggucuugaacuccugggcucaagcgaucuucccaccucagcaucagaaaguacagggacuauaggugugagccacugcacucagccccaauuuuaguuuuugaguuucuuucuugaguaguucaauuuuuuaaaaauugauauuuccagacuuguauucuuagaggucuuccaaagaacaaaaauaaaacguguuucacuuaaaacggaaaauucaaucuuugcugcaauuacuauuuggguccauggggcucuuucacuaaucuaagacacauaauagaaucuugguguucuuacuuuuccucuaccuugagauauuucgcuccuuacucaucauuacccaucaauuauuuccaauugugcuuuuaaaacgcuaaaauaauaagaaaauagaagaaugauuaaaucaccuagaaaugugaugcaauagugaaauacaugggcauccuucaguuuucuuacugcauugcccaaaggauuacauuacuccuuuucaagagauauaaaagauuggaagagucuucuuguugucuuuuaacuuucauugaguacaccugacaaaaaaaauuuuguauuuucuacccuugagagcaaagacaagaaaacugaccaaagacauuucacaauuauuagaugaaucaaaauaugaaugcaaaaagccaaauagcagcacucuagacuaucuggcaaaaauucaucauaggaauaaagucucaagcuauggagucuuuagaugacaauaacucaagugaagauucucaagcuuaagaaucaacaagcgaacaaaaugcuucucaauacaaaauggaaacaauauucucaucccguuauucaccagaagauuaucacacaguauuuugugaaaagaaucuuuaucaucucacuuugcuaaaaggauauaugacaguauucuucuuuuugauguguuuuccaaaaauuacuugauacagaaguuugcuguguuaaauucuuacuaaaaucucuaauaaagcuguuuucaucaucccauuauucuuacuuauguaaauuauucauaaaaugacuuaaaguagcuuaaaaauaauaguccacuagaucaaggugguaaaaggugauaacuacaggaugagcaacccaaaucccaaaaucucgaauccaaaauccaaaacuuuuuaagugcugacaugacaugccaaagaaauacuuacugggggccaggugugauggcucacaccuauaaucccagcacuuugggaggcaggaggaucauuuggggucaggaguuuguuuguuuugagacggagucucacucugucaaccaggcuggagugcagugacgcgaucuuggcucacugcaagcuccgcacgguggcucacgccauucuccugccucagccucccgaguagcugggacuacaggugcccgccaccacgcccggcuaauuuuuuguacuuuuuaguagagacagcguuucaccauguuagccaggacggucucaaucuccugaccucgugauccacccgccucggccucccaaagugcugggauuacaggcgugagccacugcacucggccgaggucaggaguuuugagaccagccuggucaacauggugaaaccccaucucuacuaaaaauagaaaaauuagcugaacacgguggcaggugucuguaaucccagcuacuugggaggcugagacaggagaaucucuuaaaccaaggagacagagguugcagugagcugagaucaccccacugcacaccagccagggcaacagaaagagacuccgccucaaaaaaaaaaaaaaagagaaagaaagaaagaaagaaauacucacuggagcauuuuggauuucagauuuucaacucuggaauguuuaaacugguauaaugaaaauaucccaaaauuugaaaaaaaucccaaaaucugaaacaguucuggucccaagcauuacagauaagggacagucaaauuguacauacauaaaauaaaugaaagaaccugaaggcauugcuaaaaaaaauuaaagacaugaauaaaugaauucugugcucauguauuaaaaaacuuaauacaguuacgauggcaauacuacccaaaguuaccuauucaagguaaucccuaucaaaaucccaauggcauuuuuugcagaaauggaaaaauccauccaaaaauuuauaucaaaucucaagggaccucaaaaagccugaaaugguuuagaucuguguccccaucaaaucucaugucaaacuguaauccccaauguuggagguggggccuggugggcggugacugguaugaagguggauuucccucuuggugcuguucuccugauaaugaguucucaugagaucuggucauuuaaaaguguguggcaccuuccccacucucucuugcuccugcuccggccauguaagaugagccuguuuccccuucaccuucugccaugauuauaaguuuccugagaccuccccauaagcugaguagacaccagcaucaugcuuccuggagagccugcagaacugugagccaaaucaaucucuuuucuuuauaaauuauccagucucaagcauuccuuuauagcauugcaagaauagacuaauacauagccaaaacaaucuugaaaaagaacaaaauuggugaucucacucuuacugauuucaaaauauauuacagagcuacauuaaucaggccaggugcaguggcucacaccuggaaugccaccacuuugggaagccgagggugggcagaucacuugaggucaggaguucgagaccagacuggccaacaugguaaaaccacaucucuaccaaaaauaaaaaaauuaguugggugugguggugugugccuauaaucccagcuaaucaggaggcugaggcaggacuacugcuugaaccugggaggcagagguugcagugacccaagauugcaucacugcacuccagcaugggugacagugugacucugucucaaaaaaaaaaaaaaaaaaaggcuacauuaaucaaaacauuguagugcuggcaugaagaaagacauacaggcagaauagagggcccagaaauaaaccuucacauauauggucaaaugaucuuccacaugaguaccaagacuaagacuauucaaugggcaaaggacggucucuucaucaagacacugagaaaacuggauauccacaugaaaaggaauaaaguuggacucuuacaccauauacaaaaauuaacucuaaauaccuaagacccaaaacuauaaaacuccuagaagaaaacauaggacaaaagcuucaugacauuagauuuggcagugauuuaaacaugauacuaaaggcacaggcaacaaaaucaaaaauagacaagagugcagcaaacucagaaacuggcaaauuaaagagcacaaucaacagaguaaaauggcaaccuacagaaugggagaaaauauuugcaaaucauguaucuguuaaggaauuaauauccagaauauauuuuuuaaaacucccacaauucaacaacaaaaacacaauggaauauuauucagcuuuaaaaaggaagaaaauccuguugcaaguacaacauggaugaaccuugagaauauuaugcuaagugaaauaagccagucuuggaaaaagauuccaagauuccaagcaaacgggcuaaggcuagaagaacagaagagacauaucauaugcuaccugcuguagggcagacaagguuuggaguaacugcccacuuaaccacaaaacaaaacaaauagaaacacucuugggaggaauguaacagaauccugagucuuuacacauauuaauauaauccacaaggucuaagacccaacagaaauguauuagauauaugaagaaacaggaaaauaugacccauaaaagagacagucaaugcagaccagcucugagaugacucggcuguuagaauaagaagaauuuuaaagcagcuauaagaaaucauacuuaaggguguaacaaaagauacuugucacgaauggaaaaaaaagaaaacaaaauucagcaaagaaacagaaaccagaagaaaaauuuacaaagaaagacuagaacugaaaaauacaauuaaaaaauucaccaacugggcuuaacaaguuggaagugaagaagaaaagugagugaacuugacaauggauuaauagaacagaaaaaaaauugaaauaaauaaacagagccucagggacuuguaguacaauaccagaagaucugacauguauaauuccauuaccaagaagaagagacaaaggggcaaguuuucuucuacaggcagcaaaaugaaugaaccugcuuaacaaguuaacauuaauaaugagcaacugugacaaauggaaacaagcagcuuuccccagugaguuucaaauuuaaacuggaaaugucaucuguaucaguaggacuuucauagauagccccuuuaggacuucaaaacagccagguuauuaaccaaugcuuucauguuuuaaugccucuaguuccucagguaaggaacaucuacuaguauuauagaagacacucuuauuuacaaacagagcuuacaagagaaacucuauugccuuugaggaaaauuuuccagaaauagccugaacaaucaaacaaucauauaguaacagcaacaagaacccgucaaaguuacacagagauggcugcucccuuuccugcuagguggcacaagacaaauuucaaaccuucaaguggcucacuguaacccauguguauauaauagaagcuuuaaaaacaauuguaaaauguuugauauuuuuaaaaccaagaagucauuauucauucaaauuauauuaagacauagaaagaaaagagagauuaccuugacagcuuucugggaauugggcagugcuucuucuaugucuucuaaaagaauuccuccuaauccucgcuggucaugcugaucuaagagccuaaguagggccuucuuaucucucacguuguacuugggcuugaaagcauacuucccaucuauuacuucaauuuugggauuguugacuaaagccuguaacagugauacaauuggaauauauuaacaaauggaacauaaauauauauauauauuuuugaaacguaaucuugcucugucgcccaggcuggagugcaguggcgugaucucagcucacugcaaccuccgccuccuggguucaagcgauucuccugccucagccucccucuccugccucccucccucucagcaccugggacugcaggugcgcaccaccacacccagcgaauuuuuguauuuuuaguagagacgggguuucaccacauuggccaggcuggucuugaacuucugaccucaggugauccacccaccucagccucccaaaguacugggauuauaggcgugagccacugugcccagcccauauacacauucuuaauucuacuaauuauuuuaaaauacaacacuagccaauacaguggcaaauuaaaaguaccuuaugaauacaaacuggcaggccuaaaauccuggacauccagaauuccagaacaguagaucagcacggugcucacuuuuuauaaaagaaacuguguuuuauuuacauaaauucuuugaagagaaauaaaccauuuuaucacaacuacuuugaaaaaagcugaacccauauucuucuaguagucaaaauguguaggaaucaauaaaacaccuacaaauauuaauagacaaagugaacugaguagugcccacuccaucugcaaaguacagcuuaucacauacuggcauuauaaaguaaggaacauaacccuuacuagucaauggucuuccccaucugcuaucaacuggcaauggcagcuguggaaggaacugaaaaggaccagacuagugcauacaagaacuuuaccuauaaugucagcuugagaaugaaacugaguaggaaugcaggaauuacugaauauaauuauguuucuagucaguucuguuguacaguuaguaucagaaggaaagcucuucaaaaagagcaacccuauauauuuucuucugcagcugccagccugacccugaaaggagaaagagaagaaacacagaaagaagaaaaaagggagaauagaauaguaaaaugaucaaagucauuguuaacuaaauguugguagucuaugaauucucaagguuagcuaaaccagcaaauuuaaauguggauuaccauuguuuguguaucacuaauacaaugaacuacaauuauacugauuaauggucauguuacauuauaaaagucaagaccuguauuuugcuugguaaaaaaauaaaugaauuguauguuaggaauuuuacauuugguuucuagaaucuaucucugguccuagaaaguagucuucuuaguuuucacuucauauuuuaaagcgguaaacauuugaauuuuuaaaugcuauucauuuccaaauuagcauggucacugacugcguugggguuucuucaaaugauguguguucauacacagcauucgcgacuuuuuuuccacaucaagccauaauagcaguaauugugcaacaaaauaucuuccuaucccugcaguaccuuaugcuuuaaauuuccuaaaacaaaaacaauucaauuuacaagcacacaaacuauaaaucuggcaauacaaaauaagcauuaaucuguaaaaacauuaagucgaauugguacaaugacuucuuuacaacuauuacacaaagucuuaccuuuaacauuuugaaacagauaacauaaaauuauaugaaaaccaacaaaucaaucuuauaaauguguacauucaaaaaacaaagacccuacaccauuucuuuuaagaaaaaguaaaaagcauuaucagauuucaccauauuaaaacauucuaggcaaggcgcaguggcucaugccuauaaccccagcacucugggaggccgaggugggcggaucacuugaggucaggaguucaacaccagccuggccaacauggugaaaccccgucucuacuaaaaacacaaaaauuagccugguaucguggcacaugccuguagucccaacuacucgggaggcugagucagcagugggcugagaucaugccacugcacucuagccugugcaacagagcaagacucugucuuaaaaaaaaaagaaaauucuaguuacaggaaaucucucuugauaaucaacuaaauucuuaccucagucauuagccauuguuucugcuugaguccaauaucuaaauguuguguuucauccaaaauuucaucuaagguuagaggaugcguaucuccucgcugaugccgugucuaucaagugaagaaauuguuauuagaagacaguuucaaaaugcuagaugcauuaaaucauaguuacauguaaacaaaccuucaggaaugaaaaacauguauuauuccagguagcauaauuauagugacgaagagccauagaccaugaaaucagaaugggguugaaacucauugcucuauaaaaucaaaagacaaacugacaaaaaaauauaugcaacucguaucaccaagagcuauauucuuccuaacauuucaagagcuucaaaaaacuaacaaaauagaccaggcacaguggcucauggcuguaaucccagcacucugggggacuaaggcaggugggaucacuucaggucagguguucgagaccagccuggccaacauggugaaaccccaugucuacuaaaaauauaaaaaucagccgugcaugguggugcaugcuuguaaucccagcuacuugggaggcugaggcaggagaaucgcuugaaccugggaagaggaggcugcagugagcugagaucaugccacugcacuccagccugggaggcaagagcaagacucugucuugaaaaaacacaaaacuaacagaaaaugacccaaagacagaaacgcgcagauugcaaaaaaugaccuuaaacauaggaaaagacacucaacuuucaccaaacaauccuauuucuagaaacuuauccuacagaaauaccaguaccacacagaaaagugacuuauggucacuguagcauuguucauaaaaggaaaauauuagaaauaacccaagcguccauauuagaagacagauuaacuacagcacauccauuccacuacacagauguucacaaaguaaauguaaaaguucucuaugugcuaauuugaaaagauguccaagacaaauuaauaaguuaaaaaacauauguaucaugccuauccaaagaaaacacacacacacacguagauaccaaaagcuagagaggaugcaaaggaacaggagcugucauucauuacuggugaguaugcuaaaugguacagcuacuguggaagacaguucagcaguuucuuacaacacuaaacacacucuuaccauuugaucaaucuagcaaucacgauccuugguauuuacccaaaugagccaaaaaauuauguacauacaaaaauccacuaaggaugcuuauuacagcuuuauccauaauugccaaaagcuggaagcaaccaagauguccuucaguaggugaguggguaaauaaaccgugguauauccagacgauggaauacuauccagugcuaaaacgaaaugagcuaucaagcuaugaaaaaaacauggagaaaccuuaaauacauauuacuaagggaaagaagccaaucugaaaaggauacauacuguauggcuccaacuguugacauuccggaaaaggcaaaaaccauggagacaauaaaaaguuuaguggcugcaggccagaugcagugguucacaccuguaaucccagcacuuugggaaaacgaagcaggccacaagguaaggagaucgagaccauccuggccaacauggugaaaucccaucucuacuaaaauacaaaaaauuagccaggcgugguagcgggugccuguagucucagcuacucgggaggcugaggcaggggaaucacuugaaccugggaggcggagguugcagugagccaagaucaagccauugcauuccagccuggcaacagagcaagacucuguuuuaaaaauaaauaaauaauuuuaaaaauuaaaaauuaaaaaaaguuuaguggcugccaaggguugaggggagaggaugaacaagcagagcccugagaauuuuuagggcagugaaaauacucaggaggauacuagagugguggacauaggucauuauacacuuguccaaacccacagaaagaacaccacuaagggugaacucauguaaacuauggacuuugagugguaauuugucaacguagguucauugacugucacaaauguacucuucuggugcaggauguugauaguggaggaagcuguggggggaugggcagggaauggaugagaauucuguauuuuccaaucaauuuugcugugaaccuaaaacugcucuaaaaaaaaaaguguuuuuuaaaguaaauaagaaaaaaguauguauguuaaaaaacauaugcacuaugaacccuuguauauagggaaggguagaaauaaguauacauuugaacuuuguuucugcauaaagaaccacuggaaaaaaaaucacaagaaacuaauaaaagagguuaccuguagaaagcacaagaggggagaaaaugaguaggaugacaggugagaacaagacuccuucauuguaccuuauuauacaacuuuacuuuuuguacaaagagauauguuauuuauccaaaacaaaaauaacucuucaaaagaaaaaaaaacccaagcuccaaguucccucacauugagcagguuacugaaccucauugggcuucagucaggcccuggaaaacuaaauagccacuucgccaaacuagaagguacagacagcagauagagacauaagcuuaacacaccacacaaaagaaccauucauugagcguuugcuguuaauucauucacuuauucauucaaauauuuagugguaacuacuaugugcugagaguacugcaaugagacacacaauaaaaugcaaacuacuucugccuuuagagcagaagagcucccaauagaggggagaagcuaaacauacaagcuacaaaaguuagauauggccgggcauaguggcucacaccugaaucccagcaaauuggaaggucaaagugggcagguugcuugaacccaggagauugaggccagccuggacaacauggcaaaacucugacucuaccaaaaaauugcauauauacaaaaauuaaucagguaugguggcacacgccuauagucccaguuccuuggcaggcuguaacgacugcuugagcccaggaggcagaugcugcaagugagcuguggucaugccacugcacuccauccagccugggugacagaaccagaucuugucucaaaaaaaaaaaaaaagcuagguaaacaacuaucugucaggaaggcaucuucaaucagaagaaaugaaagagaaaacuggacagaccuugaaugacgacaugauuaacuagaauacggggaaacgccgggcagcuauaguacagcaguggucuccuacgugggguguacacaccccagggacacaaaaguggguaccucgugaugauucuuuagaacauuuauuaaaauugucuuuaauuuccauuuaaaaguuaugcuuuacuuaggcugggcacaguggcucaugccuguaaucccagcacuuugggaggccgaggcagauggaucuugaggccaggaguucaagaccagccugaccaacauagugaaaucugucucuauuaaaaauacaaaaaauuagccgaacaugguggcacaugcccguaaucccagcuacucaggaggcugaggaaggagaaucgcuucaacugaggaggcagagguugcggugagccgagguugcacuauugcacuccagcgcaacacucugucucggggggcgggggggaguuacgcuuuacuaauagugaauauguggacugacaaauacuauuaguaaaguggcuccuucaucacuaguaguaaaguggcuccuucgcuucaugucaggacauccacauuuccaaucgugacaugcauguaggaauccugaggcgggccugggaaucucacaugacaaagggcccagcaugcauggccucgcucauuccuucacuuucaggauucugcaacacagugagacuggccuguuauaagauggauuguggagaauuuuuuuuuaaagaccuuucaaagguagacauuguacaaugguuucacaaagcuguaagaaaugaauuacaaauuucuccuuacaaaaaggcaaaauguuucaaaucugcucaauauucuaugauuauagcagcuauuuacaguuugcuaacaauuauuuuuaaaauaauuaaaauaagccaucuauuccuucaaaguaaagcuggcauuuaaugauguguaaaaguagcugcuuuuugaaauaaauucaugccauggaaagagcauuuugaaaagacugggaaauauuuccaucauuaugugauuucugaguuuaaaagguauaagaauaaaaacugucauaucugcauaucuuaaaauuuugauaaacuauuuucuaaccuucacuauuaucuucuuugagauguagucucgccuugucaccgggcuagagugcaguggugcaaucuugggucacugcaaccuccaccucccggguucaagugauccuccugccucagccuccgaguagcugagacuacaggcaugugccaccacaccaugcuaauuuuuguauuuuuaguaaagacgagguuucaccauguuguccaggauggucucgaucuccugacuucaugauccaccugccucagccucccgaaguguugggauuacaggcaugagccaccgugcccagucuacuucaauaguuuuacaguacuuugagugcuguuuuauaaucuuuauuuuuaaaaagucuuccagacaaaacccuucuaugaguuuaaaaucaaaauugucaguaauuuaaaaauuauaauccauuuugauauauuuugcauaaacugacuuuuuuuuuuuuuuugagacggaguuucgcucuuggugcccacgcuggagugcaauggcaugaucucggcucaccgcaaccgccaccucccagguucaagcaauucuccugcuucagcuucccaaguagcugggacuauacgcgugcaccacaacaccuggcuaauuuuuguauuuuuaguagagacgggguuucaccauguuggucaggcuggucucgaacuccugaccucaugaucuggccaccucagccuccuauagugcugggauuacaggugugagccacugcgccuggccaaacugacauauuuuuuaaaaugggaguuuacuagccaaauugucgggauuaaaauaaaucagugucacaauuuucuaacaaugauuuauagccgcugagugaauaaugcauacccucccuccaaaaacaugcacauccaaaucaaccuguggcuguguuaccuugcaugacaaaagggacuucauuggcaugauuaaaccaaggauccagagauaggagacauuauugcagauuuccaggugucccuuaaaagggaaagagggaggcaggagaguccgagugaauagcaagagaugugacaacagaagaggauggaggaaggacuaugagucagggaaugcagguggccuguagaaacugacagaguaaagagaugcuccccuuuaugucuccagaaggaaccaaaccugccuauacucugacuuuagcccagcaagucugccuuuugaaccuccgacuuccaaaacuggaagauaaccaauuucuguuguuuuaagccacuaaaguugugguaauuuacagcagcaauaggaaacuuauacacacacacaaacacacacacacacacacaaacacacacacacacguauacauacacacauucauuccuuugagaucuauaaaucuuugcuaagggucuuuauugcuaugacaucaauuaaaaccaagguuccaaacaaacuaaaccuaaaacgagaccuucaucacuuuguaagaaaagguuaaaugaagauguuugacacagcacucauucaaucauacugcuuucagucagaaaaagagcuucuuauacuguuaaaaaaauuauuuuaaaauaguguauuuuaccuuuuaucucuaucuuuuucauuucuuauuuuuguguaagcuuauaacauauacaauguauugauagaguaauacacuagcacauguacaaacaguaagcuaagaaaauuuuaauaagaguuagccgagcugggcacgguggcucacgucugcaaucccagcacuuggggaggcugacgugggugaaucaccugaguucaguaaguaguucaaggccagccuggccaacaugaugaaaccucgacuccacaaaaaaaaaaaaaauuagccaggcaugguggcacaugccuauaauuccagcugcugaagaggcugaggcaggagaaucgcuugagcccagcagacggagguugcaaugagccaagacugcgcuacugcacuccagccugggaaacagagugauauuacaucuuggaaaaaaaaaaaaaugagguagcuaagaaaaaaacagaggagagcagugcaguagacuuuuggauauauggaucuggaagcacauagccuaaacuagaaggaauaauggagguuacuugucuaaggagagccaauacaacccuuucaaaauauuuuuccauauucuccauuaucauuauuaaauuugaucuauuuuccuuuguuuccuuuacauuaaaaguuuuuuuccccauuacaaucaaguacaaaauuaccaaaaggccaaccuaaccuggaaaauaagaauacaccucaagaaaaauuuaaaaauuacuagccuuguacuauuguuuuuaaaucaaaaauaaauggaauuauuggaaucagaaaaaaaucaaugacagaaguaauaaucaaugcaugaaagccuaaccauuuucacugagcuuuguaaacacagaagccaaaaauccaacuaucaaguugcuaaggggaagcuacuggaucaaaaugagugaugaacaauaaaagaucaagagaaacugaaaaucccuuccucauagaucaggaauuaaaaagaaaaaugaaagagugcuuacagagaguacauacauaaugcccuacaacuagagacuugauuuaguuuucagcaaagaaaacaucuuuguuaaauuucuuccuaauuauuggaugacuuuuggugugcugccuuucguacuuuguuucacuuucuuauuuuuuuauugcaaauuuguagaaauugauuuuuguagauucagcuuuauuugguaaccuuacugaauauaccuauuaauuccaguaguucccagauucuucuagcuuuucuacauacuuaaucacaucaucugugguuuuacuucuuccuuuccaauuuuuauguuacuacuuccuucgugccuuacugcaccaggaagaacuuccaguacaauacagaacaaaaggugugacaauuugguauccuugucuuuuuccugaccuaaagaaaacacauuugcuaucucaucguuaaguaugauguuaaaucuaggggguucuuauauauauauauauuuuuuuauuauacuuuaaaguucuaggguacaugugcacaaccugcagguuuguuacauauguauacaugugccauguuggugugcuguacccacuaacucguccuuuacauuagguauaucuccuaaugcuaucccuccccccuccccccacccacaacaggccccggugugugauguuccccuuccuguguccaaggguauuagggaaccugccccaauagucauguagguucuuuucuauuuucccuaaguguuggccaguuugaaaaauaaagggacagaguacaaaagagagaaauuuuaaagcugggcguccaggggagacaucacaugucaguagguuccgugaugccccacaagcugcaaaaccagcaaguuuuuacuagggacuuucaaaaggggagggaguguacaaauagggugugggucacagagaucaugugcuucacaagauaauagaguaucacaaggcaaauggaggcagggcgagaucacaggaccacaggaccagggugaaauuaaaauugcuaaugaaguuucaggcaccauugucauugguaacaucuuaucaggagacaggguuuugagagcaaccggucugaccaaaauuuauugggcgggaauuuccucguccuaauaagccugggagcacuaugggagacuggggcuuauuucaucccuacagcucgaccauagaagauggccacagccaggggggccgucuacagaccuacccccaggcacguauuugcuuucucagggaugcuccuugcugagaaaaagaauucagcgauauuucucccauuugcuuuugaaagaaaagaaauauggcucuguuccacccggcucaccgguggucagaguuuaagguuaucucucuuauucccugaacauugcuguuacccuguucuuuuuucaaggugcccagauuucauauuguucaaacacacaugcucuacaauuugugcaguuaacgcaauuaucacaggguccugaagcgacauacauccuccucagcugacaggauuaagagauuaaaguaaagacaggcauaggaaaucacaaggguauugacuggggaagugauaagugcccaugaaaucuucacaauuuauguuuagagacuggaguaaagaaaggcauaagaaauuauaaaaguauuaaauuggggaacuaauaaauguccaugaaaucuucacaauccacguucuucugccaugguuucagucggucccuccauuuggggucccugacuucccgcaacacaaguguucucacuguucaauucccaccuaugagugagaacaugcaguguuugguuuuucguccuugcgauaguuugcugagaaugaugguuuccagcuucauccaugucccuacaaaggacaugaacucaucauuuuuuauggcugcauaguauuccaugguguauaugugccacauuuucuuaauccagucuaucauuguuggacauuugagugcugcaauaaacauaugcgugcaugucucuuuacagcagcaugauuuauaauccuuucgguauauacccaguaaugggauggcugggucaaaugguauuucuaguucuagaucccugaggaaucgccacacugacuucuacaaugguugaacuaguuuacagucccaccaacaguguaaaaguguuccuguuucuccacauccucuccagcaccuguuguuuccugacuuuuuaaugaucaucauucuaacuggugugagaugguaucucauugugguuuugauuugcauuucucugauggccagugaugaugagcauuuuuucaugugucuguuggcugcauaaaugucuucuuuugagauguaucuguucguauccuuugcccacuuuuugaugggguuuuuuuuucuugaaaauuuguuugaguucuuuguagauucuggauaucagcccuuugucagaugaguagauuggaaaaauuuucucccauucuguagguugccuguucacucagaugguaguuucuuuugcugugcagaagcccuuuaguuuaauuagaucccauuugucuauuuuggcuuucguugccauugcuuuugguguuuuagacaugaaguccuugcccaugccuauguccugaauaguauugccuagguuuucuucuaggguuuuuaugguuuuuggucuaacauuuaagucuuuaauccaucuugaauuaauuuuuguauacgguguaaggaagggauccaguuucagcuuucuacauauggcuagccaguauucccagcaccauuuguugaacagggaauccuuuccucauugcuuguuuuugucagguuugucgaagaucagauaguuguagaugugugguauuauuuccgagggcucuguucuguuccauuggucuguaucucuguuuugguaccaguaccaugcuguuuugguuacuguagccuuguaguauaguuugaagucagguagcaugaugccuccagcuuuguucuuuuggcuuaggacugacuucacaaugcgggcucuuuuuugguuccauaugaacuugaaaguaguuuuuuccaauucugugaagaaagucauugguagcuugauggggauggcauugaaucuauaaauuaccuugggcaguauggccauuuucaugauauugauucuuccuagccaugagcauggaauguucuuccauuuguuuguauccucuuuuauuucauugagcagugguuuguaguucuccuugaagagguccuucacaucccuuguaaguuggauuucuagguauuuuauucucuuugaagcaauugugaaugggaguucacucaugauuuggcuguuugucuguuacugguguguaagaaugcuugugguuuuugcacauugauuuuguauccugagacuuugcugaaguugcuuaucagcuuaaggagauuuugggcugagaugaugggguuuucuagauauacaaucaugucaucugcaaacagggacaauuugacuuccucuuuccuaaaugaauacccuuuauuucuuucuccugccugauugcccuggccagaacuuccaacacuauguugaauaggaguggugagagagggcaucccugucuugugccaguuuucaaagggaaugcuuccaguuuuugcccauucaguaugauacuggcuguggguuugucauaaauagcucuuauuauuuuuagauacgucccaucaauaccuaauuuauugaggguuuuuuuuuaguaugaagcgcuguugaauuuugucaaaggccuuuucugcaucuacugagauaaucaugugguuuuugucuuugguucuguuuauaugcuggauuacguuuauugacuugcguauguugaaccagccuugcaucccagggugaaaucuagguuuucacaguuacccucuuaccacuggguuucucaaccagcauuccacaaaacucuaagguuccacaagaaaucgugauuuuaaaaaauaaacauuuucuaaauuucucacaccaggugaugcuggugcucacaguaacaggcaacgaccgaacagccaaaucaaugguuucauaaggaaucuuuuagcaccauguggcagugugcaaguagggcuauguucacuuugcugagggcacugucuguuguuuuuuguuuuuuguuuuaagggacacccaggcaggaguacaguggcacgaucucggcucacugcaaccuccaccuccaggguucagacgauuccugugccucagccuccugaguagcugggacuacagccaugcgccaucacacccagguaauuuuuguauuuuuauuagagacgggguuuugccauguuggccaggcuggucucaaacuccugaccucaagucacccgcccgccucagccucccaaagugcuaggauuacaggcgugagccaccgugcccagccugccacuauccguuuuugaugcaauaggggcaguuaggccacugauaauugguaagcucuauauggcacaaacaaaagcauaguaggcugacaaugucagcagcucccuucccaaauuacauccuccaaccuuccuucacacagugccacugacuuauaggaccaaacaaacucuacugguauaacagaaaaucuaaggaaaacauucauucuaaacaaguaauuuuuacacaccaagagucaacugcuucuuaccacucugaaauguugcaaaacauggauuauguagcaauaaaaguaaaauguagcugggaguaguggcucacaccuguaaucccaccacuuugggaggccaacgugggcagaucacaaggucaagagaucgagaccauccuggccaacauggugaaaccccaucucuacuaaaaauacaaaauuuagccgggcgugguggcacacgccuguagucccagcuacuugggaggcugaagcaggagaaucgcuugaacccgagagguggagguugcagugagccgagaucacgccauugcacuccauccugaugacagagcgagacucugucucaaaaaagaaaaaagaaguaaaauguauugugaaguuuucauauuuuuugcaacuuucucaguuacuauucccuuuaguuuuauaacauauuagcaucuaugucuuauaaacaugucugacagugcagcgugaugauuucugaagauacaauuuacaagagaagagaauuccaaaccuaggcccaggaacaauucuaauaaggcaaguaauaaagaacuauaaucuucugggucauuuuacugcaccagugcagcaagagagagagaacagccuaccacuacagugaaaacuacuuaucaaugaacuucacuagguuaguaauccaaagaguccuauuccauugugcagcaucuguggcaaacaauuuaugacuccagcaaaagugaaaaaucacugaaauagaaaucacagcuacuggacaagucaagguacuuacuggaaucucagaguaaagcucuucaucuuuuuguuuuuaaaucacauucagugaaaaagcucauaaagcacguuauuaguagcagaauuuauugucuaaaaaggggguauaguggauagaaucacaccacugaugggaaccuaaucaugccagcauguuaaaugacaguaaguaaaaugcacagcaugagaaacugaaaaggcuccacucucaaacaguguaaguugacaaauugaugacaugucacaugaugcuaagagguuuaauaaacugacaaacagcuuguuuauccaggcugacaaaccaacauauuucacuauauaugucuuguaaauuuuuuuaaacaaugcugaauuucaagaaaaauuuuugugcugcaaaaaaacuaccauaaacaaagggcaugacauuuucaauguggugucuucauaucuggaaacaagaaguccaucuuagagaaacuguguuggcauccacagugauguuccccauuagugacuggcucacggcaagguuuuaccucucuugcaaaaaaaaaaaaaaaaaaaaaaacucaggacaucgcuuuuuucagagagguacuagcagcaaaaauccucggaaaugaaauuuaagaugucuugaaugggccagaugcaguggcgcacaccuauaaucccagcacuuugggagaccaacacaggaggauugcuugaggccaggaguuuaagaccagccuggcaacacagcaagaccucaucacuauuuaaaaaaagucuugaaugauguuuaaaaaugauuugcuuuauuaaacauagaccaguauacuugagcaccuaaaucucuugcuacauacagaaauccaguggcuuagcagaggagguauucucaacagaacacugaagcugaaagcugaauuacaaaguacuuucaagaaaauaguaggccauccuuuacugagugcuuugaagaugaagagugacugcaggagcuagccucuuggcagacuuuuuaaaauaauaugaaccaguugaacaaguuuagaaaaaaauguuuugacuucaagugacaagacauuggauuucaaaggaaaacugaaucucuggaaaaaucauguggcaaaagaaaucuuguaaugcuguuugggcuugaaagugaggaaggauaccagcaacucugaagcauucucgaaaaccaccuggaagaacuaaaacacaaaauuaaacaguacuuucucccucuuucaacacaaaugugaaccugggugaagguuccuuucuuaucccaagcuucugcccaacugagaacaaguaaguugccuacuuugaucaggugagaaaagaaaucaaguagaaaauuuuaaaaaagaaaaaaacugagguuuccucugccuauacuacugacuugcacaagaguggagauccuuccuggggaguagggagcaaccacacacacaaagagcaggcuaauaagcugggcgaaauaaaugcaaagacaaaaauauucuccugucaaaagagcacugacaauuauuauuaacuuaucauguccacaacuuacugauuagguuaauaaaugugaacucggagguauagcaauucuuugcauggguucucugagaccugaaaauuauuucaaggguuccuccagaguaagaagauugagaaaggcugcucuauugcauugaggaacuuugccucuacuaauuugcugcaaguuuuuauaauaaauugguauuaaauuuuaccagaggcugggcauguuggcucacgccuguaaucccagcauuuugagaggccgaggcaggcagaucacgaaguuaggagaucaagcccauccuggcuaacacggugaaaccucaucucuacuaaaaauacaaaaaauuagccgggugugguggcacacgccuguaaucccagcuacuuaggaggcugaggcaggagaaucgcuugaacccgggaggcggagguuacgguaagcugagacagugccacugcacuccagccugggcaagagagugagacuccgucucaaaaaaaaaaaaaaaaaauuuuaccagcaacuuuuucuauauccacuaagagaucaugauuuuucuuuauucuguuaauauaacuuacacuaauuaauuuucaaauauuaaccacucauacauuccuaaacuuuacuccaucacaauguauuaucagaucuauggacauauauauucauaucuuauauuugaacagauuaaauugguucauauauuuuaaaaaauuuuuauaccuguauuuaguagagauauugucauauaauuuaaauacuuuuauuuaaaacuggaaauagauccauauucuugacccaguccuacuauggaccagaacugugucuaugagccagucauuuaaugucuauggacuccagaguuucuaaauucaaaaauaauugucagaaguaauucagacagaaguuaggccagugauucucaaacuucagcauguaucacaaucacuugaagggcuuuuuuaaaaacagacuguugcucacgccuguaaucccagcacuuugggaggcugagacgggcagaucacaaggucaggagauccagaccauccuggcuaacacggugaaaccccgucucuacuaaaaaaauacaaaaaaauuagccaggcgugguggcaggcgccuguagucccagcuccucgggaggcuaaggcaggagaauggcgugaacccaggagguagagcuugcaaugagccaagaucgcaccacugcacuccagccugggugacagagcaagauuccaucucaaaaaaaaaaaaaaaaaaaaagacuguugagcuauacucccagaguuucaaauucaauaggucuggaaaggggcccaagaauuugcauuucuaacaaguucccaggugaugcugauacugcuggcuggagaaugacacuggagaaacacuaagcuagaauaagccaaauuaacccagauuuuucaacauaguguuuuacauaaccgagacauaaggaauaaugcugaaaucaagagaaaaaucauuuuaucaaaaauaaaguacacacuuaauuugucaucugagaauuaaagugcugucucauaugaagaaagaggcauccuaaggggauuuucgagauaacuuggagugcuuuuaaaacuuacuccuuuaagcaauaaaauuuguuuuacauuaaccauuucuguaaaaauccuccuaaaauaaaccauaaaguuccucuuucaucuuaaccaggucacugaacauaauuuaaucuuuuuugaugucucaguuacuguuccaacguaaauuacugagcuaugguaugauaguaaccaucucaggagcuggugagaugaggugggcaguuuguccccuccacugcauguucucaguauuaugacucugaaguuccuguaucugccuuucaucuuucuauuuaguacuuuguccaaaguuaugacuaucugcuauaaaucucacuguaccuaucuaaugccuccccuggaacuuuuuccacaguuucuaaaucauucuuauuaagcaauuaaacaguuucccuauuaaaugaaucaacuauaaggagcauuucuguugccuuucuuuugcuuucuuucuaaagguacacaaaagacagugggagacuuuccaagaaucuguuuacagauaccuuccaaauguacuucuucccuuucaaaauaagcccuucucuuuaccuuccaccuccccccgccaugaaaaaguaaucucaccuccauucagaauuugugaugcagagccugaaggaauaauaaacuccagggacccaaacaaacagacaagccaaaaaaaugguuucagggaagcauucgugaaugguaacugaggugccguaaacuauccauuacugggcuucuugucuuuuccagucacauauuuuucaaagaguuuaaaauauuuuggccccugcuggaacauucuaaucuaucauaaucugugagcaauuguuuaaaguuuccucuaacaaccauucccccuacacccccaccuccauucaguauuguccaagaacgcauugcucuuaggggacaguaugauaaaaguaaugcacagagaacacugguuaaaaaaaagauaaaaagaaauauuuuuuucaagaauucuuauuuuuuuauuagcgacaaggucucaaugugucgcccaggcuggaguacaguggugcaaucuuggcucauugcaacuuccaccucccaggcucaugugauucucagccucuaaaguagcugcgguuacaggcaugugccaacacaccugguuaauuucuuuuuguauuuuuaguagagacgggguuucaccauguuggccaggcuggucucaaacucaagugauccaccugccucagccucccaaagcgcugagaauacaggugugagccacugugcugggccgagaauuuaaauauaaguaauucucaaaacucauucccugaauauuuauuagcuugaagaaaaagcauauuuagagagcuggaacaauaucaauuagggaggcugauuccuuuaaauauaaaagaaauacuuucuaggacugccaagucauucaaauugugcuauauaaaagcuguauagaaauuacuuuagauugagugugcauuacucaauaugguaguuaaaaucuauuuugucaaaucguaucauuaaaguuuuauucuaauuagucaauucucauuauaguuuuucaacaguuuaauauuucuaccuucuacugacaaaaaauaagauaugcuagcugucauacugaguaguuugaagcaguagguaucucuuucauuaauuacccaaauaaaaauguaagguuacuucugauucauucccuuuuauuuauaccuaauagcugagaucagagaucagaagaugcaggaacacacauuuaaaaaggaguaacaggccaggucuaguggcucacgccuguaaucccagcacuucaggaggcugaggcaggcggaucacuugagggauccccugagcccaggaguucaagaccaagcugggcaacacugagagacccugucucuacaaaaaaaauacaaaaauuagccaggcaugguggcacgugccuguagucccaguuacuugggagguugaggugggaggaucacuugaggcuaggagaucgaggcugcagugagccaggauggugccaaugcacucuagccuaggugacagaguuaagacccugucucaaaaacaaauaaauaaauaaaggaauaacacaacuuuuaucauaucccuugcuucauauuuuaacugauuuaauuuuuaaucuaacaugacaagcagcgcagaaauguuuaaauuauuacaaaaauugacaaauuacuguaauucuuuuucagucauauaauuuucagcucaaauaccuuagcaguaucuuuuaguaugcauuccauaauuuauuccucagugguuuucauauuauccaaaauaucugguaaucuauuuauuugaaauuuaaaauagaggaaaauuuuaugauucaaagcaaguuuguuauggcuaguugguuugacaauggagacuggcuuuguuaacuaggagauauuuucuaaaaauugaauaagcuaaaccuucauacuaaaaguuuucacaaaaauauauuuuaaacacauaaaacaauuauaauaaaaauucacaaagcuauauuaaaauuaacaguauuucuauuuucucaacugcuucugaauauaucagauuuuaaagaaaguaccuaugaagggagggaggggaacugauauaagacauuugauaagccuuuuugauaugcuuccuagaagcuaagaaaauaaaugguuaagcacuagguaacaaauccuuuggcaaguugggugguuuccauucuuuugcuuucaauaaaacugaaggaggaccuaacagaagcauuaacuaauggaugcuugaugauaaaaucacuagugauuuuugacauauaacuuggaagauucugauaucacaaaauuuccauuagaauuaacuuauauauuugaacauuuaugucuaagcacuuaaauucuacaaaaucucaaaacacgaacagauuugccaaacacaagaacuaaugaaggaagagaggagacagcugcauucauuuaagaauaaauuucugauacaaagugaauuuaaucaaaauuuuaaucuauguauguuauucuaaucaacugugcaccaauaauuguaaaaauaacucaaaccguaaguuauuuuuaacacuuagagcuuuacggucauaggaaaaacauuuuaaauuuugauuuauauuucaauuuauuuacauauuauuguggcagaaaaguuugauagaugaucaauaaaugauuugaaagauaaaaauacauaacauuuggauaaaauucaaagggaguaacagaugggacacaaauauucaaagaaaaaauaauuaaaauucccaaucauuaagggaguuuguuuuuauacuuuuaaauaaugacauuuagauuccauuagauaaauuuaaaagugauauauuuuauugaaauacuacaauaugccagaaauucuguauuucuggucaucauuuaaauuuuugcuugaauagugccacuauuuaaacuuugcuaacagaguguaguuaucaacuuaaauauguacaaagggguacacaguuuuucaaacuguagggagcacaaguaaaaauucugaaguucacuguucuaagacagacaaaguuauaaguaagccacauagggaagugaagaccauauuaacagaguagcaaaaacaugacacuuaaaugucagugucccucaacagagugacagcccugaggguggcauuuuuuucuggguauucccaccauuagugcccuaaacagccaauagauuuucauaacugcuuaccaugugggggaauaaauggaugaaaugaaucaacagugaauacuuacgugucaaaauacauuauuuaauaauggggaguuauauacuaacauauuuauacuauaacccaaauacaaaccacagaauuuagacucagcuagacacuaagucuauuaaauuacaaaagaaaagccuuagcacaguuaaaaaucugauuuauauuuuaaccaauagauggaugaaauuaaaauaacaaauauaguacugucuuuuucaagagaugcaacuaguaacuaaucgugaauaagaguuuggcaaaagaagggagcaaauuugaaauuacuuagccaucuuagcuaaaaaugaaaucccgcuuuaauaaauuuaguuaagauucaaagucuuggucaggcauaguggcucaugccugaaagccaaacacuuugggagaccgaggugggaaaaucacaugagcuuaggaguucgagaccagccuggacaacacagugagacuucgucucuucuaaaaauaagaaaauuagccaggcaugguggugcaugccuguagucccagcuacuugggaggcugaggcaggaggaucacuugaccacaggaguucaaggcugcagugagcuacgaucgugccacugcacuccagccuggguaacggagcaagacugucucaaaaaaaaagaaaagggaaaaaaaaagauucaaaguaaagccaaaaucuuauaugaucaaaacuuuguauucaaaaaauacuaaaccuuccaucaaacauuaaauucuaauucuuuugugagucaauguuuuucuaagacucucaguaaaugucuaauuuucuccuccaagaugcagagaagccaucaccaucaucugccugaacuauguacuuuuuacuucucacaucaauggaaguaauaaccugaaaaaucaaucacauccucccauugguuuugccagccuguauucauuaagaggugauauaccuacugccuaggcacacucuuauuaagugaaauggugagcuuaaacuguacccuugaguuaaugcagauuaaauaugcuuugguaacucgccacaaugccaaauuaauacaauguaaaaggcuugagguauaauuggcauacaauaaacugcacauacugaaaaugcacaauuuugauaaauuuugauguauacagaaauuuaacuucugaaaacccuaaucuccuucuuuugccaaaaaguuaaauaggacuuuugcuaucugagaaaaguacuuaccuucauguaauucacaaucuuagcaagaacaccaaacuuauauccagagcuuccugacaaagcuuucaaguuaaaugauccauugcuaugaucugcaaaugaaguucaaaauaacaucgucauauuaugugugauuaugacucuugagcagcuaaaauaauuuuaaugcugguaacauauuucuugaguuuuucaucuaguauauucuacccuguaauauucuggugaaaaauacacaaucuuugaguauauacauuaaaguaccaauuuucucacuaaggguagaaacaaaguauaaauaacuuaaaacaccaaaccacaauucuuuuauaaauaucuuuaucacauuauuuuuuauuauauuuuuugagacagggucgcauucccauugcccaggcugaaguucaauggcacaaucacagcucacuacacccucaacuucccaggcucaggugauucucccaccucagccuucugagaggcugggacuacaggugcacaccaccaugccuggcuaauuuuuuuauuuuuuguagagaugggguuucgccauguugcccaggcuggucucaaacuccuggacucaagagauucacccaucucagccucccaaagugcugggguuacaggugugagcuacugcaccaggccccuuucuccuuuaucucauucuuaucuuaacucugauuagacucgcuccauaaucagaaguacacuuuauuaaacaaggaaacaauacaaaccucaaucccauccauaaagcuaacacaaggaguggauuacuucugagggaagaaaaguucaauauaccacuuuuuacaucaauuucugcuuaccaauuuaagaccaaaaaaauaggaauuaauggaaacuaauagaaaaaagauaucacaauuauuuuaaaguaaacuuuacagauaaauuaggaauaaaaagccacaggcacugccacugcaugaacauggaugcuuacuuuaaaaagcaucacagcacuacccacccacuuugagaaacaccccccucuccuucucuaucugguguggaaaacccuguacaaaagaucauuuguuucaaaauaucuaucauuuuguugcauucuuacaagcagaaacccuaaugucaccacugcaucacaaaugcauuccauuagucauaaccaggaacaguaaaaaauccaucauaaauacuagaaaaacauuuuagaaguacacauucuauuagcaaggcaugagaucagauauuauaaaguucccauguggcugauccacaaagagagagguuaaguaaaaggggagaggagaaccaaucucuggcaccagguugguaauaauaauuuaaacaaaagauugcauuagaacaaccacaagucaaauguaacaacugucagagauccaaaagaacagcuucuagauggcaauaccauacuccuuugagauuagugaagucuuuauugaguauccuuuuuugagacuaaaaugaaacuucauaugcaauuuuccuuuaaaacuaacuuuguuacaaucuuaauuaauuggcacacugaagucuaccauguuuccaaaaguaacaauaacauuaagaaugccuuacaguugggaagcccaggugggcagaucaugaggucaggaaaucgagaccauccuggccaacauggugaaaccccgucucuaccaaaaauacaaaaauuagcugggcauaauggcacgugccuguagucucagcuacuugggagaaucacuugaacgagagaguuggagguugcagugagccgagauagugccacugcacuccagccuggcaacagagugagacuccgucucaaaauuaaaaaaaaaaaaaaaaagaaugccuuauaggugcuuuuccauucacuguuucaauuaugaaauauuaccuacguaguucauucucccaagguguucagcacaucuguaauaaaaguaaccaauauuuauuaucugcuaaacacuaugguaaauauucauacguaaucccucccaaaaaauccaacuuaagaaguauuacuguccccuuuuaaauauaauaaaauugaggguaguaagcagcagaguauagauucaaauccaguguaaacccuguaauaaacagccuuuacacagauuauuccaucugaaacuggccauuuugucaaaguacagaaaucugugacugcacauuuaaugcuuguuuaaguaaaauaauauuaagcuuaccccacgcaacuguauaaacaacugggaagacuaugaaaaaagagaugacaauguguuaaggacaaacaccacacaaauggccaauuaugaaucacaaacaguugugcuuaugagacaugaugcuuaugucucuggcaucuacuacuaacucaaugucaagcuuaguaaacacucaauaaauauuuguugaaugaaugacuauaauacagauauuucuaugcauuccuuuauggccccagaaacuaauguaccaauucaucuauaauuuuauuuuauuuauuuuauuuuauuuuauuugagauggagucucacucugucgcccaggcuggagagcaguggugugaucucaacucacugcaaccucugccauucggguucaagcaauucuccugccucaaccuccugaauagcugggauuacaggagacugccaccgugccuggcuaauuuuuguacuuuaguagagaugggguuucaccaucuuggccaggcuggucuugaacuccugacccugugauccacccaacucagccucucaaagugcugggauuacaggcaugggccaccgcucccagccuucaucuauaauuuuaaaaaagaagucuacauagcauguaccuggucugcugcuguuguuaacagccacucccauaauuaaaaaccuucauucuguugugcuuagaccauaacucuaaauaauacacaguaacuaaaaauacucugucucuaaagagccaaccuggagaucacuuugccauuuacauuuuagagacuauuuuuugaaugcagguaguguauuuaccuaaaugagcccucuuccaacuugcagagcuaaaagccaauuauuuuccuucauaauuccuccuaaaucaaaccaccacauggaaauaaucacuuccagagugcaaaaauuauauacggaacaaguaaugaaagaaaaggaagaacaagaaaaauuuauaagauuuuaugcacacuuccugaaggaaauaucaggcuggcaaaccuggacuguuuguuuccuagguuacuaccuuucccgacauuaucuuccagcccuagcacugaaguauucacugaaggaucugaaauuuuauaaugaaacacuaaagaaucaucaauuuguuaguaacucacaaauuccuauauaggaauuuagcuuaagaacaaaaaaauaaaggagaagggaugacaguugauaccccagacagcucuauucaaguuuaugaaugauuuacucuuaaggguggcaagacuuaaugcaaaugaacauagaggaaacugucagcuccauugugguucaaccaauagaagcacagcuccaucuuggcugugcacuagacugcauuacaaacagacgauaccaucgcuucagcagcauccucucagacaagagguagguuuauaugaucuuuuuuauuuagugguacauguccuuaugaugcaauaggaaaauauuuuacccugaaaaaucaaccagaaagcuuugcuccuacuaaauaucaagaaaaagcaauguauucguuucaccgcuugguaggauuuuauuaugaaaauaugaagacugccuugugcuauuugauaagcacccuuaccaucugugccuuaauggaaaauucauuacauuuuacaugaaccugaucuauauccagaccucagaguaaaccauagcuuuuuauuuuaacugguuacuugcuaauuucauuuucucugagcgauuucauuucugcaguuuggucugucuuaacaaaggauuuuucuuaaagaaaaacccagaucaaaagcgaauuccagacuaaagcuuucugauucuaugugcaaaugauauuggcugcuaaaaaauaguuacuuauaagaaaguuuguuauauuuuuuagaauaugagaaaauaguucaaaauuauuuuuauuuugcuuugaauguagaugcagagaaugccaagaaauuaucacaauuuuaauuuuuauauaaaagaucauaaaagguaucacuauaugggcugcauuauacuacacugaacagauaauuuauacagcuucagacuuccuuaacauuuaauuaaaguauuucuucacugugaaauuucucucucguaauauaaagucaugcuauuaaacaaaaaccuucuuaaauagccuuucauuuuugauaucaauuuaucacaccauuuaaauauaauguugaagucauucuuaaacugauccucaaaauaaauacaaaguaaguccuuuugauaaacugcauuuuaaaauaaaaauauguccuaagaagaacugguuaagaaaggagaguaaguaccuuucuagguaacaagauuaucuucguggcucagagcaaucauucaugucuauuaaaaauuaauauuaacugcugaccaaauuucuaauuuuauacuauucaagcaugaaaauuuaguuauuuacuagauguuagaacuccaucuauauacuauaucggaccuaaagagccagcuucuguccuuuuaccuugcugguaaguuuauuuaaucuuuaaaggguuuuuguuuuuuuuuucuucauaauuucuauuccuuuucuuagucggcauucagcuagccugagcaaaguauccccugcaaaacccaaagguugcuguaauaagauacuagaucuguccagguucagcacagugggguuaauuaucuagaaaccauuugugcuugcuacagaaaguacagaagcaccaaacaaaagucucagauaaaauaaaaauaacuuugucaaauaaaacaguuaacuuacaaaucaaauuucagguaaacugucaacagaaaccccuaccacccacauuguuuuaacacucuaucaucagccugcauuuugcuuggaauaugucuauuguuagcacagauggaggcucauugcuguuucaccaaacugacuggagacauggccuaaguuccagagcuuaaauuaagugaguugcucuauauuuacaggcuauuaggauuaacugaucacauuucaaagugauaugcuuaaaagcaccugagaauucaauucaaaggcuuuuaccauaaauacagcaaaagcauaacuuuauucucaucuggcaacccaaagguuccagaacaguuccaagucccauccccauuaacacugcacuggggccuuugggaguaaacauaucaaaugggaguaaacauaucaaaaugggaguaaacauaucaaaugggaguaaacauaccaaaauuaacauaaaacaaaacuaaaacacauaugcuaaaaaaaaauuaugugauuuacuuuaaagcuccccauuccuguaaucaaauuuuaaggcauggguagggaaguccagaaaaagauuguuuuaccuuuuuuuauauacaccauuuucucuugcuuuucauaaagaauguuuacagcauuugcuuaauauaaacuuacauuuuaauuucaaaacuaagucgcaggauaggagaaaauccuaaugauguauuucuauuuuuuggcggggggacggagucucacucuaucgcccaggcuagagugcaguggcgcaaucuuggcucacugcaaccucugccgcccagguucaugagauucuccugccuuggcuuccugagaaacugggauuacacacacccgccaccacaacuggcuaauuuuuguguuuuuagcagagacggaguuucgccauguuggucaggccagucuugaacuuaugaccucaggugaucugccugccucagccucccagagugcuaggauuacaggccuaaugguauauuucuuucugcaugcuuaauuaugccuaauccaugaaaguaagauuuagccuuuacccuaaauuaaacaucaaaaguuacuagagcucuaccacacuuugaaagaacaugccacacuaaauuuaagguggaaaaugacuccauauuagagaguuuacuuuuuucagauaugcccagaagcuaacaaacaaugaauguuuugagccgcucgguuaucaauacacucacaagacaaaucaucaucauuuacaacauaaaccugaccuauacacuuucuuaaacugcuuagacacuuccagcaaagcauguaagugccuuuggagguggccuaugguguuaccuauaguuauuauuaaaagcguaauuuguuuugguuugguuuuuuugagacagggucucacucuaucacccaggcgggagugcaauggagaaaucacagcucacugcaaccucaaccuccuaggcucaagcuauccccccaccugagccucccaaguagccgagacuacaggcgcaggcuaucaugcccagcuaauuuuuauuuuuguagagacagggccuccccacauugcccaggcuggucucaaacuccugggcuuggccaggcgcgguggcucaugcccguaaucccagcacuuuugggaagccaagguggguggauuaccugacgucagggguucaagaccacccuggccaacauggugaaaccccaucucuacuaaaaagacaaaaauuagcugggugugacuguacauaccuguaaucccaacuauucgggaggcugaggcaggagaaucacuugaaccaggaugcagagguugcagugagucaagauugugccacugccauccagccugggugacagaacgagacucugucucaaaccaaaaacaaacuccugugcucaagugauccuccugccucagccucccaaagugugggggugaaggcauaggccacagcacccagccaagcauaauuauuaaaagcauuuuuaugugugaauaaaguauacagucuaacaaaaaugacaguguuuccuaaucccaauuugaauuuuuuggaauccagaauacucaauaaauguauuaaauagauacauaaacaacaggcucuuuuaagugaaaguaaguuuauuaagaaagcaaaggaauacucagcagcacuuuagaaguuuuauuaggcuaacguuuuguauuacagugcauuaaauaagucaauauugacagcugauuuaacuagauguguuacauuuugaaagcacaaagggauuuuaucuuuuugaauuaaaggagaaaagccaaaaaaaaaaaaaaggaaaggaauaaaagaaugguuacuccauacuacuccauaagcaggaauaaaagaaugguuacuccauacuaauccauauuguuggcuaacaauagacuuuuaagagagccaagaauaaggaauagugcuuuuuauuucucuuuuuaaaauagaugauuuacuuugguuucaaauaaauaauauauuuaaauuguugaaaaaacaaaagaacacaagguacagguuaagaagccucaaacauaucccugugccucacucuccucccgauggauccccauccacaccaucauugugauuaauuucuuguaggucuuucuaagauuucucugcagauacaagcaaauaagaguauauguuuucccucuuccuauauacacuauccuacaccuuguucuuuucacuuaagaacauauccuaaauaucuuuccuaaaacucaguuaccuaugauucaauugugugaauaaacuauauuaauuuaaccagaagaauagcucauuaauggauacaaguuaaaccucaaauaacugaauuuaguuauguaucugucugccuuccugacugccucuuucuauuuauuuuugagguaaggggaccugaaaauauuuuaagcaguucacuuauaccucaaaaguagaugagauaucucuuuuuuggaaaugggaguuucacucuuguugcccacgcuggagugcaaugugcauuuuccuucaaaaugcaggaaaaaaggaggcaaguccauccagagaggugaagugacuuaccaagcaaaccuaagaaaacaaaaaccuuagaaaacauaauuuuaucaaccccaaagauuuuauuaagaaaacaaaaaaauuuaaggaauuauauuguuauggcuuugaguuuggggugugaaaacaauauugugguuauguuuaaaaauagaguccucaccauugggagauauauauugaaauauuucuaggugaacgaugccuugaauuugcuuuaaaacaaccaaugggguggaagcaaacagguacagguagagaugggccaagaguugaugaaugaaguugcauuauaaguacaugggaggccaggcgcaguggcucacgccuguaaucccagcacuucaggaggccaaggaagguggaucacaaggucaggaguuugagaccagccugaccaacaugguaaaacccguuucuacuaaaaauacaaaaauuagccaggugugguggcacaugccuguaaucccagcuacucaggaggcugaggcaggagaaucacuugaacccaggaggcggagguugcagugagcugagauugcaucauucauugcacuccagccugggcaacagagcaagacucugccuaaaaaaaaaaaaaaaaagacaguacaugggauacucugguuucucuucagaucauacaaaucucucaccuuuuacuaaagauuucuucagagaguaauaauucuaagucuuaacccaauuuuugaggcccugcaucugcaaggcuaguaagaaagaaaaaaaaaaaaguacaugggguucauacuacuuuguaguuuucguuaaaugaaacacucucacacaaaagguaucuccagaauuuacaaaaauauuugguacacauuagguaaucaauaaacauuuguuauaaaaauaaaauccuguuuacaacuauguaguaaaggaaaagcauacagaaugacaaccgauaaauuaaugaaguagaacuacauuuuuucucuuauuuccaaaauguucuuagugcacagguuaucuuauaauuuuuaaaacuaaauguuaaaauauuuguuagagaucaagacaguaaaaacuaauuuaguuccucauuacuauaguuccauacugacaaaucuuugauucuaacaguccccauuuaagagcuaacaaguaccaggucaacaagagcuaaacuuaauucaagaauacugaaacuugaacucaccagcuucuuuugugaaauggaauaauaacugauaccuuugggagggcugaauuugucuguuuuuuuaaauauuuaugucuaugggucacucagguauacgaaacacuuaagacuaucauuuauaaccccaagauuagggucucuucacagaucacucuaaccuaaaauuuuauuauccucauucugaaaauuggcauuauuugguuuucuuucucuacuauuuuucacucagccacuauuucugauucagaucaccugucaucgaaguuuaaagaaggggaaacaggagacagaaauacacugaaccaaaaagguaagaagaauccacaaggcuaaugauaaaagcuuuuccaggggcaguuugaagaacauaaccuuaaaacgccaagguuuuuuguagauaacagcucacugaccacugcuuuaaucaaguuuuaaaccaauucagcugccuuuuccccuuccauuagcaguuaauuucgguauaugaauuuuuuuuuuuuuuuuugagaaacgguuucauucccauuguccaggcuagaaugcaguggcacgaucuuagcucaccacaaccugcgccucccuggcucaagcaaucuucccggcuuagccucccaagcagcugggacuauaggcacacaccaccaugccuggcuaauuuuuguauguuuuguagagacggguuucgccauguugaccaggcuggucuugaacuccugggcucaagugaucugcccacaucacucucccaaaguguugggauuacaggcgugagccaccaugccuggccugaaucuuaaauauacauauucaucuagcaaauaauauauguuaaaaaacaggguaugguugacuaaggacguuggcccagauauacaaaaaaauucaaaacuaccauuuaggcauuaauuaaggaagauucauguugccuauacaaauuuacuaagaaaucuuaguacugagauuugaauuaacagaucuguaguuugcuacauaaauucauuuucuaccuuuuuuauagauucaaaagagcaaguggaaucucuaagaauggcuuccagccacuggaaugaaaccacuaccucuguuuaucaguaccuugguuuucaaguucaaaaaauuuacccuuuccaugacaacuggaacacugccugcuuugucauccugcuuuuauuuauauuuacagugguaucuuuaguggugcuggcuuuccuuuaugaagugcuugacugcugcugcuguguaaaaaacaaaaccgugaaagacuugaaaagugaacccaacccucuuagaaguaugauggacaacaucagaaaacgugaaacugaaguggucuaacacucuauagaagaugaacaaaaucucugaaagcagcucaaccucuucugagaaaaaaaauauauucugaggccaacuguugcuacaaaacaaauucugacugaaugguuaaaacauuucuaguagaaggggaaaaaaaaguuaaacaugcacuguuuguguguauagccauuucauuaaauauacaguaaaacuucaugaaugugaauuuacuaaucuguuuaauacugacacuucaaaaacuggauaaaagauuccuagaguucaauauuaagcagcaaaagauaagcuggaaaagacaagcaaggcuaaugaugcuaaaaugauuuuauaacuaaccaauucauguagacaaaaaauaguguguugguaacaaaaaggcuauuuaaaacauguuucuaagucugaaguaaaauacuuccacuuauauauauaaaguuccuauuuauuaaaaaguaguauuuucuaauuuacugaaaacaacuuauauaaauauauaaugacuugaguuuuauguaggauuaguaugaaaaagucucaaaauaaucaaaaaugccacaaguauauuugcacaaaauucucacaaaacugacuuacuguuuaguuagaaaugcaugauauaggaaaggccuagucuauuuucaaacuaaaacuuacuacuacaccccuucauuuccugaguuuguucuuucauuuuaccucucuuauuuauacucucaaaggcuaagauaaccaaggcagaaagacugccccuccccccauccccccaaaaaaggucaaaagauagggccacucaacaccuguugaaauauggcaguuuuauuucuuggaauuccaagggcuauauagauauuuugugacccuaacacuauuuugcuaucacccaugagcaaacaaaagcaugcucuuaaccaccacacuaccccuaagucagaaaugccacuccuggaaauguauccuaagcacuuaguucaaauguacaagcucaagguacaaagauuuuuuacaauggcauuacucaaaauaacaaaaaauugaaaauaacuaagacuuuaacuaaauguggcacaucaacuuaaugaauuauuaaaaagcaacugaaggccaggcacaguggcucaugccugucaucccagcacuuugggaggccaaggcggauggaucacaaggucaggagcucaagacgagccuggccaagauggugaaaccccgucuauacuaaaaauacaaaaguuagccgggcaugguggugggcaccuauaaucccagcuacucgggaggcugaggcaggagaacugcuugaacccaggaggcagagguugcagugagccgagaugaugccaaugcacucuagccugggugacagagcaagacuccgucucaaaaaaaaaaaaaaaaaaaaaaaaaagcaaccgaaaagucuggcaagauagacaaguauuuaaaaguaaaaaauaaauucaccauauaaaaguuuuaauacaauuauugauauuauaaauauacacaugaguaagguuugaaaacaaauauggagaauuagaauagcugguauauuaagagggcuguggggacaaaaaaaagcacuagguauuauaaaagacuuuuuuuaaaucucuauuacugauggaauuuuuugugugcaauaaauaacuguguggugaagagaggaaaucuguucuuuucaauuuaaagaauaucggcugggcgcgguggcucacgccugcaauccuagcaguuugcaaggccgaggcagguggaucaccugaggucaggaguucgagaccagccugguugacauggugaaaccccaucucuacuaaaaauacaaaaaaauuagccagacaugggaauggggccccuguaaucccagcuacuugggaggcugaggcagaaucacuugaaccugggaggcagagguugcagugagcugagaucaugccaucgcacuccagccugaacaacaagagugaaacuccgucucaaacaaacaaaagaaucuuaacugccggucugaaauaacucuuccacaaaguauuuuuuauauuuauucucacauuagaaacaaacacaaauaauauaaccaacuuuaaaaggauuugugaagcuuggauauauaaaauacuuuggaaaccaggaacugagcacuguuaaaaccauauacauuuucacaaacguuggauucuuggcaauagaugguaaguauacaaguccuuuaauaaucagauuuuuuaauaguguacauuaccaacuuucucccccacccuauccuguaauuauuuagucauccaacaaauauuuacugagugcuuacuacaugucagcaauuaggccagauacugagggcagaguggcaaacaaggaaccacgucacuacaauggagcacauuggaagcucugucaaaaagaguagugauaugggaacucaaagguuauacagugaauucacacugaagaaugagaauaauaugacuuuuaagcugaaacuuaaaagaacaggacagaaccaaaagaggguaggagguaagaaagaauauuccaggaagaagaaauaauacgaauaaaagccaagaggcaagagagaauaaagcauguuggaggagcuacaagucaguaucacuaggacagaguacaaggagaacaguaugauaccacaccuaagagauaauuagaggccagaugaggcaggcacgcaggcugcaguaaaacauggacuuuaucugaaaaacaguaacaaucagcuugagcugaaagcaacaugaucuaaugagaaaaaucacagcuguaugaagaaugaacacuaaagcagcuaaaccaggagaccuggucaacagcuaaccuagcaauccaaugaccguggccugaacuagaguggcaugguagccuuuaguuguuacacccaauauuuccagcucucuucauuaaggaaagcauucacuucagagcccccuauggcugggaacauaacuuuggccaaugagugacuugugacuaacucuggccaaugagcugugagaggaugugacaugugucaccuucaggccacagcacuuaacugcuagugcaagcucuuccagaguuaguuuuccugcuagcacagaacucacaaacauuugagcuuccagcugcucugccagccuggguccuugagugacuauaacuagcuaagacuucuaccaauccaugauaaacauguaguaugaaggagaaacaagcuucuguuguuuuaagaaacugagauuuuugggauuguuaccacaacacaguuuauccuacccugacuguuagggaaaacccuggccaaccaaagagaaguaaaacccuacaagggcucuuccugcugucgaaugggaccuguuuguggggaagaugaaauucgcuacccaauaccuguagccuaaacuacaaaaugcaaagacauucuugagcaggucaaaggcucaaguggcuuaagccugagaguggcuauguuaauguuuaaaacaguuuuuacauuuuuguuuaugaugaguuaauucuauguacauuucauuggaacgacauauaaaccuaauauauauuauaagaaugacaggccuacuuugauuuuuaaaaaagcuuugcuuccaaaucaguuauaaaacagcuuguaggauguguaaaaaauuaacaucaauaaaaauuauuauugcuacaauuugaaguagcuaaauaauuucagcugugaauuaaguuccacugacauuguuuaaaagauaauaauguaagaguaaacuaaacccaaagcaagcagaaggaaggaaauaauaaauacugauguggaaauaaaaacaaacaaacaaacaaacaaaaaccaaaacagaaaagccaaugaaaccaaagguugguucuuugaaaaaaaucaacaaaauugaugaaccuuuagcuagacucaucaagaaaaaagggagaaaagacaaauuccuaaaaucagaaaugaaagaggacacugggugagguggcucaggccuguaaucccagcacuuugggaagcugaggcaggcagaucaccugaggucaggagcucaagacuagccugaccaacauggcaaaacccugucucuacuaaaaauacaaaaauuagcugagcgugguggcacacaccuguaaucccggcuacucuggggggccugagagacagagcaagacuccgucucaaaaaaaaugagaggggauaucacuacugacuuuauagauaucaaaaggauuauaagggaguacuuugaaaaaccucagacaauguaaaugaugaaugaauaaacuucuaaaaagccacaaaguaccaaaaguaacucaaaaagaaauagaaaaucugaguaaacugaaaagaaaaaauucuuacaaagagcuuuccacaaaggaaagcugaagcccaaauggcuucaccagugaauucuaucaaacauuuuaaaaaauaacaaaguuucacaaacucuuucagaaaauaggugaaaagggagcacuucacaaaucguuuaaggaggccagaauuacccugagaggcaccagagaaaaacgaaacuacauacacaucaagucccucaggaauagagaugcaaaaauccugaccgaaauaccagcaaauugaguaccacaacaaauaaaaaugauuauacaccauaaccaaguaggauuuauuucaggaauaaaugcaagguuguuugaacaucuaaauaucaauuaauguuaauauaucauauuaauagacuaaagagugagaacaugcucaucucauuagauacauaaaaagcaucagacaacauccaguacccauuuaugacuaaaaacucucagucagaugcaguagcuuaugccuauaaucccagcacuuugggaggcuaagggggauggaucccuugaagcggggaguuugagacccaccugggcaacaaaguaaaaccccaucucuaccaaaaaaaaaaaaaaaaaguuuuaauuagccaaauguggugggcaugugcuuguagucucagcuacccgggagacugaggcuugcuugagcuggggaguuucgaggcugcagugagccaugaucacgccagcagugagccaugaucaugcccguacuccagccugggcaacagaguaagacgcugucucgaaagaaaacaaacaaaaggcugggugcgguggcucacgccuguaaucccagcacuuugggaggccaaggcggguggaucacaaggucaggagaucgagaccauccuggcuaacaguguaaccccaucucuacuaaaaagacaaaaaaauuagccagccauggcgaugggugccuguagucccagcuacuagggaggcugaggcaggagaacagcaugaacccgggaaguggagcuugcacugagcugagauugcgccacugcacuccagccugggcaacagagcaagacuccgucucaaaaaaaaaaaaaccaccucucaacaaacuagaaauagaaaggaacuucuucaacuggaaagggcauguacaaaaaccugcaguaauaucaugcguaagagugaaaaaccgaaugcuuugccccuaagaucaggaacaaggcaaagguagcuacuuuuacuauucaauguacagccaguccagacaggcaagauaaauaaaaauuaaaaaguucacaccggaaagaaagaaagaaaacuguucuuauucacagaugacauaaucuugacauagaaaauccuagggaaaccacacaaaaaacuacgagaaauaaaaaacaaguucagucagguuacagaauacaagaucaauguauuaaaaaaaacucuuguuucuauauacuagcaaugaacaauuuaaaaaaaaaaaucaaagaaaacaauuucauucauaagugagauugaaucagaauaaaauaaccgcuggguguaaugacucacaccuauaaucccaacacucugggaggcugagguaggaagauugcuugaggccaggaguuugagaccagccugggcaacagagcaagauccugucucuacaaaaaauuuguaaaaagccaucuauucauugacuggaagaucuaauauuguuaagauggcaguucuuccccaaauugauuuauagauucaauucaaucccuauggaaaucccagcaggcuuuuuugcaaauguugauagauugacccuaaaauuuaugcagaaaaacuaaaacaauucuugaaauaaaaaagaacuaaguugauggacuuacauuucucagucucaaaccuuaauuacaaugcuacagcacucaagagaaaugauacuggcauaaagauaaacacagaagucaauggaaccaaacuaagacuccagaaauaaacucuuugauuuauggucuacuaauauucaacaagggcgcaauauaauucaacaggggaaagaucaucauuucaaaaaaugaugcugggacaacuucauaagaacacgcaaaaagauaaauuuugacucuuaugcuaauccauacacaaaaaucaacucaaauauacuacaaaccuaaaugcaggagcuaaaacuacaaaacucuuagaggaaaacacagaaaaaaauuuucaugaccugugucaggcaaagauuucuuagauaugacaccaagaauacaaaugauaaaagaaaaaaacugguaagguggacuucaucaaaauuaaaaacuuuuguacauacaaagacacuauuaagaagauaaaaugacaagcacuugcuuggagaaaauauuugcaaauguauaccagaucaaagaaugguagccagaauauaugaagaauuauuaaaucaauagagagaggaaauauaccucaguuuuuuuuaugggcaaaaaaaaauugaauagacauuucaccaaggaauacacauggucaauaagcacaugaaacaauguucaacaucauuacucauuaaggaaaugcguauuaaagccacaaugauagaacuucacaacuauagaaauagcuaugauuaaaaaaaaaaaaacagaauuucaagcguuagcaaggaugagaaaaaacuagaacccugauacauugcuggaggaaauauaaaaugguacagcuauuuuagcaguuucuuaacaaguuaaauauaaauuugacauaugacccagaaaucuacuucuaggucucuauccaaaagagauaaaaagauaugucuacacaaagacuuguacaugaauauucauaccaacacuauucaaaacagccaaaaagugaaaauaauccaaauaaccguuuauuggugaauggauaaacaaacugugguacauauauccauacuauggaauacgcuuuaccaauaaaaauggaaugaaguacugaugcauacuacauggauggaacucaaaaauaugccaagugaaaaaaacaacacacaaaagaccacuuacuguacaauuucauuuauaggaaauauccagaaaaggcaaauauacagagccagaaagcagauuauugguuuuccggggcagggaugggaaaagucacugcaaaugggcacaucagaucugcugggggugauggaaauguucuaaaauuggacuguaauaacagcugcaaaauucuguaaauuuaccaaacaucuuugaacuguaaacuuaaaaugaaugaacuguaugguauguaaauuaaaccuaaauaaaguuuuuuuaaagagguaauaaccuaaauuuuaacuacagcacaagacuauuaacauccuaagagcuuaaauucucuugucccauccuuuauauucaacaaagugccuaucaacaugagugcugaacugaaaaaugaacuagccauaacuaaacgguuuccuccugaauaaucugaauaaaaaccaaacaguccuaaacaauuuuacuaaccagaauuuuguuuagagccugacgauccuccauguucuaccuuuguuuucuucuucuuugacgaugaugaugaugacucagaagaugcugaacguuuuucuacuacaggaguagaaagagcucguuuuuugaacagcucccuuucucucaacaggcuuggauccauaaugcuacaaagaaaaaauaagugucuuuaauacaaauucaagucacucaaaccugcacuccaaauccacagaucucaacaaguuacuucccaaacaaaauuaccuuuuauuauuaguucucuagcacuugcauuuauucacuuauucaaguacucaagaaauauuucauuagcgcuuauuacacgccaagcacuguacuagccauuauaggaaaaaaagaggccaggcauaguggcugaagcacuuugggaagccgaggugggcagacugccugagcccaggaguuggagaccagccuggacaacaugguaauaccuccugucuacaaaaauacaaaaaaucaggcaggcauggugaugugugcuuacagucccagcuacucgggaggcggaagugggaggaucacuucagccuggaaggucaaggcugcagugagcugugauaaugccacugcacucuagccugggugacagaccaagacccuuguucaaaaaaaaaaaaaaaaaagaaagaaagaaaagaaacagaauuauucccuaaaguuccagaacugugcuguccaauauauuagccacuagccacaugugccuauuaaacaugugaaauguggcuaguuaaaauugagauggacuuucaaguguaaaaacccacaagauuucaaagauuuaguauaaagaaaaaaacuauuuaauuacuaacgagauauuuuacauuaauuacauguugaagugauacuauuuugaauauacuggguuaaauaaaauguuaaaauuaauuucaccaauuuuucuuuuaaaauauggcuauuaaaaaaaaauuaagagacagugucucacuguguugcccaggcuggaguacaguggugugaucauagcucaauguagccuugaacuccugggcucaagcaauccucccaccucagccuccugacuagcuaguacuacagguacacgccaccacacacaguuaauuuuuuuaaaaacuuuuuagagacaaggucuugcuauguugcccaggcuggucuugaacuccuggccucaagcaauccuccuaccucagucucccaaagcacuaggauuacaaacaugagccacugcacccagccuagaauauuuuuaauuacacguguggcucacacuucccacucccauuauauuucuauuggacaacacugcuguagaaacaugaggacuacagggcagaaauuagaagaagguggauuuaggcucacugcaaaaaaagagaaccaucagaacugcuuauacauaaaauggcauauuuuuacaacuggugaacucucaauuauuaagugaugaagaggcugaauuauuauacuauuuguuagaaaugucuacagagagccgggcacaguggcucaugucuguaaucccagcacuuugggaggcugagagaccagccugggcaacauagugaaacccuaucucuacgaaauuagccagucauagugacacauacguguaguccgggcuacucagaacgcugagacacgagaacuguuugaguccagcagagguugcaguaagcugagaucccgccacugcccuccagccugggggauacagcaaaacucugucucaaaaaaaaaaaaaaagucuacagaaaauuuccaauuuggagggaggugguuugaggcaacuucuauguugugguuguuguuugucuaguucuaaaauuacaacucaaagcaauuucacuacaaccagggaagcuacaggucaaccaacaagaauucuaaacacaccucucuucugaacucugcuagaacccuacagagggucuaugaagaccucaagcugacuauauaaaugaauuugacacuguuaagacuagugucagcugggaggaaaaagacucauacuuugaaagcuuuuaagcacagauagcucaauaaauauuuguuaaaugaacaacacauggaacaucaucuuuaaauugcucuggucccauuauuacugguuucacaagccuuuauuaaauaucuuguuugugaggcacugugcucuaagcuuugaaagguuacggaagauaaauccuugucuacaugcugcuuagauuugagaaaauggaagcauugagcuaaaaauuuuaaauauaagcauugauaagaaauaaucagacugaauuucaauuaaggcgugaacaaucacuggacggugaaucaaaaaccugccuucucucaguuucaauuuuuuuuucuuuuuuuuugagacagagucucgcucugccgcccaggcuggcagagugcaguggugcaaucucggcucaaugcaaccuccgccuccugggcucaagcgauucuccuggcucagccucccgaguagcugggacuacaggcgcgcagcaccacgccccgccaaugucuguauuuuuaguagagacgggguucauucaccauguuggccaagcugaucuugaacuccugaccucaagugauccgcccaccucagccucccaaagugcuuagauuacaggcgugagucaccgcacccggccucaguuucaauuccuaaagccaccuggcuaggcaacccacaaggccucuacauucaauuucauaagugaaaugaggacgcuaugaaagcuguccacauccagcccaauuguaagaaugagaaaauguguauguuauuuuuuaaacaguaaagucauaaaaacguguuauuucaguauuacuauuuugaguuggaucugaaagaagggaaugauuuaccgggcugaggaaaguaggagacagccuugggaggagggaaagcguggggccaagaagaagaaaggagaauugucaagugagaaggugggagcaaaaaguaaauuucuagaacaggaaacauuugugucuuauuucacguugcaaaggcaggaccucaaucuggacuuuaaaaaaauuacucuaaaagauuuaaauaggccgggcgcagcggcucacgccuguaaucccagcacuuugggaggccgaggagggcggaucacgaggucaggaguucuagacgagucuggccaacauggugaaacuccgucuccauuaaaaauuuaaaaaaugugcagggugucguugcgggugccuguaaucccaacuacuugggaggcugaggcaggagaaucgcuugaaccagggacguggagcuugcaguaagccaagaucgcgccacugcacuccagcccgggcgacagugcgagacuccgucucagaaaaaaaaaaaaaaaaaaguaaauaaagccguacaguuuacaacaaacuaaaugcuuacaguauuugacccucgcaacucuaggagcaaacagguauuaguguuauuccuauuuuaauacgugaaaucugaagugaagcugucugguuaaggucgcacagauggaagagccagggccaggaaccaaaccuccugacuccuaacucaagugcuccuuacaccagaccuggaacgcugguaaaggccuuuaaaacaaaggccaccugugagguucgggaacguucaaaggcaucuagagcagaaagcuucgcaaugucugucuuucaccaucacgugcuccgccuaacuuuuccuccuuuuucaaagacuacccaauauguguacuaaguuuuagaucucuggaccccccuauggaguaaacaggcuacaucaccauguccauuuuacaauuaaacaaaaccacaacucaaggaguuggcugguuccuccgugggcagacacggaaaacccaaaaauuaaacugaaaucugccuccaagcccacgauucuugccaccauucgaccucuuucaaccuuacuacuuccccucucuuucacuuuuacccagccucguuagugucccuggcaccucaggacccggcuaugaaaagcaggcugcuucgcccuuaaaugacggaaguggggaggugggcgaaaagggggccgcagcguuguuuagacugcagaaaucaacuacuaucguuaaaguuuagggaucaucacaaaccaaaucuccaaaagguagccuagaaagcaguccgcguaugagcaucauuuuaaaucacagucuugagcuggcuggaccccgcggcugcucaaacuccacacacgguucgcuuggcuaccgcgcccgugaacuuggaggcuuggaagaggcacagucaggcggcagaccgcgaauuuucccucuuuccaacccaaaaguuugcucaaugaaccucuggccuaaagacaaugcuccggggaacgguucgcgugcuggguguuucgcuucgagaacggcggucccagcuucccgugagguggaggucacgcucagccucccgggaggcggcggcgcgccugcgucccagggaacagcaagccggggcucugcgccccacacccggcggccgcagccccuaccugagugagaagggcagccucgcacgacucgccgcccccuuccugcgccuccgccucggccggccgcccacgccggcacugcacccucuuccugcuucucgucagcgcccccgccugcccgcacgcacgcccagcgcugacccgccaggucggggucucaccacuggcgguggcggcggcggcggcggcagcggcgguagcugaggcggcgacuggacccgggacuccgcccgccacuucccgaucggg

SEQ ID NO: 191862 - RNA, 13014 nt, Homo sapiens
agacagccugguugagauuacucuuggaggaaggcaucaguuaaggacacuggaaaagacaggcucuuuuguucugguuccuaauggaguggcuuuggcuguucuuucuccauccuauaucguuuuaccagggggcugcauuucccuuugcacuucucuucaauuaucucugcaucauggauucauucuccacucgugccagguaggcuggauggcuauuuuuacucuuacauccagaaauacuauagugacugggugcgguggcucacgcccguaaucccugcaauuugggaggcugaggcgggcagaucacuugaggccagggguuugagaacugccuggccaacauagcgaaacccugucucuaaugcaaauacaaaaaaaauuagcugggcaugguggcucaugccuguaguuccagcuccucgggagggaggcaggagaccugcuuaagcccaggagguggagguugcagugagccgagauggcgccauugcacuccagccugggcaacggagcaagccucuaucuaaaaaaaaaaaaaauucagaaauacuauaguagggcaaaaagcagaguagacugcagaugugaagauuacaauauauuaauuacacuuguuuuuaacuuacucucacugucacugauuauugauauuugauaaugaauauauauaacagaguaaaacuaaacuggaaauucacauccuuccugcacugauguaagguuugcuggguucagguuaaauggcagaugagugaaaauaaacucucaggagagaugguuguugcgaugguacaggaauucuccaaauggauacaucucugucaaccauggaucucagauauucuugaauaguccuaauuuuauggaauuuuaucauuuucaaucaaauuaaauuuuauauaaaguuacaucaguauaaguuuuauuauaacuaaaugugauuuuuaaagugccuuuauaugaauucucagagaaaugaaauaagucaaaaugaaucuuguuagauuagcuauaugauaauuugaaguucaaaaauuaucacuagagaugugaugacuugauuguaaugauuuuuuaaauaucaaauaaccucaacacauuagagacagcaccuauuuuuuuagauugcucauauaagauuuuauguuuuuaacauagucaaaaggcaagaacuuaacugaacauagaacagaaauggugaguguacuguuaacauggcuacaugauuuucuguuaaauugaaaagucgcaaauacauuuuuuauuuuauuuauuuuuauauauauauauauauauauauauauauauauauuuuuuuuuuuuuuuuuuuugagacggagucucgcucugucgcccaggcuggagugcaguggcacgaucucggcucacugcaaccuccaccuccuggauucaagggauucuccugccucagccuccccaguaccugggacuauaggugcacaccaccaugcccagcuaauuugaaauacauuuuuaaaaauaauuccaauuuuuauuuuagauucaagggguacauguguagguuuguuacguggguauauuguaugaugcugaggguugggguaugauugaucccaucacccagguagugagcacaguacccaagaguuaguuuuucaacccuuuuucccugacagucccuauuuuuaacaagguuuuguggaauguccuuuuguaaagugaaaaucuguugccaaagggccacuuccuaauaauucacuuauuuugggaauuaggauuuuuauauauugggauucuuaaauaaaauauagcuguaucuaacgaucaguuaggauuguggaauuugauuaaacaaugguaugaucaaguguucacaacugucucauggcccuuaacuucacuaauggagauuggaguugggggacagcuguaaagaaguuuccuuuugagaaagauucucaaaacaauaaagcaacaugagugcaaaaauaaggauuaauccucauggaguuaccuuagggugaagauugcucaguuucuggcuggaugcaguggcucacaccuguaaucccaguaacugggaggcagaggcaaguggauagcuugagcccaggaguuugagaccugcccgggcaacaugacaaaaucccugucucuacaaaaaguacaaaaaauuagccaaguguggugguacaugccuguagucccggcuacuuaggagccugaggcaggaggaucccuugagcccaagagguugagguuguaguaagucgugauuaugccacugcacuccagccugggcagcagggagagacucugucaaaaaaauaaaaauaaaauaaaaaagacuucucacuuuggauucagccuguugagucuugacucccucaccuaacuaaguguccuuguguauaucaauauacuucacccaaaugcccucuucuuaucuguagaacagaaaacauaaugccuaucucaugggguuauuuuaaguauuaaauaaauauauuucucguaaaggguuauuagcacuaugccuagaaugaaauaugcaaucgcuaagucacacauugcuaagucacacauucuacauuguccauguacagacaauuuaauguuuauaaaucuccuaggggaguugccugugggugggaguguugcuguguaaaggauaaauguucccccuuuuguuuucccauagcagggaaguaaaggcuuggaccacaauguuaacugggguguugaggggggaagucaccccaagcauagguucaaagagaagcacaagaaugguccaggcuuuugagucauagaugcucucacacugagacacuuaacgcucucccccaaggaaaaaagugguucuugcuaaccuguacuuggcacugugcccggagccgugacacacauuugccuugcaaugguguuuccugguucugagcugguagagaaauccuaggcuucuuugagucgcuuucccagcgagucaaaaggaccagugaguccuuuuuucuuuucuuuuauuuucgcuuuucuuuucuuucuuuucuuuucuuuuugaaacagagucucucucugucacccaggcuggaaugcagcagugcgaucucagcucacugcaaccucugccuccugagcucaagcgauucuccugccucagccuccugaguagcugggauuacaggggcccgccaccauacccuacuaauuuuuuuuguauuuuuaguagagacaggguuucaccauguuagccaggcuggccucgaacuccugacuucaagugaucugccugccucagccucccaaagugcugggauuacaagcaugagccaccacgcccugcuauuccacacuuuuucugaccccuucauucaguuuuauuaacuaggcaccaauuaaaaaacaagccuccauauaaugcagaaggaagaaccaagugugcguaaugugaagcuucccaggccucugcagaucugcaucuccuuggcuucugagagaggcaugauucacaaaccauuucaucaauguggguauuuuacaacauuaaaaaaacaauggccaggcacccuggcucaugccuguaaucccaggacuuugagaagcugaggcaagaggauugcaugagucugggaguucaagaccagccugggcaacauggcaaauccccaucucuacaaaaaauauuaaaaaaauuagccagguaugguggugcgugucgauagucccaguuacuagggaggcugaggugggaggauuucuugagccgggggggucaaggcugcagugagucaugaucgugccacugcacuccagccugggcaacagggacccugucucaaaaacaagacaaaacacugcucuuuuccucccuggccaccugaaaauuggccacuaucaugaaagacacagcagcuacccauucaaaggaguucuuaaucaacugacaacuuugguggaaacauacggucguggucacccuucacucugggaaggcaacaguaauaagaaagaaauuugggaaaaaccagccaaaauguacaagaucucauggacaugauauauaagauggagaucgucuuuguuuagauucugaccccauuuuguuguagcaagauaaguggcaugauuuaugauucccuggauuauguaaagaaaagugaacccaagcauaaacuugcaagacauagcccagaugagagaaaaagacaucaagaaaacagcaaaaggaaugcaaggacagaaugaagaaagucagggggccccaaaagccaguguuggugcugacaaaaaagaguccagauucugcaguggccgggcgcgauggcuuaugccuguaaccccagcauuuugggaggcugaggugggcggaucaccuuagguacagugucuaagacuguaccaggaguucaagacagcgucuaagacugaggccaggaguuagagaccagccuggccaacauggcaaaacuccaucucuacuaaaaauacaaaaauuagccaggcaugguggcaggugccuguaaucccagcuacucaggaggcugaggcaggagaauugcuugaacccaggagacggagguugcagugagcaacaucgcaccucugcacuccaauccgggcaacagagcgagacucugucuaaaaaaaaagauucugcaaugacuucaucugcggugauugugcagauuuuucgugacaggauauaauaaacuguaacaacuuuuuggguuuuuuuagagacaagauuuugcacuguuacccaagcugaaguguaauggugucaucaucgcucaagugcagccucuaacucaugggcucaagugauccucccaccucagacuccugaguagcuaggacuacaggugugccaccaugcauggcuauuaaacaaauuuuuuuuuuguagagaugggaucuugcuauauugcccaggcuggucucaaacucuggccucaagugaucuucccuccuuggccucccaaagugcugagauuacaggugugagccacugugccuggccuaaacuuuaauaaguauaaacuuuaauaaaacaaaacaaaauccuaacucauaagaucuuaaagugcaguaguaaggaugaaggguggauauaaagauuuuucugaguuuucacuuuucgaagggaaguguugagucuccuuucucugucagccucuggaaugcuuccggguagcacgacccugugaaaaggaagguacuugucuugagaggaugccuagggcgcucuucuagauccuugacacuagguucacagcacuuuucagucagaugacguaccaggagauuucaaagauguccuugcuagccagacuuccaggacggucaggggcaggcgguggaauaccuugggagggaaucgcuugaauggagggcaucaaagagagguuccagggccacuaaggcaggaacugagauuugucuccaggccagggggguggcucaugccugcaauuguaggauuuugggaggccgagggaggaggaucgcuugaggccaagaguuugagacugggcgacacaccaagaccccaucucuaaaaaaauaaaaagcuaaccaggcaugguggugcaugccuguagucccucccagguaggaggaucacuugaguccaggaggucagggcuguggugagccaugauugcaacucuauacucacccugggugacagagagagacccugucucaaaaaaaaaaaaaagauuugucuccaagguggaaauuuacaaauuuacccuggcuccuucucccgugauucuuuucuucugaagaacaaaaggaaggccccagagugcaaacagcauggcuacuuuagguguuguguggggccuaccagaucggguucccuggagugacaucugcaguaauuccuuugcugugccguucuaagucauucuccccaaggugucccuucucuuucagguaccucuuucuccugacuggaggaggugcccuggccguggcugccauggguuccuacgccgugcucgucuucaccccugcugucugcgcuguggcucuccucuguucccuggcuccucagcaaguccacagguggaccuucugcuuucagaugagcuggcagaccuugugucaccuaggucugcacuacacugaguauuaucugcaugagccuccuucugugagguaagcagccuguucguuggucaugcucagcccaccuacaguuugcuugcaccacggugguagcagagagaaccuggguguuggguuggaguccuaauuuuuccacauuugaccagugugaccuugagcaagucauuuuaccucuuucagacucauuucuuuuucuggaaaagauauggggcuaacaauacuguguugcaagauuguugugaauguuaguguaaccgcccaguggguucaccuucuccacugccuagacaaacaggggaauugcaguaaagaaagaguaauucacagagagcuggcugugcgggagacaggccaguuuuauuauuacuccaagcuuugggguaaucauaaucaguuucccugagcauuuggggaucugaguuuuuaaggauaauuugguggguagggggaggccagugaguugacagugccgcuugguuggguuggagaugaaaucauagggagucagaacagucuucuugcauugagucagcuccugggugggggccacaagauaagacgagccaguuuaucggucuggguaguaccagcugauccaucaagggcagggucuacaaaacaucucaagcacugauguuaggccuuagaauaguaauguuauccccaggagcaauuggaggagugucagaaucuugucaucuccagcugcaugacuccuaaaccauaauuucuaaucuuucggcuaauuuguuaauccuacaaaggcagucuaguuuccaggcaagaaggggguuuguuuugggaaaggucugugauugucuuuguuuuaaacuguaagcuauuaacuaaguuccucccaaaaugagucccgggaaugaacaaggacagcuuggagguuagaagcaagauggaguugguuaggucagacuucuuucacugucucaguuauaauuuugcaauggcaguuucauuagaaugaauauaaaugugauuuugugacuaaucaucacugccacguguugccuacauggugcagugucuggcacugagcaguaguugucauugugccugagagggagggcaaagcaggaauccuagagcccacagagcaggccugcccagaagugacucagcacugucugccagccucagcacggguugaguggacacucugcuugcagguaacaaucuucucauggcggcugcugggagaggcagcugcugugucaguguuucucuuccuucagacucagcuguucccaucuugcugaagaaggguaggcgccccaucuagaaaacagaaaucaagagcuaauuacagucuagagaaguguugucaugaaucagcaagaucccugagaugagaggaaacauugcuuugugaucuggagaucucauguuccuggcucucucuggugaucacaauuggcuucagggucacuuggagcacagaggcugugaugcuccaggcggucaccuaucugauucuagccugcgguugguucacuugcuuugccauccuccugacuauaccuagaauuuuuuuuuuuaauuuuccuguaaagacuauuuucagccaggcacaguggcucacuccuguaaucccaacacuuugggaggcugaggcaggcagaucacuugaggccaggaguucaagaccagccuggccaacauggcaaaaccccgucucugcuaaaaauacaaaaauuagcugggcauaguggcggacgccuggaaucccagcuacucgggaggcugagacaggagaucgcaucacugcacuccagccugggugacagagggagacacugucucaaaaaaaaaaaaaaaaguucggggggagagacuauuuucaccaaaggcuucagguuggcugcucuaaggaaaaggcaagauggcagguggguggggcguaggaaguaccaaaugggauggagugaaucaggauuucaguagggagcuggggccugauggggcugggagagcaaguugaacaggaucuggcuggaugcgaggcaggcuggagcagaccuggaauggggggcucugcuagucgggcagggcugcugccaucacacagugccacagacuggguggcucaaacaacagaaauucauuuccucacaguucuggaggcuggaagucacugaugaugacgucagcagggcuggguucuucugaggccauucucguggcuugcggguggcagugucccuguauguccgcgugauggucacuccucugucugugcaugugucuguguccuaauugucuguucucauaaggacucugugcauauuggauuagcgcccauccuaaugaccucauuuaaccuuaaucacaucuuuaaagacccuaacuccauauacagucacauucugagguacugggguuagaccauaagcacaggaauuuugggggcacauucaguccauaauagagagugaaugagcaggguuugguggcauuuggaggcuaccuugcuuucagugagaaucagucaagugacggggucaguuuuucuuaaaucuucagacacauggauagaaacagcagcaguuagaagacuguuguuuucucuccacaggacagcauuucugacuguagagugugucauuguaauuuucuuuccuuuuuuuuuuuuuuuucagacaaggucucacucuguugcccaggcuggagcacaguggcaugcucauggcucacugcagccucgaccuccugggcucaagcaauccucccaccucagccuccucaguagcugggaccacaggcaugcaccaccacaucgggcuaauuuucauauuuuuuguagaaacgggguuuugccauguugcccaggcuggucucaaacuccugggcucaagugaucagcccaccucaccucagccucccaaagugcugggauuacaggugugagccauugugcccagccuaauuuucauucauuguucuccucaauaaucuugccagugggaucuuugauggugaagcaguaagagcucaggugauugguuaaggccauauuucaaauugcuaauggcucagcacacauugugauccauuccucaguacaaaucccacauuaggcaaaguccuacagccagggccugguucguauuuaaaaucuucagcuuccuaucuuuucuucacuaccgaguuuuuauuuccucuacggcaaauuucucccaagucucugauccuaaucuuuguaggccuuucuuggaaauauuauaaucaacauuucccacaauguuccucaucauucucuuauuugcaucucuaauguuuaauuuccccauuuacaugauccugccugaugucacccuaaauaacaaauaggaagagucucccuaaaagaaaaugauggggcugggcacaguggcucacgccuauaaucccagcccuuugggaggcugagguggguggaucacuugaggccaggaguuugagacuagccaggccaacauagugaaaucccaucucuacaaaaaaaaaaaaaaaacccacaaaaauuaacuaggcgugguagcgcaugucugaaguuccagcuucucaggagggagaggugggaggaucacuugagucugggaggcagagguugcagugagccaggauggugccacugcacuccagccugggugauagagugagaccgugucucaggaaaaacaaaacaagagaaaagaaaagaaaaaagaaaaggaugcuuauggcugggagcaguggcucacaccuguaauccuagcacuuugggaggccgaggcgggcagaucuccugagaugaggaguucaagaccagccuggcagacauggcgaaacccugucucuacuaaaaauacaaaaauuagcugggcgugguggcgugcaccuguaauuccagcuacucaggaugcugaagcaggagaaucgcuugaagccaggaggcagcagagguugcagugggcggcugagaucgcgccacugcacuccagccugggccauagaaugagacucugucuccaaaaaaauaaaaaaagaaaaugauacuuauuuaggaauugggcauuacagugggaauaugugugccaucguauguguuuucagguagguaaaggaagacaaaguuuuuuuuuguuuuuuuuuuuguuuuguuuuuuugagaugcagucucgcucuaucaccaggcuggaaugcagugacacaaucucggcucacugcaaccuccgccucccagguuccagugacucuccugccucagccucccgaguagcuaggacuacaggugugcaccaccacacccagcuaauuuuuguauuuuuaguagaaaugagguuucaccauaucggccaggauggucucgaucucuugaccucgugauccaccugccucggccucccaaagugcugggauuacaggcgugagccaccacacccagcugguaagagaaaguuuuuuaagagaaaaauaaggagcauuacauaauuguuuugaaaucauuaucuuugaguacaggcucaaugacaagggugaugucagucugugguugggcaggaaguggcugggcaggugaccucacaaaaguauuuuuuuguauaggguugcaaugguuguuaugcaagguugugguuuuugcagucuuuugugguaguuuuuguuaucagacauacaagcauugagaacccucucuucauaccuuuuccuggcucuguuugucagaaguguuuuguuuuguuuugcuuuuuaacacaagugacuucauuuucuuuucucuuucuuuuuuuuuuuuuuuuugagacagggucucacuuggauguguaggcuggagugcaguggugcaaucauagcucacugcagccuugaacuccugggcucaaggguuccacccacgucagccucccaaagugaugggacccacugcacccagccaugauuccauuuuuauucccacaacuuucaaauuggaguagugugugguucugaauuaauucaagaaccuucagcuguuaaaguaaaauuucccaggcaaauucuccuauucaggauggaagauuucaggauggaagaugggauggaucucugagaucccugggaagcuucucaaguugaacaugcguguaaaugugugcaucuaaccuuuucuuuaaaacaaacaaaaaauauauaugcaaauauacacacauauucauacagauauacauaugcuuauuuauaaaacacacaugaucauuacaaaaaauucaaacaacgcaaaaagugaaagauuuuuuacgcuaauuucauucccuagagguaacuauucuuaaaaguuugggguauauuagucuagacuuaagcuccacuguauacuuaagaucuauaaauauugccaggggcgguggcucaugccuguaaucccagcacucugggaggccgagacaggcagauugcuuaagcccaggaguuucagaucagccugggcaacauagugagaccccaugucuauaaaaaaauaaauaaauaagauugauuuauuuuauuuuaagauuuauuuugugugggguccugcaggccaugagauuaaucuuagcuguacagaccuaucuauuuccugcgagaucauguaugacagacuggaauaagagagagagaauaaauacagaguguuuuuauguucuuuaaaaaauuaucuugcagguucugcaucacucuuucuucucucaugcucuugacccagagggucacgucccucucucuggacauuugugaggggaaagugaaggcagcaucuggaggcuucaggagcaggagcucuuugucugagcauguguguaaggcacugcccuauuucagcuacuugcucuuuuucccugcucuccugggaggcucucugugcuccuuccagcgauuucaggcucguguucaaggguccagugcuuugcaucccagacacucuuucugggcucugagcuggaggggucugcagauucuuggacuagaaugccuaaacguggcagugagcagggugguggaugcaggagcgggacugacugauugccagcaauucgagugcaucuaugucguguggaccacagcugggcuuuucaagcucaccuacuacucccacuggauccuggacgacucccuccuccacgcagcgggcuuugggccugagcuuggucagagcccuggagaggagggauauguccccgaugcagacaucuggacccuggaaagaacccacaggauaucuguguucucaagaaaguggaaccaaagcacagcucgauggcuccgacggcuuguauuccagcacagcagggcuuggccguuguugcagacauuugccuucucugccugguggcauggacuccauccaggacagguguuugguuucguuugcugggccgugaugguggaagcugacuaccugauucacuccuuugccaaugaguuuaucagauccuggccgaugaggcuguucuauagaacccucaccugggcccacacccaguugaucauugccuacaucaugcuggcuguggaggucaggagucucuccucucucugguugcucuguaauucguacaacagugucuuucccaugguguacuguauucugcuuuugcuauuggcgaagagaaagcacaaauguaacugacaucuuucccuggcuuucaccuuaaacacccaggaaacauuuuagaaagugccagaugacgcaucgauaaugcauacauuugaacuuuuccauaauaaaauuuuuucuaaaguuuuggauggauauacccagugacuugcaguaggaauuuguguaucuacuuuagcaagcuauucugcugguacugaggauacaaaaaggaaaaagaugugguuucuucccuuaagguuuacagucuagauguggaagcaaagauuaaguaaagugauaca

SEQ ID NO: 191863 - RNA, 51133 nt, Homo sapiens
gcagagggggcggagagcgcccccgggggcggggcacgcaagugacggcggcgcgggugguggagcgcugggcggccaggcucccuggcuggccgguuugggcgucugggccgugaaggugggaccuccuguuccgggccgcaaguuucccucuccagccgcccgccguucguagcaugucccccagaacucggggagcgcaggcaggacaggcuuagagaagacgcgguccccagcgcuugggccacggacgucccaccccgcuccucugucgcuggagaaccgccgggccgagccacugggagaagcaggccagagccuuccagggccuccggcccguggacccgaggaggaugagcuggcuuuuuccccugaccaagagcgccuccuccuccgcggcugggucccccgguggccucaccagccuccagcagcagaagcagcgccugaucgagucccuccggaacucacacuccaggugacuggucgcugccucuccaccggaggaaaaaguagggugggagggcgggcuuguccuaaccacccucacagcgccucagucugcuccccaccagcuccucaugugguuuaccucccuugguugugggucacacgcuugcucugccacuccugcccccuuuuacuguuuuccuccggacccucccugccuccugccgcaccacugcucagcgcuucuaacucggauuuccucaucccuccugacacauagcugcugacuguaaucucucaaucucucucauagucuauuuccaguaucccuugcugcccaggcuucgccacugaucuuucccuuugcccaccugauugccgcgucagcagaauuguuaaaauacaauugugaagaguaaucuccagguuucacaaagaauggaaaauagaacuguugcaacaucaaaggaaagggaagccagaguuuucaucagugaaugcuucucgucugagagucacuuaucacguagucagucuucuugagucucuaagauuuacccuguuggagcagucucuccccaucucacagcgaccagugcauguacauuucucacuucuuucauagucuuguccccacgcucaagaauuacuuuauguucaucuugauuguucuguugucuuccugugaguuuuucauuuuaucauggucaguuuagaaauauuuuuacaauucauauuauuucaacuuuuacuguaaauugguuugcugcagccuuuuacauugcaaaugucuauggucucuaaugguuuucaaaaauuagaacugcuucuuuauauuuuaugcauuuugcaaguauauuuacuuaacaguuucacacuauuuuaaauaaagaugacaacauuguuaagucccuaaccccuuuuuuuuuuuuuuuuuuugccggggguacggcucuccuguugcccaggcuggagcgcaguggcgcgaucucgguucacugcaaccuccgucucccggauucaagcaaucauccucccucagcuccccacaccccuccgaguagcugggauuacaggugcgcgccaccaugcgcggcuaauauuuuguauuuuuaguagagacgggguuucaccacauuggucaggcuggucucgaacuccugaccuuagauuauccacccgcuucggccucccaaagugcugggauuacaggaauaagccaccucgccgggcuccuagcccuuuuaaaaauauuauuuucauacaguuaaaaaauauguauccucagauaauaucgaauaauucuuauuuaaaauggaauaauuuuuaauuaaauagucuaguuaauagaaaaauuuacugcaaaaucaguuuggcuaaaauaaggccugaugcugacugaacuuuagguguuucuugguucguugucucaauuguucuguuuguucagaacuuucaaaaggugaaauuuuaugcuguuuaacagaaaagaauggcaggcuguuauugguggcuuucauucuggaaaauuaaguucgcaaaguucuuacaagucacucuuacuccaaaucauguucuguacugaccuuuaagagcuacucucacaagguaugcuuauaaaauaaggggacucguuuuuaacauguuuguucccuuagaaguuguuaccuugguagacuauauaccaaaccaguccugcuauugcagaaacacuuuuuuagaaccacacuuuuggaauuaauugcuuuuaaaccuuaguauguaguauuauguuaaauauuuucaaugcugacuaauuuuuuucuucgagguuggaguuuaauuuuuuaaauacuacaaagucucuugcugcuaaggcugguaaguaagggaaguaauugaugugaaauuuauaauuuuggccucccaaauaaagugagauucuauagcagcaauuguuaauguaaagaguucuggaauuggcuuaagaggaucaguaaauacgcggaguuggauacagaaaggauucauuuuauguauuauuuuuugaaccagaaauuaugaacguaugauuggacaugauuacauuagauaauguaauuuauuuuguaguguuaugaacaaauaacuaaguauuuuauuguuuuaaguucuuuuauaaaaacacuugaaguuuuauugagauguuucgcauuuacaaauuauacucgaauaauuccggagacacuuaaguaggucauaugcuuccaguuuucaaagaauggcacaauccuggaaaaugccacucaccuauucuuguuaguccacccuuuuaaauaaugacauauauuuguaagcugggagguaaaaaauaaucugucuguaugguaucugauguaaagauggaaaaggugugauauuuuuucucaucagucauaaggggcacagcugacccuccuguaacaaaagacagguuaacaagcgaaaagcauaacagauuuauuuaaucaaaguuuuacacugcaugggagccuucagaaaugaagccccagagaccgaaggaaaacugucuguauuuaugauuagguucaaugaagaauggacagccauguagaaaugugauuggacaaaaagaguaugguaaugguaauagacagagguaggggaaacccaccaaggccuguuuguucagauuuuucuuggcuucucuguauaacuuucuacuccucuaguggaccggcccgggcucauauggagugagggucuucagggcggaagggaaagugaccuuucuagauuuuuuguagggaagaaggguuguaguuuguaauauaccgcccaggggaggaggaauucugguuucuaugacuucuucaauggagaaagaggggcaggagguggucagagagagcuuuacuucugaggcccuccagacuccuuuaauucaaaguaaucagccuaccaaagugcaauauuuugggguauuguuuucugagccccaauacuggcaauauguugccugauuaccuaaauuagugguacgacuuacacuuaaaagauuuuugugcgaacagacagauugguuauucuaaaggugugguguguaaaaguugaaagaauuuccaguguguuuuuuccuaugaacaguacaaaaacuuguuacaugaggaauaucaauaucuuguuacaugcuguccaucucccucauguuucguuuuaugucucuucuccaaauguaagcucaauaggugaauaucuuuuuuuggccaugaaaguaucuuuucuucugcucuacugaguaaccuuucucuaccccauucugucaucucccuuccaacucuuacaauuuuuaaccccuuauaauuccgaaaauuccacuucagcagucucuuuuugucccuuucucuaaugauugugaacuuuuuaguugccuuaaauucuuaucuccucagcuaccucagucuucuacaaaaaaaauaggugaauuuuauguaaauuuuuucaucugagucucaacaauaugcacggcaaaugagauaacugucauagaugacacucacagaaaaguguuuaaccaaaguguuuaagucagcugugaaaauggaaacuagaaauuaugccuccugggcucaaguaauauguucucucuucuaaguaucacuuaccacaguauucaguuuaucaccaaaacuccugacuuuauggacaggaguagaacuaauucuguuucuuauacuuccugaggaagcugacuuuauggacacuguugguuuuucccucugcaaggcccauacuuuguggaggcuggaaucuuucaacccagccuccacuagaggugaauaaggauuguuuaugccagugaugauggucucaucacccuuccccccaaguuacuguggaagcaggacucuugguuagugggaguuggaggggaagucugcuggggagcugcucaaaauguuuucucagcaauaguaacaaaugacugggaggaagaaaugucucauguuuuggauauuuuuaugugagacaacccugauccuccaauuccuaucuguaaaaucagcaauugugauuccugucaugcaggauuuuugauaacuaaaaaauauauguaagacauuuggaagaguaucuagcacauaguaggcauaggacgaauuacauuccuucuuucuacugcauagaaucagugugcuugaaucuuugccucuuagccuauaagcuucuagccagcuuauuguuuguagaucucucauaagcuuaccuacaacuuaucugucucuggcagaacuacuucugacuuuccauuuagaaagcaaguccauuccagacaguuaguuucuucauaaaauuaggcaugaugcagguaaauaaccuaaauuauuaucuugcacacaggagauguaaacagcaauuguuacuguauuuuguucuugucccuaucuuuaaaauaguagugccauucucccuagucuuuaaaauuuguuuuaauauuuucuuuugcugccagucugcggauuccguuguucugauugccuaaauguuuagccuuaaaacuucuuguagagucagcucuuguauaguucucccccacagcugcuaagcuuaacguuuugaucacagcuauaagacuuugucccccuaucucaugggauucugaguaagcuuaaauuccaugcucuuguuucuauagaauucauucucagcucaugaggacucacacacaaacuugguaacacaagagauauuguaaugaagggauguguaugucuguguuucaacccgucgcauguuauauauuuuuaugaaaagcauuuauuaucaacagucaaaauuugcaauuuuuguauuaaaauuuccagguuuccuuuuuauuuauuuauuuuuugagacagggucucacucuguuacccaggcuagagugcaguggcacgaucacagcuuaccgcagcaauccucccaccucagcuucccaaguagcuggaacuacaggcacaugccaucaugccuggcucauaaguuuaauuacuuuuguuguuguuguuguuguuuugguagagaugggguuuugcuauguugcccaggcuugucucucaaacuccugggcccaagcacucugccuggcuuggccucccaaagugcuaggaugacaggcaugagcugccacacccagcccaauuuuucuuuauuuaauagacuuuauuuuuaguguaguuuuauguucacagcaaaauuaaaaggcagaagauuuccccuauguccccugucgucucuaacucuucuuuuaaaauggaaaaucuggaaagauugguuuccacauagcaacauuugcuucaagcugaagaguagcugucugcuuugcugggcuacccacuacccauuucacuaguuugcaauucacucccuguuggacuacaaggagcugccuucauucauguguguuaccucgcugguguaguuauuugauaggaaaacuucuuuauggaaggaaauaacauuaacuuguaauaaaaaauucuacaagcaucuguuaugccuuagcccauugaagcuacagaaaucuccaaaauaucaacauuuugacuguguaaaugcacuuugagcucuauauaguaaacuuuaaaauuaugcguaucaauccuguaauuaaguuaaaacuuugacacauuaaauuauauugucuauuuguaaccagugauuaagacguauaauugcagagcguaugacgcaauaaagcaugguaccauuuaagaaauaucauacagcucaagugcucaguuaauuuucucauuagaaauauuaguccguuacugcuuuaaaaaaaaguuaugauaaggcagucauuucuccauugcuaguuaaaucagcuacaucugccccuccccccaaccugaacuccuuccaaaccauuucugcuguuugcucaccuaagccgaaaaccugugccgucuuccauuuccauucagucuuccaugucuacuaccacaagguucuaacaguucucucugccuccagccuuuuucccucugccuuuucuuccacauugcugccagaguaaucuuucuaaaauucaaauuugaccaugucacuccuuucaguaguuuccuaacucuugucaaaaaaggccagccaccuuaacuugauuccugguugucacagaagauggugaugugacugguggaaagauaucaacaaacagaauguaacguuucauauauggcaaaggcuauggagacuuuuggagaacuuguguuauuuuguaucugaagcuuuucugauagggcuucuccauuuaaaauguacacuguauuucccugauuuacuuuucugaguauuaacucuuuuaaauguaacucagauauuauuuuuuccagaagaccccacugccgcuagguuaggugcuuucuucuguguuuucauagcucuuuguacaucucagucauuaucauguguucuauuaaaaaaaugugaaauaagugcuccauguuaacacagauuucgaaaacaaacacaauuuacuuuggaauuucucaaaaucuuuaaugugcuaaaguggaucagcauucuccaagagacagcuauaguaugaaggauuuuccaaacaacacugaaccauuuuuggagcuauuuguuuuaaauuuccaguuucuugcuuuuucauucuuauaucaguuguguaaguaugugugugugugcaagugcuguugucuuuuguuguucugauauuacauaaauuuauagucaucuugucuuugcucuugaguuuuuuauguuucaauuuguugaauuuggugcacaguuugcgugauuuuuuuuuauucaaaccuuuaugacguucucguuucuguauuugagcuucccuguugacuuguuugugaauacuuacuguuugccauagucugcuucuggugaugaagaauaagaaugacgaguccuuagguagggcaaguugauaguuaucuucuggaaaaggaggcuuccuggggagucaguagcugucaugggguuaguaacuuccugaggagucuccgcuagcuuagaggcugucucuguguuaaucugaaugcaaauauuacugcuauuuaccagcaacaagcuggaaacaagcuaggaaaagaggcuaauucccuagccuaccugcugcuccacgaaugucacccuguugauuaauuacucugagaaaugcuccugaccugccuucuuccccccaaacucuuaguuugcauugaccugguucaagggcuuagaggaccuucaaacugcuccaaacuuuauauuggacuuauguuuuggauugugauuuuuuuccuuguuuacuuucuuuuucuucuuuuuuuuuuaaauguucacuccuuucuuacauguaauccuuucuguuugucaguuugcucaaaauuuaucuguauaugguaguuuuugcuuuucagcacuguuauggauuugcuuuuuaaaaaucuguuuuguacuucuaucaaaacaucacaaguaccccauaaauauguauaacuauuauguauccauaauaauuaaaaauaaaaaaucuguuuugauuuuuuuaucuaaaucauagagauuuagauaggauguuugucugucuguucuccaucuauucuaagcacuugaaucuuuuauuugcaagauucaccuauaaacguuacuugaguuacccaacacugaggaaaaugcaugacaucauuaucuugaauugaucuuuuuaguaacuugaguuucucaucacacuguaugcucauucagagcacaaaacaccccauauucaucucuguauuuccauuuccuugcaggaugcuggauauaugguugguguucaguuaaacugagucuuaugaaaucaaacuaaauauaaacauaaauacaaaauauaaacuaagugggcuggcugcaguggcucacugagcgccuguaaucccagcacuuugggaggcugaagcggguggaucgccugaggucaggaguucgagaccagccuggccaacauggugaaacccugucucuacuaaaaauauaaauauuagccgggcaugguagcaggcgccuguaaucccagcuacucgggaggcugaggcaggacaaucacgugaaccugggaggcagagguugcagugagcugagauagugacauugcacuccagccugggcaacgagagugagacuucgucuuaaauauauauauguguguguguguguguauguguauauauguguguauauauauaaacuaagugauaaauuauuguuuauucuguaaaaggaagcuucagaaauagugccucuguugcauuuuuaaaucuuuuaaaauugauacaugauagcuguacaaacacuaggucuuauuucuuuuaucaacuguauauuuaaacucacuaauuaauuucauuuccccuccuguuuacccuuccuagugucuggaaccaucacgcuacuuucuuucuuuguggaucuacuuuuuuagcuuucacauaugcaauguuugucuuuuuguguuugguuuaugucacuuaacguaaugacuuccaguuccacucauguugcuguaaaugacaggauuucauccuuuuuuauggugggauaauauucuguuguguauuaugccacauuuucuuuauccauucauuuguugauguguacuuaaauuuauuacauauuuuggcuguugugaauagugcugcaauaaacgugggagugcagcuaucucuuugauuuuuuuucuuuauuuuggcaauauacccaguagcagaauugcugaaucauauggcaguuucauuuuuuuuuucaagguucuaaaggugcagagauauuguuagucuuuugaggaaccuccauacuguucuccauagcagacuccaaauuaguuguacuaauuuacauucccaccagcaguauaucaggguuccccugucuccaaauccuugccagcauucguuauugccuggcuuuuugauaaaagucuuuuuagcugggguaaaaugauuuuuuuuuuuuuuuuuuuuuuuuuuuuggagauagggucccacuguuuguugcccagacuaaucuggaacuccugggcucaaggagucccacuucagucuugcacguaacuggguuuacaggcgcacaccaccacacccuguaugcugcuuuugagaaauguuuguugagaucuuuugccaauguuuaaaucacauuauuuguuuuucugcuuuugaguuguuugaacuccucauguauucgguaguuaauccuuugucagauggauaguuuacaaaaguuuucucccguuuuuuggguugucucuuuacuuuguugauuguuccuucgcuguguagguuuuauuuauuuauuuauuuauuuauuuauuuauuuauuggaaauggaguuucacuuuuguugcucaggcuggagugcaauggcacugucucggcucaccacaaccuccgccucccggauucaagcaauuuuccugccucagccuuccaaguagcugggauuacaggcacucaccaccacacccggcuaauuuuguaucuuuaguagagacaggguuucuccauguuggucaggcuggucucaaacuccugaccucagaugaucggccugccuuggccucacuguguagguuuuuagcuugauguaaucccauuuaucuguuucugcuuuagaugccugugcuuuugaggucuuacacaaaauuguuugccuagaacaauguacugaagcauuuccucaauguuuucuucuaguaguuccauaguuucaggucuuagauuuaagucauuaauccauucuuauuugauuuuuguguaugguaagagauagggucuaguuucauucuucagcauauaguuacccaauuuucccagcaccguuuauugaaaacaucauccuuucuccguuguauguucuuggugcuuuuguuaagaugaguuggcuguaaauuauauuuggguuccuuguuuugcuccauuggucuguguguuuguuuuuaggccaguagcaugugauuugguuacuauaacuuugcaguaaauuuugaagcuggauagauagugugaugccuccaaccuuguucuuuuugcucagaguugcuucagcuauucagggucuugugaguccauauaaauauuaggauuaugaacagugaaaacacauggauacagggaggggaacaucacacaccggggccugucagggggcguuaggggagggauagcauuaggagaaauaccuaauguaggugacggguugaugggugcagcaaaccaccauggcacguguauaccuauguaacaaaacugcacauucugcacauguacuccagaaccuaaaguauaauuuguaaaaaaauugugauuguuucuauuucugugaagaaugucauugguauuuugcuagggauugcuccaaaucuguaauuugcuuuggguaguauugucauuuuaauaguauuuauuccuccagccacaagcauggaauauguuuccauuuuuuuuguacauguccucuucaauuucuuucaucaguguucuauaguuuuccuuguuuagauguuucacuucuuagguaaaauuguuugcuagguauuuuauauucuuuguaacuauuguaacuaggauuacuuuuuucuuuagauuguuuauuguuagcauauguaaaugccacuaauuuuuguauguuaauuuuguauccugcaacuuuacugaauugguuuaucauuucuaacagguuuuuuguuugucuguuuuuuugguggggucuuuagguuuuuccagucguaacauugugucauccgcgaacaaggcuaauuuaacuucucuuuuccauuuuagaugcuguuuauuucuaucucuugccuaauugcucuggccaagacuuccacuauuauauuggauaaaaguuugaaagugggcaugcuugucuuauucuagaucuuagaggaaaggccuucaguuuuuccacauucacuauaaugucaacugugguuuguuauauauggccuuuauuauuuugauguauauuccuucuauacccaguucgaugaggguuguaaucacaaaggauuuuauugagugcuuuuucagcaucuguugaaacaaucauuuguuuuuuguucuugguucucuuaauggauauaucacauuuauugauuugcauauauauugcacuguccuugcauuccugggguaauaccaccugauaauggugaaugaucuuuuuuaauguuuugucgaauuugguuugcuaguauuuuguucaggaguuuuguauguauguuaaucuguaauauuggccuguaguuuucuuuuuucuuguuucuaugggugaugcugaucuuguagaaugaguuuggaaguaguccuucuucaauuuuuuugaagcaugaguagaauuguuauuaguucuuuaaguguuugguagaauucaccagcgaagcuaucagguccucagcuuuucuuugaugugagacuuuuuauuauggcuuuaaucucauuauuauuggcuuauugaaguuuucuauuuuaucaugguuuaaucuuaguagguuguauauguccggcaauuuguuccuuucuuuuaggcuuuccaguuuuuuagcauauaauucauaguggugccuaaugauucuuuauaguucuguggucucaguugucacaucuucuuuuucauugugacuucauuuauuugggucuucucuccuaguucaucuagcuaaaggcuugaugauuuuaucuuuucaaauaaccaacuuuucauuuucuugaucuuuuguauuuuuggucucaacuucauugauuucugcucugauauuuauauuuuuucuccuuuuagguuugguucuucucuaguucaucaaagugcauaauuggguuguuuauuugaagucuuuuuacuuuuuugauacagucauuuauugcuauaaacuuucuucuuuguaucacuuuugcuuuaucccauagauuuugguguguucuauuuccauuuucaucuguuugaagacuuuuuaaaauuuacuuuuuaauuucuuugucaccccauuggcuguucaguagcauguuuaauuuccacgugguuguguaguuucugaaguuccucuuguuauuguuuucuaguuuuauugcauuguggucagaaaacauacuugauguaauuucugauuucuuugaguuuguucagacuuguuuucuggccuaagauauguucuguucuggagaauguuccaugugcugaugaaaagaacauauucugcagcaauugagugcaguguucuguaaaugucaauuaggccuauuagguccaaagugaaguuuaacuuugguguuucuuuauugauuuucugucuggaugaucuuugcauuacugauaguagagugaaaguccccuauaguuaacguauugcaaucugucuuucucuuuagguucauuaauguuugcuguauguacuuuggagcucugguuuugggugcauagauauuucuaauuguuauaucugcuugcugaauugaccccuuuaucauuuuauauagugaccuuugauucuuuuuauagucuuugauuuguagucuguuuuauuugcuguaaguauagcugcuccugcuccuuuugguuuccaguugcaugaaauaucuuuuucuacuccuucacuuucagucuacgugugucuuuuuauaugaaguggguuucuuguaggcaacauauucuugggucuuguugcuuuauccauucagccacuuaaugccuuuuaauuggagaauuuaguccauuacauuaauuauugauaaguaaggacuucuuccauuuuguugauuguuuucugguuguucuuaaucuccucucuuccuuucuuacuaucuuccuuuguagguaagugacuuucuuugguaguauguuuuaauuuguugcuuuuuuauguuuagugaaucuacuauagguuuuugcacugugguuuucaugagguuuacaaaaaacauauauguaauaaguuauuucaaagagacaauaacuuagaucacaaagaaaagaacagaaacaaaaauauuuaugccuuaauuccuucuccccaacauuuugacuuuuaauugucucaauuuacagauuuuuauauuaccuaucucuuaacaggugguuguagcuauuguuguuuuugauagauuuuuauuuugggccucauacuggaauuauaaguggauugcacaccauaauuacaguauuagaggauucuggguuucucuguguauuuaauuuuaccaguggauuucaugccuccagauguuuucucuuugcacauuaauuuuuuuucuuucagacugaugaacucccuuuagcauuucuuauaagaugggucuuggggugaauucuccaugcuuuuauuuaugugggaaagacuuugauucuccuucauauuugaaagauaacuuugcugguuacaguauuuuuggauggcaaguuguuuguuuguuuguucguuuuuuccuuucagcauuuggaaaauguuguuccacucccuucuggccuauaugguucucauugagaagucuguugccagaccaauuagagcuccuuuuuauguuguuucuuuccucuugcugauuuuaggauccucucuuugugcuucaccuuugagaguuugaugauuauaugccuaggaguagccuuauuugugucagauuuguucaguguaucugaccuuccaguaccuggauauuuaugacuuucucaagcuuuggaaguuuuucugugacuauuucuuggaauaagcuuucuacccauuccucuggcucaacuucuuuuugaacaccaguaauucuuagauguggucuucugaggcaauauucuguauuucguagguggucuucauuucuuuucagucuuuuuucuucuuucucuuacuguguauuuucuaauaaccugucuucagguuuacugauuguuucuucugccugauccauucugccauggagagccucuaauguauuucaguucagcaaacauauuucucaguuccaacauuucuguuuaauuguuuauuauuacuuaaaucucuuuguuaaauuucucugauaaauuucugaauuuuuuguuuuaucuuggagaucacugaguuuccuuaaaucuacuauuuaaauucuuguucagagagcuuacauauuauuaucucauuagggucagucauuuguucuuuguuucauccgcuuagggaagucaggcucccuguuugcucuuguuuccugcggaugugcgucuaugucuuuacuuugacgaauuaguuauuuauucuggucuucucucucuggcuuguuuugguuuuauugaauguauuugcuuaaagacucuuuacuguaagguuucugccuccuuuuugguucucaguggcacuuuaaacccagguuugccuuggcucuaauaaguaccuggagcagugcccaucucuaaugggggagcucccaaaggggauaucccaacagugugggaaggcuggcaaacgguuccugcccaugguuucuguggaauauaucuccuacaacauggagcugcugaauaggcacucugauuugguguuuucuuuggcugcagacagggcaguuuccaggguugaggaugguagucuugccucuccccuuugucucuggcuguccucaggaauauuucucccuucaguccucaugaugcuucuggugaguugaggcagggaugagucuccugccagggaaccaaaaauggugggaaagccgauuguucaccucgaucuuacuuuuuccaguguagaaaucgugagucgaggggaaauuuuuuguaugcuugaugcugggaagauuguggggagaggcaucacagguauggaaguccgauucucuuaccaucugcucagaguuuuuucacuucucuguggcccugagaagugacugauccucauauuugaguucugggaugucguugguguuaaucuuaguguuacauauuuguuguuuucugugacauuaagugaagccagcuugcuucugugacaccauuuuggaacuugaauucucuaaagcauauuaaggucuauuuguuuccauuugggggacuaucaaagaaaugaggaugccaguuaaucuauauucuuaauaacaaagugauauauuauuacagcuuuauuuagccccaacaaauucagagccacugagguaaaaccauaguaauucucuucucccagagaaacuagaaaaugaaauuauuaauuugcaggucauuuaaauuuucucuuguggugugauuaaaauauuacuuuaaaguauguguguguguguguguguguguguguauuuauguugaaaauaguaccacugucaguauaaagauaugguuauaagaauguuuaucaaagugugguuuguaagaauaaaagcugcaaacaaucuaaauaucuaauaguagaaaauagcuuaaauaauaguaugaccauauacuacaacauuaugcagccauuaaaaauuauauuguaggccggacacggugacucacgccuguaauccuagcacuuugggaggccgaggcgggcagaucacgaggucaagagauugagaucauccuggccaacauggugaaaccccgucucuacuaaaaauacaaaaauuagcugggugugguggugugcaccuguagucccagcuacucaggagacugaggcaggagaaucgguugaacccgggaggcagagguugcagugagccgagaucucgccauugcacuccagccugaugacugagugaaaccccaucucaaaaaaaaaaaaaaaagauauuguaaaauaacauuuacuaauuuggaaagauaaucacaauugagugagaaaagaguaacuuacaaaauugauguacaguguaauuauauuuuuauuuuaaaugaggcuaugaaugugcaaagaaguuuagaagauuauagagcaauauguuuacagugguuuuuuggcaacuuuuuuuuaaugagaaugaauguuuuggaauaaguuuuuuaaaaguauuaaaauagcaacauucaaaaucacauuugugaugaauauucagggaauuauuccuguuuuaauuaaguaaaacaaguacuuaucuguuguuuaaugcagcuaaucaaaaugcauuucuagauugccaugauuaacuuguuuuggaauuuguugaugguucagcucucauuaauauuauaaguaucaccuucuguuauuugugauacuuaguuugugaagaaaacucauaaaaaaaauuuuaggaacugucaucaguauaacuggagaaaaugaauuggacauuucuaaccaauuauuuagauaaaaauuauuuaaaucaaauuuauuuuaauauguuuucaaugaaaauuuucuauaaaaaucugaacaaugucugaaaaacugaggaguuaaaacuucauuggaaggccaaggcagguggaucgcuugaggucaggaauucgagaccagccuagccagcauggugaaaccccuuaucuacaaaauauauauauaaccgggugugguggcacacaccuguagucccagcuacucaugaggcugaggcaagagaauugcuugaacccaggaggcagaaauucuagugagccaagaucgugucaccacacuccagccugggcaacagagcgaaacuccgugucaaaaagacaaacaaaaaacuuuaauacuauaaaucuagagagggaccaaccuccauguucuacaugccuauuuaauaauagcuaacauuuauugaacacuuauuugccugguacuguguugggggauuuacaugcauuauuuugcguaaucuaacaaaucuuuuagguggguagauuuuuuuuaacaucucccuuucccauuugagagaaaaggcuuaacuuacccaugacaguaaauaaaugguaaagacaggauuugaacccaggaagccugacuugagaggcagugcuguuaaucacuaagaugcucuaguugacuuugaauugguggaugcuuuugugaccaguauuuauuuccuugaacaaugaccucuucagguucuaaaauaauguagaggaauaaaaaauuuaggccauucuguugauuaugugguguucauacaagggaggagguuuuucaguccaaaccuaauucccaaagaaaaacuuccagaaaaacuguucaaguccuaauauugaguguccacuugagucuuuucuuaaucguuuuuucuaagugauaacuccauuccuuaggauaucagagaggaaagcuuaucuacaucuacaguuuuucuguaacuccaucccaacacuuuugaaucuuuuaagcuaucuuaagauuuacauauccuagagucuggguuuuuaucaaaggaccaaaaacagggaaauaagagguuuuauaaagcuguuagaagaagcauccaaaagaacaaaaagcaaaucauuagucauaagcuagaucuuugaaggguauucaugcuugaagaaguuucauguucauuucaauauuaagcuuccucugcaaccucaccucauuaauacuacuuagcauuuucccccuuggaaauaucaugaauauugguuagaauuucaagugagcccccaaaagacuugcuuaguguauuauaguuguaauaauauaugccugcaaauaacaauaaaacaaacuuaugaauguagaauguuaaaguaucagggacuuagaagccaagaauuauauuaccugccaauaccaaagacccaagaaugguggcuaaaacaagauaaaaguuuauuuuucucacacauaaagcaaauucagaguuugacaguugcauagucaucaaggacccaagcuacuucuuucuuucugccuagcuuuccuuagugcauggcuucaauucucagagucacucaugguggaaaauggcuauuagaagucuaguuccuagauccaaggaggaaguagaaggaaggcaggaagggcaaaaugggcucauaucaguugucuauuauuuuguucccuuuaagauauuuuccuacaauuucucccuacaacuuuccuguacauucuacuggaugggauuuaagucuauagcaacaacuagcuauaagaacuaacuagaacauugcuacccagaauaaaaucaggcuucucuacuuagaaaaaaggggauauuuguuuuuggaaagcagccagcauccucugucauaagauuguaggaugcgucucaucuagacuuuuaaguucaagcuguuaagacccagacuuccccagcugccgauauugcuuaauaguggcaguuaaaacccagauggauugcucaucuguauuaaccggagagcacacaauugcuucugcuaaugguaaauuggauagagugauaguaaaacaguguagcauuaaugaagaguuuuuucuugccucuuuacaucaucaucccccuuccccuggauaguuuagaauguuacugugugcuuagaugaugagccuuucuaacuaugaucauuuuccuuccccucaagauacaaguuaugcuggcuauccagauucugugauuaaaaauaaagguaguuuuaguagauucuagcacuuaacauugguuuuuaacaauaaugguuucaugacuuuggguaaauuuuuuaaaauuuucuccugcaguauagccgaaauacagaaagauguggaauacagauugccauucaccauaaacaaccugacaauuaacauuaauaugugaguagaauuguauccuacuuuuucauguaaaaggacuuaacaguuuuuuuauuguuucuuaguuauuagaaauaaacuuuuaaggugaacuuauuucaaguaacuauaauuuauaaaauagugcacaauucagugaaauaaaaauauucgaaagcuaucacuguuauaguguuauaagaaagaaacuagaaaagaggaaaugcaauaaaaauguguaauacuaauucugaguacuguaauuguuuuuauugauaagcacuaaaaucuuagcaggagguaugcugaaaaaugauaauaaaaaacaaagggguuauauauauaaagccguuagagauagauucaccuuuaaaucagaaacaaguuaaaauauuccaaauuucagcaacagauauacuacaucaaccagaaaguucaagauuagauuugauuugcugaucauuuuuaagaaaaacaaaaaaguuaaaaguauaauuaugaggguuuuacuuaaguuacaaaaaguuggacaaagugauugcugaaguagcaauuuagccuuaaaugcagcuaugaggcuguagugugaaaaggcugugauuaccugagguuacauuaaguggcugcugcuagagcaaguguuugagccagauaagaaggcaccuaacuugaagacaggaaccuuaucauauucaccuucacguucuccuugccagcauacugccuguacauaggagaccuuauuaaauacuaaugagugaauuaaagcaugaauauauaagugcuguguuaacgauauauaugagcuuuuuuauuuauuuacuuauuuuugagacggagccucccucugucgcccagacuggagugcaguggcacaaucuuggccacugcaaccuccgccucccggguucaagcgauucuccugccucagcuucuugaguagcugggauuacaggcacgccccaccaugcccggcuaauuuuugaauuuucaguagagacgagguuucaccauguuggucaggcuggucucgaacuccugaccucgugauacacccgccucggccucccaaagugcuggaauuacaggcguaugugagcuuuuugaauccucacagcagccuugcaaauuagggcaaauuacagaaacacgguuaguaaguagcauagucaagauacaaacugggcuccaaaggccauuuagugccuuuuuuaccaaacuaguuuuaaaaucuucagcuuuguaaaugaaguaguuuuaucucucaucaaaugaccagguaaagcuaagcaggagaggccaacaaggacccaguuuucuuuucaacaguaugaccaacaaauaguugucugaaccaucaggggaacaaagagacaauucaaaguaaaauauucuugaguuuuagagauuuggaaacaggguuucauauccaguaaacucucauuuuuaagauuucacucacuaaucuugguuuuguaguaguucaaaaaagguuaaaauuucugcuuguguguguguguguguguugaaaauauacuguucuuuacgugaaaccaugugauugaccucuaacuugggagagaugugucauuuggggcauuuagaagggagccguguagaaccaagucuugaugacagcuacauuguuucaauccuccuacuuuacauuuuauccucuuuagaaauacaguaaauagugaaauaauguuucacagcauguuauuuauuuuuaucuuacuuuaguuuuucaaagaugaggucucacuguguugcccaggcuggacuugaacuccugggcucaaguggcucuccugccuuagccucccaaguaacugggacuacaggcaugcaccaccaugcccagccgugacagcauucucaaaguagaaaaaccacagaaaauuauauggcuagaaccugugguccaauaaauagccagacuggacuaguaugguucaccugauaaaaaugccugaucuaauuucuaccuaagauuuuguauagcuugguauauuguguuugaaagcaacuaauuggcaugaugugaagaauauucuauaauucauguccauauuucacauuaagauuuuacugcguugaaugacuagucuuguuaccaaauuuuagucuuaaacauauuuucagacaacaccauaauagagcacuuauuacuaaaugacccauaucaaagugugaaaauuuaauuuacuuuuaaauagcuuuguuuuaagauuuugaccauauaauguaccuuuguuaucuuuguuuuuguuuuucaucuguucuaccucuaccagauugcuuccuccacaguuuccucaggaaaaaccagugaucaguguuuauccaccaauacgacaucacuuaauggauaaacaaggaguguauguuaccucuccauuaguaaacaauguauguauaugggauaauuuauuucaggguaauauaauagguguauuacuuuucuacuaaauauuuuagaaaucugaaaugcauuuaaaguuucauuuugucaugaguacuuuuuuuaaaaauugaauauuuaagacuacgccuuaaaguucuuacaauaugauaugguugauugugaaagauuauaacuuccauauacucuaguauuuaccuuugaacccucaaauuauuguaaauagucaaguaaggaaauauuuuggcuccauuuuuuauucaauggacuuuuaaccuguuuacuaaucaccagauauuuaugguaucgauucuauaagaaaaugcuauaacuuguuaauugcuaauauccuuuuucauuuaauucuugaccugcaaaaguaaguuaauauuuagagugacauuauccuaaugagacuuuauaaucuuuuucuggaagugauuuuaagcgucauguauuguuacuuucaguuuacaaugcacucagaucuuggaaaaauuauucagagucuguuggaugaguuuuggaagaauccuccaguuuuagcuccuacuucaacagcauuuccuuaguaaguauauuucuaguaaauaaaaaagucugccuguauuuuaauguauuaaucaaaauauaguuuaaaaauucaaaugauguuaaaaaucaguccucugauuucuacauccccacaaauacauccauacuuucagaggcaacuguuuuacucuuuuaccuguuucuucuaauguuuaccuacaucuuucugaauaauguaugcguacuucuaucacucgauucuuucauuuuagauauuaucuguuggccuccuauuguaauagaugaagauuucagcuguuuuucacuaaacuuccuuucuccucacugucucagugaaauuauaucaugauuuuuaauauuauuccauauuugguguauuuauuacugugacucucaauauuguccauugcugagccaaguauguuaccauguuuacauuucccuuauggugcaauuuuuugccuuuuuucuggaauuaauaauuaccuacauuuuguauuugguuugguuuuguuuuagaucaucuucauuuuccacaucaucuuaaauuuuaagaucuuacuaaauuuccacagagcuuuuagcaacuaugaaaaauauccuuuaaaccauuuuuuucauaucaaaccaguaagauaauaccuggguuucauuguuuccuucacauucagugcuccacuucuucccuccauucugaguuacucucuauaacauuugaguaacucucaccaggaauuuccuuuguugucauccugggauuuucccuuugccacuuucuuguauuggauucuccauuucuuagauuucauuuuucccuuucucaggccauuuccuaguuucuugguuuacugccuuccaguagcuuccugaauaaagucauguucucguacuaaagauacuguuuuagucuuguucuugcauugcuauaaaggaauaccugagacuggguaauauauaaagaaaagagguuuaauuggcucaggguucugcuggcuauacaagaagcaugacauugucaucugcuuggcaucugaggagcuuuuacucccgguagaagguaaagcgggugcaggcacauuacaugaugagagcaagagugaggagugggggagguaccacacccuuuuaaacagucagaucucaugagaacucacuauggcaaggacagcaccaagaggauggcauuaaaguauucaugagaaauacacccccaugauccagucaccucccagcaggccccaccuccaacauuggggauugcaauucaguaugagauuuaaaggggaaaacauccaaacuauaucagaugaauaacagauuacccuaaaaacuuuugguugaaauaaugacauuuauguuuuuauaagaaucuaccauuugguuagggaccaguggcgauaacucauuuuugcuccacuuuuugcauuaccuggugucgucuggcaguuaauguuggcuuaaugguuagacuucagugcugauacaucuauauguggcaucuccaugugaccugcgcuuccucacugcguggcaggggugagaucugagggucaggaucccaagagagagagcauuccaaccaaguggaagcuguauuaucuuuuuugguuuaguccugaauguuauucagcaucauuucugcugcauuuucuaaaguuagucaccuagauccacccagauugaaaggggagggaaaguagacuucauuucucgaugggguagcaaaguucaagaaguucauaugggacuggaaaucugguuguggccauuuuggaauauaaagucggucacauucuuccuccuagccguaagaauucaccucuuuccuauaggugaauaggcacacuccccuuuccccaagaacuugcagaguucaucauauuguagaaucaggcuuguguucuuucaucuaaaucagauucaaguacagaugagguuucucacuuguguuccugaagaacaauuccucuugaucugaagacaacggaauuaaagagacaagguagcugccccucacacacccacuguacaaugguagaacaagccucggguaaccacuauagauuccaaaagagaggaaguaggaagcacacaggagccacugguucauaacaguacugaaauccaacugggcacauuguuuuuuuuauuaagacuuaguuaauggaaaugauucuucauagaguaauuuucguuucuugguucugccuucugugucauaauuccuuucuguaaaauguagcccuuguuuccaagugcauaguuuuuucagccugcuuccugccuguagaaauuaagggucuguuagccucuuuuucauuugguacuuucucugucccuuguagacccaagaugacacaauuccuuuaacaugcuuaugauuggcugggcgcgguggcucacgccuguaaucccagcacuuugggaggccgaggcaggcggaucacgaggucaggagaucgagaccauccuggcuaacacggugaaaccucgucucuacuaaaaauacaaaaaaguuagcugggcaugguggugggcaccuguagucccagcuacucggaaggcugaggcaggagaauggcgugaacccgggaggaagagcuugcagugagccgagaucacgccacugcauuccagccugggugacagagcaagacuccgucucaaaaaaaaaaaugcuuaugauuucuuaugaauccuuuuucauucauuucauuaaacaaaagcaacacccacuaagcuccuccaaauaagcuguugggcuuccagugaggcugcugagagacaaugucuuuaagauucuuugaagcccuaaguggcuguuuuucuuacucgacagcacucugaggcucugccuuggcucuuccagagguguuaacaaaggaucuucuagcccaugcuggguuugaacuuugcuuuuagagguguuucuuaauuugagaaucuuagggaagcuaggaaugagagauaaauuuauuuucaaauccaggaaaucucaucuuucauauuuagcaguucuuuaauuucucucucuucucacauuuuacuacagccagcuagaaaucagguggcaccauccgcacugccuggaaaucuccuuagcuagaucauccaauucacuagguacauuuucuguuuuccauauuauugcaugcagcaguauugguaaacuuuccacuaauaaaaaguucuccuuccggugaccaucugcucaaaggcccaccaggcuccuccuaacagccucuuugaggcccauuagaccuucauaaucuucugaggggacuuccagccuauagcucugcuuggucccaaagcuacucccacacuuuagauuuuuguuguuguuguugucauagcagcauuccacuuccagguacuucagcccucucccccucaucuuuuucuuccuguuuucuauguucuagaguccugaguccuuauuuucagauaaaaaauguauucaaaacccauaccucuaucuucuguaguaauagggcuggauauaaacucauuuaccuuauuugaaaauacaaaccgacaaguuuacuuguuuucauuucagauaaguucggggauauaguaccauuauuaaaaaucaaguuugaugcauuucuuagauuauuuuguggguuguaccugcuacugaguucaaaauaaagcagauugggucagaauuauugauuuaaauucaaagauauuacaaauacucucucauguugguuuuauuguuucuaaauagcuuguuauauucacauacauaucacuaauuccuucagauaaauuuuaagauaaagaugagccaucguuugaaaugaacaagcugauuagaaaacuuaauuuuuucuaggggucauauauucaccuggcucaaaauucaaaaaguauaaaggaguauagagugaaaaucuccgugucacuuuuuucccuugcagcuuaauuuuuuuuccucauuagcaucuaaaguuauuuguuuggguuuguguauauauaauuccugagcuguuuuauucaucuacaagaaaauauauauaguauuguauuuucccccuuuuuuauaugaaugguagcauauuuugcccuuccuuuuuuuuuuuuuuuuuuuuuuuuugguggagggggucacuaaaugauaugguuuuggaaaguuuuucauguuaguacuaaggcacuuccucauuauuccuuauagccacaaaguauuuguuuuauggguguauuauaaugucuuuagcaagccugacagauauuuucauguuuucuaacccucccucaaaagcccauccuacuucauugccgucagugcugcuccaguaaauaaucuuuaaaauaauauuuuacccaaaugugagcuuauuuguuggauaaauucuagaaguguaaugcacauuuguaguuuugacaaaugcugcaaaauugcccuccagaguaguuguaccaguuucuguuccuauacaaucccuauuuuccccaggcuggagugcaguggcgcaaucucggcucacugcaagcucggccucccggguucaugccauccuccugccucagccucccgaguagcugggacuacaggcgcccaccacuacgcccagcuaauuuuuuguauuuuuaguagagacgggguuucaccguguuagccaggauggucucgauccccugaccucaugauccaccugccucagccucccaaagugcuaggauuacaggcguguauuaggguuuuauaauuuguuuugcuuuaucaaaggacuaauauuucuguaccuuccuuuuucaggcuuuuuuucuuucuacuguggcuuauuuuuccauauacauuuuagugucauucguauacauuuaaaaaaaauguuuucuucccacaaaauuuccaacucagguuaugucauuaaaugaaauaauaguacucucauaaaaaauuaauacauuuugaaacauuuuucaauguaaagggaagcauuuuaguagcauuacauuaauauuuaaaacauaacuguaagucccuuauccuuuacacuagagugccugauccauauaaacucacuguauuauucauauauuguauuuagaugauucucagucugcaucuaggucugaauuacucuaaugcuuuuuagaguaauauaaugaucugguucucucuaaaauuugcuaaggggaaaaaauguuaaauguaaaauauuuguuaucuugcaaaaauaaauacugacuauauuguucugugauugaauccaaaguacauaaugcugugugacucuaauauacaugcguguuuauauaugcaucuguuuuuaauauuucaacauuuuagaagcucaucugcauacuuaauuuuacuucgaaauuuucuagaaaagcagucuugacuuucagucagauuuugacaaauacagagaaagcuguuagccucuacuugaauaaauguccuggauuaaauauugcucugcauucccucuauggagauacugauugauagcaguggagugcugaaaacucaaaaauggccugucuauccacuucuacuccguccaguugaauugcaugcuuucuaaagcacccaucaucuucuuuguagaaaccacaauucuacaauucuuuuuuuucggggggguggggucauauuuuaccacuuuauauaauauuuaauuccauuauauaauuuaauaaauaucaccugccauuauaacauuucaucuauauaguacuugaccuuuguuauuuagaacaauuuagaaacaauuugacauguuuuauccauaaaaucuaauguaaugaucuucucuuuuucuuuucagucuauacaguaacccaagugggaugucuccuuaugcuucucaggguuuuccauuucuuccuccauauccuccacaagaagcaaacaggaguaucacuucuuuaucuguugcugacacuguuucuucuucaacaacaagucauaccacagccaagccugccgcuccuucauuugguguccuuucaaaucugccauuacccauucccacaguggaugcuucaauaccgguugguaucgucaguuaucuauauuuugugccacugaaacauucauucaauccacacaccuuuauuacaugccucugugugccagauaauaaguuagacacaaaauaugaaaagaugaacucacauuuuucaauucaaguaacagguaaccaacaaauaauaauuuuaaauauggagcuucuaauucuaguguaguagaagggacagaguuuugguagagacacaguuaggggaauggucagugcuccuagggaccaagguagaacuaguagaucgccuuuacaaaaaaugugauucugguuuuuuucaccacuuucuuagugccucaaauauacugaugaauauaguggguacucuuuaaaaaugaggcagcuaaacaaaugcaugcauuuaugcuugaggccagauuuugaaagaucauuauuaauuugccagaauaacaaggggauacauaaggcauucuuugagaggcaguaacauugucaaagacauugagguagaaacuggauggcauuuuugugaagcugccuauaguagaucucucuggcugccauauagggugugggcaaaggcagaagaaugaucaugugggagcagcaggugucacauuaugaugggucugcuaacauacgcugagggcuucaaguguuccguugguuuaaaagcuuguauauucuuaagcugguaacuguugcuauguggaauguuccugaaggagagacuaauacuuagggcaugaaacauuuaaagggguauaaaaccuuucaauuaaaacccucagugaauaucacccauagcauuacucaaguaugaaaccauaguauauccaacauuacuaauuucagaguuuauaaucauuuagaagauacagaccuaaguggacuugguuuuuccaaaaccuuucauuuauuguguuaaugaguguugugaacaaauuacaguuaguagugugaacaaaauuacaagaggacuuuucaaggguccucaaggauaaaaagucauauauauucaaacaguggcuacucgguugcucaucuacccuaccgucucaugugacugaggcauguaacuauucagacuguugauaaauuauugcuuuuguauauuuaaugccuuucacuugagagaaacauauucauauauaccaaugaaaucuacagccauguacuuagacaagaaagagaacuaccaguucucuaccuaacacagguccucacauggccaucaccaaaaaaaaaaguaauccuauguauacgacgcugaaaagaagacagacugaaggaagaaggggagacuaaggcagugugagaugugaagaugaaaauaugauaaugcaaacaguuaugggauauaguacauuaaagauuacguuuauuaguaauugagagcagucaaaaauaauggcugaaauuuaauaucauuuaaaacuuuucuuuagacaagccaaaaugguuuuggguacaagaugccagaugucccugaugcauuuccagaacucucagaacuaagguaaaccuggaaaguaaaguuggucacauugucuauuuuauuuguaagcauaaaccagauuauuauuucauauccauauaaauuaaaguuuaaaauuuucacuaauccuaaacaauauuguuguugccuuagugggauuuaaaaaucaguuuuagguccuauagguuacauuuauugagugacugguacauacucagggauuuuuauaggauuuuuauaaugauauaauaguuaccaagauaacaaaauccuuucugucauguggccugcauucuuugaaaaauauuuuugaauacauuauuccugacaauuucaaaauauaucuuggccuauuuuagaucuuccauuguucccuuaguagauaaacuuuacauauagagaaauaaaguuauaaaguauuagguguuuuuacagauccaaacuuuuuuucaaauuuauagcagaaaaguuuauaaucaaauuuaaggugccauuuuucauggaacuuugcuucucuaaaauguuucaugaagaaaaugguuuuuugccauucaguuuugggaagcacugcacccuuuauacccccauugagaguucaugauacucauaaggcucuuauuacuaauaagacuacugaaugcaguuagacuuuuucuuuauuuuuuugcaguccuuuuugucuuuaggauauaucucaucaaagauguacagccaaguacccaugagaaauucuguaguuuaaaaagaguuuaaauuuauuugcaccaguguuuuauagucauuuuaaggaaauagugauuuauugucuucuguaauaaaaugaauauuuacaauauacugcauacauuaaagguuaauaugcauuguaaugcucacaauaaccccauaagguaggaguucucauuuaauaagauuaucuuuuuugcuuuaaauuuuuuuuaaauaauuguuaugaaaacaucaaaaaugcaaaaaaggugaagaaacuaguauaaugagccaccacguauccaucauguggcaacaacagcuauaaacccuuuugcucaccaugcuucaugccucuucuauccagcuuucuuggagggcuguagguaugagucaccauuauucuaaagcaaaucccagauaauacauccuuuuuaacccaucaauucuucaguaaauuuuucuaccagguaaggauuuucuuuccuuuuaaccauaaccccagucaccaucaucaucauaccuaacacaauuaaugguaauucuuuaauauuaccuuauuucuccagugucuuaauaauuaauauuuuugugggcaguuuguuugaaucaggauucaaaacgaguuccaccuauugcauuuggauaguggaucucuuaaguuccuuuuaauaaugaaccauuucuccccaacuuuucucuuuuauacacacacacacacacacacacacacacacacacacacacagacauauacauauguguauuuacauauguucguauacauguacacaaauaugggaauaaauacauguccauguacauacauccaugcguguauauuagacauaguguguguuuauuaaauugguuauuuguccuauaaaauuuuccauauccuguuuuuuccuuagugccuccuugugguaccauugaagauguuucucuguuucccauaguuuaugcugcugguggcuagaaguagacaagguucaauucuuuugccaauacuuaugucauaauuacugcaugcuucuuuuuacauccuaugaggcagcagugaggucugguugcccuuuuuuuagugacauuaagauuauaucagguuaaagcaccugaaaucauugaccaucauuaauauagcaagggucauaaauaugauuuaaugauuuuaucauuaccaccagaauuuauuaaccagaauuacucuaugaagaacuugacuuaaucaacuacauauuuaguuauacugaaguauacuucauacaggaccaagaaaaaugcuuaaauuuuuccccuuauauuaucaccugucacaauaaugaguugcugcacuaucugucuccaaaaguugcucugaugggugagaaacucaaguugccuucuguaucguuuuuggcaaagugaagaugcugugggcucaucaugaacauuucuucucccagaccuagagucagccauuucucugaagggugcuuguucuuuuccaaaauaacaauaccaguacuguuacuaagauuauugaaugcagguuaaauuuuuguuuuuguuuuuuacaguucuguugucuuuaggauaugacaugccagaauauacuguuguuuuuuuaaucucuccaaauaauuuuucucuggguguugauauaacuuagaauauacagguuuauuuauuuucaaagcaguccauuuucccugaauuuuaaagacugcuuuuucuuuucuucuuuauuuuuaaauuauccaacguuuuuauauggcuccauagucaaaacuaagauacguucagaaaaguuuugcuuccauccauaucugcuccaccuaguucuuucacccuacagauacccauuuuuguuuuugguuuagcccuccauuauuucuuuucuuuaaauauuuuaugaauaucuguacacacauauacauaaacacacauaaacauaucuauaacucuuacugugacagccacacaucuguaagcuaaauagucacagagguuaaaacggaguuguugugacugcuuaugugccgugucuuacugguccuacaguaacugacauuauacacuagcagagacuguuuaucuuguagagucuugggagauuuuacuggcuacauuuuggccaacacauccuuggaaucaugcacugaccuggucuaaagcugacuagaggaaaaagccaaaauguuacaguaacuacucuggccucuuuucagcucuguuucccucuuaucaauacauacaaugaaaugacuaggaagaaauucuucucaugcuaccuugucugugaacuuguacuugucugaauuuacuauaguacuaguguguucaacauuaugcuuggaagaaauaaauagcuuaaauuuuacauaucaguaagucugguuccuaucagggaaauuuaagaaauaagugauauucucaagcaauuaaguuaaacagaauuaagaacaagaaaaaaauacuuaacuauauuacugcuguccuauuuuaagaaaccuaagcugaauaagcuccuuaguuucauacauuguucuuuaccugaguuaaguugacuuuauuuuuaauuucaggucacuguauaacugugaacacuuccccacgguugugauuuuuaaagaaaguagauauaucgauauauccauuggaccaaaauuuacuuuuacagauucugucaagaauauauuacagacugcucuauguuccauugugguugauguuuuauuugauuuuaagguuaaaacuggcagccuuagguguauauguaaaaauuauuuagaacccuaucaguuaacuaaagcugaaaaauuguaaauaguugucauggagaaaaacucgaugucugauauuuauugacauuuuuucuuuuguguuucuagugugucacaacucacagauaugaaugaacaagaggagguauuacuagaacaguuucugacuuugccucaacuaaaacaaauuauuaccgacaaagaugacuuaguaaaaaguauugaggaacuagcaaguauguuuucccucuccugagcgcacauuuccugaaaaaaaucucaucuuuaccuagaaguaaacuagagauuuaucuuacaggaaaaaaucuccuuuuggagcccagcuuggaagccaaaagacaaacuguuuuagauaaggugaguuagugauaauuuugaagaaauuuacauaauuuaaaaauagaauaaaacaaccuuuucauuuucucuuuuaguaugaauuacuuacacagaugaaguccacuuucgaaaagaagaugcaaaggcagcaugaacuuagugagguaagacuguuuauuuuuuucccuuugccauagauuuuuuuuuuaaucuuaugugcaugaguccugaucucacuuucauuaucaucagaaaccauuuaugagguaucugaccuuauaagacaugauaccuuuaaacguggaugaacagcucucagugaugaggcaucauacauuauuugugcucauauaagagcguauuuguuucuaaaacagaaaauuaugacaggcccugacacauaacuuuucuggguaaguuaugaaaccauuguaacacuuguagugaaaccuagcaauaacaacaaaaacuuucgacucacuuguaagcuuaucuacaaauaccuuaaaugaaaaguucgcaaauuaaaaagaauaauauaugaaaaauauauaguauuaucugcuacaaauaaguuuuaugcuagaaauccaguuaugugaaaaucaaaagaauuuuauaaaauucaaccuauauuucugaaaaaaaaggaaucuuugaaaaggaaccagaggacauaaucuuuguaucauaccaauaacaaccucauaguuaauauucuguuuccuguaaaauuaggaacuuuggguaaagucaaugaaauaaaacauaaaauagacauaaaccaacaacagcaaaaaagaugguaaaggagaauauaaauuuauaaugaauuucagauaauacggucauuugucagaauaaagaaauaauagcuaacauugagcaauuaauaugucuugcaccgcaugaagcuauuuacguauauugggccauuauuacaccaaauccuaugaaauagguauuguuacuuuuucccauuuuacauuuuacagauagggaaacugaggcacagggagauuaaauaaauuucuugaggucauacaaguagaaacauuaguuaggaguguaaccuaagcaguccuccuucacagaaaaucugugagacucaacugaaguacuguuagauauauacuggaccuuaguaaauguugaagaagcuuucauaguacucaacaucauucuuuauacaaacucuuaguaaacuaaaaauagaaauuucuuauuugaaaaagaauacuagaaaccagcaguaaaccucacaauuacuacacauuucuaggaucccauuaauguuaggaauaagagaguaaugccucaugaucacugcuguuuaacguuguuugggagguuuugaguacugcaagaccaaaaaaaagugguauaacauaaaaagaagaaaugaaacaguuguuuaccaaaaauaaacaaucaaaaauucuagagaacugagaaauuuuuuccuguuugcuccagcaauuacuacugcaaaaugaaguacagaaaacaacucauuuaccauaggaacaaaauuguaaaguacuuagaaguaaacccaaugaaguaaguuaggaaacuuuauugaaugccauaaaagaagagcugaguuuuguauuuucuaagacuauuuagagcagcauagaauauucauugaaugaaagauccauuauuaaaaagauuucauucuccccaaaauaacuuagaaauugaauacaguucuuaucaaaaugccaagaauauuuuuuuuaucuuaacaguuuauucuaaaguucaucugaaacuuuauuuuucagauggguagucaggaagagcuugaacaaaaagaaaaaaugaaaaaaacucccuuucccaguaucagaauacacuguaaauccucauuauuuaaaacaguauaguaguuuuauaggaagagaaaauuauuucuauggaacagacuauguaguucaaaaauagacuuguguaugugaauaaucaguuggaaaaaauugaggauucaauaaauuauaaaauugguuauuuaguauccauuuagaaaaagguuagaucauuguaucauacaauacacagaaaguuuauuacagauaaacugcuucagcggaaaccauaaaacgucaacuagcuucuaggauuuuuucuuuaagauuauggugggaaaagccuuucuuagcauaauaaaacagauaugagcauaaaggaaaaacucgacauauuuaccucuacagauugaaaacucagauauauuaaaaaaucaugaaaucaaaauugaaguuaaaaaaaggguacagauauuuuuagccuauacaacaaauacuaaugccaguggucuauuggaaaaggaaacaacaggaaacugacaaaaggagaaauauaaauguccaauaaagauucugcuuuaacaguuauucugauccuuaaacauucauauaagaauugcuggaagugacucuucaaacacuuaaaaaaaagacacacacacacacacacacaaaacaaugauuccuaggcuucuuucuagauguucucagucaaaauuuucuggggaugaugaaucuucugcgcucuuacauauggaaaccacuucauuagaccauugguuccgugauggaggaaucuguucuguuucauuucuacuguacaccuaauaucugguucagugguuggcacauaauagguacucaauaaauauuuaaugaauaaauaacuggaaacuuuggaaaauauguucaacuuuacuguaauuuuuuaaaaagccaaauaaaacauccaugugagccauauuugugaagauagauaaccaguuuuggcaagggcaaugagaaaauggugcauuacaguucauuuuuauuuaugagucacaaagagauacuaccccacaugcauuagcauggccauuauuuuuuuuuucuuacucugucacccaggcuggagugcagugcugcaguuacagcucacugcagccuugaccucccaggcucaagcgauccucccaauucauccucccaaguagccaaggcuacaggugcaugccaccacaccuggcuaauuuuuguauuuuuuguagagacggggucucgcuauguugcccagccuggucaugaacucccaggcucaagccaucugcuugccucaggcucccacagugcugggauuacaggcaugagccaccacgucaagcaggauagcuauuauuaaaaaaucauuuuagugccuagauuuaggucuuugauccauuuggaaucaauuuuguauuuaaguaagguaaggguccaacuuuuuuccuuugccugucgauaauccaguuuuuuccagcaccauuuguugaaaagauuccuuuccccauuaacuggacugggcucccugguugaaaaucauuuggccauaugugugaggguuuauuucugggcugucuauucuguuccauuguucuuuauguuuuuaugccaguaccacaguuuugauuacuguaacuuuguuaguaacuugacaugaggaaauauuaaucaucuuuaagauuguuuuggcuauuuggggucucuugagauuccguaugaauuuuaggauagguuuuucuauuuuugcaaaaaaugcccuugagauuuugauagggauugcauugagucuauagguugcuuugauuaguaaugucuucuuaagaauauuaaaucuuucaacccauaaacaugggaugucuuccaguaauuuaugucuucaauuucuuauagcagugucuacaguuuucuguuuaucagucuuucacugcuuuagugaaauuuaaucccaucauuuuugccuuauucuauugaaaugagucgucagguucagcccacacucaauggugggauuaugcaagggcaggaauaccaggaggugaggucauuaguggagcgucuccuuagcauauaucuaccacagugauuuaauucguaaauccuuaggagagaacaaugauuuucccaguuucucucauuuaauaguuugcagccaauagauuaguuucucuugaguuaggugucuaccccuauccaaaagcuaaggaccuggguggggcauuauaagacagcagauuuucucaaaaagaggcuauauagggcauauaauaaauugccucuccauaccacuaccuuacuuccuuucccugugaggaguucuugugaguaucauaaauuaaaguagugccugauuuucuuuuucagagcuguagugcaagugcccuucaggcaagauugaaaguagcugcacaugaagcugaggaagaaucugauaauauugcagaagacuucuuggagggaaagauggaaauagaugauuuucucaguagcuucauggaaaagagaacaguauguaauacucgucaguugaggacaaguauuggauaaaguuugguauuuuuauagaggaggagaagcacuggguguuagcuauuucucuauuaugauaucaucccccuuuuuuuguacaauauauuuaccugaaaggaagguuucuauuccuuggguguggacuugggcaaaaaccagguuccuggaacuuaaaacuuugaaggucugucauaggacucuggacagccacacaccuuagcuauucccaggggaccccaggggggcaacugccauugcucuaagauguccuuuugaugugacuugagauauaaaugagagugagggccuguacguguggcuauuuccugucugguaugucagaggaacaguccuggucagaagggggcucuucugagcagaaauugcuaauaaacuuugugcugaucuggaaaaaaaaaaauuuuuuuuuugacagcauaguaucaaauuacuuuagcauacucaugagugaaaaacauuagcacauuacugaacuggaguuuugagugcugugagaggaaccugaaaagccucuugagaauaauagcagcaucuuccuaucacuuuagacuugcuuuuucugaguauacaagcagguaaaucaaauaguuguuucagaaaugguaguaucuguaucauucuguaauacagcugauaaaucuaguccuaauaguugaaauagacuccucaaugacuuguuuuaccacuuguugaaagaaagaauaacguacagggauuauagaauacauuuuuaaaaauugagaaacaguuucuguucuguucugauauuucuguuguauuuaaagaaaaauccaaaaaagucugcuuaauaguuucuugccuuuuaauacaguccaaaauauuuaccuaauuugucugaaauaaucacauuuuaaaaauaguauuuuguuaguaaacuuuaugaaacaucugugagacauacacacacacauacacacacuccuguuaaggcagaugagguggauuuuaucauucccauuuuucaugagaggaaauugaaguucagagauguuagugacuuacuuaugguuauaguguuaguaaggcauugauuucugcuccauuauucuucaaugcuguguaacugugccuugaagcuuguaucuguuaaucuuccugcuuaacaguagcagaauuuacguccauuuuuuuaaacauagauauuuaaaguuagauaauugauauaaaggaucaguguuuuuuacauucuagaagcuuguaggcgaaggcugucuuccaagcaagagcguuuuuuuguuuuuuugguuguuaaauucuuagcugucgucaacauuagcuaucuucaacauucaauuauuagauuacuaccuaauucaaaaugaauuggugucaugugauccucugcccagucgacugggcugagggaguggauuaugagaagggagcaugagagguucccuaaaacagggacuggggugcaggaaagaagaugacaggcaugucucaugucccauucaaaguauuaucugcuccuuguaccauuagugcuaaugaaaugaauuugcucauaauuugauaauuuuagcuauuagauuauuagcuaucuucaacauucaaaacauaaaauaaugccaacaaguuaaaagcuuccugucauacuguuggaaguaaaguaguaggcauaucuuuguaaaagugacugguauuuucaaaaauuuauuuucuagauuugccacuguagaagagccaaggaagagaaacuucagcaggcgauagcaaugcacagccaauuucaugcuccacuauagguaaauuguauuucaaguuugagucucaaggugauugcaucaguguucuuuaaauagacauguuguuaacggugccuguucaucagccuuaagcauaauucugucauuauaguuacugugcuauguaacauagaaugcuuuguauuauauaauaagcauaauauaaacauauaacuaguagaaaucuuuuggauauuuucugugaucuuggcaugaaugagauuuuuuuaacauuagcugcuaauguagaauuguaaguuauagucaguuccuuucucucaccugguguguagaguauaccuugucauguggcuaacauuucucagaaggcuccuuugucauuucuuccuuuaaagugaacuuccagccagucucuuucucuaucccacaccacgauuacucuaauaauucaccuguccccacgacuugaggguucucuuccuaugcagcacugauagaaugaucuuccuaaaauaccacuuuuaugauaaaauuugcucuacuccagaaccuguaauuaaucgcuaguaaugacaguauccaugccaaauuccucugcuuuuaagauuuccauaaucuugcauauauuucagaucauccauuuuaacuuugcauuuuccccuuacauugcguugucuuacauggcacauucuuucuucuaccacgguaucuuuggccgugcuuguaccugauguuaagaugccuuuccuuuuccucugcaucuguuuuguuuuaggaaugauuuguuugcaagaauaguucccaccccaacaaacuuaaguaaaagcuuauguuauuugauaggacagggauuuauuauagaguaaaaaugaaggaaaguacagucaccugagacugaaaacagccacucagugaccaaaacagcucuucucacaccuuuuuugaggcugcuuguuugguuguuucuuauuucugcaucucuauucuuuuuuaaaauuuuuucuggccgagcgcaguggcucaugccuguaaucccagcacuuugggaggccgaggcguguggaucacauggucaagagaucgagaccauucuggcuaacacagugaaaccccgucucuacuaaaaauacaaaaaaaauauuagccgggcaugguggcaggcaccuguagucucagcuacucgggaggcugaggcaggagaauggcaugaaccugggaggcagaccuugcagugagccgagaucacgccacugcacuccaaccugggugacagagcaagacucugucucaaaaaaaaaaaaauucuuuuuucuuacuagcccuucacguauuccugauuauaucaucugacaguucagacagccgauggagauaaacaagagucccuggaguucuagaacauucccuggaagaguaacugacccaguaugggcaagcuauccauccuacuguagucaguuuggccuggaaauugguauccugugguccucugcccagucgacugggcugagggaguggauuaugagaagagagcaugagagguucccuaaaacagggacuaggguacaggaaaagaaaugacaggcguuucucauguccaguaaacuauuucugcuccuuguaacauuagugcucacaaugaauuguuuuauguguuacuuuccaaaucauacuauaaauuccuuaaggguaggggcugauuuuugauaccaacuuugcauaucugccagcuuaagaagaaguagacacagaguaguugcucauuuauaugaacauacucaaauccguuccuuaccucuauucccucauagucaaguuauuuuauaggaaaaucuuuuuuauuauuauuaugcuuuaaguucugggauacaugugcagaacguacagguuuuuuacauagguauacaugugccaugaugguuugcugcacccaucaaccugucauugacauuagguguuucuucuaaugcuauuccucuccuugcccccaacuccccaacaggcuccagugugugauguucccuccuugugcccauauguucucauuguucaauucccacuuaugagugagaacaugcauuaguugguuuucuguucccguguuaguuuccugagaaugaugguuuccagcuucgucugugucccugcaaaggacaugaacucauucuuuuuuauggcugcauaguauuccaugguguauaugugccacauuuucuuuauccauucuaucauugaugagcauuuggguugguuccaagucuuugcuauugugaauagugcugcaauaaacauacgugugcaugcgccuuuauaggagagugguuuauaauacuuuggguauauacccaguagugggaucugggucaaaugguauuucuaguucuagauccuugaggaaucaccacacuggucuuccauaaugguugaacuaauuuacacucccaccaacaguguaaagguguuccuauuucuccacauccucuccagcaucuguuguuuccuaacuuuuuaauaauugccauucuaacuggugugacaugguaucucauugugguuuugauuugcaugucucuagugaccagugaugaugagcuuuuuuucauguugguuggcugcauaaaugucuucuuaugaaacuguucauauccuuagcccacuuuuugauaggguuguauuuuucuuguaaauuuaaguuccuuguagauucuggauauuagcccuuugucagauggauagauuccagaaauuuuccccauucuguagguggccuguugauucugaugguaguuucuuugcugugcauaaggucuuuaguuuuauuagaucucauuuguccauuuuggcuuuuguugccauuguuuuuuuguguuuuagacaugaagucuuugcccaugcccauguccugaaugguauugccuagguuuucuucuaggguuuuuaugguuuuaggucuuaacguuuaaaucuuuaauccaucuugaguuaauuuuuguauaagguuaggaagggguccauuuuuaguuuucuguguauggcuagccaguuuucccaacaccauuuauuaaauagggaauccuucccccauugcuuuugucagguuugucaaagaucagaugguuguagaugugugguguuauuucugaggccucuguucuguuccauuggucuguaugucuguuuugguaccaguaccgugcuguuuugguuacuguagucuuguaguauaguuugaagucagguagcaugaugccugccgccagcuuuguucuuuucgcugaggauugucuuggauauaugggcucuuucuugguuccauauaaaauuuaaaguauuuuuucuaauucugugaagaaauucaaugguagcucgaugggaacagcauagaaucuauaaauuacuuuggucaguauggccguuaucacgauauugauucuuucuauccaugagcauggaauguuuuuccauuuguuuguguccucucuuauuuccuugagcagugguuuguaguucuccuugaagagguccuucauaucccuuguaaguuggauuccuagguauuuuauucucuuugaagcaauugugaaugggaguucacucaugauuuggcuguuugucuauuauugguguauaggaaugcuugugauuuuugcacauugauuuuguauccugagaccuugcugaaguugcuuaucagcuuaaggagcuuuugggcugagacagugggguuuccuaaauauacaaucgggucaucugcaaacagagaaaaauugacuuccucuuuuccuauuugaauaccuuuauuucuuuuucuugccucauugcacuggccagaacuuccaguacuguguugaauaggaguugucuugugccaguuuucaaaggcaaugcuuccagcuuuugcccauucaguaugacauuggcuguggguuugucauaaauagcucuuauuauuuucagauacauuccaucauuaccuaguuuacugaguguuuuuagcaugaagggguguugaauuuuaucgaaggccuuuucugcaucuaugagauaauugugguuuuugucauugccucuguuuaugucguggauuacguuuauugauuugcguauguugaaccagccuugcaucccagggaugaagccaacuugaucgugguggauaagcuuuuuaaugcgcugcuggauucaguuugccaguacauuaaugaggauuuucgcauugauguucaucagggauauuggccugaaauuuucuuuuguuguugugucuuagccagguuuugguaucaggaugaugcuggccucauacaaucaguuagggaggagucccucuuuuucuguuguuuggaauaguuuuagaaggaaugguaccagcuucucuuuguaccucugguagaauuuggcuaugaaucagucugguacugggcuuuuuuugguuggugagcuauuacugccucgguuucagaacuuguuauuggucuauucagggauuugacuucuuccugguugggaggauguauguguccaggaauuuauccauuucuucuagauuuucuaguuuguguaaagguguuuauaguauucucugaugguagguuguauuucugugggaucgguggugaucuuuuuuuuguuguuguuguuuugugauggacucucauucuguugcccaggcuggagugcauugguaugaucuuggcucacugcagccuccgccucccagguuuaagcaguucucugccucagccucccaaguagcugggauuauaggcaugugccaucacaccuggcuaauuuuuguauuuuuaguagagaugggguuucaccauguuggccaggcuagucuugaacuccugaccucaggugauccacccaccucagccucccaaagugcugggauuacaggugugagccaccaugcccauacgaucuccccuuuaucauuuuuuauuuugucuauuugauucuucucucuuuucuucuuuuuuagucuggcuaguggucuauuuuguuaaucuuuucaaaacagcugcuggauucauugauuuuuuuuuuuuuuuuugaaggguuuuucgugucucugucucuuuaaguucugcucugaucuugguuauuucuugucuucugcuagcuuuugaauuuguuugcucuugcuucucuaauucuuuuaauugugauguuaggguguugauuuuuuagauuuuuaccgcuuucuccugugggcauuuagugcuauaaauuucccucuaaacacaguuuugcucugucccagagauucugguacauugugucuuuguucucauugguuucaaagaacuuauuuauuucugucuucauuucauuauuuaccaaguagucaucgaggagcagguuguucaguuuccauguaguugugugguuuugagugaguuucuuaauccggaauucuaauuugauugcaguguggucugggagacuguuaugauuuccauucuuuugcauuugcugaggaguguuuuacuuccaauuauguggccaauuuuagaauaauugcuauguggugcugagaagaagguauauucuguugauuauggguggauaguucuguagaugucuauuaguuccguuugguccagaacucaguucaaguccugaauauccuuguuaauuuucugucucguugaucuaauauugacagugggguguuaaagucucccacuauuauugugugggagucuaagucucuuugaggucucuaagaacuugcuuuaugaaucugggugcuccuguauugggugcauauauauuuaggauaguuagcucuucuuccuacauugaucccuuuaccauuauguaaugcccuucuuugucuuuuuugguuuuucuugguuuaaacucuguuuuaucagagaccaggauugcaaccccugcuuuuuuuuacuuuccauuggcuugguaaaucuuccuccaucccuuuauuuuaagccugugugugucuuugcacaugaaauggguuuccugaauacagcauacugauggaucuugacucuguaucauuugccagucugugccuuuuaauuggggcauuuagcccguuuaagguuaauauuguuaugugugaauuugauccugucauuaugaugcuagcugguuauuuugcccauuaguugaugcaguuucuucauaguaucaauggucuuuacauuuugguuugauuuugcaguggcugguaccaguuauuccuuuccauguuuagugcuuccuucaggagcucuuguaaggcaguccucguggugacagaaucccucagcauuugcuugucuguaaaggguuuuauuucuccuccacuuaugaagcuuaguuuggcuggauaugaaauuauugguugaaaauucuuuaagaauguugaauauuggcccccauucucuucuggcuuauaggguuucugcagagagauccacuguuagucugaugggcuucccuuuguggguaacccaaccuuuuucucuggcugcccuuaacauuuuuuccuucauuucaaccuugguaaaucugacaauuacgucuuggguuugcucuucucaaggagugucuuugugguauucucuguauuuucugaauuugaauguugggcugucuugcuagguuggggaaguucuccuggauauccugaaguguguuuuccaacuugguuccagucucucugucacuuucagguacaccaaucaaacauagguuuugucuuuucacauagucccauguuucuuggaggcuuuguuuguuccuuuuuauucuuuuuucucuaaucuugucuucacgcuuuuuuucauaaaauugaucuucagucucugauauccuuucuucugcuugaucgauugggcuguugauacuauguaugcuucaugaaguucucgugcuguguuuuucaguuccaucagguaggucauuuauuuauguucuucucuaaacugauuauucuaguuagcaauucuucuaaccuuuuaucaagguucuuagcuuccuugcauugaguuagaacaugcuccuuuagcucuaaggaguuuauuacccaccuucugaagccuacuucugucaauucaucaaacucauucucaguccaguuuuguucccuugcuggcgaggaguugugauccuuuggaggagaagaggcuuucugguuuuuugaauuuucagccuuuuugcacugguuuuuccucaucuucauggauuuaucuaccuuuguucuuuguuguuggugaccuucggauggaauuuuugcauggucgucauuuuuguugauguugaugcuauugcuuucuguuaguugucuuucuaacaagccccucuucugcaggucugcuggaguuugcugggggucuacuccacauccuguuugccuggguaucaccagcggaggcugcagaacagcaaagauugcugccugcuccuuccucuggaagcuuugucccagaggggcaccugcaaagugccagccagagcucuccuguaugagcugucugucaaccccugcugggaggugucugccugucaggaggcacgguggucagagaaccacuugaggaggcagucugucucuuagcagagcuagagcauggugcugggugauccgcugcucucuucagagccggcaggcaggaacguuuaagugugugcaagcugcgcccacagccaccccuucccccaggugcucuguugcagggagaugggaguuuuaucuauaagccccugacuggggccucugccuuucuuucagagaugcccugcccagagaggaggaaucuagagaggcagucuggcuacaguggcuuuguggagcugaggugggcuuugcccaguccaaacuucccggaggcuuuguuuacacugugaggggaaaacagacuacucaaaccucauuaaugguggacgccccuccccccaccaagcuccagcaucccaggucgaccucagacugcuaugcuggcggugaaaauuucaagccaguggaucuuagcuugcuagacuccauaggggugggauccgcugagcaagaccauuuggcucccuggcaucagcccccuuuccaggagagugaaggguucugucucgcuggcauuccaggcaguacgaaaaaaaauuccugcagcuagcucgaugucuggccaaacggccaccuaguuuugugguugaaacccgggccccuggugguguaggcaccugagggaaucuccuggucuguggguugcgaagaccguggaaaaagcguaguuucugggcuggguagcacagucccucaaggcuucccuuggcuaggggagguaguucccuaaccccuugcacuuaccgggugaggcaacaccccacccugcuucugcucacccuccgugggcuacacccacugucuaaccagucccagugagaugaaccagguaucucagcuggaaaugcagaaaucaccugccuucucuguuggucucccugggagcugcagacuggagcuguuccuauucagccaucuugccugggagccacugugggcaaaucuuaauuggaagauaauguaaagagauacauauucaucuucuuaaauauuagagguauuuuuuauuguuuucuuucuagauuuuccuggaaacaugaacugccaagagaggaaugggacacaaaaccaaacacuguuuuauauuuaugguuugcaaacuggcauuucaucaguggcuaaauucacagauauccuauauagauuguauacagaacugagacugauuuuguaccgauuagaaugauugcuaugaucuuugagaaauuuuucugcacuauuugcacugaaauguuuauuuauuguugauaaauuguaucauauuuaaguuccacugcuguuccucuuaccuugauuaaaugccuaugcauguacuuuuagcuaguuuuuaauauuuuauaaaacuucauuuaaauuuguauuuuuaacuugaaguuccauuucuuuaucaaggaugguauuuagauuuuuuuccucuuaaccuuuuuucaaaaacuauuuucaacugugaggaaacccuuauuuuucuuucuuuguggauaaaacuuucaaaagcaauuuaagauauucauaguguuaggaaacaccaaaccugccuaugugccaucucacaaaagaaacuuuuaauaccuacaauaaaucaaaagaauaaaccagcuguucuuauauauuguuucauuuuuaaaacuaaagaugcauuuaagaagcaauacaaguaaauauuuuaccuaauaggaaaaaaaaaaguugccuuucauuuaaaccauuccaacagaaauucuuaugcuaauuuaaaacauauauauaucugguagguuugugguuggauagguuuucuaaauuccuaauguuaaaaacaaucuuuauguuaauauacacuaaaucuauacacaaaaaaagucagugaacuuuucugaccuuuacugugaguuaccuuuuccuaagaggaaagcuauaguaauaaguaaaauuuaauuuuuaggcaauccugauuuuuaaugaauuuaauugaguguucuuguauacuacauugagcaguuugcuucuauaccgugucacaaaauucauguauuucuugagaagcccuaaaagcucauaaaggaaaaugccgugaacuauguagcucaggcuugguaaggugccaucuaaauuacaaaacaaacuaaugcauaauuuugcuuaaauuucaucccaguaugauugucuucccaacaccagcauauaguauagauugucugucuuuuuuauauuuuuuaguucuuccuguacauguuuuuggcaauaaaguuauaggaagaacaaaauuauuuuguuagaauuaaaacaugcuuaauauuuagucuguuuguggagggcagguauucacguggacugagauacaauguuggauacagaaaauaacuuucauugucuuccugacacugugcuaaggacaugcuguuaaagcuucaaagugaccagaugaggaaggaauaauuaauuauuacuccugauuuguagauaacugagguaagaguguuucaaauuuaugauagucuuuuggguauucagaaaccuuuccuuauacugcacuggccaccagagcuuaauuuucccagcaguuacagcaaugggagauagaacagucucaaucuuuugccaaccaucagguuccuagaaaccagguagguguaucccauaacaagggaggagcauaccacagccccucauuugauuaauucauuugaucuaucuauguuauuaaguaccuacuaggaauaaggcauuguggaaauacuauacaaagauaaacauuguuuagaugcuuaucuacuuuccuuuucaccagaaaaacagaaaaaaaagaaacauuuucuuacagaguaaaaauguucuacauaaucacaugaguaguucaucucaguguuuuuuauucuuuaaaguugaacuaucccaguuucauucuauaccauucauuggauaaccuuguuacaacccagucaugaaacagagcagugugaucaguuaucugcauuuaacaaauagacaaaucaguuuacauaaagguuauguaugucacccacgaugaaaagaaucugcauuugaauaugcccguaugaauguggguucuguuuuugcaacagagauuaagugaccauuuuuucuaauuuuauggcuauauauuuucuucauaaaaauuggucacaucggagaagcagugccacaggaaaaaugaaaugcaugugaaaguuuguauucugauuuuacaagaugagauagaaaucagaauuaaagaggaauacuuaggaguuacuaggcuaaucaguguacgaauuugucauagguagagauuuaaagguuaauaucuuaaaauagaagaaaauucuaaaucaaucaaucagugagauauaaacuaaacagacccacuucaaaguugaaagaaauuucuaggcauaaauugagacuaggaaauuuauaucagaauagagggugcuugacacauauauaugcuuaaauugaaggacagcucagauucauuuuuaggagaagaaaguaaacuaaugugcucuuaaagaauaaaaauuuauucuaugguuucugucucugaucaucaccuuccauucuauaaaaagcucaguuacugauuugcugggucauggucaaaauucuuaccuauuuauuucauaucaacuuuaaaaaauaaauuacuugcauucuauauauuacuaauugggaaguaauaugccucaaaucaguuuuauacuggauuauucccuaugcuuuaaaccacugcucucaauaaaacacuuccugauuaauguuugauuauuagauauuuuagucuuguuggggauauuuuagucuuguuggguuagccaugcucugaagaaucugugaaaguacaguaaaguuuuaauaagcaauaaauguaaccuuuuauauaaaucucagugcuagguuaacuucuaauaagcagacgaacauguuacauaaauuauaaugucugucuuguaaaaaaguugaggggacuaaaaguuuaugacucugauauggaaguugucauauuaaaaaacuacauuuuaaaacaucaaauauuuauacuauuugcuuuucaaauaaaagcauagugcuguuuggcaua

SEQ ID NO: 191864 - RNA, 157124 nt, Homo sapiens
ugcaauucuugaguauuccagcauuauuuauuugaucagaguaaaauacacuucccaucacuacaaacugagcacaacuacaguugucuacacauucauauuuuugacgugccaacauuuugcauucuacaugaaacauuugguuuaaacaaaaucuuaagaauucucuauuuuguuucccaucuucccuccuguucucucccauccuccaaagauguuuuauauuaacugcuaugagauuuauuugccggucacguaauacggaggacagcagggaacaacacaagauuuaccaugccuaggggaugaauggcaaacccaacuuuggcuaaugucauugagaacaacuuggaagcgugagcagagauaucucaugaaguggcagugaaccuacauuuccauuuaucagaagcaaacauggaagguuacauacaugaugaaguauuggaaguuaaagacuuaagacacaaaaucacuaauuuaaaagaacaugcaacaugaguaucaacuugcuauguaguguacauguaaaugacccaaauauucaccucuagcauccugaaucucuucuuacuacagcuguuauuuguacagccacugaauguagauuaguaaauacugacaucacaauguugacacaugcagggagggggagauaaagcaacaguucuuccuuccaccuuuuccaaagucucaggauuaggggagguaauaaguuuuggaaagaaacugaaaugcaaccuggaggagaguuggacaagccacauuuuccacucaugggaaagaagcggaccauucugcuacuuucccaaagacaaagggacuccuuaaaggguaacugaaaaaugagcgcuauccucccagacuguuuucuucuaucaaguacugcaucaucgguaagcacugaauccuaccuuucuuaauuauacuagccaaugacuuccuuguucucguucuuuauucuaagauuucccaaaauuuguaauaucaaauccaggcuuuaguuuauuuggaaagugguuucagcaccuggaagaugagcuggcucuggggcucuggaaaaucauauuccuuuauccuugucccagagaaaaguagguaggagguagaagguuugcuuuuguggcucuggaugguggagaaagguaaaaggaaaaugagaauaaugggagggaagaagacagguuaaaucugcaaggguagaucaaagguaaaaauaagguggaaaaacccauugguacuucccuuuuucuuucuuuacacaguuaguuaguuaguuuguuuuuuuauagaaaaauuaggguucuacauuuacacauagccugagaaaaugaauuacaggauaguguuaggcucacauggguaaguaaaaaaucuacagaaaaaucuaguuucaacugacauggcugaacacugaaaaacugccaagaaguuacccccaaaagauacagagaauguauagacagggacaagucaaagcucuuccuguuauacccucucccuacccuguuacagggcugagcagaguuggugguagaugaucauaauucaagcaacuauugcuuuuucuucuauggcuuuggcugaaauguauaugcugauugauugauuauuauuugauuaguacauauccagauauauucagauuuugacauuuaauacacagcagaggaggcugcaucagacacaugacacucugugacauccauuucauucacaccccccacccccacagucagacugaaaacucacaagaaggugucuguggugaagaacauuacaaagguuauaaaucuuaauagggcccugagaguuuuucccccuaugcuuaggugaaaaaggcaaugaacaagaugcucucguucuuuaagugcuuugugcaacaacguccgugucgaugccgaaaucuuuuuuuaaaucuuuuuuuggaggaaucuuuuggacggaggcaaaagucuuccuccagaguuccagucucagaagcugcgauuccgccgguggugacgcuccaguuacccuacggugaucacacgugugcugauauaccucuugugcccacguuccuccuuggggucaguccugcagaccugcaucaaaaugcuuucagagagucuguggacuuuggggaggugucaucugggugaaaugcuggggcuagggaaggagcccgaauuccuuggugacugcaaagggauggcggaggaugugggggaucucuuggggcuacacagguccccauugugcaguuuccacagaagcuccucguuuuccauagagagucgcuuguugacuuucgacuccuucuccagcgacucuugcagaacagccugcuccguggaaagcugccuugaagaaaaaggccagaaaccaugagaucuauguaaaaaaaaaaaaaacuugaaaaauuuuucuuagcguuugaaacuuuaaaguccaaaauuauuccuuugggauaaaacagaauccugcacaaggucacagguauuuggcuggcuaagaaaacccaaacacaggccgggcgugguggcucaagcucauaauccuggcaccuugggaggccaagguggguggauaacuugaggccaggaguucaagaucaacuugggcaacauggcgaaacucugucucuauuaaaaauacaaaaauuagucacgcauggugacaugugccuguagucccagcuacucaggaggcugaggugggaggacugcucgagccuaggagguggaggcugcaguaagcuaagaucacaccacuguacuccagccugggcagaagagugagaccucaucucaaaaaaauauauaauaauaacuguacuuuuugggcaauuucauaguaggcugagagccacuuuugcaaauauucgacauguuuuaugacuaccuuauguugcaggcuguuuucuauuugguuuuguguugcucuuugucugaaagcauucucagaggcagccagaggccgugggagcaggcuugcuggccugggucucaguguacaguuuucaggccgcuuugguaaaagcaugaacuacuacaaucauauuuuccacagagaaaucaaugcccuuuuaaccaucugcuuccaucauauuuccaggaggugcagggguagagcguguccagaaaguacacuggauguccaagggagcggggagcucgggagaaacagcacuguuuuauuuuuaccuugagauugccaugugcuuguccauccgagcuuucaauucuucauucuccugcuggaaacgcuucaauuugucaaccaaugcuguguuguuguccaccuuggcauaaacaagaauuccaacauuuauacaauauuaaaaaaaaaaccccucauuucuuaaggcaccucacgacacaagcacacuuuggagauuuaauuaaggaaaaugcaauuccauauuaaaauauuuauacacuaacaaacauacugaaaaagauuuuaaaacagcaaaacagagcggcuggguauuuuuaaaacauguaugccaggacacuuaaauauugauacgaguggguaacagauuuguuccaggucauguuguuuuggaauucucuaagaauuggugccucuuucuguuucaaugugaaauaaacccugcagacacacugcccacacuuaucaaagcuuaucuaucuccuuacggugaauuuugcuggaaaaaaaaaaaaaaagauucccacaucugaugaaaacucacaggccagcaauucacagucccuggcaacguuuacuauggacuugaacucaguuucaugguaaguuuucagcauuugcgucugaguggccauacaaagcuucaauucgauagagcucuuagagcaugccaucaaagaaguaacaugccacgagucuccucaggucagcugaagauagauaggucuguucucuugcugcccugugcaggcugaacuuucaaggcaaacaaacugaucagcggagagaugaaaggauaagaugccugaggacauuuaaucacuuaacaugaugaagaccugauuccaucccccacucacuuucuaaagguaaggcuuuaugaagaggcaauauuauagcuccgucaggauuaagucuaaguccuuguccuuguagcaggacuaacgcgcuuugaguauguugcuuaguuuggaaccugauuguucuuaagacauccuguuauccagaagcagcucaggacaaccuguucagguuaaaucacuuuccagaaaaggagucuacguucaguaauuaugaaggauucccagauaaaacaacguggaaaaaaaccuggaauuugagauugggagguauuguccuuuaaauaucucauccuagggaaacuaguccuaauaaugucacagagcugauuaugggcagugccgguuucaugggaaagcugucuuucuuagaaaacuuccugugcuucuaagucucuuaauuucaucagaggccuguaauuuacaaauaugaagggaacagugggucucccucucauuguaucaacucauucuugcacacauacacaaugcaaggcugaaggauauuaucaggauaccucuggggcauggcaagaaacaaauaguagaucaucagaaauuaaauguguugguaaguuuacagcaaagucugauuuauugcacaugauuuuuugaaaguuuugaugcaugaauggcauauggagcaguccuauuaacaggaucaucugagucaucccugacuaccagauuagaagauaccagacucagucgaacaggacgaccuuuggcaggaacugguauguauacuagguuggcccauuaacaaccaugaguuccuuuccuuccuuuacaaaaauuuccugauaauucaaaaugcugguauauccacacaggggcuuggccguuaucucccucaacagaagucauagucuccagaagaaaaccaaacgccaaaccaacacaaaccaagcagcagagaggucccccauguccccuacuguccagggcugguuuggguuugaaugaggcacuuguagaagccugagucacucaucacuguggggagaagaggccaguagcaugcggcagcuggacagucaacagcaaggcaccgcgagggcggggaucacuuaagcugccuugccaaacucugccaacuugguuagaguccuggcuggcagcagcuguauuucagggccgggccaagacugacgcugaacacugaacaugccacucacacuaacaucguucucuguucuagacacugcaaagugaauguuaauucauauuuuugguaacaccugcuacuuguccaaauggauuaaucuuauuauagcacaauuuuuuuuuugagauggagucuugcuaugucgcccaggcuggaaugcacuggugccaucucaccucaauggaaccuccaccuucccaguacuugggauuacaggcacccaccaccacacccggcuaaguuuuauauuuuuaguagagacaggguuucaccauguuggccaggcuggucucgaacuccugaccucaagugacccacccaucucaaccucccuaaacugcuggcauuagaggaaugagccacugcgcccagcccacgauucuuuuaucacaugcuaauucacaagaagcaagaugaagaauuuugauaaauaguauugcuauucauuucuauuaaauucauuucuauucauuucuauuaaacguauccaacuguuuuggaucuaagaaaccuguccaggguggcugguauauuaaaguacugauuuuacauagauauuuaaacauuuuucuuaugcaggugaagauccaaaauaccacugaaauauaagccugauuuguuuguaguuuuuccaaggacugggugcuguuuuacauguuccuugaaaaagaaaacauucuaggaggcagcaaugaauaaauauggaacaaacuuggaaagaaaaugugaacuuuaucuuuuguauaauuucuaaauaucuuuaggagcaguuaacccaacuccacaguucuaaaaugcagggcucaauuucacacauauuaccccauuuguaagauccucuuucauucugaaggaaacauaccaguuucuccauuuucauuaacuugauguccuguugaugcaguuucucauucuugaucucuaacacagcuuucaggcuuucuaacuccuguucuagauacaugaucugaggauuuuucuggaaaggacacagcaagauacugcucuuauuccacauaguucaaauucuuaacagaaagaaucuuugauuagauugagacauuagacaaguagcaagcgacagauguucaucaucuuagagcaauuucaaagaaagaggugaaaaacaagagcaccuuaaugucgaagacugguccuaauacugaaagcaaacauuucacuuauuuaucaguaacuuaauaugcaaaaaugugaguugcaucaaacauguuauuguaucaagagaaaaacuuugcuuacauacaaaacagaaucuuggcuggagaugaggcaaucugugagucaguuauuggcauuuucugggagaacagggaacaacaguucucuccuaccaaacaaacugaucaggaaagaaaaagcagugcauuauacggcucucuggaaaacaacagggauaacaauguccugaguguuuggauuuuuguuaugauggggcuacguugacugggccauacuucuagggcagacauaauacuaucauuuucuauugugacaccccaguaccuacacggcauggaguacacagccuauuuaaauuucucuccaaaaauuacaaguuugccaggcauaguggcauaugccuacagucccagcuacucaggaggcugaggcgggaggaucaacugagccaggaggucaaggcugcagugaacugugaaugcaccacugcauucuaaccugguggcagaacaagauccugucucaaaaacacaaaacucuccaaaauaaaugcuacaucaggggaggcguccucugagagcacaccaucaguguggauuucccaccaccgcccacccacuccuugcuuuauucggaaauucaacuaaaccauucaaaauuuaugcuacagaagaacagcauaugguccacugaucagauauguuuaaugaagcaacgucuuagguaagagucggugguguggucaucaagcuuaucuuccggggcauugguuucugcucuggaccaauccuuagggagaauccaggaaggggccucggggauuacuuaauccaaaccccuuacuucacacagaaagaggaaacguguuccacggguuaagcgcccuacucaggaaagaucaggaaagcuuccagagcuggaaagggucagggcagggacuaauacaucuuuaauucuagguucuuuagauaguucccugaggcuaggagagguaugcguguguauggugggaggugggguggggugggaugaggagagguugguuaaugcauacaaacauacaguuagacagaaggaauagguucuaguguucaagaacauaguagggugacuauaguuaauaauaauauauugcguacuucaaaauagcuacaagagaagauauaaaauguuccaaacacaaagaaaugauaaugaugacggauacccuaaauacccugacuugggcauuacacagucuaugauugucucaacacaucacacguaccccauaaguacaugcaaauacuaaguaucaauuuuuaaauuucauacauuuuauacaguguuacccuuguacgcaggauuuuuuuuuuuuuuuuuaccuugaaaauagcgaauccuaccucauuuuuguuagagggaaauggcauaacuuaccgucaguuuuaaaauuagagcauuuacaagacuuguacccucugcauuuucuccuccuccucugccagcccaucccuuucucccggacuacagucagacgcacucuuuuuccgcagccucagcaugcuuacgugacagaagcgguuggaugcuucuguguuccucacucugacucugccuuagcuuuucaaaagcggcugcaguagaagaauccccuuuguguaccggaagcucuuucaaaccuguuuccugagccaucaauaaaguuuauacccugcauaucccugcauguaagucuagauuucuuuugaaaucacugacucuuccuaagaaucuucuagaauaaauagcuuugaaguuucuuugaauauaagcucaucuaauguuaucaaauagcuagagggucucccaaugacauuauuugcagaaggucucacugagagauccacacauguacuuucuagagcuggccagagauuugaaguggagaaaagcuuugcuucugcagucucagaguauaaacaugaaaugaaaacagugguacuaaaggcagaagcagcaaggaaacaaauuuuuuucaaaaagacaaagguugggguaaggcuggggaaaaaggacaaaugugccacaagaaauuucagcuuccaagagauuuguacuuuucagaauugacauuuauccauacggcgaaauauuauucauccauaaaaagaaaugaaauacuaacauaggcuacaccacggaugaaccuuggaaacuuuauacuaaguaaacgacgccagucuuaaaaggaccacauguucuacaaucaaccuuuucuauucauuccucagaauaaguaaauccauagagauagaaaguagacgggggagagccuggugcuggggaauuugggggaauggggagugacugcuaauggguccaggguuccuuuugggggugauaaaaauguucuagaaagagguacuggugaccaauggacaacuuuaugaauauacuaaaagccacugaauuuuacauguuaaaagagugaacuuuuccugggcaacaugguaaaaucccaucucuacuaaaaauacaaaaauuagcuggccauggugaugcgugccuguaaucccagcuacucgggagggugaggcaggagacucgcuugaacccaggagguggacguugcagugagccgagaucacgccacuacacuccagccugagugacagagugagacucccucucaaaaaaaaaaaaagaaagagugaacuuuguaguuuguuuuaucucaauacagugauuuuuuuuuuaaauaaagucuucacauaaaacucuaauccuaauugguaguuuccuucuuuuuagcuuagaccaccagaaacauccuggacuucauccguaugucagauuuuaggaugguaaaacaagacgccaguaagcaaagcaguuguuuuacacaccuuagaaagcacauugccagacaugagaaggauucccaaccuguguuauuucucuggcugcugaguacuugaaugacucuaaaaggcaacugagaagaaaaauuccauacugauaaaggagcacacacaacuuaccaaauuugcuuuuucucuugcucuucuuuuuuguucuucugauuucaauuuuucauuuaaagcaucauuuucacucuucagaucauugauuugcuucuaaaacacaaugaaauguggaacuuaaguuaacaagaaaaccccagaaacucagcauacguacacagaaacauuaaaaccaaacaaaaucaaaaaugauauuuuuuuuugugggggauacugggauauugacauucacccaccucuagcgauuccugcuucucagaaaguaaaucuucaagcgauuucuuuucuauuucauggccuuucuuaauuucugggaaaauaaacggauauuuuugaggcaauaacauucuaugagaucaauguacucuaaaacaguuaaagcauauagauguagggguugaugaugaagccguaugacguuacuuuacaucuauaguaugcuuuuauguaaauuggccaucuguucucaaaauggccuugagaggugguuaggguagacauucccauuuuaugacugagagcccugaggcccacugaagcccaccauggcccacagaggccaugcgaccuuaggacaacacugagugccauuucagggcaggcucucauaaaugccacuccagacuccuggucuggaaacccugugcucuuuucaauuugcucuucauaaccuaaacauaagucuaaaauuauacucauuucuagcaggaaggaagaaaaacaauguucacuacaagucugccuggagccagucacuuuuacacauuaucaccucugccugacuuugggcaacucuauuuuuguggugagaaaguccuugcugaaggucacacagccgguucuuagcacucauccacgcugcucuguaagaugcaacugguuuaguagaaagacugugagcgacacugccgauucuguucugaaagcaauggcuuacacccucccacugaugacagaugaaaaauagaaaagacuauuuuucuauucaauaaguggcaucgacauuucacagcaacacugcugugcaggagcacuugggguggauccuuuacuguggauuacaagauagaaacuuguacuugccacuucccagggaccuaagcuggcaaccaccaccgccaaaauggccuuuacagucuuccaaagcccauccuauuuaacacaaggcuggcauuuguaacuauuauuugcauccuuagugggaaaaggcaucuguuaacaauaaaccacgcaaaaaggaaccaagaacaccccagccugaaggccacagggcauucgcugaagcaggaaguuaugaaucauuuccaucuuaaaacaucaugugguuccuucagauuuuauucuguuuaaagaggaaaaaaagcauccuugccugaaagggaggcuucauaggccuucuuuagcaauucaaguuucucugaguggcuagcuucaauuuccaacuuagagguuucaugcgcagcauuuaaguugucaaacuguaagcaacaaacaaaaccgugguuuaacaguaaaaccaaauguccuaaguugaauacgcaaagcaaccacauuaggagacgucacagcuucacagguaagcgugggcucuaguuuaaaggcuccucaacacauacaaaggucagggcagugguucacacuuguaaccucagcacucugggaggcagagguggaggaucacuuggagcccagcaguucaaguccagccugggcaaugucgcgagacucuguccccacaugugcacacacaaagaaugcaugaagagcaacgcaacugggauucaccgcucaacucuccucugucuccuucccuacccucaggaacacagacacagaggcucuccagggugacagauggaaauggcugcaucagucacaaggaaugaccaggaacgaggauauguuucacagugacagggccacaugcucugcgccugucacuugaccacucaggcccuagcaugugccuggccuggaguaggcacucuguagauauuuacuaaaugaaaaacugaguuaaaaagggagcuacaaaauuaaaaagguuugauauuuuauucagugaaaaaaaaaaugggauauuuaaacagaugccacuaaaaaaaaaaaaaagaaagaaaugcaaaacaauaguuuggcaacacaccaccaggauguuuacaagggauuauuucuggguagaaagaaaggguuguuuuuucaauuuuaucuuuuccuccuccuuuucuucccuucuuucacuuaacauaauacauuccuuuggucauaagaaaacuauucaauuaaaaagauacuguuuccaaggcaggcggaucaccugagguugggaguuugagaccagccuggccaacauggugaaaccccgucucuacuaaaaauacaaaaauuagcugggcauggugaugggugccuauagucccagcuacucaggagguugaggaaggagaaucacuugaacccgggaggcagaggcugcagugagccaagaucaagccacuguacuccagccuccagccugggagacagagugggacucugucuuaaauaaacaacaacaacaugcuuuuuauaccuauuagacuaaaaaagagaagcucaucaagaugugaagagcaaccaggauucaaguaagcagcagaggccucagacaagcucuggcugcaaaagcacagaccugcucuugcaauugcauuuuguacuucucugcuucuucaauguaagugucccgaagcuuuucauacucccugguguaaaacucuuuaagccgauucucucguucuguuuuuucagccuggugcugcuggacgaaugcuucauacacuguuuguaacucauuccuggcuuuuucuaauuucucacaggugguugaagcagugacugaaaacagaggagaaagaagagggaagaggucauuuuauuugugaaauguccuauauucauuacagucacacacagcugugaugacaccugaagcauacacccaugaugucuugggucucuagugaccaugucuucaaauauaacaguauggaagugaacuguaaaaaggaacacgagggcagggcgcaguggcucacaccuguaaucccagcacuuugggaggcugaggugggggaaucaccugaggucaggaguucaagaccggccuggucaacaugguaaaacccugucuaucuuaaaaauacaaaaauuagccgggcaugguagcaggugccuguaaucccagcuacucgggagggugaggcaggagaauugcuugaacccgggaggcggagguuguagugagccaagaucacgccacugcacuauagccggggugacagacugagacuccaucucaaaaacaaacaaacaaaacccccccccaccccacauucaaaaaacugacucccaagcaguaagagaaguacuucagaagacccagguuucuaagagaagauccccucucauguggugaccagucaaugcaguggucaagaaaagagccuuggccaggcagagacauuucuuaggacaagcgacuccucccucucccagccagccagugugguagaagcucacacaagagcaggaaagacgagggauaagaaacaaguggaccggccgggcgcgguggcucacgccuguaaucccagcacuuugggaggccgaggcagguggaucaugaggucaggagaucgagaccacggugaaacccugucucuacuaaaaauacaaaaaauuagccgggugugguggugggcgccuguagucccagcuacucgggaaguugaggcaggagaauggcgugaacccaggaggcggagcuuccagugagccgagauugcgccacugcacuccagccugggcgacagagugagauucugucucaaaaaaaaaaaaaaaaaaaaaaagaaacaaguggaccuuaaacuuguaguuaauuugaguugauuauaauuuguuauuucaaaacuaauaaaaauaaaauauuagccucuauuaaacgcaaaucaccagagcacaaauaucuuagggaaaaaaaaacacaucuuaaaagcacccacauaggccaggcacggugguuugugcuauaauucaaguauuuuaagaagcugagaccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguagugacgggcgccuguagucccagcuacuugggaggcugaggcaggagaauggcgugaacccgggaggcggagcuugcagugagccgagaucccgccacugcacuccagccugggcgacagagagagacuccgucucaaaaaaaaaaagaagcugaugcaggagaaucauuugcaccuaggaguucaugaccagccuggacaacauagggaaacccaucucuuaaaauuaaaaaaaaaaaaaaaaaauuauccaggcaugauggugugggccuguagucccugcuacugaggaggcugaggugggaggaucacuugagcucaggagauugaggcugcaacuguugggcaacagagcaagacccuaucucaaaaaaaaaaaaaaaaaaagcaauauaaaaugaaagguuaaaaaaauuuauauauguauacauagguacauaugugcacguauauaugcauacauauguaugcaugcauauauguauauaucuauguguacauguguauauauguacauauauguaugcauauauacaugcauauacauauacauauauaauacauauauacacauauauacacuauauauauagacacacacacacacacacacacacacacacacacacagagucuugcuguauugcccaggcugaagugcaaugacacaaucuuggcucacugcaaccuccaacucccagguucaagcgauucuccugccucagccuccucaguagcugggauuacggcacaugccaccacgaccagcuaauuuuuguauuuuaguagacacaugguuuuaccauguuggucaggcuguucucuaacuccugaccucgugaugcgccugccucggccucccaguuaauauauuuuaaaagggcaaaguaaucugauacacauaauugaaaaucagaacaucuuagcucuucccuacaacuaccaaaaauagaaugacuaacaauauaauacauggcagaacacaaccaaagauauauguacacacacuacaauaaauccuagaaaaucuugaauuccuuaggaagccugacuuuggacauucccagucuucugucaccgauguguaaauacaggcagacaggguacuacuguaacugucagggauacacaugcuguccacauccccagaguacucguggauuaauacgacaggguugcuggcaaaucuguuaaauuaacccuuaccucucuuuggaaaggaauaacauaucaggaguugaaggaagaagauuauuuuagggcacagaaaaggacaauuuagaucaauaauuauuuggccuaaggaacgugaaaauggcagguucuuaggaagauuuccuacaauggugucaacuuguuaucucaggaaccugccauguggugguagaaauacccaagucacuugcccccagucaguauucuuucagaggaaaaggaggccacauugaaauaauggcaggaauagugucugccaaagagaacccuuaaaaauuaaaucaaucuacaaauguuuauugaagggcaaagauuuaacauuaaaaaaaaauccccaaaacaaaaacuauuucucguugccuggcacagaauggggcucuuuaucuuguuuaacccucacagaggacccuccuaaacauauagauaaggaaaccgccacagagaggcuaaaucaucugcccaggggcacagagcuggcaagcgugagaggauggguuucggugagcagucugaauucugauucugccugcacccaaagcccgugccccuucuuuucuaccaagcuguuucuugugcuggggcuggcaaggcgcaugauggggccucuacuggaagagacaacagacagaggagaaguggcaggaccaggccagaccuuggggcccagggaguggcacucaggauaguuuacguccagucaggguggaccaaagguuuggucagauuuuuaaaacaauuaaaaaauaaauaaauaaaaacugugaugagggcugggcacaguggcucacgccuguaaucccagcacuuuggaaggccgaagcgugcagaucaugaggucaaaauauccagaccauccuggccaacauggugaaaccccaucucuacuaaaaauacaaaauuagcugggcgugguggugugugccuguagucccagcuacucagcaggcugagugaggcaggagaaucgcuugaacccgggaggcagagguuacagugagccaagaucgcacuaccgcacuccagccuggcgacagggaaagacuucaucucaaaaacaaaaacaaaaaaacugugaugaagcagauaccaaauuaaccauuuuaauuauuuuuagguguaugauucaguggcauugaauacacuuacaucguuguguaagcuuugucaucauccauucuccagaacguuuccccccaaccugaaacuucguaccaauuaaacaguaacaacccauccccuccccuuccccaaggcccuggcagcgaccauuuuacuuucuuucucuaugaaucugaccauucaguaccucauauaccuggacucaaauaguacuuguccuguugugacuguuuauuucauuuagcguauguccucaaggcucauccaagcugugggaugugucacaauuuccuuccuuuugaaggcucaauauuauuccauuguuggccgggugcaguggcucacgccuguaaucccagcauuuugggaggccaaggcaagcagaucgcuugaguucaggaguucgagaccagccuggccaacauggugaaaccccaucucuaguaaaaauacaaaaauuagcggggcaugauggcgcacgucuguagucccagcuacucgggaggcugaggcaggagaaucgcuugaacccaagcagugcagguugcagugagccaagauaacgccacugcacuccagccugggugacagagcaagacuccgugucaaauaauaauaaugauaauauuccauugcacguacagaugacauuuguguauccacuuaccauccacggacacuuggguugccuccaccuuuggcuacugugaauaaugcugcuaugaacaccgggggacaaauacaugcccgagucccugcuuucaauucuuugguguauauacccagaaggaauugcugacucauauggcaauucuauuauuaauuauuugaaggacuaugguacucuuuuccauagugguugaaccauucuacauucccaucagcaguacuacacacaaggguuccaauuucuccacaugcucaccagaaccuauuugauuuuuucaaauauauguaacagccauccuaaugaguacaucacugugguuaugauuuggucaguagauuuucaaauuaagccauaugauagaaauaaaauugaggcaucaaggaugaaaauccuaucccagcaugagcaaugaugggcgacagaacggugagccuuggugauuaagaaacucacaaagcagagaagauagaacccaaaaagacagacggaggccagauuacaggggccaucgcacgcaacucaagccuuugggacugaauauuaaaaguuucuuuucuccuuuaaaagaauuuagugaaagauagugauggucuugacugcuggagaacauucucugcacauucacuuuuccuucuauuacacuaguaaccacagaagaaaaaaugacucaagaaguccaauguuagucaaacgaguaaacacugcauuagcuucugccaaguaacuuuccgacucugaaggcuccucgugugaaucucguauuagaacuuucuaugaaaaccuacaacagaaacauacuuugcaagccguuggugaagguaucaaauagcuucuagucagagaaauucuaguuucacgcaggcuuuucacuugcuucucuuaaaauuuccgguauuuccaaaguuaaaaaauaaaaaagcaggaacaagaucugaacccaucuggaagcucauaucugggacagaaacaucuaagugaacucagggacucagcaauaaacaagagacugccuccaagcccugggcuagaagagcuucgaagcugacguuaauagcagacuacccuggcugauuuuaacacaucuguuuaugauaaaaauacugucgcuuugaauauguaauuguggcacaucagccuuuaaaaccaaauaggauacacagaaguccuuuccuauuagccaugggacagggcuguuucccucuauucaccaaaaaaaaaaaaggcagcucugacguuuugauaagugaggugaagagaggacacaugggaagaaacgggaaagagaaagggagaaaaugggucagaugggggaacaggagguucacugcuguuauuguaauaguccaaagcagcaggcccagccccagacagugacaucagccugcagcugugcacagaccuuugcucuguuuacuggcccggugugcugcuggggaacagcugggcugcaguaaucgcucacacuaauggcuuucguuugaaggaaguggccugggcugcgaaggaaacauuuauuuggcauaaagacucaugaaguauuuuuuaaaggaugcacauguaaacgcuguauuaaagguucucagagugcuccucggcagcugugacauaaacguguguguguggcgguggggggcgugcauaaccccgauuuuaggccauggacuuuccugugcacugacuacagcuuaggagagauuuauggugccaccugugugugcucucacuccuauccucagccuagucucuucuugcucauucuccagaauuccacucacuuucaauuaaucagacaccccacaaagccaaaaccaaacauaaaauuguuucgaauuugcaacaagcaagcauggacaugcgaauguuugaaagaagguauuagacaaacacaaagucaaaguagucuuuuugucccuauuuuuuuuuuuuuuuuuuuuuuuugagauagagucucgcacugucaccugggcuagaaugcaguggcacgaucucggcucacugcaaccuccaccucccggguucaugcgauucucuugccacagccucccgaguagcugggacuacaggugcacaccaccacacuuggcuaauuuuuuguuuuuuaguagagaugggguuucacuauguggguaagacuggucucgaacuucuggccucaugauccgcccaccucagcaucccaaagugcuggaauuacaggugugagccacugugccuggccucuguuguuuuaaucauuccauuagucuauuuuuuaaaaaagcacauauaugauuaggaacaccaacagaccaccaucuguaggagaacugcugggcaacuuuuguauacauguuuguaaaccaugaaagcuaucuccagcaaucuagcuuaaaagaggaaauacaguucucaggauuuaaggaaaaagagaaaaaaaaaaaaagaaaaaggaagaaaggaggaagggagggaaggggaggaaggagaagaaggaaaggaaggcaaacucauguacaaaaacaucucuaaaauguaaggccacauugagauuagaagucaguauuuucacucugcaaugaaucacccaagaagaauucuaggccagugacccucccugacaguuuaaaucauggauaucucagcaagaaaaaaaaaucguaaucagugaaaugcuuuaaguuuugcuuuucaaguaauuaucaagaugauauguggaaaaugcccagugccacagucaaacauaaucucuggaaaacagagcuggaguccucccagguccuucauuacuuagcccugcagaacuggaguggagccauuacuuaauuaguccucauggcuuuuucucagaggggaaggucagacuuuuauuauuuccaucucacagagacucauuucccuuuguugauugauaaauguacuguuuacagagaaaagcauuacacagccauggcccgacauuguuaauauucuuuugaaaugauacagugcuuuccuaguuuuuauaucugaguagcaugguucauuaugagacgaccaaaaauauuuuaaugcucaagaacauaaauaaauguccuaauaggauagagccaaaauuacuuggguucaaaucucagucacaccacucagcugcuacaucacuugagcaaauuacuuaaacuuucuaagccuacuuuuuguuuuguuuuguuuuguuuuuuuugagacagaggcuuccucuaucacccaggcuggaguguaguggcacaaucucagcucacugcaaccucggccucccagguuuaagcgauucuccugccucagcccccugaguagcugggauuacaggcaugcaccaccauacccggcuaauuuuuguauuuuuaguggagacaggguuucacuacguuggccaggcuggucucgaacuccugaccucaaaugaucugccugccucggccucccaaagugcugggauuacaggcaugagccaccgcaccuggccuaagccuacauuucuucauuuuuaaaguggagauauuauuagucccuucucuagaagaugaaauagcacaggugaagcacucaccccagugccugaccacaguaacuuugcagauaaauuguauaacuguuacggcuugcaagaguccauugauuccaguguguuugaagacuccuggaagacaggcuuaggguuccauaacagaaauauaacaguuaaaaagcagcauugcuggccucguauucaaauuugaugcauaugaacacacagacguagcuauuaugguggaguguacacucacuucaagucuuucccuuccgcuacuauuguucuugacauuauacgcaauagaauuuuccuaauuuggaggagauuuuauguaaaucagaacuaaaauauaaaaaagaaaagugccaggcaaauuuucauagcgccacauaagagaauaccauagaaagaagagacgaacaggaaaaagagaugauuccauucccaaacugcacacauacuccuuucccagacgcucuggccagccugcuguggguggcgacucucccccaccccaccccgaaaucccccucucugcaccaucuaggauggagaagagcagccugccuccagcucugccugcagugggccccucacucucucuuggccgccugggaaaccggccuccuccucucaguucugggcuccuucacuucuuucuucaacaguacauacccauuacacuucucgggguaaacagaacugucacuucucuugugccccacccccagaagcaggaggggacacuacauucuaccguaggagugugaugaugucauaacauucuacuaagggaaauccgaggaaauccgauccugacacacguccauggcaagcgacuauguaggugacccccuuaagccaaggucugaucugguuugaaacuggagguaguaacaucacugaacaaguaaccaagaagucauuuuuaaacaucaaauugaugcuuuguggacaggcaguggccuaaagaagaaaaaaaaggugggacccagacuaucccacaaauaggcauguccaguuuccugggccuccguguccugauauggaagguaggaacaaauaccaccuguucugccaacaguauagauuggugauaguaaagugaaacagaguuacucuuaugcuuuguagaaagucuucccagccuguggaauaauccccuacucacauagugccaggguuugccucucuaaagauacuuugucaaaugaccaagaaauuuugcagacaagugguagaccagguucuuuuucuacauuuccaaauuaucuccaaaugccuuucugauuacuccugggcauuaaaucaacaaaucacuaagagcucauuucaaagucuuccauaaaucauaaauuauuaggaacuugcuuuuuacaaaaggccugcacaaucaaaucaauccucccauaaaugccacuucaccuuuaaaacucaguucauacuuuacaaggugcucucacauuuguuucauuuaauguaacaaugcucugaacgaauaaaauagguauuaucagacaucucauuuuaccaaagaagaauggaaauaacggagcuggaucuacaacuccagccucuuuguuguuguuguguuuugaguagauaugggguuucaccauguuggcaaggcuggucucaaacuccgggcaucaagcgaucuguccaccucagccucccaaagugcuggaauuacuggcuugagccacuaugcccggcccuagaacuccagccucuuugagagccuaaccacagaacacccagcgggaucugacuggcuauuuuucccagccugagauguagaagacaaaguuaauucacacguaccauggaugccucaggguaguagggcuuaauucucuuguggaagcacugcugaaaagauuccaagauaaggcagguaaaaaaaugaccuuucccccccuauacuggguagugcugacaaagugugacucacaggugggaagacaauuccacccagccagccugucuuccaucuccaucuuggugccuagguaccagccgggccuccccuaagguucuagccucucccugccaguguuccuccucccacccuugaagagaagccugcaaaggccauuugcuguuuuucagcucauucacuggccagcaugcugcagaacagaugcuuuuuuuuuuuuuuuuuuuuuuuuaaaucacaacagcaaacacuccguguauaaacgaacacauuuaggaauaaaaguggguuggaggcgagagcacagcugaauaucugacaauauguucuaagauucaggccugagaaaaagugaggcugacuuuaaaggaauccuguuucaaucaagaguuucaauguaaaaaaaaaaaaaaggaugauuuuaagucagggacuauucauucugccucuucuccucacugacggaucauuuuuagagcacgagggucaaaaaggcugcuaaaaguccuuggcauguguaaaauuuaaaagcuuauuuauaagaauggacucaauucacucggaguuacuucauauuauucuuacuaugcuugagauauguauguauuuuuuuacauaaaagaaacaacauucuaggcagcuagagcagugucaaaggguaguccuggggcaccuacaugagaaccaccuggaugaucauuaaaagugcagauuccuccucaauuuccauuaagggaaagguuuugcuuuauuuuucuuugcagguagccaaagcuguacucagauauugcuaauaaggaagaaaaacuggucuccuguuaaccugaggacacuagggccagaggucaggaagagggaucaccuuccccaucaacacaacaucuuuuuagaagugcugccucuccuucuguaauugggaagcaccuauuacuauuccuuaaagcccaaagagggguuaguaggaugauggguauaggagacguugggguuuaaaaaaaacaaagugcagauuccuggacuucauccccagccaaccaagucagaagcaaugggcaugagaacugaggaucugcauuucaaccaggucuauuuucguacacaauaaaguuugggagccacuauucuacacaauaagguauuaaauuaggaaaaucccaaguugagagacuggaguuaggacaaggaacaggacaaggaggaacagucaguggguuucaaacacagguaccacugguaaaacugcauaucugcaggugaaagaacauggccuuuuacuuauaaauacagccaaccaaaguccaaauugagggcagauguggauaggaagagaaugagcuaagucugagguggcuaucaacucagucuucaaacaagucagggagauaaacagcccuguuuugguguacaguugguuuucaguauauuaauagauuuuucauuaaagccuacuucaagaaaagucacuucuggaauuuuacaacucaaaagugacuuaccuguaaagaguuuaaaaauuauuuuaaauacauagccuuguuaaaccaaaauuguagauaaaaacggaacagugaaugaaucaacacauuccauauggcgugaggcaaugugaaguucauagacacuggguuaaguguugauuaggcaauguguauacugcuuuuggcaauguacuguuuuuugcaaguuacuuuccucaguaagauacauuuuaacaauauuucuuaaacucuugauuagaagaaaaauauuccaaaaguagcuaucaaugcaaacgagcguuuauuucaaauaguuuuccaaucuuuuaaaucauuucaucaaacuuucccuguggugacuaccagaagauugguggucuagccaucuuggguucuuaugcaagcucuuugcuuuccagcuucccuugggaaguuacuuaaccucugagccacaauuuauuuuuuauaaauacaaugcagagaaguagacugagagcugaacauuguuuguuagggaugaguaggcaccaaacacacgauguuguuauaccuagcucauaauuuucaugcacaaaaaucaacuggucuuuuuacacuauuauaggaagggcaagcauuuuuagugaauuaaggauuaaaaucuuguuucacaaaauagaaauaaucaggacuaauguauaaaaagaugagaguuagcuguuaauugugauggcucaaaaauaauuuugaaauacaaaauaaucuucauuaauuuagaucaagcuuguccaacucacagccugcacguggcccaggacagcuuugaaugcggcccaacacaaauuuguaaacuuucuuagaacauuaugagaugugugaauuuuuuucuuuucgucaucagcuauuugcuaguguuagugcauuuuauguguggcacuagacaauucuucuuccaacguggcccggggaagccaaaagauuggacaccccugauuuagaugaaaagucugauuccaaggauuaacauuaaugaaaagcaaaaagaacucuaaagaucauaaucauggcccucuauugcaccagcuguuauucaacaugacucuggaaagaaucuuauccuagaggcaaaaugucugcugcagauguagaccauuuaacuguaaucuauuuccaaggcugacacuuucaaaaugaucugauuaacugggauugucggacauaauauaaaauguauccaagagaguuacagcucuccuuuaugacuaugcauuccuaaaggacaauuaucuuuucuuuucaagauguggauuucauuuuuuaauuauucugacucugcuuuaaacuuuuauuuuagguucaggggcacaugugcagguuuguuauuugggucaacuugaaucacaggggcuuguuguacagaauauuucaucaccccgguacuaagcccaguacccgauaguuauuuuuucugcuccucucccuccucccgcccuccacccucaggcaggccccagugucugcuguuccccucuuuguguccauauguguuugucauagaaauguuaaacgguuuauagaaaaacauuugugcauaaaaaacacugaguauuagcauauuuuaagaagaaaacuaccuuucccuagcuaccacuguugguaauaaaaucauucauugauugaagucuaagcaccugcuaagugccaagcacaaggugggagaacuacaaaaauuaaggagcuauuggccuugcccuugaagaguuccuaauucuagauggcaagaagaggucuauaaacaaaucucuguaagaacaaaaucuuaaauguguacagggugcuuugaaaagcacacuagaaggcacaguuaacuuacuugaaagauuugggugaaauucaauugaagauauuuuagcuaagacuuaaaaacugaguaaaagagaaggagcaugagggguccgcgacgggaggggaguggaaagaggagagugcacuccaggcagagaggauaccgugcaaaagauguggacaagaggugcaaaugaacccauggccggggccugggaggggaaaggaggucugaacaaaggggaaagagugccuagacgugaauuuggacuggaagauuucaaucagucaaaucauaaauggugugcuuaguaugucuggauuuuuucccccaaggccaaaauagagucuuuuguguuuguuaaaaauguccaguacaggccaggagugguggcucaagccuauaaucccaacacuuugggaggccgcagcagguggaucaccugaggucaggaguucgagaccagccuggccaacauggugaaaccucgucucuacuaaaauacaaaaauuagccggccgugguggugcgcaccuguauucccagcuacucgggacgcugaggcaggacagucacaugaauccaggagguggagguugcagugacccaagaucaugccacugcacuccagcaugggugacaggguagaaaacuccuucuaaaaaacaaaaaaaacaaaauguccaguagagacacaugucagccugacucuaaguacagauccuggccgcaaguggaguugggggcgcaggccuggaggcaaggugacccauuggguagcuguugcaguaucuuccaggugagaaauugugggacuuaaaacagcagcagccagaaugcugagcagggauggauccaaguggcauuuaggacacagacugacaugcacguggaggaugggggaacaggaguaugauuucaguuguuagcuugggugguaagugaaucauaucgacccugccaaagcugaggaacaggggugaaugaggagacgcugcauggcgcucaggaaggaaggggcuggaccaucaggaaggucugauuauacuggacuggcucaccugggggcagccccucacugggaagcaucugcagcuugggaaggagagaacuagaaaaauaaaucugugucacuguuguauagguaguagcggaaaccaugggaauggaugagaaaacagcuggcaaugaaacccuugcuauauacuaugacacuauuuaagggguaagugaacguaugggacagccacuugacagacuuucccccagcccauuaaaggugaucauaaugaacacuaugaggcaauguggaaaagugcuugaccuauccagugaaaaagaucacagcagacaucugaccaggugccauggcucacaucuguaaucccagcacuuugggaggccgagacgggcggaucacuugaggcaaguguuagagaccagccugaccaauauggugaaucccugucucuacuaaaaauacaaaaauuagcccagcauggugguaugcaccuauaaucccagcuauucgggaggcugaggcaggagaacugcuugaacccggaaggcagaggucacagugagccgagauagugccagugcacuccagccuggcaacagagcaagacccugucuuuaaaaaaaaaagauuggagcagacacuuaacauacacaaaucucaaaaguauuaugaaacaagccagagacaaaaaacagcauacuauaucuuuccauuuaaaugagaaucuaguucagacaaaaccuuugauaauaaagguuaaaucaguguuugcuucuagggggagggguguuccacugugaaauggcaugagggaauuuacuggauugacagaaauagucuaugcuugauaaggauguagguuuuaggaguauaugucugucaaacugauggaauaauuagcauuccgcuguaugaaaauuacaccuuaauuuaaaaaaucguaguaugaaguuguauauauucauauaaacuaagaaaagggaauaugcaaauaaaguuaugucagggcaguggagcugccggcuguuuucuuuucacuuaaaaaucuuaauuuucauacauuguucuaaaaaaaaaaaaaacuuuaaaacuuaaaauacccaaaaauauuuaucgaguacccaagaaaacagaaagcauauuauauuauuuuuccauaggaaacagaaaagaaucccuacaauuauggacuuuauaccugaagguaacaagaaaacacgagacaguaaagacaucaacguagaguaucaaaaaaucacuggaccaaagggacacuuuuaagaguuucugcagaagcaaagaaccagugcuuccaugaagggaguguggcucagacaguggaaacacacaggcugcuuuggacacugccacagugagacugagggaacaacgggaaagucaguggaugcugggacagcuggaggcuguuagaugcggaagguggaaagcacagacucuaccuggguuucagugcuccugaguuuaugaacuguccuuuuucuuugcaguucuuaguaguuuggguaccuugucucaacuuucauugagaaggugaagaaaaauuacccaaugggagagugacaccaacucccaucgccccacccccauuauuuuggagggaagaagugggugcuuugaugacggcgauaguggcagcucucuuuucuugaguugcugugaugggccaggcacuacaccacugcuuuauaugcauuacuauuuuauucaagcuccacaauaacgcagcaaaauacauacugauuucauaucaccagcgaaaaaaccauacucaaagaaguuagguaacauccaacuaggaguggauggacaaaaaccuaggcuuugacuccacacaccacacucuacuggaucaggagaauacucugaugaggucucauuuccacuugaguuugaagagccugucguuugggauuucuaggaauauuuagucuaaugauuauuccuuucuguagcauagaugaugcccucacaaaacagccagugugguuaauuacuacacagcugucaagcugcauacauccuaauaccuauuauuuaauagcaguuaacacuuggugcuagaugcuuuacaaugcauuaccucauguaauccucacacccacccuuggggcagacaauuagcaucgccauuuuuaccgaggaugaaauugggacagaagagauacaaagugacuuguccuaagucacucaguuaccacaaauguggccccggacagugugacaacaucagccuaaccacuuuacugccucaaaauuuaaaacuggguucccaacuuugcuaugucaaugucaaaguuaguuucaugcugaaacuaacaaucccacuggcagccuugagaguguucuuccuggaccgcuucaucacaaguguuuacagguuucgcuucccuccacuuacagaaccaaaacccuucuccaaacggagaacgguuaccaucagauguaugccugcugcaacagcagcaaugacacauucccuaagaagccagcacugggugacuggggaucuggauaggccacccacuguaccaacacucgggaggcaggagaagcagugcaccaggacagcuuccuuaucaaggauaggaaggugacagugggcacagacuguuacagcuauuuccugucaggcuaccugacucacuggaggugcugaaucccugggccccaacugcgguugcuuaauugugcuguccacuaaaauguaaaaagagcauccuucauugaagcagagcgaaugggcacaguguuccauucucauugcugccuugucuucggagagaggcugaaaugugaaccucuagguaggcucaccuccacuuccacuggguuauaaugaacucugaaacacacacaaaaaggccucuuuccugaucuucuaacucuguuaauuauguuauuuaaggcauggacaaaagcaaguuggguuggucauuuagguaaucauaagggcugcugucaaguuaaguaacauggcagaaagccugcaaagucugagagcugggcugucucucagcugggauuuccuugaacuguuucaccagaacucucaagucuuugggauucugaaguuuccaucugucuuaaaauuacuuuuccauaaagaggccuucauuuccacagccuaaaauaaagugaggacugaugucuuggcuagguauuaagaaucuggacgguuagucagggauuuggccucaccucccacuggaaggggaaaagggaagaugaaugcagagaagucuuuuacagagucuugcucuguuggccagacuggagggcagcagcacaaugacagcucacugcagucucgaacuccugggcucaagcaaucuucccaccucacacuccagaguagcugggacaacaggcacacaccaccaugcuuggcugauuuuuaaauuauuuuuuguagagucagggucuugcuauauugcucaagcuggucucaaacugcuggccucaagugauccucccaccucagccucccaaagcgcugggauuacaggugugagcuaccacacccagcccagacaaagucuugaccccacguucacugccguuugauuucugcuguggugaaggugggagaauuaagaguguucaaauccagcaaaucagguuggcaguguggucuuguccaaaagaaaaaagggcaguuucuccuagaguugggugaacacaauuugcuucucuggauguuaccuugcauuauucauacaacauaccugggcauauuuugguggagacuguaacacacacagaaaacugcaaagggcaaggaaauaagcccuagaauggucagcuccagaucuggcugaagcugaagcaggaaguugauucucuagguugaggagcccagggcagagagaagaaccccaaagcggucagaucacuccaagauacgaguugacguagaaaagggagugucggcugggugcgguggcucacaccuauaaucccaguacuuugggaggccaaggucaagagauggagacccuccuggccaacauggcgaaaccccaucucuacuaaaaauacaaaaauuagcugggugugguggugugcuccuguugucccagcuacucggaaggcugaggcaggagaauugcuugaacccgggaggcggagguugcagugagucgagaucgcaccacugcacuccagucuggugacagagcaagauuccgucucaaaaaaaaaagaaaaagaaacagaaaagagaaaagcaaaacaaagcaaaggcagugucgugucuguuccaugaacccuaagggcuuccaggagagaauggaacuaaaauaacagcguagccuggaaacuggagggcugggugguggguguugagaccuggaaacugcagggcugggugguggguguugagacauguaaacugcagggcugggugguagguguugagacguggggcucccuguggagcggggagguggugaaccaucagccccccuccaaauaguaagauuagcauagaacgugccuuuuucagccaaguugccuucauggacagcauccuuucaacuucauacucacuacucacaaaccaacccuuggaaguacaacggauuuacuguuuaucaagaggggaaacuuucacuauucucauaugaaaagugcuucagaaaaaaaaaugacaacauuauuuaacaggaauucacacaauuacaaaaauaacucugucccucucuucagcaagagaaauauuuugcucaucagaaguucugcuaggcuuagucagaucagugccaggaauucugugaacugaaggucaagcugccaagauucaaaagaaaugucgauaguaaguguuugcccagauacuagacagggagugccaacagcucccagcaugcaacuccagccacaacgcagacaggacaaccacauuuuccaguguuccccuugucccauaaaauuuaacaacaacaacaaaaagcucuuaccuagcucuccccggagguuaacaaguucuugagauaggguuuuguguuguuucagugcuuccucccgcugcggaaaacacacaucaaguuacucaugcuuucaagagggucccuuucaguaagguacacauuuguuaucacuaggaaaaugagacccaguauugggaagccaagauaugaaucauuuaggcuaacaauuuguguuguuaaaagaaacacaguugucccuuagcuguuaaggaaauucguaauucaaaaaucuguauuuuugcaggucccagugaaacuuugguuugacgcagugaauggcccauuuagaaauauuuacuuugagccagugcuucacugcugauccauagaaccuuucggcuaaugcauacuguacuuaagauguaaugcguucuccuccuccaagggcaauaaacaucuaaucaguuuaagauaaauauuuaauguucuaaacauaagcacauauaugcacuuuguccuauauuugcacauaaaaaaguuucguuacaaugccaauccuucuaaaagaaagacaaaaaguuuguuagaaagcuauagcagaaagauaauccuuuaaagacaaaauuaaauuaauuuuuuucagcuacauaccauuuucuaaggauuaugauauuuuggaucagugauaauucuaaaucgauguuagagaaacaaaccaaagaaaaccggauggcuguuuuuaguaucagagaagcaaguaucaaccuugagcugaagaauaauguucaaguuaccagcaacucccggcaaucacacauacacacauacuuacacaaauacaguaauuacauacaguuccuuaaaagguagauucccuagcaccagggaguaacuaaaaaaaaaaugaagaauuucaaagcucgcugaaaaaugcccucacgaggaucacccaagacggagcucccaccacauccugaucacagcguugcagagaucaugagacccggccuuugcaggcaagaguugcuugucauucaaagcauuuucccugaauuccagacagccucugcaguaguccugacauucuuccagaaaagcacuauaaacaaauacuaauuacccuuguugcugcacauggagaauagaggcacaguuugcugcuggggcagcccauuuuccagcuucugucuccaaguccccccaccccucgcacugugcaagaagcauacagguggccgcgccacccaccagucgggucugucuacauucaaagcucuagcaggaggcgcgccauuggcccucgggcgucuuacuucauguccugcagguuaccgugugccucggauuccucacucacagaagcugauacugcagcuucugccuuuggcacaggcagccugugauuacuuaaagccacagccuuucauuuaugaaaaacgagaggcaggcauuagacugaucgauugccauuuaguuaaauaucagcugcaacggaggaaagaaaaaacugacccccucugcauggauaauggaguuauuuuuagacuugugagccuuuuucuuccccucucuaauuguggucauuauuugaucacacuuacuaauagaaaagggaaacuuguucuucgaagcccauauacuaaaugagguuaugaacuaggugaagagcaaggaaaggggcaugcugucguuuacaaauuuaaaugacauuaugaaaugagagguguuucaaaauaagucugaagugcugaucugagaguuggagaucccauauauuuuuaacuuuuacuuuguucucaccucucaguaagagcuacggaagucaagucuaaacgccagcacugaaacguggucagcagggacugggauuuaagacccacuuuucacugaguaccuuucuggcuucaaugguauucuaaaugcuugguuuuuaaaaauauggcauuaaguuguucugaaaucaccagugagucagaguuucuuaaaauaauaaguaauugguuuucuaauguagaaauuaaagccugaggaaaaucagcccgcauaauaauggaagaaaaacauaaaaauauguaucauaaauacuucucguaauaucaaauuuaagccugaauuuuguuuaguaaucuacuucaaguaaacaccaggaagcuuuaccacucaaguaacaggaaaaacaagacagcuuuacuaaaugcccacaaacaauccugaaacucauuuggugaacuugcuuaaaauucacuuuucaguaguaaccaaguuacuaacagaaggaagagauggcaagaaaauucaaucauuuuucaaauuuauggaaacuaaugggaggaugaaagaaauuaaaaauuacaguuaguauaacugcaaagaaaaauugugugaaaucauuauguucuacugcaaaaauacaccaggugauauuuuugcuuauuaagggagguuuugggaaagggaguuucaccaagcaugucgacauuuccccaaacuucaacuccacugcacuccacguuccuguccuuaaugccucagaaacuacugacaucuuccaaccucugucaggcacaguaacaguaacaggaaaaccuugaggucaucuuucacucuuugucuaaauggguugugcaaaagucaguugguucuucccuuguaaugugacaccauuccccuccuccaaaugcauagaccauuuacccuucuaaauugguugguaacuuauuacuucaaacuaauuaacuaagcauuuuucauagcagaugcugugaaaauauaaaagaaauuuaagacauggucccugccuucaagaagcauggggccuaccuagaacuagaacauccaggcucaauucuuuuggucaucuaucaaggcagaugaccucaucggaugggaagcaguaaugaaaaaaaccaagggcuuuaaauaccauccauagaugaaaugcugaccccagugcccauacuguaaaagacacauacuaaggguuaguuucugccugacucucccugguagcuuggccuuuacauguacuuacccuuuacuuguagaugauaaaaugcauuauguccuuuagauacugauuuacuguuucuuuuuacucagcugcuccuagaucaguguuucucucuuagaugauaaacucuuaaccgucuagauaacagguugauucaauucucuuuguauuguaacaugcagaauuacacacaaugugaaaaaagagaaagguggaaaucuggauauaaagaugccuuuaugcucaggcauuaaauauaugaaaugcucaagaaaaaaaaaauggauucaccauaauugaauuaggagucccugggacacaggcacuuagucucuggcuguggucccaucggugugccugcauuuuugcuagccacugaguagcaucaacagcauagagcaucuugcagagaauagccacaucagauggcucagacgugugcugcaucugaccuccuccccaucacccacacagugaauuugcucaaugcaucuauguuuuuuuguuccaagucaacuuuacugcuagugccauucaaaauucaccuuuguucaggugcuacuuuagguuaaauuccacuugcaaaaaaaaaaaaaaaagauguggaggcauuuugaagaauuagagguuuggggagggugaccucagcccuguucaaguuuaccuagaaagccacccaauagacccuuuuaggaagaagcuuaauuacuaccaucaauacuguuguucacuuuggcugucugugcagaauaccgucuaacuaagcaaggauaaaccaagaauuagaaaaaaacuaaaauaacuuuagugugucuucugcgaaacagagugugacauuaguucucagauucaugagauauaagaaugucugauauguaaugaaauaugucugccacuacagugggaaacuuauaguuacuaaguagacuugcaacaaaagcaugguaguugcaagauucucuuaaccauuuucacccauaaucgaaggcucuaaagccauuuagaaaagguuagcaauaacaaaaaauauauauacacacacacacacaaauaccuauauauuauacauauauaaaaauacauagacauacaauguauagguauaucauguauauaaaaaacauacauaauguauauguauacaauguguaucuguaucuauuuuauauacauaugcaugugugcgcgcgcguguguguguguguguguguguauaaacacaguauauauacuucuguaaugggaaugggaacuaaaagguuaagggaguuuuuaaaauuguuuaacuuuacccaugauuuuuuuucuccaacuauuuuuauuuuauuuauuuauuuauuuauuuauuuauuuuuugagacagggucucacugucacccaggcuggagugcgguggugcgaucuuggcucacugcaaccuccaccuauuggguucaagcgauucguaugccucagucucuugaguagcugggacuacaggcacaugccaccaugccuggcuaauuuuuguauuuuuugguagagacaggguuucgccauguuggccagacuggucucaaacucuggaccucaagcgauccacccgccucagccucccaaagugcugggauuacaggugugagccaccaugccuagccuccaacuguuuuauaauagugcucaguauacauuacacaaucaguaaauauuugcugauuauaaaauaaagagagcaaagaacauuuacauaagacuuuaugcucauccuacaucuggaauuccauccucuccguucauauguucacucacauauauacuguguugacuauuaaagcugcuggggugguuucauaagaaagaacuagaugcagauccugccuucaguaaauuuccugucuuaaaaagcaaaaacaagcauuaaaccgguaucucuaauauaacacagacaaugaaagagaagcauauaugcuccuggaauccagacgggaacagaacguagaucuagaaggccaggaaaucauuccugaguggguucuggacugggagugguggaucaugccuguaaucccagcacuuuggaaggccgaggcagguggaucacuugaggugaggacuuuaagaccagccuggccaacauggugaaaccucaucucuacuaaaaauacaaaaauuaucuggguaugguggugggcauccguaaucccagcuacucaggaggcugagucaggagaacugguugaacccagguggcggagguugcagugagcugagauugcgccacugcacuccagacugggugacagagcaaggccacugucgcaaaaaaaaaaaaaaaaaaaaaaaaaaaaaaaagcggguucuggagcuguauucagugcagucacaauuccuuggcugucaggaccuaaauuuaaguauaaggugaaauucacacacaguacaauugucugggaaauucacuaggagcuugccauguuuguggacaaugcaucucucuguagauccaacccagugaauuuuuuuccucuagcguuggaucaacucucucuauaacugagcaccugauaaaggccucggcuuguguuuagaggccagguugcaugagggaaaaguaucuuuaaacacuaagauagcagagaguauagaaugcucacgccacaagagguguucggggacugagcagacacaugaaggaaggguggacuccugaccuucaucucaaauugacucccgggccuucguucacuggggggaauacaagguggacuuguguucuucauuuaauuugcuuuuuuucuuuuuuuuuuaaguuggaaucucgcucuguugcccaggauggaguguaguggugcgaucuuggcucacugccaccuccaccucucaaaguaaagugauucuucuaccuuagccucccgaguagcugggacuacaggcacaugccaccacacauggcuaauuuuuguaguuuuaggggagaugggguuuuaccauauuggucaggcuggucucgaacuucugaccucaggugauccacccgccuuggccuccccaagugcugggauuacaggugugagccacagcgcccggccugcauuuuucuuccuucaguuguuuguguacugaaucuauguaaauuaaaugcaaguggugaugugaugcugcuguaaaaccgaccugaacauguagguauugugggcaaggacagcaacccaguaaugauacgugaacaauggaugacguacaggaaguuuacaggacauuuuuaguugauagcuuccuagaccuagguuuacguccugguucuccucuugcuagcugucugauagcaggcaaauuaccuaacucuaugccucaauuuucauauuuguaaauuccaacucgugucuuuggugaggauuuaaauaagguaaguaagaauaucuggcacuuaguaaauauuaggcuggugcaaaaguaacuguagcuuuuggcaugauggcaaaaccgcaauuacuuuugcucaaaccuaguauucaauaaaucccucuugcuucuccuccaucucuuuauguacggcuacagcaucugggcaugauaauaacauuaaaaggggcaguuguugccaaaugauaaagagccuuauaguaccaguugaaaaccagacuccccaaaacaaaauaacaugaguuacguaauuauaaauuuccuaguagccacgcugagaaaaguugaaaaagaugaagcuaauuuuaauaacguauuuuauuuaacccaaauauauauauaaaauaauauuucaauauauucaauauaaaaguuguuaaugagauauuuuacauccuuuguuuucauucuaaguuuuuggaauccaaguguauuguacacuuaccacacaucucaauucaacggauuuacauuucgaaugcucagucucauauggcuaguggcuaccacacuggacacaucagcuguagauaagggagaaccacuggaagauuuaaucagcagcgugggaugcuuugguaagaggacgcugucagcagugcuugggauggauuauaggugagaaacaguacaagccuaaugauugguuaaaaaggugcuaucacagguugggcgcaguggcucacgccuguaauugcagcacuuugggaggccgaggugagcggaucaccugaggucaggaguucaagaccagccuggcccacauggugaaacccugucucuacuagaaaauuacaaaaacuagucgggcaugguggcgggugccuguaaucccagcuauucgggaggcugaggaaggagaaucacuugaacccgggagguggagguugcagugagcccagaucacgccauugcauaccagucugagugacagagcaagacuccaucccaaaaaaaaaaaaaaaaaaaaaaguugcuaucaugaucuaguggaagcuauccagggucugagcaaggauggcaugaauggggacagcaaagacauaggaaggggaaaagcacugugaaaugagaguucacaggacuugacugacgucaugaggaggaugaaaggagagaaaacaguugaggaugggggcuauuaggcuagauauaauaaaauaaaauaauugguuuauuucuaaacauaaaaacuaauuguuccccacauuugauaguauacaguuucuaguuagcuuacuugguuauauaaacacacucuugauuccuuucuuacaaaugaaagagaaacaaaaauaccauauacuauuaccguuacuaaaacccuaaguagucuccaacuuccccucaaaaaaaacaaaaacaaaaacaaaaacaaaaaaaucuggagaaagcuguaaaauacucaucaagaaaucauuaaggcugggcgcaguggcgcaugccuguaaucccaggacuuugggaggccgaggcagacagaucacagggucaggagaucgagaccauccugccuaacacagugaaaccccgucucuacuaaaaauacaaaaaacuagccgggcgugguggcgggugccugcagucccagcuacucgggaggcugaggcaggagaauggcaugaacccgggagauagagcuuguagugagcugagauggcgccacugcacuccagccugggcgacagagugagagucugucucaaaaaaaaagagaauucauugaaacugucuacuagucugguaguuucuccaaggcacagaccaagucucauccacuucucucucuccccacucccuaaaaaggcagccauauuacaggggccucuguaugaaaccaggacagguuuguugaucugaacaaaacuacagaacaaccaaacugaacaguuuucuuuuugcuuuuaauuuuuauuuuuucccuauguugcucaggcuggucuugaacuccugaccacaagcgauccucccuccucgucuucccaaaaugcugggauuccaggcaugagccacaguacugagccagucuuuuuuuuuccccuuugcauuaucauguauagccaucuuuaaaacugugauuuaaaaaaugucugaagagcucaaguuguauucuuaucaguugcccccugagauaauuacagcuuuuauugcuaugucaguaacauguugauauaaacuugguuuucucaaugaauuuuagccaguuccugaaauaacaucccugaagaauauuagggaaaaguaacaacacggcaaaucugcuuugcuuuuguugcaccacagagauuguuuuaggaauaaacagaacuuucagaaagaauccccagauaugauucagggaguuaacucaaaagugcucuuuaauccauaaauauaacuaacgucauuuuucaaagcauuaaacuaagugugauaugaaaagcuacacacagacaaacacacaaauuaagugaaaaaaaugcuaaugcuaguuuaggucuagaggcauacaccggcguaagaggcaauuauguuuuuugcuguugccauucuaaccaacagacucuaggggaaaaaaaggaagugagaaaauguuuccaucccaaauugcuagagaccgacucaaguaucuggugaagugacaaaaauguaaugggaugaaugacaccugaucuuucccaucauuuaccuagauauucccaaggccagcgugugagcaaguccuccccgugcucccccgaccucaaguagaaaggcucuuucuaggaugcaccuccuuaccucagacagcaggugcugaaucacaacugucaaugccucaaacuugguauuaccacaggcaagaagcugcuugagcugcaggauaaauccacuuugguuuucacauuuuguuuuauauugcgucaauucaaguguuuucucagggggcagcgcaucgggagcugucuguggcuggauacauaagcuucgaggauucuuuugccugcucuuuucaacugcaaaacgaauuaacauagguacaaagauaggugagguuaauuuuuaaaaucaccaccacaaggauucaaaaacaaccagauaagccacagaaauccauuuaaguuauguugcuguaaggaaugcauauggaugagaacuggaaugaaucggagaucuagacgguuggaauucaugaacagggaccguggcuucauuuaugacuuuaaaagauuuauggggaacagagaauuaggaacaugacacaaauggauuuggcaacccagaaacacaaaaacugggugcaaaauguuguucuccucguuucucauuuuccaguuaaauugguagagaaaccuugacugaagagaagccugacuuuucugaucucauaugcugaaaggaacacacaaaucacuggacuuuaaauuaaaugccuuucucuccucccauacauuuucuacaaaucuuuuaccuuuucccugaugauggccuagccauuacacagauuuauaccgcagaugagucauuuccuaaucucuaauaaaucauaacauacaucgaaaauauacucagauuuugccucuuuaaguucacuguuaggaguacuauacuguugacuauacuauuccauuuucuaucgaacacaagcuuuguuggucuuuuuucccaaguaguaauaacggcuuacacaguuuuuuuuuaaagcacaugcuaacacuccaaauccacccaaaaugccacgcuaagugauuauucccuuccugugcaauggugcccuggguauuacucuguuuuaaauaaaaaacuguucagucuuggaaccauuccaaaugugucauuuugaauaucaaacagaauuggaaaaacaggacaucaauugcuuagguucuugaaauaaacaagccaaguaauccaaacaaauguaaaucuggaaaaaagacacaagaaacuaaaaaaaaaaaaaaguuuccuuauucuaacagucuuucauuacagcauccacguucugugguagcaaaucugaaacaacuuuuaaagaaauuuaguaauuacugucucuaauuuuucaggaaaaggcaagcuacuacagugauugcuuaaagaaacaucaguacucacuuucuaagaacaaauggcuaaauauauugaauaaacuaaguuaaaaacagggaaaaaaaggcucuuauuuucuauggcugcauuacaugguuaaauaagucauauuuguauuaauacuugauaauucucaguucuaaaaucacuaaaauauccauugucccacugugucucuguaauacuugaugagaggaaguauuuauccauuacucuuuauuauuagcaauuauuaguaguagcuuaugaauaauugucacuugcauagauguagaaaauagccaaguuaauaucguaauauuacagcccugaaggaagaacaaauuauuaguuacauacuaaugaaaaauaaucuaaauauuugaccaugagauuagcauucuuucaugucauuuccuaaauguuuuuagaaauugucacauaacacauaacaauuccacaguguuucgcucaucacagugugcucucacuuucccuuucuuuucauccucccaauaaccccagauagggaagagaaggcucacaggugugaaugucuucccuggauguagacaacuucuaugggaauccagauucaaagucagaacccaggccucugaugcuaagccucuucuguucccacacauuuuggaaagcggauuagguggugauguaauauaugacauacauaaaaauaaauauuuaugcaacaaauguaauaauaucuugcuauaauacauauaagcccauuaucugauaacucauuuuaacaaaccuacauauaaacaucuauguguuauauaacuuuauaaacaaaaauguucaaauucuuucacuaucuagaauuuacuguaacaaauauagacacaguucauucuccugauaucauuuguauauguccuaccgaaacuuacuuaaaaauucauuuauugauaacuccuuuaucauuuccugaguccugaguaacauuugccucucuuucuagaauuucuaugcuaaucaacgcuauuuuuaacacaauuucagagcuuuaaaacuguugguuuauaauuauuuacaaaaucugagaggugagucuuuuauauuaauauuuuggagaaaauauucuucaagauucuugcuuuuugcuuauaaauccguaacaaaaauaucacagaauacauguaauuguacuaacaauguuuacuuuugaagggaagguaauaggaaucagacagcuaaaaaguauccugaagcauuuuuuauacuuuuuaaccaugggguaaauauauuaccuauucaaaaguuaaauauaagaaguaaauaaaaucacuuuuaacagacaguuaaagugaaauucgaggacauacauuuuuuauauaauacuuagcuaugaaggaaauagucuaugcagaauuuuuccuuggggaaacuacacaggaaucuaaacauuacgcaggguuuguaagugauuacucaggauagcuuuaugauuaaggaggaaagaacacauugauguauucgucuaagaguacgugucuucaaauuuuaaaaugagagcaaaugagccaacagacugcccucuccguggcgcuggaaacucgugcugugcagucaccaucuuccgcuccauauacugugcucccuaaggaugaagugugaccgcauggcagccgaugacccaguuuccacaugcuucccacucucagcacuccuggcucagcugaagaucagagaugaugcaaaaaucuccaaugacgcucaaaaccccaaggcucaucaauacguacuucacaguacugaaaagccagggguucccuuaaauccugcaggauucauuacuaacgugaaauuagcauauuaucagccaaacuuugcccuuacccuugcuuauuagcauguuacuguuuugauaacaaagguuuuauacagaaguauaaauuauuuuguuuacuguaccuauuaacagaacauguucugauuuuaaagggccaauuuaaucagaaaccuuaaaauuaaacgucaacuucuauaucgauucagauuuaucucaacaagauaauuaccaccaucagcugugauccagccuuacugggacucauucuaaugaaauggcagccuccaucaggaaaacgaaggccagaaccaaagacauuugcucauuuggaaagcagcuggaugacccuguuggcuaucuuuguucuuucuauucagaaaccucaauuuaauaagauuuaaaacuagugcaaugaagucauguaucaucuucuuaaagaaaguaguugguuaaugaggaagaugcccauuucucaggcucaaaucacuuaggcaaauagaccuccaaaucccaagaccaaaaacaauuuugagagaaaaaccuaaccauuaagacauggacuaaccguaaccacauacuagcagcugaggacacauucauucuaggcugaagaagccacacauuuccucaaucugcuggcuuuuccaauuauuaaaaucaaguuagagaccagaccuacugagggaguuugccuuggguuccgugaaacacaaacuaaacacagaauuuggaaacgaacguuguccacuuuuguguauacucacugaccuacucacucacucaugaaauauauuuauuaaaaucuaccaugagggcacugcuguggugggugugcaccugcccuggugcuuugcggggacaggagaaguaucacauaagagggugguauugcucagagaggcacaaagacaccaaagaucucugcugacucauguuucccuagugcucagcucuucaacuccaaaucucaaccuaucuguaaaaaggugacagucacugacuggaugguaaguccuuucuacaacauauugcauuaaaaaccgauguuuguggguugacaaaacauagguuaugaacucagaagcuagugagaggucucucucugcuagcggcauggacagacagaaaauucccuuuuuucugccuuaaucuaaucguacacaucuaaaagcccucacagggacacugacacagaaguucuuucagucaguuuccccagcaucugguggcaggugcuuauccugccuaugcaaucuuacauacaguuuuuuaaaguuaccauucaugucaauuauuaguuuauguuuguauaaaguuuucuaguguucauuagcuguuuacucuaaaagaguuaacaguaauaauuuaggagacauauauuuuucuauuuacauauaauauuuuucuauuucuagguagacauggcauuuacugaaaauggaaaauuuuaagcucagcaaagcacaguguuuagacauuuagaauuacccaagccaggccgggugcgguggcucacaccuguaaucccaacauuuugggaggccaaggcgggcagaucacaaagucacgugauugagaccauucuggcuaacacagugaaaccccaucucgacuaaaaauacaaaaaguuagcugggugugguggcaccugccuguacucccagcuacucgggaggcugaggcaggagaaucacuugaauccgggagguggaaguuccagugagccgagaucacgccacugcacuccagccugggugacagagcaagacuccguucucaaaaacaaacaaacaaacaaacaaaaaaccccaagccaagcccaauuauuuguagggggagggaggaggauuuaggaugccucaccauuuaaacuuuucauuacuauauugguagaauucguugcaauagcucauauuauaucaaaaaggguucuacuucuuuucuucacauuaaaagcagauuagagaauagaaagcauauucgagaauagaaagcauauucauauaaaaaauuccuguuuggguuaauuacgcuuauaaaauuuuuccugaagcaacaguccaaacuugcccuaaacuauuuuccauauagcuggcaggaaaaaaccaaauuucucauacucuuauguaccuaaaauggacuccuaacucaaagaagaguuaauauaaauucaccacauucagaaguacuuuuaagaaggcauugccucucuccuauagcaaccaaaaaagcauggcacuggucuaaaaauagacacauagaucaguggaagagaacagagaacccagaaauaaagccacaugcuuacagcuaauugaucuuugacaaagucagcaaaaauacauacaauggggaaaggacacccuauucaauaaauggugcugggaaaauuggaacagagaaacuggagaccuaucucuuaucauaugcaaaaauuaagacagauuuaagacuuaaacguaagaccugaaaaaauaaaaauuccuggguggggggagggaacuagaaaaaacucuucacaacauuggccgacgcaaggaauucaugacuaagaucucaaaagcaaaugcagcaaaaacaaaaauagacaaaugggacuuaaacuaaaaagguucugcacaguaaaagaaacagucaacagaggaaacagacaaccuauagaaugggagaaaauauuugcaaacuaugcauuugacaaagaucuaauauucagaauuuacaaggaacgcuagcaacuagcaagaaaaaauacaaccccaauaaaaaaugggcaaaggacaugaacagauguuucucaaaagaagacacagaagcagccaacauauggaaaaaguagaacauacgaaaaaaugcucaacaucacuaaucaucagagaaaugcaaaugaaaaccacgaugagauaccauuuccuaucagccagaacggcuauuaccaaaaagucaaaaaaccacagauguuggcaaagauguggagagaaggcaaugcuuauacacuguuggugggacugugaauuaguacaaucucuauggaaaacaguauggagauuccucaaagaacuaaaaauagaacuaccauucacccagcaaucccacugcuggguaucuucccaaaggaaaagaaaaacacagacuaucuuauaacagaaaugaaaauuaaaauagccaauuaaaacauuaaacauuagaaauauuuacaauacaaacaauaaauaaaaagagaacaucauucucaaaauacuaaacugucgacaagcaauuuggaagaaacgugccuaggacucaggucaccagggagaaaaaaggcaaaucucucaccccaaaagaaagcucuauuacucuuaauuuuccacagagccacauaauugcugauguuuauaaaaaggacccucguguacuaaaaugacccaaaguauugccuaagauaaauacagaaauaugauauucaauauuagauaccucuaaaaucacaccuguuguguuucuaagaaaauaauaugcauauacuauuaauaaaauauuauucuuagcucugaaagaggcuuuaaagcucauaaaaagcaucauuacauuaauuuauaggguaauuaucuauuaauuaaccagaauaaauuguucuaacaaaacaaguauuuacuuauauacagcuugccauauuccuccagugucucuugaugaaaaacacugcuauccuucccauucugaaugcaacucuaaaccguaauuuauuacuuacuuuccauuuuuguguaaaaguagauacuacauuaaaacauaauuuaguguaguaaaacucuaguuaucugaaacuugucaaauuaggacauacugucccuuucaacaucucacuuuuaaaaacuuaucaaaaucuuaccuauugugagcaaaacuugccauucaacacuuuauugucuucuucaauugaaagcuguaacuacaaaagggcagauauucaugucacggcaaagcuacagcucuaaaaccgccacagcuaccgaagcuuggaaucaauccacgacaaaacguuuucagcaucaugccauucaucacaccaguucuuagcaaaugcuugucuauguggcaagaggccagcaaaaucuuucaugacugcuuucaaggaggcugaaaggaagaaucuggauucacaguaagauaacuaaggggcagugaaagacuacaucucucguucuucuucaccuugguccuuuugauuucuucuacauucuacaaaucccugaauuuuaccuuuucacacgcaaaugcuaauauauguguuuuuuuuuaauggaagcuuucuaauauggcuucauugacgucuacauuuuguaguacgaaaaacacaagagaaauugaaguuuacuuacugucaccuuaacaguacaugaauaaaugcccuccuaauccauaacacauccauaaaugcgcuaauaacauauuaagcauacaaaagccacauuuaaaguugaacacauucuucccaauguauuuuauaacugaaaauucauucaagagaucaaaaaucaaauguuaagacuuacguccaaacgacaaaauaacuugaaaguuuaauggaaccauuacacacagguaaucaaugccccuccaaaacgcauagaauagagaaaaaauagcaaggccuguugcaagauccaacuuguuaaauaauacacuccccucauuuauaaucggccaacauccgcuugagaaauaccuguucugccuucucuguggcagauauuccaauagagcucuuauaacauuuuauaccugucugugggacagagacuagagaagucacacgcucuauuucccagccucccuuccaggucgagucaugugacuaagacccggccaaugagacggaagcuuaagcgaccuggcaccaccccuuccucauuucuuuuucuuccuuccuggagcagcuacugugagaucaugaggcaacaaucaugaggacacggcuaagaagacagcagagaugaggauuccugacacggcagagccaccgaacaaccucaaagcugcuuuucuucaggugagacaaguugcuucuuagugaagcuguuaauuccaucuaaaaagagucaaaagugaauaccaaaugcgagaacauaauuugaugaauuucauccuaauuaaacaaacgcauucacauucugccugccuguuacugaacacuucuuuaaaacgguucucuucacgaacacaaagaagggaaacaacagaugggggucuaauugagggugcaggguaggaggagggagaggagcagaaaacaauaacuugggugcugggcuuaauacuugggugaugaaaucaucuguacaauaaacuauuuauuguacaagaaucuguacaauaaacucugugacaugaguuuaccuauauaacaaaccuuuacauguaccccugaaccuaaaaguucaaaauaaaauaaaauggcaaaaguaaauggaaauauuuuguucugauacuaccucugccaucccucgauacguacguacacauguuccucccuugcgcugcaguaaucacuuuuaaugucacuagcucagcagaaagaauucugucuuuagcguacugaauugccuucacuggagucaagaaggaaauuaaccugugagguucaaauggcacucuucauagcaauuaauacaagaauuuccagcuucauagaaaaacugaaugcuaaguggcagggaauauuucuuagcaaagucuuuucccuccacuaacucauuauaaaaauagaacuaauauguugagguagaauuccgaaauagaccgaguuuaauacuuugguaaaaagacuauugcugacccuucuccaugucagugacgucaucacuggacuucuuagauuuucaucugugccuaauguccugcaacaucacgcacaguuccugacaaauucacucuuuuccuccucuccccuguuuaaagaggaaagauaaccucgauccaacaacacgcuuugccagugauggauaccacccaguaauaauauaucagagugcccagugcccucugcgugggaucaaugagaaagcuuauucuggccggaucucuacaaugaccagcccccgucccaccacauucuaugcucagaaauacuacaacuccuuuguuuccuugaaggagcccuuccucaagccccucaagguuuuuacaugcuguuuucucugucggaaacacuuuguuucuuaguaaauucuccauuuccugaggacccaacuuaaaaggcacuucuacuggaggaccuggauuaaagguaccuccaccugcugagagcugcuugggcacaaguccacacccugcauuauuaacuggugcucugucuccuucuguuaaacagugggcugugugaaggcaggguccaugugggacuuagucccagucauacuuucagcaccuaccauuaugccugguacacaguacucaucuaacggguacuucuuuaugaaacgaaugaauuaaucuguaaugugaaagacagucuagaagcaagggaaaggcuggaggcacagaccaaauacuaagcucuucagaaagcccagucaacaucuuaggcuggauuauacaaaacuguuccuauuuggcuacuuuugacuuauuauacaaaaguguucauauuuggccacuuuuuaccuauuaauuuuuugugugugguuuuuuaaauagagacagggucucauuaacucuccagggcuggucucaaacuccuagccuuaagugauucucuucccuuggccucccaaaguacugggauuauaggugugagccaguggcaccagccaggaagagcaguuucaaugcuucaacaugauaaugccuggacuaggguaauggcaggugguaaaaacaaaucaagauuucaaaugauggagucuuagaguuuucaaccaauugauuguggauaaaucaggacaaguaaugauucaaaggugagguuuggccagacgugguagcucaugucuguaaucccagcacuuugggaggcugaggcaggcgaauugccugaggucaggaguuccagaccaguauggccaacauggugaaaccccaucucuauuaaaaauacaaagaaauuagccggguaugguggugggcaccuguaaucccagcuacucgggaggcugaggcagcagaauugcuugaaccugggaggcggagguugcagugggcccagacagcaccagugcacuccagccuaggcaacagagcgagacuccaucuaaaacaaagcaacaaaaaaacaacaaaaaccaaaggugggguuugaugaccagacacauggugucaugaaaagaaacagauaauucaugaguauuaacugaauuuaggagguaaaaaaauaaggagacaaaucauuuagauaagaugaauuuccaagcagaguaauacacugaggguuuucaaaucuucagccagaaauucacagauuuggaggcuaaggggaaccuggaagucaucucuugugguucccuuauuuuguagccgugugagguuaggugcacagggcuauucacuuggucaccagcagaaucaaggcuacaauccaggccucuugggauccaggucaacaccacugcacugaggcaaccaacaccacuuccuucacuaaggauaccaacccaaguuacugcugacaguccauucagauaagagucaccaugacggcaugaauuacccacuugacggacgauuucucggacguuaaaaugacauaacauggauaagcccaucaaagacugauauugggaguaagcagaauuauauuccuuacaugauuuuaaaaagccuccaacacacaaaacgcuuccuccaucccugcuauuccuuggaucuaacaaaauuacagcaaaauuugcagcuggaaaauauguacgccaaaaauucuaaauagaagucccagguuuuaguccuaucucuggcacuuacugugugccucugggcaagcgaauucacuucucugggccucagacuuccugguauaagacagauuagaucaccucuaugugaacucuagcucaaaaaauuaugacugcaaauaaacagaaaauaguuuuacguaaguuuagaaaauaaaauguguccaauacaucacuaucaacuaaacccugguaauagaagccuugugucguuugcuuacgcugucuuggaaagcuaucugcuucacaacaacacuacagacaacuuagaaugucuacuacuagagcacugguuaaguaaaucaugacuuacccaauaauggaauguuacagaacuauuuuuuuuaaugagguagauaaacaugugaucacaugcaaaucuaaaacacauuaacuuuaaaaagguauagaauauauaguacgcuuuuauuucuguauaacaaaaaagaauaaaaaagaccugcauagauuuacaugugacuggaaacgugcaagaacacuaugcaagcagcugagagcggcugucuccacggagagcagacagggacucuggguaagagagaggcuugccuaggacugcacaaccuuccauacuguuugauuuuuaacuuggagcguggauuacaguauuuuuaaaagaacucuuuaaaauuaaaagcuauuuggagcuacuuuagaucagacaaauuauugcaaauauagggcacccuuuguuauuuuuccccccuauuaauuuguucaguuggaagggcugcagcggcccugagcugggagaggagggccacugcugaccuccuccucgcugccuccccccauuuaccgucagcucagacugaaagggagaggcuggcaaaaucaaaugacaggucaaggggaguuaugaaacacgagagagaggugcuggaaaaaaugagaauucucccacagagaagggagaugccucugggaaaacuaaaaauagucagcugaaaacaaaucaccagggacagagaugagccacguggaaaauaagaaacacgaggggucacgugcacaugaagcagaaacaaaaaucuauuuacauccucaucaaacauuccugugacaccuaacgcuauucagcccaaaacaaauauaaaaacaccccagcuaacauauuuuacagaauaaaacugauuuaauuuacuguagcuguaaaaucaucuaggacaaaaguagcaacauaggccaacccaaugcccuaaaagugagcagacaggucaccacgugccuaaaauauauacuaaauuuauuuucaucuuaggcaccgaaaauaauaagcagauacaaacauaaaccucaggggaaguauuuugagacugcacacacuuuuauuaugaagauuggaaaacuagauuugugauucacuuacuacuuccccauaaccauuaggauguuuucugucagaaguguuuaguauacagaaaucuuuuagcauauuaaaauuaacugucaaaucugacugagaaacuauccaaugaaaaacgaugggaaccuucucaucuacacaggcgaacaggaaauauucuucuaaauuuaccuguguccuauuucccaaacacuggaacuaaaauauaauuuaacaggugcugauuuucacacauuuggcuggugauggagaaaagagcuagggaacaccaaggcaacaauucugccuuccaucaacacaaacaacacaaucugcugccaaaaguaaaaguacuaugcacuugugcugaagcaacagaaaacaauuuuuaaauuaagccucaucucucauuagagagagcuuuuuuccuccaauuaucugucuccuuggaaaaaccucugauaaacaucugcaaauuaaugaagacaucccccgugcaacacuaaacagagaucuaugcgagacagaccuguguggaaaacaacagugcuucuccuaaacccugaaggaagucgaagguuucgaagcaauccuuuggccgucagucguaugugaaugguggauaaggagaauuugggagacaacaacaugucuucggagcagguggcgagauuucacagaagaggcaauuuccauggacugucacauacugucuuuuuaaacucaguacucuucaaggccaagaaauacagucagaggaaagaugccuacacagcaaaugucauuccaccagagaggcauagaagaaaaaaaucccccagggcuggccaaguguuucuggcuuccguuuucacuuucagauguugccaaaaugaugcucuuccucugaauacaaucucccuccugcaggucuagaagcugccucugaaccacaucacacugugcaugcuuguggaguuguuaugguuuucauccgagaugguaaaggggaggagaaaguggguggucucaggagcuuuacagaacaaccaauaaugucacagauccuguaaccacuugaaagaucgcuaggggaaauuaacuacuucaagugccuaauguuucuuucauaauuagaaaaaaauuaggauuuccugaaaguaaacuguguccugauuuuaacauuuuucacuccuuauauucacaaugauaacaugagcauuuuuucucuagauauuuuacauguaaacuacauuuaaaccugguauuuuggaaaaguuuuuuuuuuaaagacuucaggcaauaaauguucucaacuacaauauuuaagaaaauuucuauucuaauauauuaaugacagauugucaaaagguuaaaguucaacuuuaauucccacaugcugaggaccucacaaauaaucaacaguaaaagauuaauacgguuucucuaucagauguaauaucagaguuccagaagaauaguccaucagauaggcauauucuaaagacuacauuuauugcaugaguaauugcauuuauagaacaucauguggucucuuauaguggucuuucaagacuaggagugugaggagggcacaguuaugaauaucuuuugccaguuaucuacuaauuuuuauuucaguagaguggcuuguaaaaguauguuaaaacaugauagcaaaaccaaaagaacuugaaaaacaaagauaugguuauaagaauuaacaacaacaauaugcccacuuaagcuaauuccauuaaaccacgaauagccugagcucuuaacauuuuuaaaaauguuauaaacaaaacaauguuuuaaaaauguccuaugccuguuuccaagauuuccuagaaaauaagacucagaaauaaaugcagaauuguuaccauaaauaacacuauuaagugcuauuaaaacuagcaggaagcaguucuuuuagaaauucuauagaguaggguaugaagcagggaagagagagggaggaagagaaaauuuaaauaaguucucuucccucaagcccccucccucuucacucaagcccccaacuugccauuuuagagguugucagcaagagagacagacccaauaaccuguccaggguuccugugagaaagauacaccuaguucauacacugacgaaaaaccugcuacauacauugcaccacagcaacugaagcuaaaugaucaaggaauuaaaaucaaggccagcugcuucuagguguugccuuuuacuucaucccaguuuauuauuaaaaaaccugaacaccuuuuccuuccagauucuacauacuaaaaauauaccagaaccuuuuccucuaccucccaaaaccuuguaaaaaccaagaaaccaaucagcauuaaaaacaaacagaagaacagagucaaauuuugccaugauuaaaaacagacaugccaccacuccauauaguaggaggugguuuuucuuucuuuugguuguguuuguuguuucuucaguaacagcaaauucuaaauuauccuuuuuuguuuguuuuuguuuguuuuuugagauggaguuucacucuuguugcccaggcuggaguguaauggcgcagucucugcucacugcaaucucugccucccggguucaagugauucuccugccucagccuccguagaugggauuacaggugcccgccaccaugccuggcuaauuuuuguauuuuuaguagagaugaguuuucaccauguuggccaggcucgucucgaacuccugaccucaggugauccacacaccucggccucccaagugcugggauuacaggggugagccaccacgcccagccuuaaauuauccuuguuaaaagggaaguucuuuagacucccuaaaagaagaaauuaccaucuaaucaucgauuaaucagauucauuaacauuuuuacuugaauuacauuaagcuauaaccacacauauugaaaauaaacauuguuaaugauaucucuuaacagcagagcaagaagcugcaggaauaaacuaaauucaguucuuucccaaacauagucugccuccugguggccgugcagcacaagugcaccaaagcaagggagcugccuuggcaguccauaaacaaauggccaucgcuuacaaucuacugcuccaagcacucucuuacacacuuuacguuugcucauuuaaauaacuggauaagcaauuacuuucaggucacaacuauuuuuauacuauauaugccucuggggggagccaagauaaaaaauugguuccaaaaaauucuuugauuauuugaucaucuguuaccaguuaggaacuccauauuuucugaaauugaacgaaugugagaaguaccuaaaaaaagcaucuuuguuauuuuuaaaagucuuaauuuaagaggaaaagauaggcaucaccaaggacaguagaggaaaaaauaaggaaauuuuagugccuaaaguacaacaguuuguaguuguaaaaguuagcuaugagucuuuaugggccgggcgcgguggugagauuacaugccuguaaucucagcacuuugggaggccaaggcaggugggaucaccugaggucagaaguucaagaccagccuggccaacauggugaaaccccgucucuacuaaaaacacaaaaaauuagcugggcauggugacaggggccuguaaucccagcuacucaggaagcugaggcaggagaaccgcuugaaucugggagauggagguugcaaucagcagagauugugccauugcacuccagccugggcaauaagagcaaaacuccucaaaaaaaaaaaaaagaugagucuuuaugaagcagagccuguguuaggaugucaguggaaaacaaaaacaugauuuaaaauuuuaugcaauguaggaucucaacauuaaacaaaaacgauuaaguauauuggagcaaacaugccagaaugucaccaaugcucugggagguagaagagggaggauuucuauuuuuucuuuauuauauguuuuuguauuuuccuaauuuuuuuuuucaaaaaucaugcagccagaaaaaaauuaaaaaguuuaaguguuagaauaauuuuauagaaagccuacaaaaugagccgaguuuucauaaugacacaaagaaaaauaaacgauguguaaagucuauacuaaggcuuaaauaacaaaagaggaugauacagaauguuucauaagucaguauguuguaauaucacaguauauucaaacaaacagaaauuccacuggucugcauagaaauguguuuuuuuaaaucagugauuuagaaaacaaugaugucaugauucuagacaagaaucuagcauaaucuguauggggugcuuagaugcuacaaaaugccuucaauuuaucuguuauuguuuguuguuguuaaugaucauaaagaaugaggaagaagauuaaaauuuaaaccaagugacuuguguggagauucaagcaucucuauccaaccaaucuuccuuagccuaauauggaauauuaaucuuuauauuuaucuccuuacuuucccuaacacagcauuaauugcaacauuuucuucauuuuacuccucacagucuuuaauguaguaaguucaauucucuauuccaguuguagaaacuucaacuuaaggcccaauuuuuccacacuauccucuuccucaguacgaagauaaauuguaauuaucaaaaaauuaacacaaagcaauuagaaaaacaaucaacuuccacccaccuguaagaugauaagcucucaaagaacagugacauugccuuuuauuuugcaauaagcaaaauaagaguuuaaauuaaaagcaguaaugcuuuuaauucauguacaauguuuguuuuuaaaaaacaaaaccucauauguucaucguagaauuuuuuuuuugagacggaaccucggucugucgccaaggcuggagugcaguggcgugaucucggcucacugcaagcuccaccucucggguucaagugauucuccugccucagccuccugaguagcugggacuacaggcgcccgccaccacgccugacuaauuuuuuuuguauuuuuaguagagacaggguuucaccguguuagccaggauggucucaaucuccugaccuugugauccaccugcuuuggccucccaaagugcugggauuacaagcgugagccaccgcacccggccagaauuuucuuuucaauuuaaauuacuuacacaucagacugcucuccaauuuguuuuuaaacuuaacauaagcuuaauaaacuuauuaaacuuaaaaauuucacacuuaucuuuccaugggauuaaauaagcauuuauauuguuauuuuaauggcuucaaaaaugucuuuaaaaugucaacgaacuuaauuccuguaagguauauagguuguuuccaauuuucccccauuguaaacaauucugaaaagcagucaauaaguaaauaaauuacuuuccuaggaccaauucugaaaaacagaauucccggguggaagguguuugcucucugcuacagcugcuguaauuuaccaaggagcuguacauaugagugcuguuucuuauucuucgccaguaccaggugcuaacauuaagaaauaagcaagaacugagagcacauuauuuuaacucauauuugguaaacauuuuucauauauuccuuaguccuucauauauuucuuuucuguccauccacuuauuuuucccuuucuuuuuguuuaguuuuuuuaauuguggcaagaacacuuaaugagaucuaccuucucaacaaaauuuuaaaagaacaauauaauauuguuaacuguaggcacaaugcuguaacaaacaucucgaaaaccuuuucgcccuugcauaacaaaccuuguaccauugaacaucaaguucccauucccuggcaaccaccacucuacucuguuucugacuuugacuauguuagaugccuccuauaaguggaaucauacaguauuugccccaugacugguuuauuucacuuagcauaguguccuccagcuuuaucuguaucacagcauauggcaggacuuucuucuuuuuaaaggcugcauaauacuccagugcacauauaugccauauuugcuuuauccuauggacacauuuagguuguucccacauccuggcuaucauaauguggcaaugaccauuguugcagggagucagggaccccgaauggagggaccggcuggagccacggcagaggaaacauaaauugugacgauuucauggacauuuaucacuucucuaaaaauacucuuauaauuucuuacgccuguccuacuuuaaucucuuaauccuguuaucuuuguaagcugaggauguacgucaccucaggacccugugaugauugcauuaacugaacaaucugauugcaaaauguuuauuugaacaauaugaaaucagugcaccuugaaaaugaacacaauaacagugauuuuagggaacaagggaagacaaccauaaggucugacugccugcgcggucgggcagaauacagccauauuuuucuucuugcagagagccuauaaauggacgugcgaguaggagagauaucguuaaauucuuuuccuagcaaggaauauaauauuaagacccuaggaaaagaauugcauuccuggggguaggucuauaaacggccgcucugggagugucuguccuaugcgguggagauagcuuggccgggugcgguggcucacgccugugaucgcagcacuuugggaggcuguggcgggcagaucacgaggucaggagaucgagaccauccugguuaacauggugaaaccccgucucuacuagaaauguaaaaacuuugccuagcgugguggugcgcaccuguagucccaguuaguagucccaggcaggagaauggcgugaaccugggaggcagagcuugcagugagccgagaucgcgccacugcaccgcagccugggugacagagccagacucugucucaaaaaaaaaaaaaaaaggacugagagagauacgcccuggucuccuagucuccugcaguacccucaggcuuacuaggauugggaaacaccaacccugguaaauuugaggucagaccgguucucugcucucaaauccuguuuucuguaaagauauuuaucaagacaauacgugcacugcugaacauagacccuuaucaggaguuucugauuuugcucugguccuguuuccucagaagcauguaaucuuugcucugccuuuuucccuuugaggcaugugaucuuugugacguacucccuguucauacacccucuccccuuuucaaaucccuaauaaaaucuugcugguuucgcggcuuagguggacaucacggaccuaccaauaugaugucaccccuggaggcccagcuguaaaauuccucucuuuguacucuuucucuuuauuucucagaccggccaacacuuacaggaaacaaaaauaaccuacauugaaauauugggggcgacagaccaugggaaugcaaguaucucuucaacauccugauuucaauuauuuugguaaauaacgccuuaucagacguaugguuugcaaauguuuucuccuaucucauaggcugccuuuucaugcuauuaaaugacugcuuugcucugcagauuuuuaaucugauguacuccaaccugucuauuuuugcuuuuguuaccugggcuuuuggugucauaccaagaaaaaugacaugaaguuuugccccauguuuuguuugagguguuuuauaguuucagaucuuauauuuaagucuuuaauccaucucgaguugauuuuuguguacugugugagauaaggguccaauuucauuauuuugcuuguggauguccaguuuucccaguacuaucuacaaaaagacuauccuuucccuauuguguauucuuggcacacuugcugaagauuagcuaaccguauaugcacggauuuauuucuagacuauuuuauuccaucggucuauguuucuauauuugugccaguaccauacucuuuuaauuacuguguguuguaauauacuuuaaaaucaggaacugugaugccuccagcuuuguucuuugucaagauuguuuuggcuauuugcaguccucugucauucuauaugacuuuugggauuguuuuuucuauuucuuuaaaaaaaugacacugggauuuugauagggauugcacugaaucuguagaucucuuugggugguauguccauuuagcuucuauuauagaguugucuuuaucuugcugauuugacagagcucuacacagaguaugugcuaauauaaccucaguuuguucuuugcuuauaaauacuguuucuaaugauuuuuauucuuuuuauuuuuuuugagacggagucuugcucugucacccaggcuggagugcgguggugcaaucucagcucacugcaaccucugccuccuggguucaacgauucuucugccucagccucaugagugcugggacuacaagugugcacaaccacgugcagcuaauuuuuuuguauuuuugguagagauggggucucaguacguugcccaagcuggucuugaacuccuggccucaagcaauccaccugucuuggccccccaaaguguugggauuacaggcgugagccaccaugcacagccuguuucuaagguuuuuuaaagcuuuuguuguccuaauuauuaaucguuucuauuauacuaguguuccuggaaagaucuuuucuacuuaagucuauauucuuaguguuuuaauuacuuuguguguuuaaaacuaauuuaucugaaauacuuuguauauaugugaaaaagaucuagcuccugcuaaaaagguagucacugucucaagaagauuuacuaaaugauccacuccucacaacccccaacaccaauuugaaacaaaaauguaucccauaugaaaagagcaucuguguuuuaaguauagggggaaaguuauguuaaucauaaaacaacagugaaaaaacagccuucucucuacucucaccagaagaaacccuggcagccucggcaucaccucaucagcagguuugcaacuugcaaccacuucccagcacuuggcaaaagaaggcaagaaagccgcccuguucuccugugaugucuuuacuaaguaacugcggaaggaccagugcauuuucuaccuuccaaggcagacacucuggcaccugagagugaugaucuuguguaaaccaaucaggguacuggauaaauacagcucugaugccucugguaugccaguggcuuuaguguaugguagaaccaagguaauaauaguauucugugguaugugugacaucuuccuuaucagcaguaagccaagauuuuuuuuagagucaauaucaacuacaaucuugcagcgucauaacguuuaaauaaauuacaacaguuagaccccaagagguugguucuugacuuuaagcagucuuuccugcuugcuuuagagauuuaaaauaauucaacuuccuggaaaagaacccuaaaaauaagccccuagaauuauaaaaacaauguaaaagaucgccaucauuaccguuccuagcagcugacuuaacuauuauuugagaaccuuuuauaaaacaauucuaugaugucauauuauugccuuucugggaauuauuuccccaauauucccaugucuccaaacgagaaauuugagacuuggagaggcuuagcaacuagcccaaggucaggacacaaauagaaagcagcaggacgaagguuuaaaccaacaucccgugccuuaaaaguucguucuccuccugcuuuucuacauugucuuaugagauaauguaauuucuuuaauugauaaaggucaagcuaaaacaaugauguaacauuuuaaacuauuauguuagucaaaaaaauuuaaaaauaauauccaauguugacccaagguaugaugaagccaggugucuuuuaugucaaccacgguauaaaaugauaugaagcuuuuggaaaacaauuuggcuauuugagugaagugacuguaaauggguacauauugugauuuccugauacuacuuuuaauaaucuaucacaagaaauugaaaguugaaagugcuaauuguauagauguucaucauagaaucauuuaugaaugugauacagaagcacccuaaauauucaaaaguaguuaaauguuacuguaucugcuaaauguaaaagugauuacuauauguuaaaugacaaagcaggauauacacuuaucuaaauuucauuuaaaacgacaaauuuuaaaaagcugaagggugauuucuaaacuacaugcuaaacuuuuugaaguuuggcaaacugcuauaauuaaaagugauuauuuuacuagaacuaaggaauaugaaguuggucaacucaacuguaaucuccaccacuacuuacagcuuuaaaauaaaaauaucucaaagccauaguacaacgauuaaaaauuuacacucagaggaacauguuuauguguggaggcaaugucuucuguaucagcuaaaauaugacucauuuccagcagaauaugaaaaaagucaaggugauuuucagucacagaauaucacaguagggagaaaucuagaaauccacccuuucaguuacauagaaaacuauuaucaaagagguucaaugauccacccaaagucacuggcuuuucagcaucauuuuucagcaucaaagucgucuuuccaaagcaaacacacuuuguugugguccucuguccacacaguaacuuuuccucacuaggcuccucauaauaccagguuagucuuaagucaugauaauaacuaaccaucgagaagaaccugggaaagucaugcuuaugguuucgggaaaauacagaggccuaccacacaaucuagauuaagcugcaauguugaccccuuagaauacauucuauauauacagagucaucuauagauucaauguaacagaaauuauuagaauuggaauuauuagauuacauuccuaaaaccucaccugacuucauuacagagauugacaagcugauccuaaaauucauacagaaaaucaagggacccagaauagccauaacuaucuugaaaaagaaagacguugaaugacucacauccugauuucaaaacuuacuaaucaagacaguguagcacuggcaaagguaacauauaaaugcaaagaacacaauuuagaaaucagaaauaaacccucacauucuuaaccaauuauuuuuaacaaaggugccaaggcauuuaaaugggggaaauacaugucuucaacaccuggauguccaugugcaaaaaagaauuagaccuucuaucucauaccauauaaaaauguaacucaaaaugaaucagaaaccuaacuauaacagcuagaauagcaaaaaaaacuuaaaugaaaacacaggcuuaaaucuucacaaccuuggauuaggcaacuguuucugagauacaauaccaaaagcagaagcaacaaaagaaaaaaaguugauaaaguggaccuugucaaaauuuaaaacguuuauguuuccaaggacauuaucaagaaagugaaaacacacccaagaauugggagaaaauauuugcaaaugauaacucugacaagggucuaauaucagacuauacaagaacuccuacaauucaacaauaaaaaugacccaguuuaaaacuggcaaaugauuugaauagacacuucuccaaagaagauauacaaauggccaguaagcacacgaaaugacacucaaugucacuggcugucagaaugcaaauugaaacaacaaugagguaucacuucauacccaguagggauagcuauaauaaaaaagacagacaaagccaaguguugacaaggcuguggagaaacaggauucuucauacacuccuggugaggauauaaagugguccagccacuuuggaaaacagccuggagguuucuuaaacuguuaaacacagagcuaccaauugagccaguuuucugauaaugguuaacuaauuuuuaaacaaagccauuccauagaauauuagcuaucuuuuuuccccagauauuaggauguaccagaaacuuaaaaggaaauaaaagccuaaauguguacagcagaguuucuucugcauuuuuacccuauaaaggcuuuaguaaccacauauauucacacucagcauccuggggaucuuuagaacuuagaucauucugcauggcugucuuccuagcuuuaagagccuacaaaagguuacgaauucugagauagcugggcgcagugacucacgccuguaaucccagcacuuucggaggccgaggcgggcggaucacgaggucagaagaucgagaccauccuggcuaacacggugaaaccccaucucuaguaaaaauacaaaaaauuagccgggcaugguggcaggcgucuguagucccagcuacgcgggaggcuaaggcaggagaacggcgugaaccagggaggcagagcuugcagugagcagacaucgcgccacugcacuccagccugggcgacagagcaagacucugccucaaaaaaaaaaaaagaaaaagaauucugagauaauuuccccacacuucccugcuuauuacacugaggaaacugaauacaccugauggggcaucaaggauauuuguuauucauguuauucaugauguaauguuaucccacccuguuuucuuuacacaacaggcucagaaauuuauaccucuugcccagguuucccucacaugacagccuucaauccggaccucucuucuaggacaagacaacccuccuuccuagaacucagugcauuugugauucaugucuauuugagcagguuuuuuauuuuauuuuuuuaacuauccuauuagcucuccagagacaaggccccugcucauucuucgcucaggacugcauccuuaacaccugacacucacaaugugugaacaaacuguagucaacauucuguaacauuacaugcauaccugggagauauauaucaccccauaagacacaugacauaauaaggcaaaucacaaaaauugucugguuucucagugcauauaaaacuuauauuaacacuacacuauagucuagugugcaacagcauuaugucuaaaaaaauauauaccuuaauuugccaggcgugguggcucacaccuguaaucccaucaguuugggaggccgaggcagguggaucaugaagucaggagauggagaccaucuggcuaacacggugaaaccccgucucuacuaaaaauacaaaaaauuagccgggcaugguggcgagcaccuguagucccagcuacucgggaggcugaggcaggagaauggcgugaacccgggaggcagagcuugcagcgagcagagaucaugccacugcacuccagccugggcgacagagcaagacucugucucaaaaaaaaaaaacaccuuaauuuaaaaauauuucauugcuaaaaaaugcuaaagaucaucugagccuucagugagcaggaauuauuuugcugguggaacaucuugccucaauguugguggcugcugacugacugauuaggguagugguugcugaagguuuggguggcuguggcaauuuaaaguaagacagcaaugaaguuugcgacaucaauugacucuuucaugaaagauuucuuuguagcacgugaugcuguuucauagcauuuuacccacagcagagagucuuucaaaauuggagucaauccucucaaacccugccacugcuuuaaguuuauggaauauucggacuccuuugucauuucaacaguguucacaucaucuuuaccaggaguagauuccaucucaagaagauacuuuauuugcuuauucauaagaagcaacuccucaucugcucaaauuuuaccagagaucaacagcaaugcagucacaccuuaggcuucacuucucauucuaguucucauccuauuucuaccacaucugcagugacuuccuccacugaagcacugaaccccucaaagucauccaugacgguuaggucagcuucuuccaaacuccuauucacguuggugcucugaccuccucccaugaaucacgaauguucuuaauggcaucuagaagagcaaacccuuuucagaagguuuucaacugacuuugccccguuccaucagaggaaucaguaucuagggcagcuacagucuuacacaauguacuucuuaaauaguaagaccugaaagucaaaauuacuccuugauccaugggcugcaaaguggcugcuauguuagcaggugugaaaacauccaucuuccuguacuauacucuuguacuauauauuacuauguaauacacuauacuauacuccaucagaguucuugggugaccaggugcacugucagucggcaguaguauuuugaaagacaucucuugaguuguaggucuuaacaaugggcuuaauauucagcaaaccauacuguaaacaaauacgcugucauccaggcuuuguuguuucauuuauagagcacaggcagaguagauuuaacguaauucuuaagggcccuagaauuuucagaaugguaagugaacgucagcuucaacuuaaaauuaccagaaguauuagcuucuaauaagacagcuugucaucugaagccaggcacugacuucuccuguuuaccugugcaaguccuaaacagcaucuucuuucaauaugaggcuguuucaccuacacugaaugucuguuguuuuguguagccaccuuuaucaaaugaucccagcuagaucuucuggaugacucgcuguagcuucuacaucagcacuugcugcuucgcccuguacuuucauguuaugaagaguuaccuuaaaccucaugaaccaaccucugcuagcuuccagcuuuuuuuuuucugcagcucccucaccucucucagccuucauacaauuaaagagaguuagggucucacucuggauuaggcuuuggccgaagugaaaguugcagcuggcuuaaucuucuggucagaccacucagacuuucucucugccgggagucuguuuugcuuucuuauuugaguguucacuagaggagcacuuuuaauuuucuucaagaacuuuuccuuuccauuuacaacuuggcuaacugcuuggcacaagagaccuggcuucugaauuauccuggcuuucaaugugcccuccucauuaaacucaaucauuucuaucuuuugauuuaaagugagagacaugcaacuuuucuuucacuugaauauucagaggucauuauagggcuauuaauugguuacuuucaauauuauugugucucagggaauaaggaagaccaagaaaagggagagagauggaagagggaccagucaguggagcacuugaaaugcaaacguaucagcuguguucacugucuuagaugagcaugguccauggugucccaaaacaaucacaacaguaacauggaagaucacugaucgcagaucaccguaaaagauauaauaauaaugaaaaagcuugaaauagugugagaauuaccaaaauguaacacacagacaugaagugagcaacugcuguuggaaaaaugaugcugguagaguugcaaaaagcacaguauuugcaaggcuccagaaaaugagcgaugcuuguaccuucguuucuucugauuugcucuucuaaucugccauggauuuagaaggcacauaacuguuuuaucacuguauauaaaauaagacaauguaggcaguguacaggagaccuuaucuaucuagagagaucaauccaucuaucuuuuuuuuuuugagacagggucucacugugucacccaggcuggagugcagugguguaaucuacgcucaaugccaccucugccucccagguucaagcaauuauccugccucagccuccugaguggcugggacuccaggagcguaccaccacguccggcaaacuuuuuuguauuuuuaguagagaugggguuucaccauguuggccaggcuggucuugaacuccugaccucaagugauccacccaccuuggccucccaaagugcugggauuacaggugugagccacugggcccagccuaucugucggucugucugucuguccauccauccauccauccaaaguauaggaaucgcagugaagauauuuugugaaaucuuuuauggguucuugagagacauaaaguuuuggauucucagcugugguucaaauaguggaggcugcaggcuaucuugggaauguuaaguccagugaaagugugaaaaaaaaaacauaaaaauauaggcugcugaacugggaaaaggugcuaaaaccaaauauugagaccacuuaaaaauuaaggaauauccaauuucaaaauagcauugaucuugggggaaguacauuuuccauuucauuuagaccacauuaacaaaaucauuuuuuaaaagacuauaacuaucuauuaguaauacaauguccuuucaugcauuagauggccagucaugcuuaccguauuuuaaugcuaugcgacccgucauaaaaaguuagguuuacaccucaaauuggaaauucuacuuauaagcacaccaguaaaaaaucacuguaaauacuuguaguaacauaacuuuacaaaaagauucuuuuuaucgccauccauaaaguggucacucaccugcauuaagagcuguaaauaaauuuuuucucgaaggaccuaagauauaaaagaaacauguaaaauacauauguuuuauuugacauaucacauaaaaacaaaccauguugauaagaauuauuuucaaaaacaaucaaucgcuacauuucagguucccggugggaaauaucaccgagauucaaccaacuuuugucaagugcauuuuaaauauaaggugauauuucacauaacaucaaaauguuuaaguaugauaugaagucaccacaaauuaaauaggaccaguuuuaaaaggaaaagccgcaguauuuuuucagucaagaacagcugaaguucaaguuuuaacaguacugaauucacagacugugcacauaugccauucugcugccgggagagcagaggccagacuucacgaaggacagucacucccgugugcuuuccgaaacuacccguuucuauucagcuaugaagaaaaauagaaguuuuuccuccaaacugauaaaauauaaaaucaggagggguaauagguacacagcuguaagucacuaaaagaaaucuaugaugcuucuacuuaacaugaaauaguuguuucuaggacauaaucaucugcagauaccaguuagaacagcuaccauguucuaucugaaauuuuacagagaugaugaucucuuaaaauacguggcuguuaucaauggaaagcacugauucccacacagguaaaacuguugcgacauaaccuauccauucaauagugaggcauuuuagaauucugagucuccuguucuacaaagcuguccauggaaucucauucucugcaaguuauuuuaguaucaaaguucaacagcguuaacuucauuauugcuguguggaucauggggcuuuaucaucaucaauaaaaaaccacaguuuuccaaccugaugucaacucagcaagaggucauuuggugccuccgaaauuugauuaacucccuaggcaaaugacaaccugcugcacacugaagaauucaacccacuccuaaaauucaugccuauuuucucuucaauucaguacaaagaaaagguauugacauacauuaaccagccucaagguaccauauuauccuuuaaacacacacacagagagagagagagacauguuaaggaggaugcugugacagaguaacaccucugagaaaguuacuaauagauauuaacaauccaaagaguuucaugcagguuaacccaguaauuccuccuucugggauauccacaaguaaccagaaucugaaacaaugaaucuugacucacauuugaagagguucaucucaguauuaauaaaccccaauaaaagucagaaguugcccacuauaaacugaaguggacaaccauagaauagccauuuaaagugaagaagcucuccugauacacuacuaacuuaauaaaaagcaagauacagaagaguauauucauuauuaccucaguuuugcuggaauaaaaacaaaacaacauauacauacagaggaaaaaagucacaaggaaaugugacagcaauugcugguugacagaauuaaggaagacucuuuguuucuguguuuuccaaauucucuaacauaaaugugggucucauuuuauaggucaaguuucucacucacaauuauucgcucaggcuuuaguuaagcuucaguucacuaagcacaaauaaugcuuuuuuuuuuuuuuuuuuuuuuuuuuuuugagacagagucucacucugucacccaggcgggagugcaguggcgcgaucucggcucacugcaaccucugccuccuggguucaagcaauucucaugccucagccucaugaguagcugggacuacagguacacacgaccaugcccagcuaauuuuuguauuuuuaguagagaugggguuuugccaugucggccaggcuggucucaaacuccugaccucaagcaauccaccugucuuggccucccaaagugcugggauuacaggcgugagccaccgcauguggcacaaagaaggcuucugaugugcuuuggccccacugagacaaagcugcaugaaaacauugcacauuaaguguauaccacauauuuuguaaaccugaaaauuacuuuucauaaucacagcaaauaaaaagugagggauaugagaaggaacagagauaaagaacauuuagaggaagaacaaugucuuagaccaaagacaugaagacacaaguacaguaauaaacauaaaacaucuacccugaugaaaaguaaucaugcauuucuacuccuuucucacuauucuagagcacuguuuuagaauaauuuaacuccugaaguuuugcuguuucuaccuuauaccuuuguucugccugcugacuuacacguaaugauuuuuaacuauagaaccuaccaacugucagaaaaacaauuuccucagugcaaaaauguauuauaucuccuuucucaacauauuuguaaucauuguugacuauaccauaaaccuaauugucaaaauuuaacuuucuacaagccaaggacuuuaagcgucuugcccucccucuucaaaccacaaugaggacuguaccuuuuggaggaguuuucaucaagugaacaugagcccuggauaccaaaggcuucaaauaaaaggauccugaggaaccauucugaaaugcugguuuuggagguuucuccucauauuugaugacagcggcauuaccagcuguaauaaaacagaaaaguacauuuuauuguauagauaaacacaguuucgaccuuccacauuuauuccuuuguccuugaaccaacaaaugcucaauaagcaccuacgacaugccagucauuacugaacauugggaauacaacauggauaacagguagcuugugucucagggaugcgaaauaaaggcuauaaucagagugaccacacauccugguuagccuggcacaguccaagcuuaugcaucuuguccaguucagcuuucaucccagauaagaguuggggaagaaauaauacagccacuucaugcuauguaacaagaaugccccaggugcagcuaggaagagcacccaucuccauggggacaaggaagaauucgcacagucagcuaguuaaugacacaagaacaguaacauacagacuccuugguagcuauaaggacacgcucugguucaaauccuugcuccuacagcaaggaguuaaaaugcuaacuucugcccugaacaaaggaaguuuguuccaaaguaaacuuuauguuuuagcuccaaagcaaaaacauaaaagggaaucuuaccucaauaacaaaaaccaucuuuuuauauuauguguaaaaauuuccccuccaccaauccagacuggauuuucuacuguuuguuuguuuguuuguuuguuuugagacggagucucacucugucguccaggcuggagugcaguggcaugaucucggcucgcugcaagcuccgccucccggguucacgccauucuccugccucagccucuugaguagcugggacuacaggcgcccgcggccacacccggcucauuuuuucuauuuuuaguggagacgggguuucacuguguuaggcaggauggucucgaucuccugaccucgugaucugcccgccucagccucccaaagugcugggauuacaggcgugagccaccgcaccuagccuguuuguuuccaaauaaugaucaauauccaauucuaggcacccaauucuauucuacuauucaacgcuuauaaauuucuuuauuaccaacuaugaucccuuuucucacuucacucacuuagcaaaggguuaagauaccuaccuuguuuacaaaugcauuauaaaugugaagacagcuagaaauuuuucacuaggcuaaccuauuccaacugcuacaauagugcuuauacacaucacauucaaacuuuguacaggcgugcuauuauuuuccccuaauccacacccaggcccuguacaaugagccaucuguucauuguucucgugcccaaauaacauuccuaauauuaggucaaaucaacacagagcuuucccuccugcugagaaaauucugucaauuuccuguccuuuuuuccaauucucaccuucccuagaaccuagagacuuggcuuuuccaaaguugacaggaagcuaaugggagugacaguauuaaagacaccgccauuacaacauucaacagaacccuuuuuagauguucauagaaaauggauauuggguuucaauuagcauuuuagcuuuugcugaaucaaauccaacaaagaaaauuagacagucuuaaccauggaauuauaacaaucuggauuuuagucuuacuuuucuugaagccguauuugauuauauucagcaacaaauaagucacuuauucauauuuuaaaaaauuaaacugaguucaauuuacagaccuaauaugcaauuguaugauucuaaauucaugcuuuucuuuucuaaaauuuagagacacaaaggcccacgguucacaaagagaucaguaaaaagauuuucacuaaaguaaaggacagguucuucaugagggaugguacuccugugucccuugccucucugucacaugcaaaauaggagguggugugcuggaaaucagcugucucacugccacuuuucagacucaauacaacacuagaucaacccggcaccacacccaucaucagcuucauaacacgcaacaugaagucagaauucauacugcaaggauaaaaugucugcguuugacucagguacaaacacacaugcauuuauauuuuauacauauuuacaugaaagcuauauauacaagauacauauucauauacucuaugaucaacgauuguaccugcuuucugcuuuacuaauggcaggcacaaccuguacugagcugaacauaauuuuaugacuaacaauaucuuucucucaauuucuacuuacuguacucuaggcuggcccacugcuuuccaguaaaccccaacuugaaggauguauaccaccaugagucauaaugcucuucaaauauuuccccugcccucuauuucuguuccuaacauggcaacugacugaguauccugaugcuaucuaaauuuucccucagccagagucauuauauccaaacaauaaaguccucagcggcaacaauuccaauauaagagaugcauaauaguuuccagcaauggaacaggauguaaaauauccuaguucuggugcugacuugaccacugccuagcugugcugaaucaccuaucuaugaauaacaagggucugaauaucggguaugggaauagacagugcauucgcccauaucggguaugggaauagacagugcauuugccuucacaacucacugugguauucagucccacugaggcuggaugcauccucagaaucauccuaaagacaguguucuagagagccauggacacuaaacacugcuggcuugaagagacaauacauaaaauuuuucauguggccaccuacuucucaaccugaucuaauauguaguuuaaaacugccccuuugucaucuuuggucccaacugucucaauuaugccagaauaacagauucucuggaaucuuuaucuucauuuccccauggccaaagugugguucaagugaaauaaaggagcuggugagucuaaaaggaaaaacuaagggauauucucaggaaagcccaagcagaagacaugauuuuccuauuagaaaagggcuucucaugcugggcacaguggcucacaacuguaaucacagaacuuugggaagacaaggugggcagaucacuugaggccaggaguuugagaccagccuggccaauauggcaaaacccugucucuacugaaaauacaaauauuagcuggacguggugguaggcaccuguaaucccagcuacucaggaggcugaggugggagaacugcuugaacccaggaggcggagguugcagugagccgagaucgugccacugcacuccagccugggcaacagagugagacucugucucaaaaaaaaagaaaagggcuucucauuguuucagacuuuuaucugcaaacuaacauucauacuacauucuaacaccuagugaaaauucgcuuuuauuacauuauguauauacacacagagccaacauucuguucauuucuugaauuuuaugugaaucaguuuaacacuccccacugugccagaucaucugcccacuuggcuuaaaaucaaaguacuacugaaaucuaaacuuuugaauuucaaaagcaauaucacucaacuauauaauaacaagaaugucucacauauacccuagaaaaacgugaacagagaaagaacgagaacaaaguuaacaguggucuggauaauauuuccuuuuuaaauaguccauucagaagugcguaaguacuaacauguuuugugauguggagccuaaugaaucuaccgccuguuccucaucuuagccucacccaugacagacaucacgacuugaacacaaaacuuucccucugaaccuggaggcacccugagaaaccacugacaccauccuacaggcgaauucuuauccacuaaccaguguuggccacuaaccaguguuggcaggugagacaauauucacuucccauuccuguugugagagaagaaaaaaaacaaaaaacaaaaaacuaaggguaaauaagauccacccuauucuuuaucagcuuaaucacuugaacaacucaaaacaccauccugccaaacaaugaggcccugucuuauugcagugaaaagggucagaaauguuuguugcugcaaggacuuugaagaugacccaguccucccuugucauugaucagaggagaguauggaggcuggaggcuaagaaaagacaaagauaguccaacuuaacaugaguuaguaggaaaacuacggugggaccgggcgugguggcucaugccuguaaucccagcacucugggaggcagacgcaggcauaucacuugugguuaggaguucgagaccauccuggccaacauggugaaaccccaucucuacuaaaaauacaaaaauuagccgggcaugauggggcaugccuauaaucccagcuacuugggagguucagacaggagaauugcuugaacccgggaggcagagguugcagugagcugagaucaugccacugcacuccagccugggcgacaagagcgaaacuccaucuaaaaaaaaaaaaaacaaaaaacaaaaaacaaacuaagguggguccaagguuagugcccuuuucugcauguuacaccccacucagccagggcugucagugaaggugaagggaaagaacacuccauuucuuuuauucagucuccuucuguuccuuccauuuccaggagaaugcaaauagcuuuggucugcaccucuuacauuuccccuaccaucuggcucucaaauauaaacaugguuuuguggccaaaguggaagaggaaguaaugucuuuggaccuuacuuuccugcuaacaucgcaaaguuauacacucucccaagacccccuucuaaauugcacaauaguccccaaaucuucaacucuguucaugacauacaauauaucauuuauuuuuacccaguuacuuuaaugaucuuaaaaacuggauauuagguaucugagugugaaagaccuuauaaucuuuaaccucuauaaaugagcacauuugguauagaaaccauugugaaauguuuuacacuaauauccaaaaggaucaagaucguaacuuugaaauuuucuacacuuaaaagaacacacacaaagaaccugcuaaaauucccaaauaagaacaauuuauugccuuacguauuuugauuuggucauuuaaaaaauuuaguaacauuauuucuauaggaucccaaaguuccgagaacccagugcuaauuuuacaacagcacuguguuauaucagaaguucuuaaaugaugccacuaaagauaucacaucacaaagaaacaagcagacaaagcgagaaaccaauauuuguuaaagggauucaaauacuuaagccaguauaaaucagaacacugaucaaaagaggaaguuaauucuuaacaugaccacccauuaucagaaacaggaaauuuucagcgcgagaugauuuuuucauguuuugagguagccuuuaaaaguauacauguuuaauacuuucaguuacaacuuaggaaaauaaagaugugauguuuccauuuuaauuuuagaaaaguauuuuucuacacuugcacaacuaccagcuacauacacacaaaaacuaguuauuucauaagaaauuaaaccaucaaaaagucuuugauaauaggauaauuucaugugccagaacauuaacgaugcugcugaauuauauuaagagugcaaaacacauaaaagagacaacaaaauugguccuacacagaagcauucacaucuuaaauauacauacaaaaugcccccaaauacuaccauuaccauaaauuacaaguuacaaaaacagaagucaagagauccuaaaucaauuuauugaauaaaaauuuaagcaugcuuacaaagaaaagaaaccagaaaucgucgaccuacuuuuuuucccaguaaacguggcuaacaaaggaauuauacaaaggcuguacgaucccacgaccagcagugucaauaagguagcaucauagugccucucugaaccagccgguggggugaguguagaauugauaaagauuuuugaagaaauaucaguuucuguacaacugcgaaauccuccugguacagucauuuaaaaggaucaaagcaagcuuaagcaggaaaaacugcagccauguucacucucauaucccucaugcuugcucuuagugaauucgaauggagggaaaaaaaaaaaaaugcguaagcuccaaggcacuacacaaaacagauuaaaccagcuagcaaaucaaacuaagaaagagacucacugauuugaaugcuuaauccgcaacaggaacacaucgccacuagacaggcucuguggguguaugguaaaccccuuuguuaaaagacaaaaaggaauggacaaaagcacuuuacagccuccuuaggagcaucagacacaguacugaaacgguggccaagucaacauggaugucgauggaaaacacggggcuguggcacuacagacugugucugcuucaagugccacaaauucuguugccacaacaguuuuucuagagcauguuggugauucuguuuuggcaguuugucuuuaaaauugcuuugcaagacaaagagagcuuaaaauaauacacgugugaauuaccuuuucaaauucagaguucccucuuacaugcaagccugauuuugugccacaccuucaaaauuccaacaguaaagcugguaacaauccuguuuaauugcaagucacauaucccaguauuccugaagugccaggguaugcagcuacuuacucucauaugaguccagcuacugcugcuaggugacccgucggaaaugugcucauuaauucggucauuaauucaaugccuucucuacaaaaaaugcauucucaauucccucacauagcugcugugugauuuuagaccagugacaacaucucugagccucaaucaccuucuauauaaauaucaggguaacagcagaaguuaccugagagaaaaaaauaaaagcaaauauggacauccuaaaguacugcuccacacccagaggagccucaugagcauuauuacacuuuguccccaacuccucacccaaaagaagaaacugaucugucaaacugaagagaucaguucgccacuccucuccacacccuugugucugguuuuauugguauucucaucauccaugaaaauaccuucuuuuucuccucaacuauuuuuuagaauaagggccauuucuuuuauauccugugcuccucacugcgccuaucauggugucugugcacagcgggcacuccaagaugguuuaaauuuaugaauuauuucguggggaaguauaaaaaaggaaaugagaaaauaagaaccaaguccaaauacaucuuuggaaugaaagagguaucucaguaaauucacucauuuauacacagaaaauagaacucacguuaacugaaaacuuuaacaaaauucuccugaguuucaauuuuuuagaauuaggauucaaguuauauuaguccuauuacacaaaaucuagcauccaaagauuccacaggagauagucuuuugcaaaguaaaugaaacugaaauaaucuuuuuuucugauuccaguuagaguccaaauccccuggguugcuacucuuaaaccuccaaaacaccaucacuucagacgaugcacuuucgaauccuucaugcaaaaauauacuuuaacacauaauuauuucaagaguguuuuucaaagaauuuuuuuucugccaaacuuucagagcaacuccaaggaagcaguaugccuauuuuuccugaaaccccagaaacaaaaauucuaauuauuugcagagcauuaguuuuucuuguaaugacuguuuccacaacccccgaagugugauauaaagucgacuuacaauuguugcuguaagugcucagcucacugugggugcuggcuauugagggggugcuuccuguccuccgcagcgcaggacuuuucaaagaugcuuuggauuuaggaaguggucuaggcaaauucacccaugacgacugugcaguuuucaaggauguaggcuuuccuugggguuuaaaaaaaacaaaaaguuuccagugcuauucaucccgaaagcuggcacuuuuuaagccuguaaacucaaacuucugcacuaacaacaaagucaaaacacaaaaugaauguucacaaucauguaacuucagaugaaagaugaaagcuucacgcagacauguuuauuuuugaucauuuagaggcaagagagcagaaaugaugaggcaauuaggauaugagaaguguaggaguaacccugucuccuaaaguaauuaacucacacauguucucugaaggagaugaucaaucagaauaaucaugagaaagcagcuuuuggcaaaacugaaauaaaaaaauaaacaaauugauacgaccccccauacuggugacuaaaaaaaaaauaauccauuaggacaauaggcuaucauauaagaaauaaauaagaaccaaguccaaauacaucuuuggaaugaaagagagaucucaggaaauucacucauuuauacacagaaaacagaacucacguuaacugaaaacuuuaacaaaauucuccugaguggaaaauuuuaaaaucacccaaacaggaagaaaaaugcaauuugauaagcaaaaauuucauuugaaaaaugccuaauguucuaacaccagguggugcuauacuauuaagauuuuuuuuuuuaaucucaccuuuucuucuuuacuccccacacaguuuauuugccaaacuuaaaugaucuucacuccaacuugcaacucuuucuugcaguaaaaauguuuccacuuaucagugaaauaaauauacaggcugcguauccucuggcaucucugaaacuacauucuccugaugcucacgaaccugcuaccuaaauaugggcauuucccaagcccagucuuucgcucuuaacccuccucaugcccauucucuuggagagucuauuuucucuacuuuccucuaaccauuguccuaugcggaugaaucccauguucucaccugcagcccuaucuuccuucugaaucucaaggcuacucauguuuuaaaguacuuauugaguacucuagguuuucaucuuagaccgacaugcuccuguuuaugcuaauuauagcuccacuguuuuauuuuuuuaaaaaucuugcuuuguugcccaggcuggucucaaacuucuggccuuaagcaguccucccgccucagucucccaaacugcuggaauuacagguguaaaccaccccacccagccauauagcccuauuuuuuauuuuuuuccagcuucaaaccauuggaaucaucuuuucuuccccagauccccauauauucuagcacugucucccaaugcuaccaguaccaccuaacugaagacuacccagaguugaaaaagaccuuugaugaaaaugacauuguugcguaucacuaaggaucccauaagugagucaaauaaugcugcuggaaaguaaugcccauugcuuuguucuagcgauuuugcucauaaaaaccucauccuaauggagaaaaagaugcugaagcuccucaggccuggcauuugaaauuaccacauuaagcuccccuccuucggcuccagccucacucuuguauggcucuccuacauccaugugugcucugcuccgauuaaccucgcuuucucucugacaccagggcacaucaugugcuauucuauuaauauuccaacaggcacaucauuucuuuucaaagagcucuucuuccacccuuugaauccuuauuuaacccuuuauaucauugucuaaacuguauuggacuccuaaaauccuguccuuccaucccuuccaacuccaucauguuaaucuccuaaaugugaaaauuaaggucaugacccaaucuaaaauuugggauucuccaccaucuacagcaugcggcccagcacagcuuugaacgcuaacccaauacaaauucauaaauuuucuuagaacauuaugagauuuuuuugcaauuucuuuuauuagcucaucagcuaucaucagcauauuuuauguguggcccaagacaauucuucuucuuccaauguggcccagggaagccaaaagauugcacaccccaaucuauaggauggugaucguaguuucaauccuuuuauuuaauauuuaauuucacaggcuuaaaaggcaaugugggguugaucccuacccacuucuucccccucaggccaugccucuaccccuucauacacacacaccccuucgugguuucucuccagucauuucgcucuauucuucugcuuacgcccauccuuccgacugaacggccuccuuucuauccccuccccuauuucuguccagugaauccaaagucagcucaagcuucucuucugaacccuugcuacucauuugcagcuccacccuaggccuacugaaucaccaccugcaguuucacaagauccccaggugauuaaaaugcaccuggaguuucugaagcacuguugagaaucaggaccucucugugagcuuauccugccaggacacccuucucugaaugccguggacuaagccuugcuuucuccucacaccauguacuuguuucuaucacagcauuugccuccacauucuucuuggaccaucucuaagguuccugagaucaggaagagcaccugauucaauucugguccucaggaacuggcaaaggucuagcauggagugagacuuaauaaauguuuccucaacaaauucauuuuuuuaaaugccaacaguaaaugauguauuuugauaauguguucucccaucaucuauacugaagcauucagugcuuaacccauuuuuacaagcuuauuugaaucuucagucuauuagagacuuuuuucuuuacauccuuuacaauaauuagcaacuguuagauagcaaauacacacuuuaaaaauuuaugguuagccaccaguuuuacuugcuuuaggaagaacaggaaaacagauuuuuagaauauaaauuugccaaauugccgccccuucagcagaaacacugaugagucaucaucaaaacuaauaagcaagguugggcacguaacagaucaaaaugacugggccacagccacagugcagccaaggcuuccuacauuuuggaaaucagcuuauucuucagaaaugcaugccucauagcuuuguuucuaaacacaacuuagguuugcagacauuucugagugugccugggaauuacuacagaagaccuguaccuucacacagcugcacuagaggaaagcuuaccccggcaaccaaauaucauuucccugaccuccccuaucucauugucacccccauccaggcccauccccuacaccuaauggcagccaguccucaccaaagucuucccaauuccaccauggcucuugacuaaugagcaaugaggauaaugaaugccgauuucaccaaaagauuaguuucuuugauagaauaauccuaacagugugugacuauuacuaucccaguuaauagaugagaagacuacuuaggugguuaaauggcuuacuugggucacauacccggccagugacaguaaggccuagaauccaagugucuaaccaccugcccaguguucccucggccaugccacagaauagaaacaucucaguuaaagaaaaguaugaggcuuggaggcagacagaguucagaauggagcucuuacuggacaggagcuccuacagcggaauggugaaaaccguacggaugcaacaaagacauauaacuauuucaccaacagucccgacguuuagcuuaacgguaaaguuggcaauacuaaaacauagcaauauuagguuaauugagagacugcaaguaacacaggcgcuaaauucuuaaacagugaaaucaauacaggacuucucugaguuacaguuccgaaaaggugacauuuaccaggucauaucguauuguguaacuuaucccagaugagaaagauaaagauuuaagaucuacuugcaggauauuauugaccucagugguuuauuuuaagcucgugcacuuagcauagacuuacguauagacaacagauugguuuuuauucuguaauuauaaccaucuuuuauguagggaaaaucuggaaggaauaacaccuccacuuugccuuagauaguaacacagucuauuggauuugaagcaaaccuucacuaaucaaccaauuuacuaaaauacucaccucagaaaaccugaguaaguauacuauauuuaacaacaauaaaaaucaguaaaagacgccuagcaaaacuaaaauuucaauggaaagauuaagugaacaacaggauaguguuaauauuaauauuauccuauucuguaaaacaaaaugguagaauggcgcuugccaggggcugguggggaagggaaauggggaguuguucaauggguagaaaguuccaguuaugcaagaugaauacguccuacagaugugcugcacaacuuguguuguaggaagcugggauuacacccacacaacaccacacccggcuaauuuuuuuguauuuuuaguagagaugggguuucaucaggcuggucucaaacuccugaccuuaagugagccacuugccguggccucccaaagugcugggauuacaggugugagccaccgugccuggccaaaacagaucaucuuaauaaaaaucuggacaauagauucacaugaaggugugucuuacacaaguauuuaugugcuuaccuaguaaggcaagugcaaguaaucacaaaguucaaacauauacagagccagaaccaccugacauccugccacagaauuagacguucucaguaaaaacuguaaacuaaagaaaacaucaugucucaccauaagguauguuguucuguaguuuauacagcuuaguaggaacacaggugggaagaagaaaauaaggcuggagaggcagguaguuuacaguugggugagacauggcauugaaugccagacucauaauuuuagaccuuaaauguuagggauggauauggugggaagauguggguugggggggucggggagggugaggcuuuuuuagcauuuacaucagaacuugauugugugguagcagugugcagaacugacugaagacugaaaucagggaaaaagauaggaagcuaguguaccagcaccugccaggguuagagaagugagaauuuuaacuaaaaaaugaaaagauuauugagguccauuugaaauauaucaguauggcacacaaguggcaaggccacuaacuacuaaguaagaaagagaaaaugccaaacuaacagacacaguuaaaauacgagacaugagaauauguauuuuuuuuccaguuaauucagagaauaugucuguagcuauaauuauauaacuuggguuccuuaaauacaacucaacuacuuagagacaguuaccuuuagaguaauuaccuacaguaacuaggaauuauuauaaaaucaggggaaacuuaaaagugacaaacaaguuaacaaguuauaagagaaauaaauuauacauacucaaaaccguggcugcagguccacuuccaauuaagcuuaagggaccaaauucucucaccaacacuaaauauacauguuuaagaacuuagcuucaaugguagaguaucacuguauaaauauuaaauaaaccugaugggcuucuuaccaaauaaguauuauacaaaauccauauauuuccuaugugccaggaaaaaacagaaaaagaaaucccuuacuuugguaacaaaaaggaauugcacacauagacacacacauaugcacuguuucugugaauaaauuuaucaaaaaagugcuauucuauugugaaaauuauaaaaaugagaaaaauaaaaguucugaacaaguguacacaugugaauucuuccaugaauugauaucuuauuaaaugcuauugcaaucugaaccuacaugugauugcuuuuaaacgcaggaauugaauuuuuaaaacauguuaaaguaaucuagaauaauuaagaauagccaaaaaaaaauuuagaacagaaaaacauuaagacuacaauucaacaacgaaaauaccaaaaaacccaauuuaaaaacuggacaaaggacucgaauagacauuucuccuaagaagacaacaaauagcccagaggcacaugcaaagaugcucaacaucacuagucacuagggaaaugcaaaucacaaucgcgcgagauaccacuuuguaccuaaugggaugcuaucaucaaaaaaaaaaaaaaaaaaagcaaaaacaaaaaauuaacaaguguuggcaaggacacggagaaacuggaacccuugugcaaggcuagcgggaauguaacaugguguagccacuguggaaaugguauggugguuccuccaaaaauuaaaccugaaguuaccauauaauccaacaacugcaugucuagguacagauccaaaagaugugaaagcaggccgggggugguggcucgugccuguaaucccagcacuuugggaggccaaggcaggggaucaccggaggccaggccaggaguuugagaccagucuggcgaauauggugaaaccccaucucuacuaaaaauacaaaaaacauuaucugggcaugguggcgggcaccuguaauuccagcuacuugggagggugagguaggagaaucacuugagccuggaagguggagguuacagugagcugagaucaugccacuauacucuggccugggcaagagagcaagacucugucuuuaaaaaaaaaaaaaaaaaaaaagugaaagacuugagcagguaucuguacaaccaucuucacagcagcauuauucacaauagccaaaauguggaagcaacccuacuguucacaggcagaugaacgaauaaacaaaaggugguacagauauaccacggaauacuauucugccuuaaaaaggaaguugacacaugcuacaacauggaugaaccuugaggacacggugcuaagugaaauaagccaguuauaaauaauguaugauucucuuucaugauuacuagaauagucaaaugcauauagacagaacauagaguggugagugccaggggcugaaagagacggagaacuggggguuaguaaaauggauacaggauuucaggggggaaaacaaaguucuggagauggauauggaggauggcugcaaaaaaugugaauguacuuaaugccacagagcuguacauuuaaaaaauuguuaaaauggcacauucugugcaauauauauuuugccacaauuuaaguuaaaaacaaggaacuugugcaacuaguuggaguaagauauuauaaaauaauaaaaguccuacuggaauaaaaccauacugacagauuaauacggugguauauacaucucagagauauaaaaauucaggauaggauaggauaagggagguaucuuaaaucagcaaaaacauacuuauuugugguauuaagauauuugaauugccaaauuaaaauuugagaagcagaacgguacaguaguuaauaguugacaaucucgagguagaucgucuagguucaaacccggcgccaccucacacugccuagugagcagguuccucaccguucugcacuucuguuuucucauaugugagaaugggggugauaggaguacuccuuaccucauagguucuugugagaauuaaaugaauuuauaauuuuaaaaugcuuagaacagcaucuggcacaaaguaccauacaaauauuagcugucagcgcucgccauccaccaaaauaaauuaaauuggauuacaacgcaaagggcuuaagaugaaaccauaaaaaaaauaauuaaacauaggucagucuucuugaguagggaccgucuuauuaugcauaaaaacacaggaaaaguuaaaggaaacaauguauuugacaacauaaaagugaaaaaaaauuaagaaaucaccauaugcaaaauaaaaagacauaaaaacaacaggcaaaggaaaugaacagcagcagaucaaaaaaaaauccuaugcccccaaauauaagugagcgaaagcucuugaugaaacaaugaauacaaagaguugauaacuuuuauuauuauucuuuuauuuaaccucacugugucuaacaccuuuccuggugagccaacugucauuccuaauccccaucaccauugcuuaaccccauagaagaguuuaaaaagucaaauacuugcuuccaaccuuucaugccaguaggggcaagagccagaucuggucuguacccaucagacauaaggacaagagggcgaagggggagcugcugcauggguguccccaugaaaaacaaagagaggaggaggucccugcccugagaugccguccuuugcuuccagccuuugaaugcagucacaggaaguggugggaugcacacggaacuccuagcagccauauuuuaacugaaaagccaaugacaaagccacaugcugaugugagaugaguggagaggcagaaagaggacauuuaugaaucgucaaaccuggaacagccugccucuagcccucccgaggaauaaacacacacagccucugguuuauguccacugguuggguuuucugucgccugcuguaaauuguguucuuaacugcgccauucuccugccaacaguauuggaugcaauugguuccuccuuucuucuugaaaggcuuuccuuacuuggcuucagggaugccccuacguuccuggcuguuccuucuugacucuggagaguccagggagcaccccagagcuauccuugaccugugcucucuacacuuacugccguggggcucucauccagucugguggcuuuaaauauccucuauauggugcugaauccuaaauuuauaucuguagaccagauuucucccacgcacuucaaacuugcauauccaguuuucuacuccacauggccucuuaucaaucauuucuauguaacugaguuucagaucuccccuucccaacaucuguguuuccaccauccauucccaucucagguaaaggcugcaccauucuuccauugcucacaccaacauggucauguucauccgugacuccucccuuugcucucacccccaauccaaucuaagcaaaccucacuggcuuuaccuucaagcacauaccuagaaucugagcgggccucacugccacaaccugguccgagaaaacauaaccuccugcugccaucacagcgacccccgcaagcugaucucccuguuccuacuucacccauauccaaucuacucccaacacaacucucagagugaucccauuaacauuuaagucacuccaguucaaacuccaaguccuaacuaugauuuucaagacuauacaugauccacgcugggcacggugccucacgcccguaaucccagcacuuuggaaggccgagguggguggaucaccugaggucaggagcacaagaccagccugaacaacauggugaaacccugucucuacuaagaauacaaaaacuagcugggcgugguggcaggcaccuacaaucucagcuacucgguaggcugaggcaggagaaucgcuuaaaccagggagguggagguugcagugagccaagaucaugccauugcacuccagccugggcgacacagcaagacugugccucaaaaaaauuaaaaaaaaaaaaacagcagacacugucuccauuauauacauaaacauaugugcaugagaauaugcaaaaagaaaagguaccaaauagucauaaauuuuuaaguuaaaagcuauuugguggugguaagaugacagguguuuauuuucucacuuuuaauuuaaaaugcuauaccuuuaaaauagccuacugggaagagaguaguguaaacuugauaaacuauccaauuugccugguuaaauucaagacacaagagguaaagaauaaaacagggccccgcaucccuuucuugacauugacaagaggcucuaggucagccucuucuuuguugacugccagaaagccaaucuguuguguccuaaucaccuguuggcccuccucuguauuuucacaccaucauuacugacuuugaccucaaucucuacauucuauauucugagccauaacuccucuucucauucuaccuucuaguaucucagucaaguccugaaaaauagcucaauacaugugcauccuccuuacuucucagaucucagggggcaaaaguuaaacagcacaaagcaucaacauuaaaccaagccuggccccuaccuauuuaagaguguaacucuauuacauuauauaaucuccuauauuacagaaagaaaaccauuaagcgaacuuugguauuuguaauuacacccucuuccaaaauccuacaguucuuuuuauuaaauuuuaguauuauaagaacaaaugugaugaaacaagaacuugucaccucuucuauuuggcaguuaauaccaagaaggcaaaaacuacaucuuacucaucccacaaucccucagugucugguacaugacuuaccuagcauacacgcucuaucuguuaaguaaauacguugcagaacacagaauauuucaguaacacucuagauuuauauguugcaaauagugauuuuacuauuccaccuucuugaguucaucaaggcaauaggacucuguauaacuauccucauuugcuuaaauucaaggguaagcuccccagacaaaggcagagcaacacaggugagucauaacaaaaacacggcaagucuuaagacugcaguaauuugacaaaggagcaaaaagucccacaaagggaaguucucacgaugacucgaacuccacagaagcgcagcauucucggugaugcugucaguaccugccucugcaaguauguucacaagaugucuguggcuucagguggggauuaaacaaaaauaacugccuuagucacaggccuggaacaugugucccacaacuacaggaacauuuaaauucagaggggaauaaaccaaagacuuaaagguguugcuucauuuucccagcuaccauacaaaggagauaaacaagggucuucacauguucaccagcaaauuuauuuaccaucugacaccuaugcuaauaaugccugauaagaacaaaagaaggugcacagugagccuccuggcucauuaggagucaagguuuaugagcagagcuccacugagcaaugagguggugagaucauugagaccucaaaacuucacaccaacuuuuuuuuuuuucuuuucuuuucagagggucucgcucugucacccuggcaggagcacaguggugcaaucauagcucacuguagacucaaauuugggcucaagagauccuccugucucaggcucccgaguagcuaguagcugagaccacaggcgggagccacugggccugucucuuauaucuuuaugucagcucuuuucugaugguuuccuuagucucuacauauuuuuacucuuaaaccucaggcaugcacauaccccucugaggugcuucccagucuguagccuccuccaauuucacaugccccgaauuaaacucacuauucuccuccggaaaacuucuugcuacucuauuccacauuucacuucauggcccaccaccuauccagccucugaaggcggcgguuggggagacacuuaggacuguucacaccaacagaaguggccagacacucugucuccuaauuauuuuaaacaugcauucuacuauccguucccaaaaaauauguagcacucgugcaaguuugugucuacauuauuagaacuaaucagccucuaccucccucgaggcagaggcucaucugucauugaccccgggacacgucugcuccaggcaugcugacucuggccuugacguuccccaagcacaugguauccuuugacaaggccacaucugcacccucagcaaccccagcagccuccucugcuggcaagcuccugcaggcgcauuccaaacaguucaaaugucaccgccucuccuccaguucucccucacaacaaguuaguguugcuccuuuacuguggauacacagugcuucgcacaggucuccauucaaaucaagccaaggaauguuuuuaaacaccuguugugcaaccaguacacugugcugggcacuggaaaauaugaaaauaacuaagagcugaacucuauccuuauggauuucaccgucuagaaggagacagacauguaaggaaauaaugagcauacagcacuauaaaugcaaagcagcagagaggccaggacagcugagguggaaucugaagagccaagaguuuucauuggaacgauuugcuuagacacccccuuauccccucacccuccaaccaguaagcuccuuaagagggcauauuugcuuaauccuguuuguagucucagaaucuaguacacugcccaacacagagcagcgacucuaagcacuucuugaaugaaugggcaagccugcacugugacauauuaagccuacucaugagucauuccacaaagcaaucuucuccauaauuacugccaaguaagaauugugugaaacgccuggaaaagaucaagcauuuacaagugaugauguccgugaggaugaaaagaggacaugugccucgcaggcaccugcauggcccugcuugguugguccugaccuccuccgcccauccauguccuccagcccccaccacacacagugcgugguucacuguuccucacgcacccuacacccugccucaccucggggucucugcacggcuggucccugugccuggaaaguccucccgccugacacccaaaugccucccuccucccuuccuuucagguguuugcccaaaugucgcccucucagugaggccuuucuugaccaaccguuuaaaaaucuaaucuccuucacugcuuuauuuuuauuuuauuuuauuuuuugcuuguuuuuuuugagauggggucuugcucucucacccaggcuggagugcaguggugcgaccucagcuagcugcaaccuccaccucccagguucaagagauucuccugccucagccucccaaguagcugagaccacaggcaccggccaccaaacccagcuaauuuuuguauguuuaguagagaugggguuucaccaucuuggccaggcuggucucgaacuucugaccucaagugauccaucugccuuggccacccaaagugcugggauuauaggcgugagccaccauguuuggcucuuucucuuuuauuuuuggauucaucaucaugaauccaaaaauguauuuauuuucuuaauccccuuauuagaauuuaagcucccuaauggaaggaacgggucucuucugugcacuucauuccagcacuuagaagaguucuuagcacaaaccagccuuccccacauucuccuucacacauaugugguuuaaugaagaauucacauauguccaugaaagaagacaggagugugucaagacuucugcaugcacguaaaggaccaggguuaagagcacagacuguggggccagaacacccggcccauuucccgucuccaccaauuaccccacuguguaacuuuggacacguuacugaagcuuucagacccucaaauuccucaucuguagaauggcgauuaucacaguaucccuacuaggaguugugggaauuaaaugagauuaugcauuuaaaagagggcuuagcacugugcuuggcgcacacaggcacucaaaacauguuagugacuaauacuauuuuuaugaaaagagauccugauacacacuuuaaggaaacuaauuuaauuacauaaaaauauagaaacaucuauuagcgacacauuaaaauuaaauuuuauucacauuucagagacagggucuugcccugucaccuagccugaagugcagugguacaauuauagcucacugaacccucaaccacuuggguucagugauccucccaccucagccuccugaguagcaaggaccacaagugugugccacuugcccagcuaauuuuuuaauguuuuguaaagacagggucucacucuguugcccaggugggucucaaucucuugggcucaaguaauccucccacuucauccucccuaauuccugggaucacagaugugagccaccauguccggccucaacuuggcuuuuagaauaacuuauuggguaauaaccucugauuuuuaguaauuacuuuauucaaguaugugaaaaaucucucauaauuuugcuuacugucucccucaaauucucaccuagaaaaguuuaaaaggauauaaaaguaauuugaagaagauuugaaauuaccuuaacacgaaaugaaugaaaaaauaaucaguuuacauaaaccacgaaggaaauaacuuagcaagaaagaagagaaaccugcgaugacaggcaagucacugcaaguuucggacggacuacugucuugaaaggaauuuacuuuauuaacccacaauaaacucaacugaaauaaagaguugcccuuuugaaaugugguuucucuuucucuagaagaaaaccaaaaaccaucucuuucaggaggccuuucuucaccgacccaccccuggacauucuucucauggggccuuuuccccacccaucaccauucuuugugccgcuuuguguuugcugcauaaacacgcacucucccuccucagcucacaggagucacggggcagggagagcauucugcgcuacuucuguaauccuaccuggcucaggcuggccucugaaauggcaacucauguguguagagaagaacacagauauuuaucaucuaaaaccugggaaaagcugguauugccuccaaaagagagugaaggcgggucucucuaaagaugucugaauugaucaugaaggauuuacucagcaguuauuuauucagcagcauuaauuuuauuauuacuguauuuuuuauuguuuuaaguuccgggguacaugugcaggcugugcagguuuguuacauagguaaacaugggccauggugguugacuucaccuaccaaaccaucaccuagguauuaagcccggcaugcauuagcuauuuuuccugaagcagcauuaauuuucaauagccacauaaaaucauucacaucagaguuaacaucaagcuuuaaaccaaggccugaaaagaaaagugccacaguuucuaaaccauucagcugggcaacaagaauuuuaauuuuuaaaaaaauuaaacguuagccugguguggugguucaugccugucaucucgguacugugggaggccuaggugggaggaucacuuaagcccaggaguucaagaccagccugggcaacaaagugagacccccccaucucuacaaaaauauauaaaaaucagcugggcaugcugacacacaucugugauaccagguacaugggacgcugagacaggaggauuucuugaguccaggaauucaaggcugcagugaucuaugguggagucagugcacuccggccuggacgacagagugaaaaugucucaaaaaaacaaacaaacagaaaacaaacaaacaaaaaaacaaauuagacuuuauuauuaaaaauaaaacucaggccaggcgcgguggcucacuccuguaaucccagcacuuugggaggccgaggcggguggaucaccugaggucgggaguuggagaccagccugaccaacauggagaaacccuaucucuauuaaaaaugcaaaauuagccagguguggugguucaugccuguaaucccagcuacucgggaggcugaggcaggagaauugcuugaaccagggaaggggagguuguggugagccacgauugcgucaauugcacuccagccugggcaacaagagugaaacuccaucucauaaauaaauaaauaaauaaauuaauaaaucaaacaaacaaaacucauggccauacuaauaguauugagauuaauaauguguugguuaacagcaucacuggcuggucugaaucccaccucugccacuuuccagcuguuuaacauuggacaaauuauuuaacuuuucuguggaagauuccuugucuauaaaauagggauaagccucaaaguuacugugaggauuaaaugaauuuauagaugaaauuacuaaaacugagccuggaacccgacauauacuuaacagugugagcugcuaucauugacauuauaauaauuacuacuacaaauaauuuucaucacuaucucaucuuauuucaguauauuuccaaagaagcaaagguaguuuagauuugguuuguuauaaucucuuauaaucuggucucauauaauauauuuccacauuuugacaaguaaaauggaacagcucuuugggaggccaagguggguggaucaccugaggucagaaguucgagaccggccuggccaacauggugaaacccugucucuacuaaaaauacaaaaaauuaguugggcgugguggugggugccuguaaaucccagcuacucaggaggcugaggcagcagaaucgcuugaacccaggaggcggagguugcagugauccgagauugcaccauugcacuccagccugaucaacagagcgagacuccgucucaaaaaaaaaaaaggaaaagaaaaaggaaaaagaacagcuguguuggguuuaauuacaauuccuucucacauucauuuuaaagcuucaagaaaauggcuguuucaauacugggucugguuuucuacuuaaguguucugaaaggauuuauugaaaacgccaaauuggcuggaacauuucugccgcuuaccuuucagcagaguaacugugagucaguaugguggauauccauuugguuucaauuugcuaauacacacagacacuucauuguacaaucaauggcaacaggaucacggggaucuaaaagcacauuguuucugcuccuugauuuuucuguucuacuuuuaacucuguggcgauuaagaaacaccucucaauuuacugagagcauccaaaaaaauuaguugcuauuaauuuuucuguaaaacauaauacaguagaaucaaauuagucuucuuagucggcucaggcugccauaauaguaauaauaccagaugggguggcuuaaacaacagaaauuuguuuucucacaguucugaaggcuggaauguccaagauagaggugccagcugaucugcuucccagcaagggcccucuuccuggcauccagauggccacauucucauucuaccucacauacugaggacaguuccagugucucuuccucuuuucuuuuuugaaagagaguuucgcucuugcuacccaggcuggggugcaauggugcuaucucggcucacugcaaccuccgccuccugggaucaaggaauucuccugccucacccuccccaauagcugggauuacagucaccugccaccacccuuggcuaauuuuuuuuuuguauuuuuaguagagaagggguuuccccacauucccacauuggccaggcuggucucaaacuccugaccucaggugauccaccugccucagccucccaaagugcugggauuacaagcgugagccaccaugccaagcccaucucuucaucuuuuucuaagggcaccaccccuacuggauuaggaucccacucuuaugaccccguuuaaccuucaucaccuccucaccagcccugucuccaaacacaaucacauugcagguuggggcuucaacauauuaauguagagggacccaaguauucagaccauaaaagucuucuaaccagucaaauacaaaacucaaauucaaauccagaauguuuccaguuacauuaacuuuguuuccauucagauacagaaaaccacccaguaaaacguaauuaguuuuuaacucagacugaaaaaucuggaugcauaacucaguuaucaagcucaucgacacaggaugauaaaagcucaaaagcaugcccugucuuuucacuaagacuaaacagauccacuuuucucuaagacacauuaugcaacacagaguaaaaggacuuaacaacuacuuccccgcugggugggacugaucgccuacauaaaaggauucuaucuuuuucaauguauccuggguacuggccucauuucuuaaaaguaugugcgcuuagauuuucugggauucaagccccacgaaauucagagaaucauaccaguaacagcaguuacucagaaaauuaggugagcuccaaauugucccuagaaagguaagggcuguaaaagcugacagggucuuagauucucagacacuuacacuuucaagaugugaagaugaagcccagggagaguaaaagacuugcucaggcagcguauuggggccagaguggaacuaaaacacagggcuccuaacugcaggccaggggccacacuccagugccaccaagcuacagguguuccucacagaggaggaagggagcuucccauucucugcaagcaccaugagccuuauuggacaacuacaguaaggaccagagcuuuuucuucaccaccaagggacaggguuuugcucugcugcccagguuggaguacaguggcaugaucauagcucacugcagcuuugaacuucugggcucaagugaucuuccugccucagccuccugaauagcugaggagccccuacaagggcacaccaucaugcucucaugcccagcuguuuuuuuuuuuuguuguuguuguuuuuuuuuuuuuuuuuuuuagagauagugucuugcuauguugcccaggcugguccugaacuccuggcccacuuuggcuuccuaaagcacugggauuucaggcauaaaccaccacacccagccaggacuagagcuuucaucucacucaugccuugacuccccagguguggcaauaucccaaauaagaaucacucuuucucccaauggcuuuuggccucuguuuuucucccagaugaugaacacuccaagcuaaugaauuccuguuuccacccagauccucuggggauggagccaugugcugcaaaccccucuuccuccacucacgccucuguggucaugucuccuugaccuugacacuaggccugaaucuaaauaaacagcccguaaaacauuucuaagcauuacaggcuuucacacuugaggcuucaugguaggguugaaaaaugaaaccuacaaauacuaaauuguagagagguacagagaucuucugggauuugcucgcuuucauuaguuuccauaaaacauucucacguguguggacacauaacuauuuguauaagggaacuuacuacuaaauugauuugacaugacuuuaauuugcccaaggcuguaccggcagaaguaagguggguucuuugcaagauguucucagucaauuggaauggcuagcaggcuuuucauccccgugacacagggaugacuuuuccauuucuuuguaacacagaucuguacguccgccaaauuuaguaugauacuuaauagcuauucuugaggcgcucacauuucauuggccuaacaugacuuuaaaauuacaaauuguaagauacaagccaacauaaauaaaaguucacauuagaaaaauuuaacuuuuuagucacccucauaucccuccuaaaucuaucauacaucuuucaguaaaauuaaaaaaaaaauuaaucucuucacauguauugagggcacacuagggaccuaccguacaacacuucagcauuguuaagcacuuaaccauuugaaaaaacuuaaugaaaugauucaaauuuacaucagccacccaauuguauauuuauguacacauccuucugaauagcuuauaagaugguuuauacaccuauaccucucuccucaacuagccuuugccuugcucaaagauaagggauauauguugucaucuucuuuuucuaccuccugugcucaggaugcugauccacaaaaggcuaacugcuuuagugacagaaggcauuagaccuauaaucaugacuguccaauuuuacauucaauuaacucauaaacuauugaacuauuuuauucuuaccagaacuggacacacgccugauccucugaggagauacggcucgaucagcacugggauuucuauugucacuguuccgccucaaacaggaaacagggggccccacuuuggcuuuuggagcagcuauuugccucaaaccgcaggagucaggcuuggauauauuccuaccugagguggucguuguuuuugaagcagagcccugugaaaauaacaguuaagacuguaaaccaaaacuaaaauucuaagccccccaacugacugaaugggccccuccucuaggccaaggcaauuccaaagaaaccuaaaaaacaaguucaggccaugauggcaaagaggucagacaugccucauuauacucuccucccuuuagaauucaggcacaacugaccagaauuaacauuaaaacagaaaccuuaagucagacaaaacagacucuuuauagcaaaaagacacuaaauuccaaccugacucuaguuuagcaucacaugacagacagcaagcccugaaggaaauugaaguauuuuaccccaaaauauuuuucuuuaacacauuuugaaauggcccugcaaagcugucucuuguaggggcaaauuuacauucuguagagaaucuucuucccuucccagaucuuuggucccaaagaaauuagcugagagucuagcaccuuuuaaaagucuaaauagguaauauuugccaucuauuaccucuaaaggcggccacguaugagauuucaucuacauaauaagaaccuuggucuccacagccccuuaucuuaucuuaaccgagacacuccuuucuauugauuucaggucuuuagauaauaacuucuuuaguuuuuugacacggagucuccucuaucgcccaggcuggaguguaguggcaugaucccagcucagugcaaccucugccucccggguucaagugauucuccugccucagccuccugaguagcugggauuacgggugcacaccaccaucaaucuuuuuacuuuuaguagagauggcuaauuuuuauauuuuuguagcuaaguuuuguauuuuuuuuuuggcauuuuauuuuuaguggagaugggguuucaccauguuuucuuuuuuuuuuuuuuuuuuuugauuuuuuguauuuuuaguagagaugagguuucgccauguuggucaggcuggucucaaacuccacacuucgugaucugccgccucggccucccaaagggcugggauuacaggcgugagccaauaacuuaauucuuucaacgaacugccaagcaguaaaucuuugaauccaccuaugaucuguaagucccuacuucaagaugucucaucuucccagaccaaacuaacguguaucucaaauguauugacugauguccucugucucccuaaaauggaugaaaucaagcuguaacccaaacaccuaggcacauguucugaggaccucuugaggaugugucaucagccaugguccucauauuugggucagaauaagucucuucaaaugauuuagaguuuggcuuuuuucauuaacaaaauuuuaauccagaucauaccuuccccauaccacuuccuugugguauuagcuacgugaaaggaacaauuucuaagugaacguguacaguugucccucgguaucaaaaaugauuaguuccaggacccuggcagauaucaaaauccauggacacucaaaucucuuauaugaaaugguguaggguuugcauauaaccuauguacauccucccauauacuguaaaucaucuccacgaucauuacuuacaacaucuaccuauuacuuguuucagguggauucaacauaguauucagcauguaguaaguucaaguuuugcuuuuugaaacacugcagauuuuuuuucugaauauuuucaguccaaguuuggcucaauccacagauguggagcccauagauacagagggcugacuguauucaauuuucauuuuuacuaugaaacaauuaaaacucuucacagcuuacucuuuaauucaccauauucugccuuuguacccauuagugagaguguacucaagaucaccagugucacaaguuaaauucaagcuaguuuucaauccuuccccugggggcucucucuacacaucgaacguuaauaacuccauucucugguuuccugacaaagcucuuuccugguuuuccuucuaccuguccgguuauuccuuuucuggguccuauucuucuguaccuuuggaagcuagugauauaauuuggaucuguguccccacccaaaucucacaucgaauuguaauccccagugcuggaggagggaccuggugggagguaacuggaucauagaagcagacuucccccuugcuguucuuaugacagugaguucuuacaagaucugguuguuuaaaagggugugucaccugcccccucacucucuuccuccuccuccagucauacaagacauugcagccuugcuuccuguacagccuguggaacugugagucaauuaaaccucuuuucuuuauaaauuacccagucucagguaguucuuuauauagcaaugugagaacagacugauacagcuagucuucaugaagaccuagccuuggcccuguucucuuuccucaccauguacucuuccuacaugaucuuggcugcuguuucaauugccacguguacacugguacauccaaauccacauguucaaccaguacucucuccugaguuucccauauaccuaacuucuuucuauacaucccaacucagcauccuucaagcaccucuacguauuaguccauuuucacaacgcugauaaagucacaccugagacuggguaauuuauaaagaaaaagcaguuuaaugggcucagaguuccacguggcuagggaggcuucacaaucauggcagaaggugaaagguucaucuuacaaggcagcagacaagagagaauaaaagccaagggaaagcaguuuccccuuauaaaaccaucagaucucaugagacuuacucacuaccacaagaacaguaugggggaaaccacccccaugaugcaauuaucucccaccaggucccucccacaauaugugggaauuacaggagcuacaauucaagaugagauuuggguggggacacagccaaaccauaugacucuacuuaacuuacuaacauauagcccguauagaauacuauucuaaauucuaaguauauguaucaauucacuuaacccucauaauaauccugugaaguugguagguuuauuguaccccauuuuaaagaacaagaacaugaagcauuuucuaaaauuaaucuuacuuuccuaucuaucucaaaacuuaucucuuccuguauucaccacaacauacccaggcacccaacuucaacaaugaaagcuguuucucuuuuccaucugcugucauuucucagcaagauuacugaaacgauguccacaggaucuuucuggucucuccagcuuucaauucaucuuuuaucugccugcuagggcaaucucucucaaacucgaauaggguuagacaccuucugucugucuuccagauaacaucuucuucacaaggcccagcaauccuuuugcauauggaagccccugccauccucuucaccuuauucccuacugcucaggguuccauucucccagcucccaccacaccuaccuagaguccccuaaauuagaaaaucuucucauauuucuucagcuuuguacucuacccagaauaccugcccuucaaauuccagcuagugacaacaugugauguccccuauaagccuuccuugacaacucugcccaccaccacaucuuguucccccuccugcagcacagcagucuacucacacucccaacuuagcaaucaacauacccuugccuguuuacuguauugauagaggcaggaggcagagaaauucuaggcagacgggggcagguccccagcaaaaccccaccuucaaggcaaaaacccugaaacccacagccuaaagugagaacuucuaaaccuguuugcccacucucuccuaauuaguucuuucugaauaaugucuuuuuaccaauugaaaguugccuuuuccaaaacuaccuauggccugccuugccccccacaucccauucauguaaagaccccagacucacuugguaggggagacaagcggcuugacugauguauuaguccauuuuuacgcugcuuauaaagacguacaugagacugggcaacuuacaaaagaaagagguuuaauuggacuuaagaguuccacguggcuggggaagccucacaaucauggcagagggcaaggaggagcaagacaugucuuacauggauggcagcaggcaaagagagcucaugcaagaaaacucucccuuauaauaaccaucagaucuugugagacuuaaucacuauuaugagaacagcauggcaaagaccugcccccccauuauucaauucccucccacuggguccuucccacaacaugugggaacucaauacaagauuuggguggggacacagccaaaucauaucaacuggagacuucagaggacagcugagucuacugucauaucacccugaacacacccaaucucgccugaucuuugaagcuaagcagggucaggccugguuaguacuuggauggcagacagacagcuggacuuuggaggagagauggcuuagcuuuggagaagagccaaguguagauggccagacuuuagggaagauuaucugcccguccugucccgucuucagcuacccucucugcugagagccacuuucauugcuaaauaaaauuaucugccuccaccauccuucagguguccaugugacccaauucuucuuggacaguggacaagagcuugggacccaccaacuuuggguacccaaaaaagguuaucacacugacccuuugcccucgcuacuggagggcagcugccccacacagugaggcaaagggcccacugagcugaugacacaccgguguccauggaugguggagccaagagagcacuguagcaugcccucuggggcuuuagggucacagacaccaccaccugggcaccacuguggggccugcacacagcaugcuccugccggugcucaaaguggcuggcuggauccuguacucacuugcccacacacuccugcccgcaagagguugagcauggcgggcugaauggggcacccccaucgcaaguuuuacaaauggguugagaaaaacuccugcaacaguauuacccacugcacuaggcacucagacagggucucuuuuuucccuacauccuaacaaucaucaccauauguauaauacauaguaugcacccaauaaauguuucuauucuacauagaggaaaugggagucugagccuuacucacagugugaauuccaacaccaaacuacaauuugcaauucucccuuuacauuaauguaaagcaaaaauaaaauucuaagccccccaaccaucugaagggaccacuucucucggccaagggcauuccaagguuaaccugaaaaacuaguucaggauaugaaaggaagggggagucagacauaauuauacucuccgaaggguuggaauucaggcacagcugaccagcauuaacaucaacaaagaccuuaagacugauagaacagacucuuuuaagucugauaagcaacauuuacaaucaacucccccugaagccggcuaccugaagguuucaucuguaugauaaaaccuugguuuccacagcuccuuaucuuaacccagacauuccuuuuuguugauuccaggucuuuaacucuuugaaccaacugccaauuagaaaaucuuuaggcugggggugguggcucaaaccuguaaucccagcacuuugagaagccgaggugggcagaucacaugaggccaggaguucgagaccggccuggccaacaugaggaaagccagucucuacuaaaaauacaaaaaaauuagcuggguguggugguccucaccuguaaucccagcuacucaaaaggcugaggcaagagaaucacuugaacccgggaggcagaggcugcagugagccgagagaucacaccacugcacccccagccugggcaacagagaaucugucucaaaaaaaaaaaaaaaaaaagaaagaaaaagaaagaaaaucuuuaaaucugccugugaccuggaagcugccuccacuuccaguugucucuccuuucuagacagaaccacuguauaccuuacauguacugauugacgucuuaugucucccuaaaauguguaaaagcaagcuguaccucgaucaccuuaggcccaucuucucaggaucuccuaagggcugugucaugggccacuggucacucauguuuggcucagaauaaaucucuucaaauauauuacagaguuugacccuuuuuuugacacaaagaacaacugagcucaauagagacuuaguaaccugccagaggucacuuugcccaguaaaugguggagcuacaauuugaaacuacucuaaaauccgugcuuguaaagcagcauguucccugucaucacucuucuuucuuuaauaaaucucaaguguuaauuuccgauagauacacauaaagcccaaugccgauggcagucgaauucauacauuaggugaauucaacaauaacuuagcaggccaaucacccaugagaacagcuggaggucauguuuuggcacuggagaacaauacagaauuggccaagaaaagcaagugacuguacacaaacuaacaaagaucuucugucucuggcuagguuaaauuaaagcuggcuaaauucaucucccagagaaaaaucuucuuuuaaaaagcaacccaaaaguuaaccucccagagaaaaccuucuuuuaaaaaguaaggcaaacugcucaucaauuuacaaaagugaaucuucagcaaaucacuuguuuugccuuucagagccaacauuccaaaaauuuugaaaccguaugguguauggagcagaaaaggccaggauucaagugagggcucugagugugaaucccaauuuuacuauuuaccagcugugugaguuuuaagugaccucgcugaaguauuaaaaugucgacaacaauugcccuguuguuauugggaagaguaaauaacaauguauggaaagcaccugagcguuacagggcccauuaaauggcauaauauaacuaaggcaccugagcaaagugccugacccagagcaagcacugaauaaauaucaauuccuuuccuuuuagguuaagucuccacucccuuuaucucacacacuaucaugaacacauaaccucuguugugaggagcuacaucuagccccguuucaaauaaaaaucaaguuccuucuuccaaauaagaacuuuucuaaagauucagauacacccugaccaccaaugagcugugagguugcaggcagucuagggauucaguaaacucaaggccuaaggcaggccaaggccaacaaagcaacaguaaaaauuaacauccgaccgggcgcgauggcucacgccuguaaucccagcacuuugggaggccaaugugggcggaucacuugaggucaggaguucgagaccagccuggccaacguggugaaaccccaucucuaauaaaaauacaaaaaauuagccaggcaugugcaccuguagucccagcuacuugggagaaaugcgugaaccugggaggcagagguugcagugagccgagaucgcgccacugcacuccauccugggugagagaggagacuccaucucaaagaaaaagaaaauuaacaucccuccagcauggucucuucgucaauccagggcaguaagagccuuugagugcugcugaagugaccaaccgacauucauguuucaggaaaacacgcagcaaauucauucagcucucuacaguaagugcaaagccaguggccuaugagggucugcccagacacuuuccaguccuccuucccagagacauggaaaugugcaagagguaaacuagcaaaauuagagagcacugugcuucagacaugaucgugaaaaaagaguaggccgggggcaguggcucacgccuguauucccagcacuuugggaggccgaggcagguggaucaugaggucaagagaucaagaccauccuggacaauauggugaaaccucgucucuacuaaaaauacaaaaauuagcuggaugugguggugcacgccuguagucccagcuaccugggaggcugaggcaggagaauugcuugaaccugggaggcggagguugcagugagccgagaucuugccacugcacuccagccuggcgaaagagcaagaacaagacucugccuuaaaaaaaaaaaaaaaaaaaaaaaagaaagcaaaaaagaaaaaagagucccuuaugccaguugauaagcauaugcgaauaugggacaaucuuucaagacuuacaaaguauuucauaucuaauuaugaauccuaacagccagauuccugaggcgaaaagugcuguuucuccaagacauacuaggauccauuucaaccugaugauucuauccuuaccucaguaccacaucgggagccugaaaaacagguuuucaagcugcacaggggcaacauaacccuaagacucaaugcacaaaucaggaaaacuuuuaguuucaaaauuacacaaccaauuuaaauucaagacaaaugucauuaaagaaaaagaaacuuuaugauagaguuuuugguagcuggggacugacacaccaaaaaaagucucccauaaaucaagagaauaaacaucguguuucuauguauaucuguaaaugccaaacuaagaauguugauuagaauuaagaguauguuguaauuuaauuuugcaaaaaaauuaaaauuauaaaugauaucgguuuucuaaguuugacuucaagauaacuuaaaaacuaaaucugaguuuugaaacaacggaugaacucauuaguuuagaaaucacugugguguacccuucuuccaaauagagaagacugguuguuaaagcccaaacaugucuaaacugauguuuuagagaaucuagaauaucuucggucuuuccuaaccuugucuucuaaacggaccugacaauucccucccuugugguccccaugcacccugaagacacaccuaagucagcccuucugcacuugcuauucuaugugcuucauuccucuugccacgagcccuccaagggacaggcugucugugucacaccugccuuucuccgcuggcacuuagcucccuuccuggcccagaggacaggcacccaaggacagccugucuggggcugaaaauacaccuaaguccccacugccaaaaauagggcugaggacacaugcccaacgaccaacaguggccugucaaauguuuuuaaaacccagaaaaccaauuucuacacacuauucucaaaaacacaugcauguuuaaaggaaaaucaccuuuacacugcaugugaauucuuuauucuuuaaacagcacucucuaggucccccccaaauauuuuagacaggcgcuauggaaaacauacugguuuuucacuauacauaaguaaaagauuuuauuuuauauaccaggaauuaauauauuaaggcugcaagaggcuucacacauccacuagguccaauccuuucaucuuugggucucgaaaaauuacuugccaaaaaucauuauuggccggucagaggaaaaaucaagaacacucuugcucauacaagagggcucuacuucccagagcugccuccuccgcaagaguccaggaguuauuuuuauguugacauguuuaccagcacucccaagcccuuucuuaaaugcuguccaauacauuuuaaaguugacaacccaacuuuuucagaaaaauaaaauauaaccugauuguaucaggcacuuaaacuacuaauuauacuaaaauauuaaaguaacuucauuuuucagcacacuauuaaaaggaacggugauacuugauacaaaauacugaaauugaggauuuuuuuuuccauaugcaguuuuguuguauugaaaccuauuaacaccccaguacugacaagacaaugaauuaacaacuaaauguaaaucugcccaccugguucugcaauauuauugacuaauagauaacuaaaugcuaacacaucucaguuuucuccacaguucucugaagcaugcaaaaaauauauauauauuacuuaccaaaaacagagaaccauauucaaaagucucauucauaaucucuuguuucagcucuuguuuuuccauagaugucccauuuucuuuuucacccuucuuuucagggcuaauccuaucaauguugggaacauaggucauuuccaaacauucugcacuuuccauuuuaacagggaguaugccuuugaucuucugaaacaacgcagaaacggacccggucucgcaugcugaguuagaagaacuggcuuugucaacaucuuccugauucgauuucacggcagauguuguucuuggaacccugugugaagcauuuuuagaaugaguuguaacaugcacagccuggcuaguaaugaguuuauuaaacugcugcuuaugugucuuguuaauuagaauuucugcuuuuuugucugcauucaagucagaucucgguguucugcucaagacuguuuguugucuugaauucacugaugagggugaugaggcacuggucugcugaggucugggcgugaccuuugauaaagcagcaucuuugggcugcaacacugcucuagacauaacuuuugcuuugacauucuugaaguuuggucuuggguaacuuauaauuucaguuuuucuaacuuugcagccuauugggguauucguuuugauuguugauuuuccuaaacuggguuuacacagguucacaggugccuccuucgagucugguauguuuuuaagcccucgauuacccuucuccacuuucuuacauuucuccgucgcuucaaucggugaaacagaaaagguuacuuuuguggguucuaggacugguguugacaugcacaucguuuugucugugcuaaugaccauaucauuugcaucccaagucaguccaaaugacgagcccaccuuuuguccuggcgggcuacuuagaaucaauucugagguaugauuuuggguucccaaauccuuuccuuuggagaccauuugugugucuucagucucagugacuuuaugcucuggguucagcacuugagcuucgcucuuaucaaaagcuggcaccauuaaagggcauucaucaucaauaagacaauaggacacugucucucucagauuuuggcccauuuccuugugccuguaugagcucugugaaugugguucgcuauuggauucaucaugggauaaacaaaagaacucuuguaaugcagaaucauuggggacuuccaugccaucagaaacugguguuagugcuugugucuccuuuucuccaacuagucuuuguugugauccaucuguguacucacuggugaccuuuccugaagaacaugcacacugauuuccaauaucugaaacaaaaaccucacuuugcaucaccacaucagaaaaugcuguguaagucaugucuugggcuucugauggugugacuugaggguuuucaaagcuuucucuaucauaaguaguuucucuugcaugcgucuuaucagaaugggaagauguccaaguggaauaggauaaagaagauguacuuccacuucuccuaccaguugguggcaggcuuccagcaguauggaaggacugacucuuuccgauggcaugaugugauauaaaggugcaguuaacuuuauccacugucaugucaaauguuugguuuagcuccaaggcaucacaguagccugcacaguucaaauugucauuaggcuuccacacaaaaggcaaagauggcucaacacucuggcccucaacugcuucuagggaaugacaacuguguugcagauauuugggcuucucaguaccuacaagugcaggacacugacaaauagaaucuuuaugcauaucuaacaccugcuuacuaaugaaaucacuagaagacuuuucaugaccaaauacuucaacacccugaaggcuuaaagaaauauuuucaccaguaacuacagcagggucaguuucauaaucaaccaccaugucaucuggguuggcagaauuccaguucacacugcuggcugaagaguuuuguguagguggugauuucggguuguaugcauguguauuuccaucuuuaucacugguaaagaagguuugcaauucaucuucuauuuuaucaucugaauuaucaucagucauccugaauaguaaccuuaaaccucugccauuuuauuucuucuucaauuccuuuuaaaugagagggugggcaaaauggucugucuucuagguuuuucagcacaguugaaagguuuucagucuaagaugcucugaagauuaaaugauuuguuguucccuggaagaaauaaaauguuuaacucaaguaacuauaagaaaaauuaacaggccaccccuugguuucaaucacuaagugauuaguuucaaucacuuuauguucacauuuagaccccacaacuacugauguggguaacugagauauaaucaggcaaucuaucaccgcuuuucaagauacuuuuuuaauuugagggaauagcaaauggggcaaaauggaagauggggucauugcucguuaacccugucccugacuuuauaacugauaugccucucccccacucccagggacuugucaaagagaggaggagguaaaucuggcaauaguauuuucuucuuguuggcugacagagugacaauucacccaaauuugcuuaugacagucccaaaguaugucuguugucccaggaugauuaguaaacaugucccuuucauucucagaagggccccccuauuauuuccaugcagagugauuauuagacaggccaugaaagcccagcaaaucagcugaagaucaaucaagaacucacguuucuccuuuguuuuuauuccuaucuuaaacauaugcuauuuccaaauugaaggggaaaaaaaaauugucgauucuuaaaggcuccagugguacccuguuggaagucccuugaaaugugaguuaccuuauguuauacacuaaacuguuccccaccccucuccaauucauaugucaagcccaaacccccaccccuuauguaacuauguuggagacagagccuuuaaggaggugauuaagguuaaaagcagucauaagcguggagugcugauccaacagagcuggugcccuuagaagaagggaaagugacaccagaaugcucucccacucuugguucauccccucucucuaccaaauuaggguacacugagaagaguaggagagcucucaccaaaaaccaaacccugaaaagaaccuuaaucuucaacuuuccagccuccaaaacugugagaaaguaaguuuuuguuguuuaagccauccaguguaugauaauuuguuaugguggccgaagaagacuuaaguaccacaugccccagcaauucuacuccuaagaaucuacugaagaaaaugaaaacauaugucaacaugggaacuugcacacaaauguacaugauucuaaauagaagcacuauucauaauagucauaaaguagaaacccacaugcccaucaacugaagagcagaaagcaaaauguacucuuaugcauuugacaaaauauuccucagcaauagaaaggaaugcaauauugacacaugguacaacacggauauaauauuacacuugaaauauuauaucaaaugaaagaagccagucaugaaagucuacauacuauaugacacuauuuacaugaaauguccagaauaagaaaaccuaaaguggcugcuaauugggaugacguuucuuuugcgaguauguucuaaaacuauguacugaugauggcugcacaauguuauauacugaaaacuacugaauuguacacuuaaaaaugaaaccauuaaaacacccacgaaagcauuuaaaucuaaaacuuuuugcaaauaaauuauuauugcuuuuuugagauggagucuugcucugccacccaggcuggagugcagugaugcaaucucggcucacugcaaccuccaccucccgguuucaggcaaucuuccugccucagccuccugaguagcagggacuacagguguacaccuucaugcguggcugauuuuuguauuuuuaguagagacaggguuucaccacacuggccaggcuggucucgaacuccugaccucagguaaucugcccaccucggccucccaaagcacugggauuacaggcaugagccaccacgcccggccacuuuugggaaauaacuuaaauuuuauuaugcuuuuggucaaacugcagugccaaagaaagguccaaauguucaagcuaggacugcaaacaggucauugugaauccuaaaaugagggcugugugauuuauauucugauggaaaguguaaauuuguuaacucuuuuuacuacugcaaacagauacgcacacacuugaacuaauuuucuaauccuaguauucaaugucaauccgaugucacaguacuguuguaaagaaaaaaaaauauccaugagggagggaaaaaaugccauuucguguguuaauucaacuugccgaaugaagaguaggucucauuuuucuaucuugcagcguuuucucugcauucaaacuucaguggccugaauaaaaccagaauaggaacuauguuaaaacugaaacgaucaguuuucuucgcuaacagugcucugugucuuucuggccaagcauccugauaccagccuuuaauggaauaaagaaaggcugcaauguugauuucaacagcaugugcacacauacacauccaaaaagcgauuuugaauccaaaaaugaaggcugcgugauuuauauacugauggaaaguguaaauuugugaacccuuuuuaccauauaacuccuuagugaaaucacugaauaguuuauuggcaagagccuuaauaaaagcuuuuaugaaacauaaauuaacauuuuuaauccuccaguauaaaauacauccaagcuaaauguuuaaaucaagaaauauauuuauucauuuuuaggcuuacaugcaggggauauaauuuccaaaagcacuaaauaugcuacagcuuucugcuucccuaacagcuaauacucaguuaacagacuguggcauaagcaaauauaugcaaagugcacugcaaacacgcacuuagcauagaucgugggaacugucuuuguaaauaauuguuagcuucaauuaauggcauuuuuauuacucaaguuuccucuucugaagugcauaaaagaugauuuuuaaaccucauauaaauugaauuaagggcucauaugucaaaguuauuuuuuauuuauuuauuuugagacggagucuggcacugucgcccgggcuggagugcaguggcgcgaucucggcucacugcaacguccgccucccggguucaagcgauuacccugccucagccucccgaguagcugggauuacaggcgcccgccaccaugcccggcucauuuucuguauuuuuaguagagaugguguuccacuguguuagccagcauggucuugaucuccugaccucgugauccgcccgccucggccucccaaagugcugggauuacaggcaugagccaccaugcccggccccaagguuauuuuuuaaauaaguauguaagaggauaaauaauuuuaucacuaguccuauguuuguuuuuaccaguugucuuuuuuuauuuuucuuuuuuuugagacaaggucucacuuugucacccaagcugcagugcagugaugugauuacagcuuacugcagccucaaccuccuaggcucaagcgaucuucccaccucagccucccgaguagcugugacuacagguaugugccagcaugcccagcuaauuuuuuuaaaaaacuuuuuguagaaaagggguccagcuuuucucauuuauaaauaauacuaaacugaaaucuucacaaucuuugacaucugaucauuugccaaauugcuauauuuaaaaagggggcaggauucuuuauaaugugcauguuacuauauauguauauuuuauauauauauauaaaaguucucuuucuuuuuauauauuuauauauaaaaauacguaauauaaaauauauauauuauauacugaguuuugcuuuuaagacucauauacuguggucagcauugucucugaagcauuuucccaugucauuauacuauaaaaacauuuuuaacgguugugaaacgccacuaaaguuaagguuaaauguuuuagauuuacaagcuagugguuuacaagaguaacagaaaaauaaagaagccaucaaccauuuaacuuucacuuaacauuuuaguacacuuggguuuaugauuuuuuuuuaauucacaaaaagagauuggguguggucgcucaugccuguaaucucagcacuuugggaggcugaggcaggagcaucauuugagcccaggaguucaagacuagccugggcaacauagcaggacccuaccucuacgauuucuuuucuuuuuuuuuuuuuuuuuagcacgguggugcaugccuguagucccagcugcucagaaggcuagggagaaaggaucaccugggcccaguaguucacagcugcaguaagcuaugaucaugccaccacacuucagccugggugacagggacccuaucacuauuaaaagaaaacaaaacaaaauaaaacaaauuucaaauuggugagcaaagagacuaaaaaacccacaaacauguguucauaaauacuuaaggauuguuuuuauauaaaauaaauuuacugacaucucuucuacuuuguagacaagaguaaaaaaauagugguacagggauuuggauaucaaaaagguucugcaguuaagcugaucaguuccagcaagauggaagaucaaccucaccauucaugaaaagaaaacaauggcuuuaagucaccaccaccaccaccaugaagacaaagccaaggacagaaaaggggugaccggccuucgcucaggaguuugucaaaagaguuaaaaguuggccauuuuguuuuacugccuauuuuauuucuccccgacuuuaagaauggguccuaagcuugcaccacuugcucgacauauauauucuuugccuucaucucaccugacucauaagcaaagucuucauauugcuguaguugcuauuuguaaagccuucaaaguugccaucuuagaaauauuuugauuaaacaagaugcagaaaguuaaaaaauaaaaagacagagagugugcuggagggaaaaaaaaaaaaaaaacuugaaacaaaccauccucacccaaagggauaauuucucaaguucucuuuugguaguacuaccuaccagaacaaagguauaacaccagaacaagguauaacaccagaacaaagguauaacacuuguguaacacuccagaacaaagcagaaugaucaaguuuccuuucuaagagaaucauuugggaaaacaaggagaucuuuuucagagaacauuuuggaccagagagaacaaauuccccacuuauuaaagagcugggaauguaacagagcagcuccucuuaaacgguuaccaaaauauauauuucccuaaggauuuauaaggauuaaaaauuaguaaauaugugcugaaagaaauggucaaagaacuacuaguacaagcuuugagguauaauuccaaugccuuuggaaaaaaaacuuucuaaaucuuagcuuaagaaaagugauuguuuauuccccaaagauaaaaaauuccauuauuucuucaugugaagagacacaccuaaagaacugaaucauuauauuaauuacaauuauuaucauauaauagaauucaucaucauuaccauauuaaugcuagaagaaauuuuaaagauccaauucaaacuucauuuuacaaaugagaaaccucugagaaaucaacugcaugacgugaccaaaucaguugucaauagcagauuauacaauagcugugugccuuauuucaccaacugaacuagaaacucaauagaggcuuauauaagaguagaugucuucuauaucucccuauuacccacagugucuagcuuaauaauuuggaccuaauauaguuaaccuuguaacaccauauuauaacuauaaaaucaagaauguuuccaaaaguaaaacauaagaacuggcuucauuacuuuauaaccacacagaauguaauuuuacuacuuauuuauguuaauauauggcacgccaguccuuuaagaugugaauacaaauacaguuauaauuuauagcuuccaaaucauaaagccauuaucagucuucuuaaaaguuuuuaagaacucacaaaucacaauaguaguuuagcucuguaagcuuuaaaacccaaaauauuaccugaucuucaaccucccuugaaucaaaaaagaugacauuggcacaacaucuaagcuaucauuuuaucuuacuaaaaacgaagcaguugaggccuggugcaguggcucaggccuauaauaccaagacuuugggaagccgaggugggcggaucacuugaggccaggaguuugagaccagccuagccaacauggugaaaccccgucucuacuaaaaauacaaaaauugccagguaugguggcaggugccuguaaucccaccuacucaggaggcugaggcaggagaaucacuggaacucaggaggcggaggucgcagugagccgagaucacaccaccacacuccagcccaggugacagagcaagacuuugucucaaaaacaaaacaaaacaaaaacaaaaauuaagcagcugaacaaaaugucaucagcagcauguauuauaaaaaauauauucauaagacuccaccuccuguuaaaaccauucaagguagcuaacaguucuacucuaagccucaacuuccuacuauuuuucauaaugcaagcuuacauucuuaaauuugcucuugcagccuaccuuucaucaaacuuaauagccaccucaagcacuacguuuaacggagcaugucuaccaccuaggaaccgaguagaggaguacuugguggucaauuuccuaaaagcauaacgauuuccuaugaaguugcuuaaaucaacagcaggaaacuagaguugauuuaaugcauuucaaaaugguggacggcuaugaaguaauacaaguuauaccuuaaauaauuuagaaaacaaguauaaauuugaaauuacauccuuuuauucugaaacaguauuucucugacuuuaaugugcccacaaaucaacugggccuuugguuggucaacugacugauucagaaggcaaggauggggccugagauucugcauuucuauccuucucccuggugauaccaauccuuuugguccaugggccaccuuggauuagcaaagaugcggcaaagagcuuugagaaacaccuguccaguugaccagaucaaaaacaacaguggcugucagggcugacugcuuucacauccaaugguaccuuuuuuuuuuuugagacgaagucuugcucuaucccccaggcuggaguguaauggcgcaaucuuggcucacugcaaccucccccucccguguucaaacaauucucugccucagccuccugaguagcugggauuacaggugcccaccaccacgcccagcuaauuuuuuguguuuuuaguagaggcaagguuucaccaucuuggccaggcuggucuugaacuccuguccuugugaucuacacaccucggccuuccaaagugcugggauuacaggcgugagccaccacgccuggccgguaccauuucuuaaaguagauacagacuuucucuacauuuggacucuuaauuuaugcuuuugaaugcugcucucaagacagcucauauuuugcaucuagaaaauaacuggaaaugcagagaauguuguuuccauaccacuucggcuuauuccuuccacguggagggaguuuaauuuguauaacacuccuggcuuuugacucacuccauccaggagaagugaagugacuuaguggauuuuuguaaauuuagugagaauuagcugcacaaacccagaauggcccgaccucuuuuuuucucuugggaaugagcugcccaccagagccaggacgacggugcacugagggagauacucgcuggaggcacuaaggcaacaggauuaacaguacccuacccagccuggagccccaggcaaagggaaacacaaguaacuguggcuggcugguuaucuaacucaucuccucuucuuucuagcacacagauauuauguuucuauguguuuugcagguaaugcuguguguuccagacagcagaaugugaguggacaucauauguaccaccucugggccuggaccauagaacucacacauaauccuucauguucuuaugugaccacacagaugaacaaagcaagccaaguguggaaacguguuaaagaugacggaaccacaagauggaacaagccuggaucccugaaucccuccuuggaggauuagugcccacaaauuguaaacagccacccagaucucagcgagcaagaaauaaauuauaccugaauguuuuaaaggguuuuuugguggggaaagaacagugaugauagauauucuuaaauacuguaacuacuuugaaagaagagaacaacaguuaagaacuaugucauuuuagucaucuuuuguuuugucaaaacaaagauguuacaggccugugcuuguuuaauaugaaaaaacucuaugaucuacaaauccuuggggauacagagaaucaggguagcuggugacaucugaccuauccucuuacucacugauauuguucagaaauccaagcuaagagguucuaaaauagcagggaaaaaugguaauuucuaugcacuugcauuuuuaugaaagaaaacugcaaaaaaaaaaaaaagguaauuucuauguaccugcaauuuuaugaaagaaaacccauuaaacaauaguuuauaauaaugcauccccuacacacugaacaauuucccuguuccuguuucaucuuuauaucuuccccaggucugcuucuuuuaagacgucuucacacguuaaucuaguccaagggcuggcaagccauuucugaaaaaggccaauauaaaauaucuuaggcuuuacaggaugugcggucugugcugcauuuauucaagucugcuguuguagaaucaaagacgccacagacgauauggaaaugaacaagcgcaacugcaucccaguaaaaugauuuacaaaaaagaggcagugggccagacuuggccguggacuguagcuugcugaccccugaacuagucuaugcccuaaucccgugguccccaaccuuuuuggcaccagggacugguuucaugggagacaacuuuucugcggaccaggaggagggggaggauucaagcauauuaugauuacuguacacuuuauuucuauuaguauuacauuguaauacauaaucaaauaauuauauaacucaucauaacguagaaucagugggagcccucaguuuguuuuccuguaaguagacagucccaucuggaagugaugggagacagugacagaucauuaggcauuagauucucauaaguagcucgcaaccuagauaccucgcaugcacaguucacaauaggguucacacucccaggagaaucugaugcugucgcuaacaugacaggagguggagcucaggcacuaaugcaagcgauggggaguggcugugaacacagacgaagcuuugcccccucgccugaagccuaccuccugcugugcagcccuguuccuaacaggccacagcccaggaauuggggaaccuugccgugaugaaucaaaacuagcugucauuggcugggcaugguggcucaugccuguaaucccagcacuuugggaggccgaggcaggcagauaaccugaggucaggaguucaagaccagccuugcaaaacucuuucucuacaaaauauacaaaaauuagccaggcgugguggugugcaccuguaaucucagcuacuagggaggcugaggcagaagaaucacuugaacccagaggcacaaguugcagugagcugagauuaugccacugcacuccagccuaggaaacagagcaagacucugucucaaaaaaaaaaaaaaaagacuagcugucaucuauacuucaccaucauuaaaauacagacaccacacacacacacacacacacacacacacacacacacacaaaugcacacacaauuuuuuugguuuuauuuuuauuucuuggcucuuucagagacaggucaacucaauucaaggacaguauacucucaauuuucucguaaaguccauuacuacaucucuucauaaaaauaaccacucacaaaaucagguaccauagggcuucuaaauuaccuaacaacaaacagaaauagcaccaaaaauugguucuuacuuuucacaaauccucuccacuaauuaucauuuaagauaucauuuacuauaugaaauuauauacuuuacauacuauaaauuauacacuacaaauuaagagaccuuuaugcuagcauuaguuuaccuuuguuuaaauaaaaaagcuuaauugucacuuuagaggcauuuuaagacugguugacacugggugccgauuuagugaauuuuugucaccaaguucaaguuugcuacagcugucaaagaucauaaaacugaaagcauacgguauuagcaaaaacaagucuuaucaguauccaugcaauuuuaaaaagaacagaaacuuggcaacuaauggguaauuaaaugucugcagaccaucacaugugaguacacccaguacacaaguaaucaucauccuuaaugagaaugagaaaauguuuaauucccacucaugccaaaggccacauacaagucuccuuccuccaugagaucuccuccuacuacucaacauggcuaucuuuuuucaaguuuaauaggcaaaccucucucagcacuugacuggaauaacuguugcaccauuugggaguuauuuuucuuuuagacauuugcagaucuuaucugaaggugacuaagagcccagaguuaaguauuugugaggcaaucuaugcgaacucugaacuuaccuaguuggcuuauaugaaauuuguagaacgcauggcaggagccuguguaagaaaguauuguccugguuuucuggugguuuguuguuguuguggggucugagaauguacagccaaccccucuuuuauaacagagaauugauuuugauacauauuuuaaaauaugauagugcagaguuaauggauguuaaaauuuuauuuucuuguuuugguagguagauugaauugagaaucauauaaucaguauaucugagaauuguaugaccaguauauuuuaaaauaugaucuuucuuuuaaucauauuuuaaaguaugauagugcagaguuaauggauguuaaaauuuuauuuucuucuuuuaguagguagacugaauugacaaucauaugaucaguauauuugagaauuauaugaccaguauauaauaagacuggcacaaccauuugccaucuuuuccuguuaucaucacauaguguggguggggagaaugaauggaaaucacuccagaauaaugacaaaugguuuuuaaaacucuaugcugaauacauuccagcugauaaugaccgacuuuucuuuuuucacuuuggugauaucauccucaggguaaaaaaaaaaaaaaaaaaaaaaaaggcauuuauaaaaaacaguuucauaaaucuuuuaguuauaaacaggaaaguuuuauauuaugugucauuucauuucuagacuguugaugaugaugauaaggaauuuggggccaauuuugauauaugaauguauuguuuuuccauguggugauuaaagcuuccauuagcaguuuaaaaaaaaagagugagaggagguaaaaggggcuggguacaguggcucauagcuguaaucccaaaacauuaggaguccaaggcaggaggauugcuugaggccuggaguuugagacuagccugggcaacacagcaaaaccccaucucuuuaaaaaaaaaaaaaaaucaaccaggcaugggggugcacaccuauggucccagcuacucugaaggcugagggcaggaggacugccugagcccaggauuucgagguuacagugagccaugaucacgcuacugcacuccagccugggugauagagcaagacccugucucuuaaaaaaaaaaaaaaaaaacggugugaaagagacugaagugcagcaagaugcuccaaguuuggggguuggggaacaugaagauaaagagccaacgguuuggucagcucaagaguuuggcuucuacucugagagcaaugggagucugccaaaggaguuaugauggagacugaugcuucgaauuggcuaaagguggaagauguccuagugaggagagacuagacgcacgaaacugcuagggcagaugggaacuccuggcaguggcagcacgaggcaaaggagaggacaagccagacacgcuuaaaaggccacugcuguguccucugcccugagcagcagagaggcuggcacacaauaugugcccaauacaggucuguugaauuaaacauuauuuuaaaagacuacuucacuuacauuaauauuuaaagaaggaagccacagcagauaguaucagagagcuguauaaauaauguaucacauucuagagagauacacgaaggauuuacgcuuugaguauaaacuaggagaguuuuauaauguucucucuucucuuucuucaaauaaacuaauaugugagcucaggauauuaauucaggauuuuccagggucuugaaggucuuuuacucaauccaaaauaaauaaaagagagguucaaaacaugaauaagagaucuggguuaaaaugaauaauuuauuaagcauagagacagauacuaguuuaauuauccaaggaaaacuaauuugcuucuuucuaaaacacacacauuuaagacuuuuuaaaagaaaaucauauacaacaaagaaagcuaugagagaaacucuguuuaugccaugguaaaaaaaaaaaauuaaaaugaccucaacaaaaauauaucacccccuuucccuacccacccucaaagccacaugagguuuguauuuaaaauaucuuuaagagccuuuuugcagcaauuagaacauuuuuauacaaacagucaaaaauuaucaagugacuuauaagaagauagaagucuccuaccuccaaaacaaaaaacaaaaacaaaaaaccauuacaagaccaccagcagagaagagagaguccuggugggcagacagcauuccaaaguccucuaaaacugauaucaacacaccagaaaagucaaagaaucucccaaaaaaucauguuuacaccaauaaagauuaaacaauuaaugguauuuuguuuacacuucuggaguuuucgggggauuuuuguuuuuguuuuuuuaauaugguuacaauuuaaaugggcauuggaguggaaaacugacuuacucagucaauagcacaguauagucaguuugucuuagauaacucacacuaugcaauuaaaaagccucugcuuggggguggaggagcaagccccuagcuggugauagcaaagacagcaccccgaaggagaagcucccagcaaagccugcgggaaguauaaagauuccagacaaaaucaauucacugaccugcuaagguucaagaauucugauuccucaaguucauuccaaaaaaugcuuuuauuccuuuuuuuuuuuuuuuuuuggcucaacaacuuccuaaaaccuccaaaccagcauguggaagaccuuacacauucacaaacucuuaaaacugcauuucugaaggcuuagucaguaauuuuuuuuuuuuuuuuuuugagacagagucucgcucugucgcccaggcuggagugcaguggcgcgaucucggcucacugcaagcuccgccucccggguucacgccauucuccugccucagccuccccaguagcugggacuacaggcgcccgccaccacgcccagauaauuuuuuguauuuuuaguagagacgggauuucaccgcguuagccaggauggucucgaucuccugaccucgugauccacccgccucggccucccaaagugcugggauuacaggcgugagccacccgcgcccggcccuuagucaguaaucuuaauaaggaaaaugguuuaacauuuucagggcauccuauauucuuuaaacauaucauaaaagcagcagaaauaacaaaguuguguuucccucaauccucaucucuugcugugaagacgacaugaaagccaaauuaaaaugcucagaucauuuuaaaucauaagcacucaagcaguuucaguuuucuucucucucugacccacugccacacucuuugcuuacacacacacacacacacacacacacacacacacacacacacacacgggggggguugggggggaagcacuacagucagaaucacaaugcaaaagugagaaauaagcaagguucuagacacuucagaugacauauaaaguauauaauacauaauaauuuccugccgcacuccauacaauuguugguguaaccauaaaauaaccacagucauuuguaauaauauacaacauuuuuacauguugcuuaaugagaguuuuuguacuugauauuuuaacccaaagcagagcccugcauuugauuauuauccuuuacaaaaaguacauaaggggauacucacuuuucugcauaaucaucuuagcauuuucaaacguucuagaauuuagccugaaguagggguaaucuaauaaaguaugauaaauaccacaaacaaaauauaagcagguggaaagcaucuaagauuuaaagagcagcuucaaaaaaaaaucccuuuugaaacuugagugguuuuaauuuaaaugccccaaaucaaccauaccaagcuaacuuaccuauauuccucagaauaucaaaaccaacugcuaucaacuuaagcaagagaugucuuauucgaguuaucuguccaaacaaaauuuuuuaaugccuuugguugcaccucagagacugucuuuuucauggagcaaugcagaaacugcaaccagacuacaggaaauacaaacaccagaccguacaaugaagccucucuggggacuaugauuauucaaagacaguucagccuugcagcaguaauagggcugaguguaacgacuuuuuuauucuuccaaacuaaagaauuuuccuuggacucucugccaaugaaacaucacagacuuuucugaggcuuuacaggcagaaaacuuguacgcagauguuucuugguuauacuguacacaucacuugcaauaaaacuguaaacaaacaaaaacaugacaaguucuuuaagcaauuuucagaucaucucugaaaacagaaggcacuuuugccugucagauuaaaucagcauucacuguggcugggugacugcuucuggauuaaagaaacuggaauauuccagugauuuggauaaugaaaaagaaaaaaaguuuuaaagguaagauguuaaguaugcaucuauaauauaauuggaauuuagauguaaggaauaaccuacauuaaucuggcuacaauuguacuucucacucccuugacuaauuaccuauaccaauaaguucuuaggaguguuauauccuuuaaacuuaggaacuucagacugcucaaaaauuaucaaguuaauaauaaauaaaauaaucuguguaaggaaaaguuccugaaagauacauaccuucucauuagcagugguucaccaucucaggucaaugaugaggaaggggaggcagggggcugcacuguaaguuuacuuuauacauuuauauaauuauuuaaauauuuguaauuacuuuuggaauuuugaauaucaaaacaaaauaaauuuaugcuccaauggaaucaaauacaugcuucaugcaaugaaguuuucaaaucaacguuucuuucacagacauugcaauuaaaagaucugcaaaucuuuuauucagaaucuugggccagcguaucugcucucagcaaugugaauaacuagugucaucaaagcuguuacuuuacaaaauagucaguguagucccuaaauaaaugucuuucaaauuccaacaacagauugucugaaucagacaccugaaaugcaugccaagaagucuugcaagcaggcagucuacgcaugaaaacaaacccuaugauagauucucuugaaauuaaauacaacucuuacaacaaagacaauuuuacuauuuuccgauaaacaggguccacucauggaaaagagaucgacuaacauggauaauucaucguccaguguuuacaguggcugaguucauuuaacccaaucuacuaguucuguaugugagaaaacugagaucuagagaaaagaaguuacgauuucuacuagugucuacugcauaacucuaugagucaccauucacaccacauucuauggacagaaacuucacugguccauuuacauuaaagaugauggccaugguggcccagaauugugcaggguaguggccuggaugacuuuuaagaugacacaaugauuuagaagcagaaucaggaucagaauuaucuccuuccucuccuuuaguuuaccaucaucuugccucauaaauguaugaaagaaagcaaaauacaagugcauuuaggauaaaacucuaauuuuuauccuugaaauggcaugaauacugcagacuaauccuaccuucagaacaucguauguauuaaaaggaaugccuauagaaacuagacacacauguacaaaacaaaauaacugaaacauuuaaagauguccuacaccauuauacuauauuaaauacuuugugucccaaagcuacaggugaaaacaagaauaaauauuucacucgcauuauccaaacuugaaucccuauuguuuucaauaucccuacugacuguaccacagaggauuuaaagagauucauaauuaugacugucauauuauaucugcuaaaacauaauuaucugguccugcuucccaguagaagaggccaguguacucucuacugaugucauaccaaggaagcacuuauggcuacaaucacugaugucaauuaacauaagaaaccaguacauucaguacucuaguagguuguugcaaagcagauuaaguuuuccuacaaagagaaacuaggcccaaaaccagacaaaguauguucaacuucuucuuauaacccacuaucauucaauguuagagaaaaucuaggcacuaaguaaaagcauuucagaucaucacuuuguaaacagccagaguaguucuucuaauuucugaaacaaucaccuguaauucagcaccaaaaaaacacacaaaggaauaaaagguaaggaaaaaccauaugaacauaaggugcccuugaaaaguacuggcauggaaaagacuugaagauuauauaacaagacuaauccauauuagagaaucaaaaggagauuaaacucccaaagauacguucagaagaaaaacuacuaugaacuaaauuauccuuccuuuccauauuguucaugcaauauacacacaugcacaacuuucccccacuuucaccuaguugggaugagauguuaauuuaggcugaaggacuauuauuucucuuuacuccuguuaugccagagaggauccaagaggaaaaaagauauacaguaaaauaaaaagauuaggaaucagagccccaaggaaaauaaaagacuguauuaaacaucacugcaaaucaaugucucugaaccgaauuuuuuaaauauuuugcaacgucucagaucaccauacguagugcaggagcaggggaagagucuucaagagucaugcuagccacacugucauuagagguggccuagagaugcucugggguuaccugaaacaagccaaaaagcccagugucuauaucaauggcuuuccuacauaaaggcaaaucuaggguaagauaccucacuuugauguauauguuacuauguuuucuguugcuacaccauagacuggguaacuuauaagccaucaaaguucauuuagcucaggguucugcaggcuuagaguccaagaacacaaaacuggugucugguaaggaccaucuugcugugucauaacauggagaagggcaucacauagugagacaguaagagccugccagcucaggucucucuucuuaggaagccaccagucccaucaugggguccacaccugaugaaauuaucuaaaucuaauuaccucccaaagacuccaccuccaaacauauaaaauuugggagucacauucaaaucauagcaauggagcaccaaaaucccacagggucuuuccaggaagaacucuugacaugucccucaucacuccugucuaugucaaccagcuuggacacagaucuacacaugcauggaucaaugacuagcauuucugagguggaagccagggcccacagcacacuauauaaaaauaagacuaggaggcacaccuaaccauuccaacguccauguucuuccccacugugcagcccucacaucuacauucucuccuuuagcucccucaccucauuauaugaccuuaacaauccugcugguaaaggcaguccccaacccacaagcauauaaucuuccaaaguuugccuggagauuuauuuaacuuaaagcucguuuuccuagauaaacgcuacuaacagcauuucucucuuaauagcauucuguuaagaagcucccaggcuggccuccaaucugaaacccauuuaaaccacaaugcagcuacuacuaguuugggaaaacacuagcccuucacaucugcauaaacgccaaacagcugaacaccaguuaggacuuuguuuccaugugucuaaaagaaacaaagguguugcuuuuccuacuugauucuggcuaguaccaccucagucucaaaucagaagaggauaaggacuggggaagaaaaugaaaguaaguuuaccccuuucuaaaaugugaagaaaaggaagcggaggugaugccaccaggcauuggggugaaucucaugagaagaugcucaacaucauuagucuuuagcgagaugcaaaucaaaaccacaaucagauaccacuucauacucguuaggacaccuaugaucaaaaugcuggugaggauauggagaaauuggaacccccuugcguugcugguggaaaugucaaguggugcagcagcuauggaaaacaauucugugguuccuccaagagauaaacauagaauugccauaugaucaagcauuccacucuuauacccccaaaagcagaaaauagagacuccaagaaaucuguacauccauguucacagcagcaguauuuacaauaaccaaaaaguggacaccaucaaaggugucaguggccaccacugacagaugaguggauaaacaaaaugugaucuauacauacaguggaauauuauucagccauaaaaaagaaugaaauucuguuacaugcugcaacauggcugaacccugaaaauauuauaaguaaaaaaaaaaaaaaaaaaaaaaccagaaaaggacaaauauuggaugauuccacuuacauaaagcaccuggaguagucaaaugaauagagacagaaagucaauucgagguuaccaggggcuggggcaggggaacauggggagcuauuguuaaauggguacaguuucugugugggaugaugaacaaguucugaaaauacuggugauaguuacacaacuuugugaauguacuuuaugccacugaaccguacacucaaaaaugguugaaaacguaaauuucauguuauauauauuuuaccauaauuuuuuuuuuaaagcaacaccacaaauuagaagagucagagcuaauggcuucaccuuuggauaccucaaccuucccaaucuacagaauaggagaaaaauaccguaccaccuccgggauccugaaacuucaggcugcaucaugaguaucugagaccucaaaugcuaaauccucaaauguaaagggucuacacgacagcaugcaucacgcccuacacaccugccagguggaagcuuuucuaagcuagauggucgcacagaaagcagccauguguacauaugaacaaguuuccuaaguuugcaaguucuuuguuaaaaucuucaaugaaauucucacucuauuaacuuaacuaucauaaaagagacauuauaucauagaagaguaaaauuaucauaguaaccacagcaaguaugcugacaaagauguuuucgauguagcuguuuagaauaaauuacuaggacaaacaucuggacccauggccaccaggcacugggcaaacagagcucagguacagucuccuggugaggcagccuggccaaccuggguuaccccagugggggccuaaaaauaaaagugacaagacacacagcccgauacugagucgcaugacuacgcaggcauuucagagugaagucaaggugcuuagguuccuacugggccgccaagccauucagcaucagcgccggucccaucugcaggcaaagaaugacacaacuaccucuucauggaauauucccagucaaagcccacuuaauaacgagguccuucugcaggguuaaacaaaccucaguuagaaugcagcauggugcugaguggucuuucaaacuugcuuguauuuacagucagccaacugcagauugaacauagucgggagaaaaaaaaacaacaauacaaaauacacuauaacauaacuaguauaaauguauuuacauagcacuuacauuagguauuaaaaguaaccuagagaugguuuacagucuauggaaggauguguuuuuauaugcaaagacuacaauauuuuauauaacgaacuuaggcauucucagauuuugguauugacggugggggcgggggugauccugguaacaaucccugcagagaccuacagacaauacacagaagucucacauacgaggcccagugcagucaggccuguaaucccagcauuuugggaugccaaggugggcggaucaccugagcucaggaguucaccagccuggccaacguggugaaaccccgucucuaccaaaaauacaaaaaugagcugggcauuguggcacaugucuguagucccagcuacuugggaggcugaggcagcagaaucacuugaacucgggagguggagguuguagugaggugagacugcaccacggcacuccagccugggugacugagugagacucugucucaaaaaaaaaaaaaaaaaaaaaaaaaaaaaucucagauacaaggcuuacauaaagaaagcauucaauaaauguugacuguaaauuagauuuuccuugcuauuaaacauuacucauaggugacgaugagugauauuuaaucacuauuaacaacuguuuuccuaucuaaauacaaauuuaaggaaauauaugcguaauacucccugggcucucuccucuuuuaagaccuaauuguaauugcgcuuucggagagcaauuucaacagcuguaagacuugauuucaugauaucuuacuuaaaauggaaaaccugggugugggcuuaguccacaacaacccccuuucucugaacacagccccuccuacucacugagguggguuccacuaaaugaacuagugaauuagcccucgugcagacacuuaagucuaacaguaugcaauuuucccacccccagcauuuggauuugaaacagguggcuauggccgggcacuguggcucaugcuuguaaccccagcacuuugggaggucaaggugguuggaucaccugaggucaugaguucgagaccagccuggccaacguggcaaaacuccaucucuacuaaaaguacaaaaaaaauuagccagacaugguggcgcacaccgguaaucccagcuacuuggaggcugaggcaagagaaucgcuugaacccaggaggcagaggcugcagugaguugagaucacaccacuguacuccagcuugggugacagagggagacacugucucaaaaaaagaaaaagaaaaaaaaaaaaaaagaugucaggcacagugugucccuggaacuaaauaacauaaauccaggcgcugugcaucagccaccuucuccacacacccaaaagcagagaaagcaaaucucuacagagacguggaugggaccaacauaccaaggggagcagaaaugaaaaacagugaagguuagauugccucacugacuugguuccugagaaccugccagacacuaaguucuuagaaggacuccauauccuuaucacacccauccaguuuuugucccuauuugcuugaauuuuuaugacuuuccauuaagagucucaagaaaacuaucgucagaaauuuauuauaggaaauauuucagcagauuuucaguauauuuuccacaucugugaagacuuagaaaugaugaaaauguugacaagaaggaauuagaaaaccacaguacagugauucaauaaaaugcaacuauuuauaaauuaugcaguuuacaaaacuaggaaaaauauuuuuguguuuuaugauuccugcuauguaaaauauguagaaaaagcaacacaggaaaacaaaaacagauguggguggggguauggagcugugggucacugaugccauuuuauuaucuugccuguguuauuaaacuaggaagaaaaaucuaauugccaaaaacuugaaauaacccaaauguccaucacggguagauuauuuuuuuuuaauugugguacauucaucugaugaaauaccacuccacaacagaaagguaaaccauugauacacaaaccacacagauguaucucaaacacauacgcuaagcaaaagacgucacacacaaaagucuccauacucuauaacuccauuuauauaauauucuggaaaggcaaaucuaagggaacaggauugguguuugucuaagaaugggcaaagacugaaaggggcacaaggaaacuuugaaauaaugaaaaucuauuuugcugagugugguuggugguugcacagcuacagguguuugucaaaauucauuguacuauacacccgaaaagugcaaauucugcuauauguaaauuauaccucaauaaaccagacuuaaagaggagggcaggugugguggcucacgccuguaaucccagcacuuuggagggaggaggcaggcggaucccuugagcccaggaguucuagagcugcacggugaaacccugucucuaccaaaaaauccaaaaauuagccaggugugguggugggugccuguagucccagcuacuugggaggcugaagugggaggaucguuugggcccuggagggggagguugcagugagcugagauagcaccacugcauuccagccuggguggccgaguaagacucuaucuccaaaaauauauaaaaauaaaaauaaagaagacacugagcucagacaccaaaccaaagcuacugaggcaccuguaaggugucuguuuuauaauauuggaugacauucaucauucaucaaauguacugagugcccaucuaaugccaaaugcucugcuaugagcuaguacagagugaacaaaauagacaaaaaaauagacacaacuauacaaacaaacuacaggucacauaggaaagcauggaugcucugauugcuauuacgggauuaggggucaaggaaggccucucugaacaagucacacaagcuuagaccccaggaauaaguaguagguaaggaggcagagacuggaaagguuucuaaaugugucauuacagcaguaguuaacagcaacucaacuguuucaacaugugacgggugguuacaguuuacuauuuugcugugauaaggauuauggccuccuacauaagaagcccuaguaaaugaagguuuuaaaacagccuaaagacagugaccaggagacguaaugauguguuuuggauuucagggaccaucaaggaguacguuccuccaauccuugucaauauuucaaaaaugaucaacacauguauguauuucccugaaaugagguugccuauggguaaacuaaaacccauguucugguguuuaaaagauuuguuguauuuguucuuacuucuggcugaauuugccauuauuuauuuaacaagguuuccugaagcuuaucaacguuucuaaaugauaaugacacucacucacucucucucucaccaaaaauuggaaaaaauggucccaguuugacaaaucgaaaccucuucacaauacgggaaucaaccuuaaagaaggcccccuucacuuggcuucagaggcccuacucuaucuugguuuuccuccuaaacucacagacuucucuuuggcaaaugccucuaagagauucuucuuugaucaacauccaaguguuggagggggggcgggggcagccccuuauuccuucucuuccuucacucacucuuguuucaaauacacuccgauaacaauucccacauacucaucucuagcacugaucuuuccccaaagcuccagguuugaauucucaacugucaaugugacaucuccacuuacauguuuaacaggaaucucugacauggguuggauguguguccccuccaaaucucauguugaaaugugauccccagugguugagguggggccuggugggagaugacuggguuauggggguggaucccucaugaauggcuuggggcuguccacaagagggagucaguucuugcaacaucugguuguugaaacuguguggcagcggacucugggcacacuuccuauggcuuugcccugcuccacaagggacagccaaaaaaaaaagugugguaccucccccguccccuugcucuugcucucaccaugugacaugacagauuccugcugccuucugccaugauuggaagcugccugcggccucaucagaagcacaugccagcaacaugcuuccugcacaaccaugagccaauuaaaccucuuuucuuuauacauuacccagccucggguauuucaaucuagcaaugcaagaacagucugauacaaucucaagcuucaagucuaaaagggaacucugggcuuccagaccccugcccauuuccuucuuguccuaguguuccugguuuucaacaaaagacaccaugaauauaccucaagccaaaaaccuaggagucagcaauaaucugccucuuucccucucuccccaguagcaacuccgacaggcacugccuucaaaauacauuucaaaagcaagcauuccucaccuucacuauuaucccagguccaagccaccacugucucucucugggacuacuaacuggucaaaucaugagccucugccuccuuacaauauauucucaaaacagcaaccagagucauccuucugaauuguacucaguuccugccauuccucaguccaagccuucuaauggccuccuaucacaucuaauacaaaaaagggacccagugaccuaagacaauaauuagcaacagacuaaccuuuaugcaaaaggugacgugaggcaucaucgaagguaagggagugcucacugccaugacaaaucagaugacacagcuuacacuucauagucaauccugaggggcuguggaagaaucuaggaaacucaaugacauuucaccccuaaaucaacaggugugcaaacagaauuauccucuuaucuaaucagaucuccauaaguacccugaaggcuucaaggaauaagagugugccuguuuuugaccacggauuauuuacuugcacaacuucucaagugaucuguuuccaccuaaaauggaacaaaggagucucuaaaagaaauacuacguuucaaauaucucauagccaaucagcaaacaacuaccauucugaaaagauuuugucugaauuuccaaucaaaguuucuuccagcccauaugacuucaacauacaauuuguaccacauuguaaccaaagaguuauuaguaagaauguuaaauaauccuccccuaaauuucaacuuaaaauguguagucuuuguuuaaauggccuguugucugcaaguuuugaaacaaggcuucacuuuguguucaaaggcaguauaaggaaacaagacauguuacuguuucgauuccucugaaugacagugauuaauauuaaacacaagaguuucuuacaaauuagaauuauccagaaacauaucccaguaagccuagccucauaaaaugacuaacuucaauauuuacuuucauuucuaaaauuuuuuaaaucaaccacuaagacuuuaaccucccccuacacacgccaagaagaaaugcuggcucuccccugcacuggccacaccugucuuuagacagcaccccuuuccugcucgacggccuccugcccccaucaugugaucaaccucuggcaucaggaaggcagugguggcucugugccaugaggucccucuuuguaggcuguggcuauuuuugggcuggcagccccucugauuccugacuuggcccuagauaaucaugaggccgccuuuagagagaaacccuucagaagccaggcaggucccugugggauuagcaacacuccacugcuaacacagcaagucucagguccuaagugcuauaaaggcccuccaaggacagcgcccucuaaccugauggcccucgguuggccagacccaaggcugggcucccauuucaaaugggcaaguccgugguuuuauggggcuaacaaaucaaagcugacacagauauacuacucauacauggauuuuagccaggaaauuucaaacaacucaaugaugggauuuuuuuccccccuuaaaugucauguccauucauaacagugagauuucagauguguguaacagcuuugggaaaagguauugauaaaaauauucaaagaaaauguuagucacuuuucaaaaaaagcacagcauaccaagaugauguaguaaguuaaauauucccuugugcuauuuauagacauaaccauauacuguaucauuucuaauuggaaaaggucuaccagagauacuauacaccugauccuaaaacuauacauuaucuucugcuacgccucuaggaaacaagacuauaauaacuugaauuuuaagaacuacaaauucaagauaaauauuugauugguuuuuccaucucacuauuaaaaugaagcauaagacccucaaauuagguuuaaauguuuuaacagugaaguuuuaugggagaguacauccaaaaauacagagaaaauacauuuauguauuucauaucacaccuuuccuccaaggccaucaugacaucaaaacugaucccuuuucuuuaucccuaacuuggauuuuguaaagaauuguaacaucuuuucugaaaccacaagucuacaguguaaaaaauguuucauucccagguuucuacuggcaacauuaaaugaagaccuuaugaaaccuggccgggcaugguagcucacaccuauaaucccagcacuuugggagacagagguggguggaucaccugaagucaggaguucgggaccagccuggccaacauggugaaaccccaccuuuacuaaaaauacaaaaauuagccgggugugguagugggcgccuguaaucccagcuacucaggaggcugaggcaggagaaucgcuuaaaccugggaggcggaguuugcagugagccaagaucgugccauugcacuccaaccugggcgaagagagugaaauucugucucaaaacaaacaaacaaacacacacacgcccuuaagaacgcaaugaggauaacauguuggcccuuguauuugagaaggcaaccuggcuugacucugagcuacagcuccaagaaauaaagacgauuugcucacugguccuagcucugacaauaagcaccugcccagugaagucucuggcugugaaggugagugagguguucucuccauuccauccauucuggaguuggaauuuuccaaacacugcuaaaggugggggugugccaggaaaacaaaggaacacaacauggaccagccaaguucccucucuugcccucauaagcagaacaaagucucagcacuccaggacuggccgcuauuugccuuucuuagaugggaguguaggaagagggagcauaccaggccuuagaaucuguccucacuagacauggaggaggagaugauguaauuuuuuuuuuaaauaaaaagauaugcaaugcgcaugcuguugugcuaugagaagaauguggaaauucacaaguugggcauuguuuagcuuuguaucccuguggcuacuguguucaacucagccugaggcuccaugaagacgguccuugagucugacuuccaagggccugacagccuauuggugacagccuuuacaaucacugguaucugaagcucaagcaagacagacaccaacuaaguacccccagcaguaauuucucaaaaaacaauucaguaacaugcagacuccauccuuaacggcaaucugaggcucugcuguggucaacaaauaccacugacaguggcccggaccaccacuccaauucccaaagaccuaugggccccgaugacaugaaggucacucagagcuuaaaggcagagaugaaugcaaugaagauuuccacugaaagauggcagagaaauguucuacccacacucacccaauugagauuuguggaauucaacagcccccaaacguuuuaaaagcaaauaauucaguauccauucaugccuuucuccaaaugauuucaacucuucauaaaguaaucauaaguuaaauaaaauaacaucucuccuuuugauacuaacuuccuauagcuuagccguuauaggcaaaauggcagugugguuuaacugaauccacauuuacaguugagaauacuccuacucccugcuguuacaucaguguaagauguuuuaguuggcaaucuaaacccugcuaauuuucuuacaacuguuuuuuuuuuuuuuuuugagauggaauuucacucuuguugcccaggcuagagugcaaugucgccaucucggcucacugcaaccuccaccucccacauugaagugauucuccagccucagccucucagguagcugggauuacaggugcgcaccaccaugcccggcuaauucuguauuuuuaguggagaugaaguaucaccauauuggccaggcugguuuugaacuccuaaucucaggugaucugccugccucggccucccaaaguauugggauuacaggcaugagccaccauauuaagagacuuucaagaaugaaaugaucccuguguaauuuuuacgauugaguuccaacuggcuacaaagagaggaauguauacaauagcaugcagaacagucuccgagaaguuccguggcuacagaaugggggcauuucucacaccacucugucagcuuccuuaucccuguuacagagugaccuuuuuauaacaagaagaacuuuuuuuuuuuuugacacagaggcuugcucuaucacccaggcuggaguacaguggugcaaucuuggcucacugcaaccuccgccucccggcuucaagugauucucgggccucagcugccugaguagcugggauuauaagugugcaccaccauguccggcuaauuuuuguauuuuuuguagaaacgggguuucaccauguuggccaggcuggucuugaacuccuggccucaagugauccaccugccucggccucccaaagugcugggauuacaggugugauccacugcgccccaccuauaacaagaacuuuuauucaugcaacaaacauuccuagguccucuaucacaugcagcuucuuugcuaggugauggggacacaaugcugaacaagauggucccagccuucaaagagccuccaaagagccuccaguucagccaggaagacaaaaauguacaaguaaauaauuacaaaaacugcaaagguagaagcgacuggaggcuaaagggacccagagaauaggcuccacuguuacagauauggagaaaacagugaaaugucacuuccagaagaagauaaagcuugagcugagacuaaggcauaggcaggugagugcuucucagccuuucagauuuuauggaccugugacauccacacuccaaaacucugcagagacagcauggggaugucagcuuuaauuuugccaagaggggcacuucagacaaaauuuguacgacugccaacacaucauaaaaggacauuauuuuaauacaaaaagugaaagggguacaaaacugcagcauaaagaacauuccuuuaguuuacguaauauacauuuagccuuaugaaaaucuugguacacuguauuuuuauuccaucucaccguguucaagucaacauucugucaccagguaccccagggucacagaugcacauuuggaaccucugaucuagaugacaaaggcagaucuggagggcaguuucucaccucugcaaagaucaaagcaacagaccaggagagaaagaaauacaccaagggaaguacugagagggccgauggaucagcaaaggccuaaggccagguaccaugggucaugccuguaaucacggcacuuugggaggccaaaacaagagaaucuauugaacccaguucaagaccagcccgggcgacacagugagacucugucccuaaaaaauuuaaaaauuagccagccaugguggcacaugcccauagucccagcuacucaggaggcugacaccagaggaucacuucagcccagaaguuagaggcugccgugagccaagacugugccaaagcacuccagccugggugacagagcgagaccccaucucuggaaaaaacaaacaaaaaaaagcagcuuagaacacgucaaggaaggucaguguauucugacccuucuugcaauggaagccacaucaccaacacacgcacgagccuaggacagaggcacccaaagaccaagcccgaugaguuacuuccguagagaccagagaggucuggaaggcagugccuggcagcagacaguccucacccgcugccaugaugcuaaaaccuccuccaggacccaggcaccaucucagauaaaagcucuucaaggacccaggcaccaucucagaagugggugagccgcugaggaaggaggaaauccauccuucagaggagagaagagccucagauaggaagcgugaacugaccacacuuaaaauccucaaggagauauuuaucugcaagcgacucuuugaaaccaaaaaacacugaguuaucuugagguugccacauuauauguucucuacaagugaggugaaaugaggaugugugaggcaguuggguuauaaagaaauaaaguuccauuuggggucacaaugugaauguguaagugucccaccugcuuccguaguugagagacuggcuggggcuggaagaaauggauccacccgagcgguaugaaggagcuggguuucauaugugauauuaagaguuaaggugcuacguuaacaaccaacauuuaacacugcagggguagcgcuuuaucacaagagacuuucgcucaggccacaguacaucaguucuucggaucccuuaugaacucuuccaccucaaaccagcauauacuguuuuguaucacagcuauacauuucagaaagaaaauaaaaguugaauuuuuaaaaaagacucuuuccuaguacacuugacaagcauuguggagugaggcugaccucauugcugaaaagcgaucggaagcuucaggacaucauaagggcuggugagagaaagcgcuguguaaacacaguguuuggcaaauccaaggacugccaaggaggggccaccgcucccugacacccugucaauuccacugcuccacgccaggccagcacaguuugugaggccaggaugaggaacaggccacagccuccagcauggguaaagauaacgacaucagugcacagcucuucaaaguccacaguguucccacagucauccucccaguagacagucccaugugacagacaggucacaugacagucacauucccccaucccuccuccucugagaugcuaaaccugauguuuccagaaguugaguaccuugcucaaaacacagaguuaauaaauagcagcaauggacauuaaacucuacuccaauguguaaucuugaucuauuuccaccuuccuucucacaauaacgaaaucaccuaaacaccugguaggucugcacagcuauggaccuuauagccaccugauaugagaagcauacguuuaucaaggagcuccuaaacugacucaggaacuggguuaccuguuacaagccaaaaauauucuucgccucauuuuccucauggacaaaaacugauucaacaauccaucucauagggucguuuuagaguuaaauaaaauuuuuggaaacuuucuaauacacaauuguacauugcuacuguuaugccaacaaccuuguaaaacaagccuuauuaucauccucacuuuucugaugaccaaagcucaauaguuuauucauccagucacgaagacuuucuggcugggcacaguggcucacacuguaaucccagcacuucgggaggccgaggcaggcggaucaccugaguaaggaguucaagaccagccuggccaacauggugaaaccccaccugcacuaaaaauacaaaaaauuagcugggcgugguggugggugccuguaaucccagcuacuccggaggcugaaguaggagaauggcuggaacccaggaggcagagguugcagugagccgagaucgugcccuugcacuccagccugggcaacaagagcaaaacuccaucucaaaaaaaaaaagacauucuaaggugauggacacauucuguaucuugauuggugugaucguuacaccaauauguauuugucaaaacucauauaauugcacacuuaagccaggugcacugcauuucaucacacuuaauguuaucucaaaaauuguuucaaagaucaugugguagugaacagcaguguguauucugagacauauucaugaauucuuauuggaaucuacagauuuuuuccgcauucuuuuucuguaaucugcuugccaacuaauccuuccuacccaacagaaacccuuaaauguugacgauagcuacuaguuaccguuucugucucuuuacucagaauuucauguuuuacuguuacauccugaacauauucaucuagaaccuuccacugaaguaggucucuguccacaacccaguaggguacgacagccacagacuaaaccaccaccuugaaaagcaggcuaggaaggaucaugugccagcugccugcaguccuaacucagccgacuucugagaaucucaacuauauuucucaaucuaagucaacauuccuucaacaguuuauugaacaaaaauaaaaagcacaauucuaaauacuccucccagaggaaggaacaaaauaaagcccuugcucucuuagauaucacaucauauuguagaugauuuucaaaauuccaucagaaaguaaccuuugucaugaaaaucaguaaaaaagaacaagaggcaaaacaguaaguuucaggauaguacuggguccaaaguauuuacuuuuauacaaugagcuguuuguauagaaguaaauaauuaaaagcaccaucuacccccagggcuuaucaaaggcacucucaaagacuguacaguuaugcuaaagaaaugauuugauguacagacugugcaugcuuuuaguugucuuuuuuuuuuuuugagacggaguuucacucuuauugcccaggcuggaaugcaauggcacgaucucagcucaccacaaccuccgccucccagguucaagcgauucuccugccucagccugaccaguagcuaggauuacaggaaugagccaccucaccuggcuacuuuuguaauuuuaguagauacaggguuucuccauuuggucaggcuggucuccaacucccaaucucaggugaucugcccgccuuggccucccaaagugcugggauuacaggugucagccacugcccccggccacuuuuaguuuuuaaauuauaugcaguuaguuuuuaaaaacuaccuaaaagguagcucagacuguuugagggacguggggguagaucgcgugggcagggcagaguuuacagcugaaauauaaaaucuuuaccccaaaguguuaaaugaccaugaacauuuccuuguuuagaaacuucagaguuguccucucucuccaaaguccacuuggugaaaaggaaauaauuuuccauuugaaucacgccaacaccaaauggaaaaugucuuuauguguguguaguuacgcaaguuggcaccucaccuuauaccucccaaccuuuauuaaacaucgacuuccugcacccuuuucuugaaaaugauuaccuauguuaggcuuucugcuagcaagaguucuuuaacagaaggugacuguauauacacauuuaacucacagcagcagcccaacgauagccaaccuccaaccagggccuauuuauacaguccuaacccuauauauuccuuagaagacaauuuggaaauagagaacugaugacuuuuagggcuaaaaaucaugacugauauucagcugaaacugugguuuugugagggcauucgucucuucccaguucugacacuggccucaccuccuacuucaguuuccaucugggauuaccuccauuuccuccacuaauuaccugccgcucaguagcuuacaauaaggaaacagaauucaagauuucuacuuuuaaaaaaaguuucaacugggcacgguggcucacaccuguaaucccagcacuuugggagguugaggcagguggaucacaagaucaggaaaucaagaccauccuggcuaacauggugaagccccaccucuaauaaaaauacaaaaaauuagccagacaugauggcacacaccuguagucccagcuacucgggaggcugagguaggagaacugcuugaacccgggaggcagagguugccaugagccgagaugaagccauugcacuccagccugggugacagagcaagauucccuuucaaaaaaaaaaaaaaaguuucaggaaaaaaaauaguaguugcuauccagcauauaagaccacagacugcuaaucuaugaagugagauacaaaaaaucuaauuauucaaaugauuguuucuauacaguucuauuaggacuuauugcaaaaagcagucugaaagcuauaaaguccuauguaaguggaauucaugauuguaaugaucucuaacugucaauuuuucacuugugcuacuaaucugaauggcuuacaacauuuaacauucggcuuuacguucugugauuagaaaaugugaaaauaaaccguaauucucagcuaugucauuugaaauuuuacauaucauaacuacugcaugacuuggccuggcacaguggcuuacuccuauaaucccagcacuucgggaggccaaggcagguggaucacuugaggucaagaguucgagaccagcguggccuacauggugaaacuccaucucuaucaaaaauacaaaaauuagccgggcaugauggcaggcaccuguaaucccagcuacccaggaagcugaggcaggagaaucgcuugaauccgggagguggagguugcagucagccggaucguaccacugcacuccaaccugggugacaaagcaaacuaucggugggggcggggagaaguuuuaucccauuucagcaccaauguauagaaaauccuggcaacagaaacuuauuacuuccacucgcauuaaaacuagucaaauaacagcaucauacugggugugggaaauggaccgguacaaguccagucccaguuccauaacuuacucgccauaagacaaaacauuuauccaaauaguucugguccccagucuccuucaguauaaaagaaagcacucaugaccugcucugcccaaccgcagggcugaugugaucaguucuuaauaucauauuuacaaugugcuugccacaaacauagggaauuaauauuucacuaugcuuaaaagaugaaaauacaaaauugcuuuuauauuuaaauacuguauauuaauaguaacauuuuacaauugaaacucuaaaauacaaauauucuggacuauguuacaggugaaaaaucagaacagggaaccuuaguacuguaauauccacaaguccaagauuaguucaaagugaugacucaauugucuuucgaaugugcugacugauagcaaagaggcaacauaauuuacagacuuuaccaaagauaaaaguaucuacauugauuuuuugaaaacacaguucaaauggaguaucagcagcucacuagacuuaaacuuucaagaaaaacaagaggugacaaagcuggagucugagaauaaacaaucuccaauguuugcuacaaaucaauuccuccuaaggaagagggaaaguuaucagccuccugagccuagaauuuaacucccaaccgacagcaccagcagauccaagcaacaccuccaaggcuaagcagcagaaauuaaaugaaacaccuaucuaugaaucagaagauuuaauuuaaaacuagagacuaaggaagguuauuagcacccauugaucauuuucuauauaccuggcaccugugucagaauaaccccaggagacaagguacuacccccaccuuccagcguccugaugagccaacuggggagcaaagguaaugaaauuucacucaaggucacauggcuaauaggaaaaucucagacaugaacccaauuuugccuguuaagucugugcacucucuaugacauuacugcaccaaauguccuggauacccauuacauuuuuccaauucuauaauaaaguauguccccaggguuucauaauggaugucauggugggcaaaaucuagcuaaauggugaaauaccucuauuuauuauuugaaauucaauaaaaacaggaggaaggagagaagaaaagcagucccuagcacugaaggauggagggcuaaucauucaagaucaaaacaacucacaccauauaaggagaaaauaguuuucauuugauuauauaucuacaagguuauacauuuuuaaauguucagccuaauaagcuguaaccagaacuuuccaacaaaauagucuuaucugcaauauaaaaugguuuagguuuucucauagaaacagaaauguaggauuuuucuuaccucccuuuucauuaacugacccuacucuuuuaaauucaaauuaagaguaaguaaaucccuuugcagaggugccaucaaaaacacuauaaagcaacaucagaaggcugggcaugguggcuuacgccuguaaucccagcacuuuggaaggacaagguggacagaucgccugaggccaggagauugccaccagccuggccaacauggggaaauucugucucuaccaaaaauacaaaaauuauccaggcgcgguggcgcauaccuguagugccagguacucagaaggcuauggcaugagaaucacuuaaaccugggaggcggagguugcagugagccgagaucacaccacuguccuccagccugugacacagcaagacucugucucaaaaaaaaucugaaagcaaaacaauuuuuuaacccuuaaacagaaaauacuucuucacagcauuaaaucaaguucaauaaccagcaagucuagagaacuauugaaaaguuuuacauaaaugcaaaacuacucugaaacacaaaucuuauuagauguaaugagaaaaaagaauccuagacugcaaaguuaucugaauuccuaaguuguacauacauuuuucucuaaacagaaaacagcccaagucccuagucaaaagaaauugucaacuugcgauugucugcacgaauagggaaugucauaaaucaugaguggaaucaauuacguacauguauuugcacauggguaugccagauguucucaaacugacucuucauaauaaaacaguaacucagaagcaucaggaaacuuggcaccuuccagcucugaugcucugcucccaaagccauggccguucagucggacacaagacugaggguaaacuaccuucccucugcuugcugaguaugaaacaauggaugagggggugagggcaagaggagagggcaaggagcaaggcacagaaaagcaauaaggaaauuaauaccugugguuuaaaagaccuuccaguagcugugacuaucugacaaaagaauuucaaauucccaugccaucagagcucuagaugauuuauuccagaccacaucugggagaaauaauuauaaaaguaaaaauguacccagcauccgaacauuuagacccuauccuuaaggagcuuacaagauguagcaaaaauauacuggaaaagguaacuaaagauucucauugagagaaauuaagagacgccaaagaguacagugcuaaguauuuuccuucuuaauccuuuuggugagaaggaaaaggguaagcaugauuaaugacaaggaugcuuuauauaaccaagaaugucaauacaaccuacgugaccaaacuuuggucaagucagcagguggaauuuuuaaugcaaagcccaacguuaacaaccugggagaauauuucgaacaacacaaacacuuacuaacaucuccaaaacugcacuuuucacaaugauugggguuucucugacuccuccaagaaaagaggucaaauucuuuuuuuucucuucuaccucaguguuuggcccauagaaagugcucaaaaauggcugaggcugaggaaaaccaaacacaggccgggcacaguggcucacgucuguagucccagcacuuugggaggccaaggccgguggaucaccugaggucaggaguucgagaccagccugaucaacauggugaaacccugucucuacuaaaaauaaaaaaugaagacgggcgugguggugcaugccuguaaucccagcuacucagaaagcugaggcaggagaaucgcuugaacccaggaggcggacacugcagugagccaagaucacgccacugcacuccagccugggcaacaagagcaaaacucugucucaaaaaaaaagauaaaagaaaaaaaaaucaaacauaauauucuaacagcaaggauuuuuacucaugcuuuuuauuuaucauuuuacaugaaauauaagccuaacuauacacuacguauaaaugacuugguucuguauguggggccuagauuggggaucuaauacaacacgugaauuuuucuugguagcuaggucuuggcauggcucagcccuuuuaaauccauuucucauucuccaauauccuucuacccuauccugacccaccagcaaggaggacuucugcaauccucacuucaauuaaagccuguuggcuuagggucacaguaauaagcaaauaugguucaauucuguaauuugauuaacaacgaaaugauuaacaguauagcaguuuacaguauaauaaaaaauaagauuuuaacagugcaaggugacuuaaucagaauucugggaaauaugacucaaccaccuugacacagaggucaggggaaggggguaggucuauguuucaaugucaucucagaaacugcucauaucuaugcuggcuucuauuuucauuccguaaagcuagccaagggagcuauguuuuacgaggacaugcaguuucaacuucguaucauucauagcuaacaaucaugcaaaaaucuacaaaauaaacauuaaggaaaauaaauuucuuauuugucacugaacacugcugaauaccuccuaugaacugcuuaucugaaauaaggugaagaaauauugauucuuuucauccagauugguauauguguaaauaacaccugaguuaaauauuaccauguuuccaauguacaaaaagcauaaaagauaagcuaacuacccaacagucaagacuuaaugaacacugucacaaacauuauuuacacaagaauguauguuacgccucuucuuccuagucuccugauaaguaugagucuuucccaagauucccuuuucaaugucauuuuaggacacaaaauguccuuaaauguuuuaguuaacaguagaagaucagaauaauuauauuugauuaguccucaaauuuaaauacuaauuuucuuuucuucugcaucaugcuuaagacacaauuuacuuauaagguacacauuuaugcauuuaaaagaauaaggucauuuaaugguuuaaaaaccucuuccaauacaucuuaccugaaagacugauccauuccuagucuguucuucccuuuagaugaguucacacuguguccuagcaauaaagcuucuagguuagaaugaggguaaaauguguguuuuucuuacuuuuauuuauguagcuaauguguauacaagaauauuccuuuuauuccuuuuuagacagagucuuacucugucacccaggcuagagggcagugaugcgaucucggcucacugcaaccuccgccucccggguucaagugauucuccugccucagccucccacguagcggggauauaagcacccaccaccacaccagcuacuuuuguauuuuuaguagagucggguuucaccauguuagccaagcuggucucaaacuccugaccucaggugauccaccugccuuggccucccaaauugcugggauuacaggugugagccacugagccaggcccaagaacauucuuuuuuucuguuuuucuuuuggagacaaagucucacucuguuggccaggcuggagggcaguggagcgaucucagcucacugcaaccuccgccuccuggauucaaggaauucuccugccucagccuccugaguagcugggauuacaggcgcccaccaccacacccagcuaauuuuuuguauuuuuaguagagaugggguuucacuauguuggccaggguagucuagaacuccugaccugaagugauccgcuuggcuuggccucccaaagugcugggauuacaaugagccaccacgcccagccccaagaacauucuuacuuuagauaugggccugcuagcaagauuuaaaugcaguuuaucuuugaauaaauacauuuuuauuacuuuacaauauacagcuugaagucuaaacuuuaaugaacaaaguuauuuuguaaucaagauuuauaugcaaauacguacuucuaaaguaccugaaagcuauuuacuuaagugaagcacuuccaaguucgaccuuguucacacucuaaacuuguugagaaaacccacccuuucuuccuugauuguguaacauuuauauaucagagcaaucacaaguugccaaucugcuucuaggguaugaaaaggaaguuuuaucuuauguauccacauggcaaagagcccccaaaucugucaccuccaaaauggaagucucuuuuaccauuucuaaggccaagugagcaagaaaaagucaugauuaaugucaucauggaaaauugccccauauccaagaguaaauucaaagauuacugagggauuuuucucuaagaaaauaaauaaauaaccaucaucagggcaaucaucuacaaaacuugguuuagaaauaaauuuuuaggccggacuuuuaggccagacacagcggcucacgcuuguaaucccagcauuugggaggcugacguaggcaaucacuugaggucaggaauucgagaccaaguuggccaacauggugaaacccugucuccacuaaaaauacaaaaauuagccaggcaugguggcgcacaccuguaaucccagcuacucaggaggcugaggcaggagaaucacuugaaccugagagguggggguugcagugagcugagaucgcacgcaccacugcacuccaaccugggccacagagugagacuccaucucaaaauaaauuuuuaggcugagggcgguggcucaugccucuaauccuagcacucugggaggcugaagugggaggauuugcuugagcccagcaguucaaauccagccugggcaacauggcaaaaccuugucucuacaaaaaauacaaaaauuagccaggcauggcggcacaugacuguagucccagauacucaggaggcugaggcgggaggauagcuugagccugggacgugaaggcugcaguaagcuaugaucaugcuacuguauuccagccugggugacacagcaauaucccgucucaaaaaauaaaauaaaauaaaauaaaauaaaaaguuagaagaaauuacaagucaaauucaacuccugguuauacuggaccauccaaaaccagguauaaagucucccuggucaaaguaggcuuuucggggccagauuucaagcuagcugaguucauaccaucccaucuaguccuucauuuccugugggugggaucgcucauccuccuucucaggaggccacagucaccacuguauccgcugcuaaguggucaccucccuccggggccugccuucuuccagagaaagucugaggccauuuuuaagugccccuaagcacgcagauccugaacuccaauuucauccuuauggcucaaauaugguccuaucgcuuacucuuacgcucuaagcuuggggaauaaaagggacucaggcucucauggagaacacacuuccuuuagugaggacuuucaggguauauucaagcuuucacaacacagagaaagaacccaacuuugagauaucaggaagacguguucccccgcccccccaaauaaauacuuugcugaguagcaguauuggaaauuaauccaggaaauuuuuuaacuacguaugcaguacauuugucuggacaucaacaaguccguaugaaaccacaauaaugacuauaaaaagaagaaucuggcaaaaugauacuacaaauagauuacugacaauaaauggagugugagccuacuuuguauaaucacagaauaacagaucugaaaaacauucagucuuagggauuuaaaacuuucugcucugauuucaaaggauguuguuccuaauaguauauaccaggcccaguggcuucucaucaacaaaugcaauuaguuuugcaacagucucuaacccaagauauggaaguucuugcaaugaauuugaaaagauucuaauuuagaauuuggggaauuuuuuuuuuuuaagauggaguuuugcccuguugcccaggcuggagugcacuggagugaucucggcucacugcaaccuccaccucccggguucaagcgcuucuccugccucagcgucccaaguagcugagauuacagauccaugccaacacaauugacuaauuuuuuguaucuuuaguagagacgggguuucaccauguugcccaggcuggucucgaaccccugaccuccugauccgcccgccuuggcuucccaaagugcugggauuagaggcgugagccaccgcacccggcuggaaaauuuuuuuuaaaucuucuaccacagucacauauaguucugaagcuacgauuuagaaguguuaaaaauucuguuuugagaaagucaacagauuuaucaacauuaaagaaauuuguguaugucaaaacuacuguaaauauauaaagcaaagauaaaaugggaaaaguaucugcaauaugaauggcaaagauuuacuaucaauccauaaaaggcucuuaugaauuaauggaaaaauacuaauaucccaggagaaaaaucuggcacuacaucaaauuucaaaauggaaaacaacuagauuucuuugguguucaaaucaucuguaaucaaagaaauugaaguuuaaauauagagaaagcacuguucaccuauaaaccugggaagaauuuuuuuuuuuucccuuuaaggaugauucuacauguugacaagaauacgguaacaccaguauucucacagagagcuggugggaacauaauuugguuaaacauuuuuuggaaagcaaauggucaauauguaugaggagaucuuccaaccaucaacuguauuucaagggcacuaaggauauuaacccugcacauaaaguuuuaaaaacguauuuguugcaaaaguauauuuaguaaguggaaauaaaugaaaaccaguuugauacaucuauguaauguaauauuaaguagccacuaagauuucugaagauuucaugacauggaaaauuuuucaugauacauuaaucaggaaaaaaccuccacgcaauaguauauuuagauaaacuauauaacuauaaaaaauuuuucuauauauuaacaaguauuuucuuaaauauuaacugugauuaucuuugcugaaauugcuuaacucacuuuucucaaucuaccuauuuuuauacagcaagcacggauuacuuuugaaaucaaaacaaacaggguuaacagaacagggcuauuaaguaacaggcuuuuuaaaugcuugaguguaauaacugcagguuaguuuccaaaaaauauaagauauuaucuagaaucuuauaauccuauuauacuccaaaauguaaccuugacuuauugacauaauuaaaaggucuuguuccaagcaugauuuucuaccaagcagauuuaccaagaauuauuuucucuucauaaaccugauuuuaaaaagaacaggugaaaaaacguggugcaaguuacauaaauaacuacauauuauuuuaaacuaaauuccacuucuaagguuuuuuagcuuugguuuuaaggauaagcauguaguucuaaucuuuucuuuguauagcuuuccuaauggaauauauugccuaugaaaaaaaaaaaaucuguaacagcacuuucuacacuguaaagcacuguacuaacaggacaucaccauuuuaaguuguguaucauuuccugcccuaaccaucccugaaaaagcaaacugucuacagaauugcaauuccguuuaugcaauuccuuuuaaaguuguccaugcacuguuaucuuguauauacccuccuuaaagaggucacugguucccaggaagcaaugacucucuuuuuuaauccccucccuccugcauugccucccuuccuccugaaauucacugguaacaccccuacucccacccuccagccccagcgcugugauuuagugaugauugacuuucgaucaccugcaccuggcaaaacuugaaagcuuccacgcaccguuuugccuaagacuuugguuucauugaaacaaacaaaacacacuggauuuccuuucuuagaacacugacuacuucaaacaaacaguauuuaacagaguauguguaacuacgcaggcuaaaugaauuaaccucuuccuuccuagucccaaauuacuccaagucaaaaaucaacaaacaacuugguagaaaggaguacgucuucaaaaaagaacaaaaacguuccucagugaacaccuaaguccacuaagcacuauagaguagucaauaaggucaccuuaauuaagaugagauuuuucuagagcgugaaaaagugcaaacaagcugcagaaaguagcgaggcgccacgaggggucuuugggaccugcagcaacccuauuccacccgcuuucucggccccgcuugcuucugcugagaaggggcccugcgagaaggcugggaccgccgggcccgggugggcggcguaaggaguccacagucaagccccucggucacuuucaaggugacagcgacgagauccgcauccgucccuuccgcaggcucugcgcuggcccacgugagacccgccuccgcuccgccggcgcugccgcccccuuu

SEQ ID NO: 191865 - RNA, 107092 nt, Homo sapiens
cuccagucuagcucgcauugcggcucccgcccgggcgaguucucgcccccgcgcggccguugccgaggagacggcgcaugucccgccgcgcguugcccccucugcaguacccccgccccucuucucccaccacaaugagauccuaagauggcgguggcugcggcgguuggcgcugcguagcugaggucgaaaaggcggccacuggggccgaggcagccaggaaacgugugggccucucugcugcggucuccgagggccgaccgcugccggcggcgggucgugggggcugacugucgcucugccuuugacaggagaggcugcuucuuguagagguaaugccugcgcguccccagcccuuggcaaccuagggcggcgcgccccagaggcgggagaguaacggcuccgggacacucggcccuguugggucuggccacgggcccacgccuccucuguagguucccgggucuuccugccccgggcuucccgugcccuaggcggucaguccgcccgcucccucaggacugaucgccgggauccccgggugagcaccucgcgacgcguuggugauugcaggacucccuucuugccuccucgccccuccugcuggcccugucggggaggcuguucugcgucccgguggcuccggcuauaccccuugcgggcggaggaagcggagcggggacucugguuugggugcuaggggcacugggucgaguucuuagagaaacaggccuugguggccauaguucuuccccgcguucccucuguggaacucucgguguccagaguuugggguguagaagggcggaugaggagcgacgcgacucugaagaguugcaguugggcugugagcugcaggauuuccgccgucucuggugcugugggagccgaugggccgggggaggcguuccugggaagguuaauggaguaauuauugccccuucuuucucccuuccuaccuaucuaguuagaauugggccuagaaccgggaaagacuaaaugccaagugggacugggggaaacguuguuugguuuacagaaacuggcguuuggggauuaggccccgccagggaggcugggcgcgccaacuuugcaucccucagccuacuccccaggaacucgccugguuuaauuuuuuuuguuuuguuuuguuuuuuugagcgaguugaggucuguauugugugucuuacgggugacgguucguguuugggcgcuggaaggagcgggcuuucugggcgccccuaccacccccgccccauaaccgcuuuccagacuccgccugcugguguucucugguuaccggaguggguguugcagagccucgggugcaccugcuccuuucuuucccuagcaccuuccuggugaggaccccugaacaccaauauaauacagaguuuuugaauugaagguaaaccugguauuuauguagugacgagguuauuuuauuaugaaguacaguagcuuuuaaaugagcaaacauuuuuaaaaucaucggauauacgagguuguuacauaguuugaguaacaggaagcucgaucaaucagaggaguaaacuuuggcauagacuauuaaaggauaguuagggcuaaccaucuuuguuacacuguuccgaaauagauaucacuuugcuguuugguaagauuucagaaguuuaggggauuuaagcauuuaugcauaucacacuauuuuccaaaagaauugagguaacuuaaauuuaaaauaugaauaaguuauauuuuuccccuucuuuugaucuuucuaaacauacuuuagaccaaaacugaaguauuuuuuauucuguauuucauagcguaaguaauuuacuuaagugauacauauuuuuaauccuaauuaggaaacagcuuugaaguguggagcgggaaaggagcaguuucugagcugcaaaaacuaguuucuaaacagguaauuugacauuauuaucuguauuauccuuuguauuagaguuggagaagacuuuaugguggacacugcugucacaguuacagugcaugacugaggauccucucugcuuaguaaacaaacuuucuggguucaccgcccuguuugcucugcuuuucggcgugcugcuuuggccugccgguauaucuuuguucggaaaggcccugucauuccuaauuauuaauuacuagaaugguuuaugcaguaccguuugaaauuuauuugucuucacagaauuuuuucaaccuguuugaauuuguccuauaacuggauagccucucuuuccaaauccauuuaaucucaaguucucuccuacaacauuccuauuaauuggcuguucaugaacucuacuugucgaacuuguuauaccuugaccgaaauuuaguugucuaaaauuacuuuauuauuauuuuuuguacuucgaucucccuuuccugguauaaaguuacuugaaacauuacuuuuagcgcauaguacauugucacaugcaagugacauaaagguauucucuguccagcagaauaaagucaguguuguagaauguaaguucacuaggagaaguucaauaauuguuugcaaagggcaguuuggaaaaauggcuaaaagauaauuagaaguuuguuaaaagcuuuuuagaaauaauugcucuucagaaaaaaaccucagaaauaaauaaccuaaauuuaauucuacucuuaaaauuuuaagaaaguucauuuugaaaguuuuguagaaauuggcugggcgcaguggcucacgccuguaaucccagcacuuugggaggccgaggugggcggaugacgaggucaggagaucaagaccauccggcuaacauggugaaaccccaucucuacuaaaaauacaaaaaagauuagccaggcgugguggcgggcaccuguagucccagcuacucuggaggcagaggcaggagaauggcgugaaccugggagcaggagguugcagugagccaagauugugccacugcaccccagccuaggcaacagagugugacuccgucucaaaaaaaaagaaacuuuuguagaaaucaauauauauucuugcuuucuacaaaagcagacagauuuuuauuuuauagcucuccuaugaggaccugaaaugagacugucaugagaaaauacgaauagguaguugauguauaucuuaauuauaauucucaguggguuuuuuuuuuuuuaaacuggaagacuaacaaaacagggcaagaaaaauggaacucaagggaaaggucacaugugaauguguguguuagaguuguuaauacuacagugauugcuguauggugggcuuuaguaaaauaaacaauaauuacaaaauuaguuauaagauuuuccuuuuagcacauuggggaagaugauggauaagacgaauaaaaauaaaggguaauugaguuaacuuaaauuggaagaccuggguuuuuucaauaggagauuuggccauuuuuuucugaaggaggaaaguggauuugagacuuggagaaacuaguaaggcugugagauucacaguacagaacuaagaagacaaccagaaauaccuaucaguacuuucauuuuuacggauuugagugcuaggcaacgugcuauguaaugacuacuacagauaaaacagugugcaaaacagacagggugccuuucuucauggaguaaauuuacauuuuaaaaguaucuauguguauguagaguguaguauaucuuaauagugaucacaggcaaugccauuuuaugaucauuuccccacuuuuugacagcuugagaauaguagcagagaaaacagacaguggaguuuagccagaauugagucgacacaguacgcaaguaggugaggaagugaaggaugcuagcuagcaaggcauuuuugcaaugacuuaguuggguuuggguuugaguaaagaaucaagggauugauggauuuagggagagagaaacgaucaaggggcugguaguauucaggaaggcuaagagcaguuucagcaggaaucaagugagagaaguagaaugcaaaaacuuaugaucagaaagaggaacuucagaaguucaggauccugaacaaauuaucaguucaguauuggaauagagaagaugagauggauauuggaauugaggccagaguccuagaaaagucauugcaaguguuuaguucaugcaagcagggaaugaaguagaaagugaaaccaugcgccaguuacugucaggaaaaguacaggcauaucuuggauauuuucagaggugauuaugaguaauuuaaugccauuugagaaaaaaauaauuuuuuucguuacugaucacuuugauuuuuuuuuuuuuuuuuuuggagacagagucuugcucuguuguccaggcuggagugcaguggcauuaucuuggcuuacugcaucccucuccucccgaguucaagcaauugauucuccuuacucagccuaccaaacagcugggauuacaggaacgccccaccacacguggcuaauauuugcguuuuuaguagaggcggaguuucgccauguugaccaggcgaaucaagugauccgccugccucagcuucccaaaguggugggaucacaagugugagccacugcacccagccugauuauuugauuacuuugaauuucuucuuuaccuuauauucuuauuucaaagguaaacuguagucauagguauuuucaugguaauuaauacugugauauucuacuguaauaugucucuauaguuagaauccugcaacgggauguucuuuuuuuuggcgauggagucuugcucuggcacccacuggagugcagcagcgcagucuuggcucacugcaaccucugccucccagguucaagugauucuccugccucagccucccuaguagcugggauuacagacgcgugccaccacguccgacuaauuuuuguauuuuuaauauagaugggguuuuaacauguugaucaggcuagucuucaacuccugaccucgugauccgcccgccucagcuucccuaaguccugggauuacaagcgugagccaccgcgcccagccuaacaggauuuucuuaaaaaaaaaaaaaaaaaaaagucauugaaaguagcuuaaaauugccauaguauauuuucauuuuugugucuuuguaaaaaaaaaaaaaaaaccacuaaggcuguuaaaaauagcuaaaugaaacuugaaaguaacaguuucaacuucguuuaguaaggcauagcaugaguagaagugcguguuuaaaguagaaggauuuuauuuuuauccccguucagcuacccguaguacugucaucaaucacuucuaccaauuguuuuccuacaguuucaacuuucuuaucuuacugucuuucuguuuaacuugcauggcaaaauuucaaccuuggguggauucaguggaguguuuauauugagggauaugagcacugcuggaaaaaaauaucuguaguauguguuauaugagugaauagucucucguuucccugaguccguagugcugcccacggucauucuccauucccuacuuuucuacgcucucucagacacugcugucucacccucacauuuaauguacaguccuuccuacuucacaacacuuaggaacaccuuugguuuccuaccaccacaucugcuaagcagccuccaacccauuccauccuuucuugguuuuuuucaauuaaagagauguucuucuuccucucuaaagcuaaucauuugucuuuugcucuagaccccaauggcccccgcuuucucagagcccacaugcuaguugcuuaucuccuuucucuucugcauuuuuaguaucucccucuuuuuuuuuuuuuuuuuuuuuuuuuuuuaaagugaggcggaguuucucucuuguugcccaggcugagugcaauggcacuaucuccgcucacuguaaccucugccucccggguucaaacgauucuccugccucagccucucuuguagcugggauuacaggcaugugccaccauaccuggcuaauuuuuguauuuuuaguggaaacaggguuucgcaguuuggaacaggcuggucucaaacuccugaccuuagaugacucacccaccucagccucccacagugcugguauuacaggcgugagccaccgcacccgaccaguaucucccuccuuaccaacaaauuguaaacguacucaagauacuucuauuuuaauaaaacuuuccuuaugaccgucugugcuugcuucucaucauaggcugauuccuuaaaaauauuagcuaaugacuuucuuuauuuuuucccucuuccuuccaauaauacauuccaguuauggaauugacccucacuaccccugcugaaauuucucaccaaagucaacaguaaccuuguugcuaaaucuaggaggauacuucucaguacuucucuuaucuggcaagguaacuguuugguuucuuaucacauucuacuugauacacuuuuccccuuuuggcaggcucuccugguuucccuccugucuuucuguaccuuauuaguguauuagcguguccuuuuccucugccucucuauuuaauaccaguguauuuaagaucuggucuucucuuacucuuuaucgucucccugaguccucugucccacuuuuugaguggaugacucuccagcccagauuucucuguugagagauagaucgcuauuugucaaccggacaauuuuauuggguguauuauaggcacaucaaacucuccauuucuaaaacuugaacucaucaucauccucucucaacaaagaaaacuuguuucuuuucugaucaguuuaacugugugucacauacccaguuucuagcaaccuuuauccuuuaucuuuuaacucuacuauccuuuaacucuucugcuucuuuaucgcccguguuguaauacaguagucugcccuauucugugugggauaccuuccagagacccccagugcaugccugaaacuguggguaguaccaaacucuauguguauguuauuuccuguauguauguaacugugauaaaguuuaauuuauagauuaggcucaguaagagauuaacaauaacuaauaagacagaauagucacaacaguauacuguaauaaaaguuacaagaauguggucucugucgcucaaaauaacguacuuuacucaccaguuuccugaccaugguugacuauggggaacuauaauccuguaacacaaaacugcagauaagguggggacuauagucaccaacuccuauugauccugcacagcaguuuugcuugaauugguauucuguacauccuuagucuuuucguuauuggaauacuuccuuuuuuuuuuuuuuuuuuuugagacagagucucgcucuuccgcccaggccggagugcagugguguuaucuggguucacuacaagcuccgccuccuggguucacaccauucugccucagccucccgaguagcugggacuacaggugcccgccaccacgccuggcuaauuuuuuguauuuuuaguagaggugacaggguuucaccguguuagccaggauggucucgaucuccugaccucgugauccgccugccuuggccucccaaaaugcugggauuacaggcgugagccacugcgccugaccguuacuggaauacuuucuguacuuguaaguacuaguuuauauuaauguguuuacagaauaaaauuuagaaggcagagauucuguauuuguaauggugacauuuaggugguuaaagagguugacaugaagagaaauaacaugccauuacucuuaugagggagauacuuaguauuuuugggaaauguugugaauguggccgggugcgguggcucacgccuguaaucccagcacuuugggaggccgaggcgggcggaucacgaggucaggagauggagaccauccuggcuaacauggugaaacccugucucuacuaaagauacaacaaaaauuagccaggcgugguggcgggugccuguagucccagcuauuggggaggcugaggcaggagaaugacgugaaccugggaggcggagcuuguagugagcccagauggcgccacugcacuccagccugggugacagagcaagacucugucuccaaaaaaaaaaaagaauucauccauaugcaauuauuucuuuagcuucauacuaauaguuuuacuuuuuaaaggcauacuaaugcugugccuuuuaaacacauuuggugucaucauuaaguuacaaaguauucuacccccuauggcaaucacaguguaacaguggaugaaauuguucauuuugccaaccugauagauuagacuuuaguaaauuuuguuuuaaaaaauacuaaaaaaaucaucuguuuuucccaaacuaauuagaguguacaguuuuaaaauuguuuuagaaacuuauuuuaguaguguucaaagucguuagccagaaauaggucuuuggaacaagcucugcauuuuagggggaauuuauugugauagggaaauagaaugcguaaaacauucuuucuccagauauauucuuuuuuuuuuuugagauggagucuugcucuugcccaggcuggagugcaguggcgugaucucagcacacugcaaccucugccucccggguucaauugauucuucugcuucagccuccugaguaacuaggacuacaggcgugugccaccauggcuggcuaguuuuuguauuuuuaguagagauaggauuucguuauguuggccaggcugguauugaauuccugaccuugugguaacgccgaccuuggcccagauauauucuuaauacauuuaucuuacuuuacuauuacuucauuauucuauuaauagaaaguauugcuaacauacucuuuuaagauaaaaaugauauguaauaauuuugacuuaaauaucuuaauuuucccuuccaauuuacguuucaaaacaauugcuuuuaguacuuuuaaauauggcaucacuucuguugccuggcuguuuuauucuucaguauuacaaauuaugucaguauauguagaauacaguaguugcaaaauguuuuauuuaaaugagucauuuugguucacuggauauacuucuauggguauuauuuuuuaaaguuuuaaaauauauuucuaguauaaauaauuacguaaacuguuccugaaaauaugagacagaaaaaaagaagaaaaaucaccagugccuacccuguaaccaauaauugcuuuugugaaagcacuuuaauaaaguuucuuagcuuuuguuuaaaaaaauuuauguauaauuuuucauacugcuuuuuuacuuuuuuauauuacuuuuuccaugauacaccgacagguuauauuguccaggcuucauaauuacauauuuugaaggguacuuaguauucuacccagcaaguguaguacaguuugccuaauagcauugauuuugucauuugacauuuaguguuguuuuuuaauuuaucacaauuauagcguaauaaacaacuucauuauaguucuuuccaccauauuuaagguuguuuucuuagauugcauauagagagguagaauuacugcgucaaaaauucaguuuuaguucuugauacaguauugccaaaaugcuuuccagaaauguuauacugguuuauauucucaauguagugucugagaauuccauuuuccuuuuacugucauuaggauuagauaauauguaauuuauaugaaaguuagcaaauuuaauaguuucuuauuuuaauuugcagcuggacuuuauauauucguauuuuuuuuugcaaacuacuuguuuugcuuauauuucuccgguuuuauuuuuuuaaaacaaauucucuguauaacaaagguauuaacuauacuuaguauuucuuugagauuuuuuuuucucccaagcucucauuuacuauucucagcacacuuaggaauuuacuuuuaugugaauaaaaucuguugaacuuuuuauuuuuuauuucuuuguguucuaaauuuaguaaguucucuguuuuuaaaaaccauucaauuuucuugucuuuuuaaaaucuuaauugauguuuaaaauucuguuuuaaucuuugacuauuuugauaguaugauauaaggcagccuuucucaguugggagagaauuaagcuccaauacccuaaggcaucuguuguuuacugugaauuaacuuuuuuucugugugucugggauggaugguacuggauauguaccauccuugggagaauugagaaaguagugacucaaacgauuuuuccccucuucuaugauugaggugaagaauaccacuuaaggaagacuguuaaagcucuaaauguaucuuuuucaaaucuguuagcaaauuguuguaucagugcucacuccuacaucauagaauuguugugaggcuuuaaugacauaauggacgugaaauauuuuagcaugguguuuggcaugugguaagcaaaauaaaaugcguuagcuguuacuaguuuuucuuacuacauuuuucugauuacauguauuugaggguuuuuguuccugagcuaguacugauuuaaccauauagacagcauuguugaaaccauauagacagcuaauuuggauuagcauucuaaccuccugaccucuguugcuauccuugcuuuuauuuuacagaugguaacuuuuuuuuccgauauguuuauucuuccagauaaauuuuagaauuauuuugucaaguucuaaggagaaucccagugggaucuuaacuggaauuacauuaagccaaucuacauuuagaaaaagugguugguuguaauauuuaguaucccaucauggaagauaguuuuucuacuuauucacauuuuuucucccauauuguuuuauagaguuuaauagugcuucuugacauagagccaaauuauuacuccuaguuauuuuauauauuugucacuauuauaaguagcaucguuuaagugguauuggugauauuuugacguucucuagauuuuuaaaaaauaccuacucuuuaagaauaccaccuuuucucuuuucagugguaauauuucuguuucauauuugucugcuugauagaauuucugaaagaaugccaaguaacugauauguagcauucuuauuuuggucuuuauuggagauguccuucaugucuuauuuuaagcauaauguugacugcuuguuuauacuuacuuucaacucuuuagagaauuauuaaaguaauauaugcucauuaaaaaaagagugaaauauaacaggaagggucaauguauuugugauuuuuaagauuuuuaaaauuaauacuucguugaauuuuaucauuuuuauuuugagauaaaauuuaauuugcuauauaauuuguuaaaguaauauguuauucuaauagauauucuagcaucaaaacaucugugggacaaauucuacuuuuucagaguugauaauccuuuugauauuuuuucucuagugaaugggaugaguuagggucuuagaauuaaagcaacuuggauuuuuaucauuauuacuauuuauuuaauuuuuaaucuuuuuuuuuuuugagaugguuuuuugcuagucacccaggcuggagugcaguggugcagucucggcucacugcaaccuuggcuuccucuguugaagccauacuccugccucagccucccgaguagcugggauuacaggcaccugccaccacacccggcuaauuuuguauuuuuaguagagaugggguuuuaccauguuggccaggcuggucuugaacuccugaccucaagugauccgcuuaccucagcuucucaaagugcugggauuacaggcgugagccacugcacccagccuauuaauauuuuuuuauugccauuuuuagcugaaugaccuuggccaaacugucucuuuugaaugucagugcuuuuguguguaguuuaaugacuuuucaugucccuugaauuuuagauaaaauuaucucaaccucuccucuuucagcuagcacccuuucaaccuguacaauuccacagcuaguggaaauccaaagucuucugcaagauuaugcagaaaucuuacuuucugaugaucaucucugccuuugaaccucuacuuccaccauugcugcugcuuuuucucaucucuuugacccagguaggaaauucagucccuuucuugauuuucacauguacaagcaaaaaccccauuuuuauggggaggauuagaguuugguagucuuuaccaagauuuagagaaagcacuaauacaaauuaaacuaggguaguaagcaucacuauucuuaaaaugucuucuagccacugcacuuuuggauguuuuggcccuaguccugcuucucuuucccuaccuucuuaucaucuugcuauuguaccuuccuguuaaaaccaaaauuuucuucuuguuucuugcagagcaguucucccgucuuugacucuuuggcauacaacuaaugccuguguuuucaggguaucaucuucaucccaaguccauugucagaacagagauacuuucuuuccugggagaaguucugggucuagcuguuuaugacacuuuuccuacuuuauuguucuacccuuuggaacuguguugaauuaaguaaguaaucuucaagcaugcagacuggugcucacaagguauauucagggguuuuccuuuccuucucugucauuccaacuaccuagcucauuuuaaucauaauaugccugucacagcuaaaucaauuugucugugaugugguugacagugccucauuuuaguucauaaaaaucagugcuucaaagauuguauugcuaaacuucauggaaugauuugaaaauugaauuuguuuuuauguguuauaaagcucaguucuuaacuuguuucgcagagaguuaauuguuaaauccaguauggccacaggaggaggucccuuugaagauggcaugaaugaucaggauuuaccaaacuggaguaaugagaauguugaugacaggcucaacaauaugguaugauuccuuacucuucaugguguguuguuggcuauuaauguuaaaaugcaguuuucccccugaccaaauuuaacucacugaugcucuuuguauacacuugcuggccaagacauuaagggacccugggccguuuauuauauuaauugaagacacaaaucaaauugaguuuuuaagccccaaagcagauuuacuguuacauaaagauguaaaaguguuuuuuuuauggaaaccauguuuaagacaugcagcuggguuuuaggaagggauuuggagaaggaauugggaaauuaucaagaauuacguuuucaccacccuaacucugcuuuugagugcaucugccuaacacaccuuucucuuuacagaccaguuuucucuccucugguccaugugauauacuguggcugucccauuguucuaaaccuuuuaguuaugggugcaguuauguacugacuaguuaccucuuaguuccaauuugaaauuuuguaguaugauuauccuaauuuggauuagauauguguuucuuuuuucagucuucuguggcgaggguggggugagguguaaguaguguaacagguuggcaggaauauucacucauagauuggguggaaggacaguucauaaagaaggggguuuuguuaaaauaaggaaaauaucccaagugguuuacuauacuaguacuaaaagaauuuuccaguuggauaaagugggaauuuacagaccuuuuuguuaaugaauuagguuaugugaguuuaacuaaguaaauaaaaauguuuucuauuugaaacuauaagcacuuuuuguaauuccauauuagcuguuaccauguacauuuuuaccuauaaaaauaauagcugucuuuauugcuuacuaaaugcuagguacuaauuaguuuuaauccuauuuugaaggugacacuauuuuagagauuaggaaacugagacuauaggaagcaaaauaaauagccuagggucacacaguggaguguuuuuucagaaaacaguaauuagguuuagaaccuagguugauuugauuucagaucucuuuuugauacguacugacuuuauaggagaucgguaaagguaucuguaauuuauuucacuauuuauaauagaaaaucacaauguaaaaaaauccucuuggaaauauucagauugauuuuaggguuggcauuugaggauuuguauuuguuagugaucuugauaagaaaauaaucucuuuucagaaggaugggcuauaaaauuaagguagauguaaugaggggaaaauggguuaauagaaguaaauauuugucucuaggaguauaagucugucaaaaaugucuugucuuuuuuaauuuuaaaacugaccaaaacuuuuuaauuauaccaaucuauuuuccugguuugauacaggccauguuaauuuuugcuuuuacuuuuuuaaaggauuggggugcccaacagaagaaagcaaauagaucaucagaaaagaauaagaaaaaguuugguguagaaagugauaaaagaguaaccaaugauauuucuccggagucgucaccaggaguuggaaggcgaagaacaaagacuccacauacguucccacacaguagauacaugagucagaugucugucccagagcaggcagaauuagagaaacugaaacagcggauaaacuucagugauuuagaucagguuugugaauuauuuuuaaaaaugaagcuauuacugugagaaauacuugaaauggauuaaauaauuugucuuaggaauaaaaaauugagcuguuuauguaauuuuuaaaaaaaguuucugugccuauggaaagaauuuuaaucacuggggaugguccugucuucuuuagaaggaaaugaagucccauuucuaaacuugcuaaagacaugcauuucuggacuuuauacuauguuauaugacuaacucaagugauuuuacuauacaacuaaauuuugcauuuugguaacugaauaaaaugguauuaaguaauggaaaguuccaguuuaguauauauaucauuggcuaagugugggaugugcuggguuaccucaaguuuagaaugaaacuauuuucuguuuauaaucaccaaaauaaaguuuagaucuaaaaacaaguagaaaugauaauaaauucuugagagauauuuuacucuuagaucuauaugucauagagacacacacauuuccaaaaauguagaaagguagauucaagucugauaaugauguugguaaugaucauguaucauuuauuuauaucuauuuaucaauuauugaacacuuaacuguauaucaggcacugagcugaauacuuuuucagacaguucuucauguagacacaacuuuaauuacauugauucauuggguccaaagcguauaaaaauacuauaagcaaguaauaaaaagcaauaugaguuaaagugugauccaugguccuaggacacguugagcaucccuaauacgaaaauccgaaaugcuccaaaauccaaaacuuuuuaagugccaacaugaguggaaaauuuaacaccugaccuugugugauggucugcagugaaaacgcgucaaaacuuuguuucgugcacaaaauuauuaaaaauauuguauaagauuaccuucagauuauguguauaaggugcacaugaaacauaaaugaauuuuauguuuagacuccggucucuuuccuaagauauaucucauguuuaugcauauauuccaaaauuugaaaaaaaaugaaacuccuaacacuucuugucugaaauauuuuggauaagggguacucaagcuguacuucauuuagacuuaccuuguucauauucgucaguugaauugucucagcaaagugaagucuagaaaaugcuaaucaaauuuucauauuguagugaaagacuguuacagagccaaagcucuuucaggucuuagugcaaagcucuuugugugcaccuucugaaucaauaucugauggcgaaacuaagaacauugggguuaaaacaaaauuuugucauaagguuaauguuugugugauuugauuucuuuuucauauauagagaagcauuggaagugauucccaagguagagcaacagcugcuaacaacaaacgucagcuuagugaaaaccgaaagcccuucaacuuuuugccuaugcagauuaauacuaacaagagcaaagaugcaucuacaaaccccccaaacagagaaacgauuggaucagcacaguguaaagaguuguuugcuucugcuuuaaguaaugaccucuugcaaaacugucaggugucugaagaagaugggaggggagaaccugcaauggagagcagccaggugauaacguuuguuucuuuugcucauucuuuacacaaaccucaaaauaccaacaguaagguuuagaaaauuagguuacgcacacaggaauuuuaguuggguggaauuaaagugcuucacugaccuccuuuguuaaucugccagauuuacuuaaaauagaguaaauuucuguuuauccaaaaauauuuuagaaauggcauauucagguuaguuaaaggcuucuguuuauuuacaaaauagcauauugccaguuuuuaguaaagggggauuggaaggaaagugauuaauagauuuuuguaggaauuuuuuaaaauggcaaauauucuuuugaaaaguuguaaaacuauaauacauuuaauuaauuuauaaacauuaggaaaauuuauauaaaaaauuguaugcaguuguagaaguaaaauuuuucagauacuguagauuaaaauuuugaaauguauuuuugaauugacagugauuggaguuuuuaguauuaccaauuaugucuugauuaaaaucuaagcuggauucagauuuuuugcauguguuaauucacacaauaauccaagugucuuugguuaucuucgaaauaaaaauuuguaaaacuguugcuauugaacuaauuauccuuaguuuuauauauuguguacuuucaugcuuuuuuuaaaaaaaauauuuccccugcagauuguaagcaggcuuguucaaauucgcgauuauauuacuaaagcuaguuccaugcgggaagaucuuguagagaaaaaugagagaucugcuaauguugagcgccuuacucaucuaauagaucaccuuaaagaacaagagaagucauauaugaaauuucuuaaaaaaauccuuguaaguauucgacuuuuaaaauaacauauuauuuuuguaguaucucaguguguauuuacugaugacauucugaugccaccccagaggaguuaacauauuuucaaaaaaucaugccauccauuauaacaauuuauugcccauuuuaauaguuguaugauuuauaccgcuaaaauauuucaggcuagagaaaaugaggaggaggauguucggacuauagauucagcugugggaucugguucuguagcugagagcacaucgcuaaacauagaugugcagucugaggcuucagauaccacgguaagcggcuuuuugguaauuaaagugcuggaaaugaagguuuaaauuuuucucccaguuuucaagauguuauuuuuauaggcguuccuuaaugaaaaguguauuccagggaagaaccccucaaauuguuaaugcuguauguguucuucuguauuuaaacacggaaguuaaguuuuauuuauuaacacuaaaaauaguuuuaaugguuaauuugaaaauguaauuuuugaucuucaguuuauagaaacauuguuuuuguaguuuguuuuguuaagcaaagcuucacuaauuuuaagaagcaucgaggaaguuaaaauggaugguggaauuaagggcaauaggcaacauuagugauuacuuagcauguagucuuuuggaaauaaccaaguucauuugucacugaggacacguuaaggauauuagaauuuuucauuuuuugggcucuauccuaguacuggagcaaaaccagaugacugaaaaaucgagagaaagacuaguaaaugggacaggauagcauuuacauugugacuuauucacaaugagaaaaaugcuguaauugcugacuuggcaaaauggaauuuguugaaguacuguuuuucugaagaauaguaauuuacagaacuuugaggaaagauuucuaaaacuuagugugguucaaugcuaggguguuuuuaggcauuuuaaacaggcgugccuauaaccaugcauuauuaagcuuuuaacaccuauuacaggcuaguaaagcuuuuguuuugagaggauaagcauauaucucuucggguuuugagguguucaaaaugccauucagcauuaggaauuugaagguuuguuuccuauuaguauugaccugcauaauucuuaccugccuccuuucucuucccggaccuuccuaauuugaagaggugauuuggauuucuuuucucuacauuauuuucaacaggagauacuuagagagccugauccaaacaguuguugaagaauggauuuuacuguggggaaauucuuuuucuauuuacaguggugcgaggcauaauuucuuccuuagguuccagcagaaauggaaggguuaggacgauguggguaaaggaauucuguuggggaggagugggaacuuguauagauuuauuguaauuuauauaaaguauucauugugauggcaauuucuuucauaauauaaaaugacgguaugaaaguugacuaauaacauguagcagaguaaauguuaaaaaugugcuuuaacaacugugugguaugguaauuccgcaggaugugguacuugcuuaguuacaguaagcaacagucuagucuacagaaaacuuaaaagacuaaauauacugcugcuuggagggggauguggauugauuuuuguuuuuuuuuuuuuuuaaaaaaaagguggacugguacuuuuuaaauuguuuuacaaggcuggcuuauauguuaaacaggaguuuguguuaagaauuuaauaugcuacacuauuuaauaaaggaggaggcaucuuuuauucugagaauucggccgugcauugaggacaaacuagggaauucagcuucacaagaacagguuucagacauugacguuacuacaaguccaaaagggaaaggugacagaccucagaaugacagggaacugaggccuaauaggaaauauagccaaaaacguggauuucccucaaagguauacuuuacaauauuaacuugggaagucucuaaaugagcacuucuucuguucauauuuccucuucuuuauuugcuuuucuguuguugcuauuacucuuacauauuaauuguuaauauaguugucauacuguaauuugcuuuaguaaaauucugucccuuacuguuuuuuuucuacuuuguuauauaccucuccauggauuauagcuuacagcuguuuuuaauuuauauuaacaaagguuuugaaauguaauuuauucccuuuuuuauaaauugcgaguauaauuuauaacacguucuuaaaccuugaccaucagucaguugcccuuuguuucugauauuuguguuuauuaauuuagauggggccaggcgugguaauucuagcacuuuggaagacugaggugggcggaucaccugaggucagggguuugggaccauccuggccaacauggcgaaacccugucucuacuaaaaauacaaaaauuagcugggcacgguggcgcacgccuguaaucccagcuacucaggaggcugaggcaggagaaucgcuucaaccuaggagguguagguugccgugagccacugcacuccagcaugggugacagagugagacugcgucucaaaaaaaaaauaaugaaauaaaaauaaauaaauuuagaugguaguuugucagauuuuuugguuuauauuuuuauuuuuggaaaccccuuucauuugcuuuuuuuagaaaaauuauccaguugacuugguugccucuuuuuuugcugguuuuuucugcaguguuuaauugguuuuuuaauuuuccaugauuugcauaauggcauuccagauagaguuaaagacaacuauuuguaguuccacauaaaaagaguuugaauaggccgggcacgguggcucacgccuguaaucccagcacuuugggaggccgaggcaggcggaucacgaggucaggagaucgagaccagucuggccaacauagugaaacccugucuuuacuaaaaauacacgaaaaauuagccaggugugguaguaugcaccuguaaucucagcuacucaggaggcugaggcaggagaauugcuugaacccuggaggcggagguugcagcgagccgagauccugccacuguacuccagcuugggugacagaacgagacucugucucaaaaaaaaaaaaaaaagaguuugaauaaaaauaccauuuauaaaagugcauguaucuguuggcaggagcaaaguacuauuuuaguaauugaguauagguaagacuaauuucauauguuuuauuacugguuuauuaccuaggacuacacuuucccauuuuguggcuauuuuauggguuuguuguauuuuuuuuuuuuuuuugguguguguggcuauuuacaaaugguaaaacuucaccucuaguauuuuggcaguuuuuuuauuuuuucugguuccuacaagaauuugagagcacaguuugaaauuaguuaugggaaucuuauuauaucaaauaucaaguaaaaugugccccaguucaccaguagagugaauaaaguagcugauuauuuuaaaaacuaguggcauuggagaagagcaaauaaacaugaagcauaauagguaaccauuggaauuuuauucucuuuaauccuucugaauagugacaagcgaaauuuaagaguuaacaguuaaugcaguaucugccaguucuuuuuuucuuaaggcauuacauauaauuuaaaaaccacuuugcuguuuuuagguuucuuugaauaauauccuuauaagugauuauuauucuuuuuugaauucucuucuuggcauuuauuucauuuugacuuucuugauucuuaaggcugucucguuguucuguuaguauucuauuuguaaaaacauuuuaauuucuucaggggaaaaaaucuuaauucucaccaccuguguuuauuuuuuucucuacucugcaggaacugucauucuuaccaccccaccccuguuuccuccuuagaaucuuuucaaaauguaguauucuguuagaauaguggaaaacacaguugagggucuuacaugcgauucaagguugaaagcaaccuugagacuuaacgcaugauaugaaaugauugauauucuagagcugccuaccaagggcacauuccacuuuaugaaauauuuuaagacaugaugacaucuuguauaagaugucagaagaaggcaaaagaaagccuucuacgaguagccaugcguucauuguuuuccuauacucauggcccccaacuuaaucucaccucuuaaaauuuauaagcuuucuuuguaccuuguaccuguguuuugccauuauuuucaucauugcuaguuauuucgugugagauugcccugucuuuuaaaccagcuaugguucuucagacaugaugucuuauacuucuguauuuagaacccagcacauaauuuggagcagauaguaugacguaaagaagacuagagccuaagaaccugauuucccuuaacugugacacuggauaagucacaacuuuaucuucucuaggcuuauaguuccucaaccuucacaugaagaaauugaaguacauaauuaucugaagcugucaaaauacauuaggauccauuaauaauuacuaggagaaccucaguugaguagaggaaaggaagauugaggguucucugaaauuggacuacuacauauuuacaacucaggguuugaugccuaaguuauuuuuuuaaucuguaaacuaaaaauauaguuggugaaagugacuuuuucaaaaaaaguuuaaagaaaaauauguguuugaagaauuaauauacaccuagcauccuuuuuggauuucuauuccaggugccaucuuccugguauguuauuacuccuaccuagauauuuuuauuuucucccuucuguauauuucaucauaggcuguacucccaucuuuuggcucaguuuuuuugagcaucagucugaaauguuguuuauaugaaugugaaaguuauuaaguaguaauauuucacuaauuuugaaaauugagaauucauuuuuagauuagugagaaaucugaagauaauuguguuuaauagcuuagaauucuuuaugauuagguuaucacaguuuugugacuaauaaggauuaaagaacuuuuuagaaaguacgcuuuuuucucauuugcauauuuuuuucuccuaauuauaauuuaugcuuugcuagaggaguauuugaucaaccuagagagauuuuguuuuaccccuuccauugauaucuguaccuauuugauuugguuuuacauuuuaccguugacuuugaugaaaucauuauaaaauuauuuuugcugcauucugagagggcuagcuauugauaauuaucccuacccuucaaaguuguuuuuuuccuaaugauguaaacugucuggaaauaagccagacuaggaugaauuuccacggaaauggauguaaauauuuacaagguaacuccccuuauauaggauaggagagaacugaguaaacaguacuuaauuuguuaaaaguuucaguuuauuagagguucaagacaacagaaaaaccucuaauaaauauuggcuuaccaagauccagguaggcuauuuguuucccaugcucaugaagucuagagauagucuaggauagagaggcacugacuaggcaccucugauguuuacaugaaauaaucuaauuauagccaacuuccuauuugaucauaacuuucuugaauauuuaacucuuugccauguacuuauuuguuuacuuauuaauuuuauggauuuccaagucacaguguaaaauauuaccacaguuacucaugcucauucacaauacugaugaguucuacuuggggagguaaagaaauuuuuauauaguauuguaaaggaugucacccagaagggaguuucucuugagcccaucugcaugcuccauaauuucucugggaaucaaauguacauagcaaguguagaucagugcauuuuuacuuucaaaagaaaucuuugaacuucuuugcucucuuuagucauuuauuugaaauuuacauaacccgacaaaaauuuguuagcaguacaaauuuaaaauugacuaagugaaacaaaagugaaauauuuuauguaaauauuagguaaaaucguucaacuuuuaaaauaaaagacuuuuuaaaagguaaaucggugaugaaaaauacaauuacgguauacguuucgauguauaauuuagcuuguaauauauuguuuccagguuguauuuaaauuugucucugcuuugcuuuuccauuuucuuguuggauuacauuuugaauaguuuuaagauuaacacuuaaaauuucaucauuuuuuguaagugccacuuauuuaauccaucccucuacuuuuagacuagaugauaaccuccuagcauuuucggggaauuuggaaguaguuacuuccauuuuaugucaucagacucagaugaaugagcauaauuuaagaggaaaauaaugaugccuuugaugacgaauauaaaauucguuauuuucuuagaugucugauaauaugaugugauuaaaugaaaaucuuuuuacauaagauuaucaaauaaaaaauguauuuuuaaaauuucaguccuuuguuagaaauaguaggugugccuacuuucuagguuuuguuguuguuuuuaaauauuacuucuagucuuuuuuuuuuccuuuuuucuuuuuucuuugagacggggucucgcucugucacccaggcuggagugcaauggugcagucucagcucacugcaaucucuaccuccugaguucaagcgauucucuugccucagccuccugaguagcugggauaacaggcgcacaccgccacacccggcuaauuuuuguauuuuuaguagagaugggguuucauauguuggucaggcuggucucaaacuccugaccuugugaucugcccaccucggccucccgaagugcuaggauuacaagacuuucaggucauuaacccaguauaaugugcuccuuuucuguaggggccuagauucuucaguguguguguguguguguguguguguguguguguguguguccauguguccgugucccucuuggccuuuuauguuuuguauaucuuuuucuuuuccuuuuguucauuccucuuccugcugagccauugauuauguagcuuuuuacugugaaauuaccucuuaaguggcaggcuauauauauaucucugugucaucauucuguucuuacucuuuuuucuugaugucuacuaaaacuauauuuaggguuguauauuuaauaauuuguuaucaauguguauacuuugccauugauaauugaaaccgcaacauggauuuuaauagucagauacaaguauuguuggucuuauuuuccaggccagagauccucagcaggagccuauggaagagauagaaaauuugaagaaacaacaugauuuauuaaaaagaauguuacaacagcaggagcaacuaagagcucuacagggacggcaggcugcacuucuagcucugcaacauaaagcagagcaagcuauugcagugauggaugauucugguaugucacagucugagaauauucuuuuuguaaggaagacucauacauaauuguauugcaggguggaugcugauuauuacauaaucagaucuugauuguugucuaguuuagaaaccuucauaugaggcuuauacuuuccugugcuuuucucugguuaugcagaaaagguugcagggacaacuggccaucauacuauaccaugcagauagccagaucucucuccuuuucaucagagaguacccuuaagagguaaaagagacaggcuguaguucuguuuuuguaccucagacugauaaggcucaugaugcguuuauuuccuuuuuuucuauuuuauucagcuaggauugucauucuuugcuugccucccaagaaaggguuaaaaccuuaagugaggcagugaguaaauuuauaaagugucuuuaaccuucaagguuaguaguagcuaguagcuguuauuuuaauuagguauccuuuuguauaugcuagcuccuuggaacuauauuuauaguguauacauucuucguaagacucagaaauuuucuuccuccuuuccucauagccaugugugaauuagaugaaaguuguguugaauuucuuaguauugagucuaauuuuguacguuuaucaucaccuucaaacuuauuuuaguuucucguuaaauugcaaaaaaagaugauuaguuauuaaaagucaacaaaacuaaguuauguuuucuaauagucuaucccccacugucugcuuuuaguaauaauuucucuucuuugagcgcuuuguuuuugcgagugaguuagguucucacugaggcuacccuguugugaaucaguuuauucugcuguccaaaccuagcccacuggcucaccugucuaaucccuguuauaccuaauuuaaguuugcauuuucacaaggaacguuaugacuuucaaauaaccucuuuuuuuuuuuuuuuuuuuuuuuuuuuggagacagaguuuugcucuguugcccaggcuggagugcaauggcauguucucggcucacugcaaccucugccucccagguucaagugauucuccugccucagccuccugaguagcugggauuacaggugcgcaccaccaugccuggcuaauuuuuguauuuuuaguagagucgggguuucaccauauuggucaggcuggucuugaacuccugaccuugugaucugcccgccuuggccucccaaagugcugggauuacaggcgucagccaccgugccuggucaauaacuuacucuuuuguaguaaugauauagcuguauagaguacuguauacaguaauaauuacaaagauuuuuguccccauuucuccauuguaaaauuuaaaguaccauuagcuuuuauauuuaggaaacagauaauuuaggaaaagauaauuaaaaugcuuuaacauaaugacuaguacuaguuugguuaaugacuaaccuuuuaaauauuuuucgaguuuggaauaucagauuuaaaagcuuuccuuugguaguuaauauuaaucucuaaacuugcauaaucuccuuugaucaucagagauuucuagguuagucagagcuuuaauucuuauuucuguuuuauagagaaggaacucuacagaguuuguggcuugccuagauuuauauagaauuuuagcagaauuacauuucuugaauuguaggucaggggucuuguuucuuuuucugaauaugaacuuuugaaaguaagcagauaauuucuuuuuaaaaaauacuauuaugagucagagaauaggaguauaaugcacaugaguuugaacuucauacuauuucaaaaagaauuuuagcuuaguaauuuuaaaacaaauuuagucuuguauuuaugagauuuugcaggggcaugcuaaugaaaagccauggaaagcuacaauuacaguauuuaaucuaguauaugagacauuaucuugggauaauuauguuaccucaaagagugucccuuucaccauuuaacuaacaaguuacauauaauuacuguaauuucuuucuucucagcauagaguuuugacuagacauauaggauucuauauagccuugaaauucucaguucucaguggaaaaaagguaguguuuuccuuuaaaacagaagcaauuuauaacuaauugucuuuuuucuuuaucuuuuuuuuuuuuuugagacaggaucuugcucugucacccaggcuggaauacagugggcgugaucuuggcucacugcagccucugccucgcagguucaagugauucucucaccccagccuccugaauagcuaggaauacaggcgugcuguaccacgccgggcuaauuuuuguaguuuuguagagauggggucucacuguggugcccaggcuggucuugaacuccugcgcucaagugaucugcccaccuuggccuuccaaaguguuggaauuacaggugugagacacuguaccuggccaccaaugucuguuuuagaguuggagaguuagaagucagguuaaggauggaguuauuuguuaguagaacagugacuaucaugaaaauuguugucacaaaacugcuuuaugaauaugggggcauuuuuuuuaaauuaagaagauaaaaaccacagucuuuuaguaugacuuguaucacaaacagccacuucaauaaauuauccauuuuacugcaggggucagcaaacuauggucagcugaguuuggcucauugccugaaauaaaguuuuagggaacacagccaugcccuuuuguuuacauugucugugguugcuuuuaccuuguaaaagcagaguuggguggucgagacaaaaacuguauuucccacaaaguuuaacauauuuacuauuucaaccuuuaagcaaaguuugccagccccucuaccggagaauugauucuauucaagaacauggagauugaaaccugucagaaucagcugugcuuuuuuacacuaucacuuucccuuucacuccucacugaucuuagaccugcuccacugagucacuacuauuaauuggaauguaauaguaacccuccuuguauguugggacaggaaaagaugaaccacuuuaccagaguuuugugagcaucccuuuauuuuuaaguuaggugguaacuucuaauaaaaugauuguuggcagauagaucggauuguuaacuaguuucaaguuacguaugugagcuuuuuaaauucuuuuuuuaaauuuauuuuuagcuucucagagauuaaaaaagguguuugauuauuuacauuaaucaguaguuacuaauuucuuuccaguuguugcagaaacugcagguagcuuaucuggcgucaguaucacaucugaacuaaaugaagaauugaaugacuuaauucagcguuuucauaaucagcuucgugauucucagguaaccuagauguuuuaguauaguugaguuuaaaaaaucacauuaauuagaacagugauucagaaacuucagugagcauacauaucaccuggcaugauuguugagcaguguagguuucugauugguggggucccccccaccuucaaaauuacgauucauggauuuggggugggcuucuccacgucucaguccaaugcugguggccuggggacuauacuuuaagaaucacuaaauuagaggagaguuuacuuugaaggaagugauuaaugaaguuuuucuuuguaugcuacuggaugacguauucuuuuuuccucuaaaagacuuaauggucacaacgauuaagacuuugcuuuaaaucuguguccuucgacuagauacaugggauucuauacagccuuggaauucucauuugaaggaauauuuuacuaacaauuuuaagaaaguucuuaauuugagaguuagcaaguguuauaauuugaugcacuuuguaagugauauaaaugcagauuuucaauaugggggccuuggguaagaaaggaugaauuaaugccucuccauuggaagugaguaugauugaagaugcagugucucuugucuucuugcugaccaagugaaaaugagagaauauggcccaaccacuuuggagaguuauauagcaguaccuaguaaauuucuucugguagaccuggggccuacuuuagagaaacucucacauguucagaaggagguagauggaagaauauucauggcaacucuguguuaauagcaaauaaccagaaacagcccaaauguccaucaacagaaaugggcuaaugaauucuuacauagagugaaauucuuuauagcaguuacaguaaauaagccauugcuaaugaauacaaaauucaaguuuaagaaggaucccacuuaccuuauuuuaaaaaaagucuacauuuuuaauguauguauacauaggcauuagaaaauaaaaacauguagagaaugguagaugccugauuccagguugggguuaccuuuggaguggguaaugacauuggaaaggguacaaacagagcuuuaguuaaaucuguaauguuauauuuuucuuaaaauaauugaugcaaauaugggaaaaucuuaaaauuugacuaagcauaaugggagauauucauuauaugauuuccuaagcccuaguggauucuugcaaaguuucauaauuaaaaaaaauuuaaaaaaaggccaggugcgguggcuuaugccuguaaucccagcacuuugggaggccgaggcggguggaucacuugaggucagguguuugagaccagccuggccaacauggugaaacccugucucaacuaaaaaugcaaaaaugagccagguguggaggcaugcaccuguaaucucagcugcuugagaggcugaggcaggagaaucgcuugaacccaggaggcggagguuucagugaguugagaucacgccacugcacucuagccugggccacagagugagacuuugucucaaaaauaaauaaauaaauaaauaaauaaauaaaaaauaaaggaacaugagagagaaguggugggaaaaauugauagguuaagaaguuaaaguuuacagugguaguucuagaaagaaggcaagagagagaaugagauuuuugaagguuuauuuuauguaacguggcauuguuauuacuuuugauucaauuacugaugucuagugaauccaagaccucuguguggucaugugucucuaaaacuauguagagucagcucucaguaucuguggguuccacauccauggauucaaccaaccauggaucaggaauauuuuggggggagaaauaacacaacaauuuuuaaaaugcaaauuuaaaaauauaacagcuauuuacauaguguuuauauuguauuagguauuauaaguagucuagagcugaucugaaguauauaggaggauguguguagauuaugugcagauacuacaccauuuuauauaagggauuuggguaucuguuguuuuugguguccccagggguccuugaaccaaucccucauggauacugagggaugacuucauauguuaauaguggcauaucaggaaaccguauuuaauuugggaauaguaaggguauauacuuaccuaccagcacagccuagcaaauauuucuuucucuuuauaaagaauauuuaugcauuuaaaaaaugagaaugcauuuaauugcguuagucuuaauucuucuuuuuuguuguuuuuuuuuaauaagccuccagcuguuccagacaauagaagacaggcagaaagucuuucauuaacuagggagguuucccagagcaggaaaccaucagcuucagaacguuuaccugaugagaaagucgaacuuuuuagcaaaaugagagugcuacaggaaaagaaacaaaaaauggacaaauugcuuggagaacuucauacacuucgagaucagcaucuuaacaauucaucaugugaguaaaucugguucagcaguauuggguauaagacacacaaguauauauacugucacauaauaaauuuaguauuuggugaaugaacacauagcuccucaaaaauauuuguagggacuuaagacuugcauaugaaaaguuucuaaguugcaagccaauauauaugaaagccaaauaggugauaaaucaguuuuauaauucagaaaagggaaagaauaaaguuggaccuugaaaaauuaguaggauuuuaauaagggaaagguagaagagaaggcaacuguuugauacguggacauauuaauacuuuguuucuuaacauucaaaauuuucccuuaaagaaaaguuaauccaguuaguacuuugauuuaaaaacccaaaacugugaaacauaguguguauuaaaaaaaacaaaaaacaaaacuaugaaaaacuuuuauauaugguuuagucuagagagcccagaacuuccaacugcuggauuuauauucauuuuuaaaaaauauauaaauaaucaucucaagcagguauaacugcgggaguuaucuuuuuugcuccacacguguuuaaccuucuuugucuaaaucagaucuagucuucaguuccuauccuaauaccuuuucaaacauggccccugucucauauccaaauaguaauagaggcucaagcauuagaaauugaagucaguagggacaacuuccaacuagucuuuaaacauucuagcugcugucuaauuaaagaaaagaugagggauuuaaaaauaacaaaaccauugucucuggagccucugguccuuauucuccaccuaucuccuuuuccuuuuccacccacaaaagaaccuuaauauuccuguccuaaaacauacuccuuucuuuucucugacuucugcuagucucuuucuccucuagaguauaaucccaguuuuuauccuuuacaaacacaugaauacaacuaagauguguggcugggugugguggcucacgccuguaaucccagcaccuugggaggcugaggcggguggaucaccugaggucgggaguucgagaccagccugaccaacauggagaaaccccgucucuacuaaaaguacaaaaguagccagguguggugguacaugccuguaaucucagcuacuccggaggcugagguaggagaaucgcuugaaucugggaggcggagguuguggugagccaagaucgugccauugcacuccagccugggcaacaaaagugaaacuccaucucaaaaaaaaaaaaaaagaaaagaaaaaaacaacuuaacaugugaaaguugcgcuuaaguccuugucgucaguuuuguaugcauaaaguagcacuccguauacugaugacucuuaaagccuauuuuuuuccucacugggaagcagugugagagcagcagcaaaagguagacucgucaaggaauagaaugaggagacugcuggaaaccaccuacaggaauugugguacuaaagugagcaacaaauaaugaugguuccuuugagaaagauacugguaaaugacagcaccuuugaaaugguaggagguagagaagugcaaagauucuuaaucuuuaauuccucuugaaagcaugauuuauauuugauaguaacagaaguuaaauagaaaguaauuaaauuuaguucaaggaccauagaggauuagccauuaucuaaauagcagguuuuuauugcuguuuaauauuucaugguuugagguaccacagucacuuuuaacacuuuucuuucucuccuggagcaagaaaaguuccuucuugguguccagaugugacaucccccugaucuguggguaugaaaaacugaugaagaccuaaucagcuacagcuacccuguaaagauuacagauugaguacugcacaugauucauaguggcccuguuuaacuuaaccuagaaccaaguuuaucaaguuaguuaccaaguuuacucguuaguuaaaacuaacuagaguacuucucuaguuaguuuuccaagguagaauaucauuauucuugucaauuuccaucuuuuuucuuuccuuucuguuuuaacccagugguuauauuguaaaggugauagaaccuguggaagaaagagguaaacaagucuuuguacauuuugauguguuuaauuguggaguaaguuaauaaacaauuuucugaaauuuaaaucugcagaaauuaaguuguuaauuuuuacuuuuuaguuuucaauauccaagccaacuguauguguuuguuuaugguaacuggugauuaaaaaaaauuuuuuguuguugugccuucuucagccucuccacaaaggagugucgaucagagaaguacuucagcucccucugcuucuguaggcuuggcaccgguugucaauggagaauccaauagccucacaucaucuguuccuuauccuacugcuucucuaguaucucagaaugagagugaaaacgaaggccaccucaauccaucugaaaaacuccaguaaaacauuuauaaucauuguuuacaugaaguuaaauaauagggauaaauucuguuuuuuuuuuuauguugaaaauucugcaaaacgagauuuauuuaauauuguuguaaacauucuuaagggauagguagaagaggcguguguguguugugugggcauaauuugaguugucuaagagaugugauguaacauaguuucugugaacugauguuacuuucuuguuuuucaaauaaaggaucaaaaauaagauuacaguuaaaauauuucuauauucagaugguuuagagaccaggcuguagaaucagacagcccugaaauuguaucacacaaggcuguguuacccuguacaaauaacuuagccuuacuaagccuguauuuccucaucugcaaaauagggaugauaauauaccuguugauaaauauguuuucauuaaaaaacguuggcgcaguuccuggcacuuacaguaagaacucagcuaacuuaauuuuuauuuuugguaaacguaguauguaguguauagaucucauaugugcagacaaaucaagaaccuuccauacaugcucaguaaugucuguauaccugauuuuccugagagguaguauuuaguaguacuucacacuuuugauacuugagaaacuagaaaucuuuuugacaucagguuuucugcuauuaacauuuacaccugcuuaaaaugaacaauuaaauugaaauugguuuucuuacacuuuugucccuaaaacagcauaagaaaauaaugugagauuuugaguaagcuguacuuggcauuaaccucauuauuuuacagucauacccccuggagaguucacuagguggauauuccauuaggucuaaauuuuguuucuguuagcugcuaugauaugaaaauaaugucuguauuauuuugcuaaaauggguguaaaucguauacauaaauuuuuuguuuaucaggaaguuaaaugaaguucgaaagagauugaaugagcuaagagaauuaguucauuauuaugaacaaacgucagacaugaugacagaugcugugaaugaaaacaggaaagaugaagaaacugaagagucagaauaugauucugagcaugaaaauuccgagccuguuacuaacauucgguaagaacuuuucuggggauguuuuuccagcauauucauucugucuugauacuuauaaugugggaacaaaaauacuucguuguaguauuuacuauuugccuuuuauuuaagcuuucuacuauuuuggucaguguaaucaucucugcccugugaagaaagaugaauagggaaguauggaguacaauaguucaguaaauuugcccuuuguuagacugaauucgaguaaaucaugagauguaucuaacuuagcauuuugcugucuuuuucuuuuuaggcguaauuuucauuuuuucagauguuuuucuacuuaaauagcacauaugcagaaguuaaugaaaagcaggagucgauuauucaauuugaauuuaaauggaauagccaacaaugugcuugguuugguguuauuuuauuagcaguucuaaacuuggauuucuuucucucuuuuuuugugccuuaaaugacuucaggcuguuuucuuucuucuagaaauccacaaguagcuuccacuuggaaugaaguaaauagucauaguaaugcacaguguguuucuaauaauagagaugggcgaacaguuaauucuaauugugaaauuaacaacagaucugcugccaacauaagggcucuaaacaugccuccuucuuuagguaugacugacuguauuuacauauaauuuugcuguguuauucuuacaaaguggguuuucguucaugugugcucuuuccuuuaaaaguuacugguuuuaauuauacauguuuucagcagauugucgauauaauagagaaggggaacaggagauucauguugcacaaggugaagaugaugaggaggaggaggaagaagcagaagaggagggagucaguggagcuucauuaucuagucacaggagcagucugguugaugagcauccagaagaugcugaauuugaacagaagaucaaccgacuuauggcugcaaaacagaaacuuagacaguuacaagaucuuguugcuaugguacagguaaauauugcuuggucuuuuaaaaaccuauuugucaaauaguacagucuuaaguaaaauuuguguaugauaauuacuuugguuuaauuauacuaauacacauuuauguaucauaugugagguuuaaauuuuuagcacuuuacaugcuguaugucagaggucagcaaccuuuuuaaauuaagagugaguugguuagauaguugcggcuuuguggcgauauaguaucugucacaauuucacaaugcaaaagcagccauacauaauacauaaaugagaaugauuauuugccaauauagcuuuauuuuauuauaaacaauauagcuguuuuuauuuacaaaaacagaagagguuuuguuguuuuuguuguuuugcugacaacucuggccuuauauuauguacaacuugcagcaucucaaugagguagacauuaaauagguuaaagagaucuuaauugccgaaguuuauaugacuguccaauccagaauucagacuuccugauaccagagccugcgaucuuaaccuacuguauauaaaagaaaaaccauauguuaucuuauucaguaagguuaaaguuagaacuauuaaucauaaauuuuaaaaagcaguuuauacauauuuuguauuauaguuacacaauuaacuauaauguacaauuguauauuuauacaaauguaaaaauauacaauuauaguuacauaacuauuaacacaaaauaugccuacacuuauaauuguauaaauauguaauuaacuauaauuguauuaccguguaacuauuaacacauuuauaaagguguuguguauauauauauaaaaaucauauaaaaugguuuuugugagugaaaaaccucaaguuuuauuaacaguuucuuuugaaaugcuauguacuuugaauuacucaaguaaaaggugagcgugcucucucgguucaaaaaaaguacguauuuguauuuauuuauuuuuuggggacaaggucuugcucugucacccagguuggagugcaguggcaugauuuuggcucacugcaagcuccaucucccggguucaagcgauucuucugccucagccucccgaguagcuggaauuacagauguguaccaccacaccuggcuaauguuuguauuuuuaguacagaugggguuucaccauauuggccaggcuggucuugaacuccuggccucaggcaguucacccaccuuggcuucccaaagugcucagauugcaggcacaaaaaguacauauuacuaauaaacucugucuuuaccuccauuaauaauccuauucuucuucacugaaguugcuaggccuuuucucugcaguuagguacaucacuaugcaccuauuuuuaaaaaaauacaugacguuuugugguauguuucuuuguuuuuacaaacuguauauauaauacacuaaguauuauuuuauagcuuuccuuuuuuccccacuccacauugucucagagaacuuucaugucaguauaguucuauauaauuauaaguaauuaagaaacacaaauaugauaauuauaaaauauaaauaauacugcauauauauauauacacacaguacauaguuauuuguagcugcaguacaguuuucaguauaucgauggacuuuaguuaauguauaauagcauccaguuacuauauacuuguuuucaaucuuucgcuauuuagaaacaaugcaccaaagaauauacuugcacaagcuuuugugcauuuguguuuuuuaagaaggauuuggagaaguggaacuacuaugucaguugguguacauuuuaaaggacacaacuuaauuggucucuagagagcaauuuucuauauguauuuccguauguauuuauauuucuauauguauagaauuuuugauauguauucauauuuuucuauauguauuuuuuauauuuuaagcagugguaugugagaguucguuucuccacacccuugauuguguuuuauuuuauugauauaccguagcuuguuuaaccauuacuggaauuggccuuuuccaaauuucccaauuauaagaagaguuauugaggugagauaaacauguaugcaaauacaaacguguguaaacaaauauauauugaacacguguacacauguauacaaacgugcuuucuuuacugcuuuaaucuuuuuauguaaauuuuacagacuagugguauuuacuaagguaugaauuggauaaugucuugagguaucaagauuguuuuaauguaaugaugcucuuucaggaugaugaugcagcucaaggaguuaucucugccagugcaucaaauuuggaugauuucuacccagcagaagaagacaccaagcaaaauucaaauaacacuagaggaaaugccaauaaaacacagaaagauacuggaguaaaugaaaaggcaagguauguuaagcuuuuggccuucauuuaauauaauaaaaauuuagugccuguuuuggagaaggugcucagcuagguacuguguuauguugugccuaaugcuucaucacauuuuauuggaguccauaaauauaaugucaauuuaauuguagagagaaauuuuaugaggcuaaacuacagcagcaacagagagagcuaaaacaauugcaggaagaaagaaagaaacugauugacauucaggagaaaauucaagcauugcaaacggcaugcccugacuuacagguaauuaugaaauuuauuucuaauugucugaaaaaagauguuuaaaaccuuaggucaacugaaaguacucuuuuuuguuuuuguuuuucuuuuuuuuugaggcagagucucacucuguugcccaggcugaagugcaguggcgugaucuuggcucacugcaagcucugccucuuagguucacgccauucuucugccucagccuccugaguagcugggacuucaggcacccgccaccaugccuggcuaauuuuuuguauuuuugguagagacaggguuucacaguguuagccaggaugguuucgaucuccugaccucgugauucgcccgucucagccucccaaagugcugggauuacaggcgcgagaaacuacucuuuuuuuucuaguauuaaggugacagaauuauaucuaguaauuuugugauuaaugaaguggaugaacuaaugaagaguugggguuauacguuuacaguguaaaagacagcacauaggaauugacucauuauuuucauucuuacugggcuggcuggccauagauucagaacauguguacucauaacuguuuauuauguuaaaauauucugauuugacuuuugcaguuauggaccagcauuuccaucuuuuacuggccugaaauaauauaauaaaaucuuuaagccaccauaagauaucuaaggaaaauaacuguaugugguuuaaagaguaaguuguauauacuuuugcuuauuaacuaggaucuuauacaugggucuugagauugaacagaaaauaagauaucuuuggugauaucaaauaaucaguuaauaauaugggaaggggauaauaauuccuucugauauuuucccagaguuuauuggcuagcuuuuuuuuuuuuuuuuuuuuuuuugagacggagucucgcucuguggcccaggugggagugcaguggugcaaucucggcucacugcaagcuccaccuccuggguucacgccauucuccugccucagccucccgaguagcugggacuacaggugcccgccaccacgcccggcuaauuuuuuuguauuuuuaguagagacgggguuucaccguguuagccaagauggucucagucuccugccgucgugauccgcccgccucggccuccugaaguguugggauuacaggcgugagccaccgcucccggccuauuggcuagcuuuaucuucaguuagguuguguuuucaaagaaaggaaaacagggcaacuguguucauuuucuaaacccuugccuuuccuacuguaucuaauccuuuuucucuccuuaucuccaaucuaaauaaugucuagagaaauauguugcaaagguggguuaaguauacaaaauuuuccauuauguuuuaucccuguuguuucuguuguuucugagggcuuguguuuguuaaccucagcuuguguuuucaucuuuguuuucuuauuucauguuaucuucggaugaugauggaagucagggucugauagcagauuaaauauggcacuagagccuuagugccauauuuaaaguaacugcuuuuaugaaauuaauauaauugcuuuaauuccucauaacguuuuuugugaauuccuuuuuagcugucagcugcuaguguggguaacugucccaccaaaaaauauaugccagcuguuacuucaaccccaacuguuaaucaacacgagaccaguacaagcaaaucuguuuuugagccugaagauucuucaauaguagauaaugagguauuguaaauuguacucucuuguuccugaguuagucuuuuguuuuccuuuuuuuuucuucaauaaggcacaucucaagaaaggaaacugaauauccuugaaacauguuuguaaauaguagucugcuuugugccuuuuuuaguagacacaaaaauguaauagauuauaauaauauaagaaagauaaaacauuuuaauuuuuaaacuuuaauugaaaaguuuuaaauaauuuuuucuaaaaaguaauuaucuuuuaaaaauauccauguucuuuguuaguaaauauuuggcagaaauauauagggggguaguugcagcaaauaguaaucauuucaguuagaaagaccuauccuuugacauuuuauuuauaugugguuuguagaaaauauaauuuuuccuaaauaauuucugaaguauauuugaguucuacuuguuucuauuaauaggccaugugcggugacucacaccuauaaucccagcacuuugggaggcugaggugggcagaucaugaggucagguauucaagaccagccuggucaacguggugaaacccuaucucuacuaaaaaauacaaaaaaaauuagcuagguguaguggugggcgccuguaaucccagcuacucaggaggcugaggcaggauaaucacuugaaccugggaggcagagguugcagugagccgagaucacaccacugcacuccagcccagaugacagagugagacucugucucaaaaaaaaaaaaaaauuggcugauuuuuuuguaaucauaacuauauuauuauuuuaaccuucauggacauguuagugugaaaaggagagaaugagaauagaaaccuuuguugauacugacaauacuaguagucuuuuacucuuuuaggcuacagcaaauccaaauauuuauuuaacucugguuucuuaaaaaaaauaguuguggucagaaaugagaagacaugaaauguugagggaggagcugcgacagagaagaaagcagcuugaagcucugauggcugaacaucagaggaggcaaggucuagcugaaacugcaucuccaguggcugugucauugagaagugauggaucugagaaccuauguacuccucagcaaaguagaacagaaaaguaagagagcugcauaaaucacuuuucuaaaaaugucaccugccgaagauugaccuguaggcuaggcagccacauuucuccucuacaucacagcacaaaucugcuauuucagugaggcuacuguuuaacuaccaccuuugugacccaguuuaauugaauccagccacuuucuguucugacuucucguagcaucagcuuucucuuuugucuuaaauuacuauggcacuugaucaaauggugauacagauuuucuuauguguauaagccuuauuaguuaaguuuauaaaaagaaaaugcuugauauuuuguagugcuuuucugucaggccagaaauaggcccuuuuuugcuuaaauugaguaucugcuguuuguaagguucuuaaggaucuuaaaacauuuuauuauaaucauuuaguuuuuaggauuucaguuuaaaauguccauauuuagaauauuucuaaaagaguuggucaucuauaagaucagugaauuauuuagcuauauaguaguaaccauaucaaaaauuuugaaauauagauuuguuuaugaccuucccuuuugauauccucagauggcauuucuggaauuucuggaguuuugcaccaagcccuacucucuucucagaugaacuucuauucuuggggucccaauaugcauuuuacugaucagacuauaucuacaauauuuuauucuguucuggguacuacacgucuguucuucuacagaguucuucagauaguuuugaugagcaucugguuucagaaucauuggucuggauuuuugcuguccaguauggcagccacuagauauaggugguuauuuaaauuucaaucaaaugaaauuaaaaauuuauuuucucagucauauuagcugcauuuuaagugcucaguagccauguguaccuagugucuacuguauuggauagcacagauacagaugauugccguaauuauagaaaguucugcugaacugcacugaucuugaaaacucccucaagcaaauguuaaggguaguuuagcuuugggaaguagucccaggggauaugaugauuauuuaaauguauuugaagaauuguuuugaggaaggcaaacuaaacauauucuguauauaacagcaauagggagagugccacccguagcauaguuauugugauuaaaugaaauuuuauauacagacauguauauguauguuugaaacaaugucuggcacauaguagguggcagaguauuuaacuuaucuccagaaugacaucuguuuuaugucucuuaaucacuagaacgauggcaacuuggggagggucuacccagugugcacuagaugaagaaggagaugaagacgguuaccuuucugaaggaauuguucggacagaugaagaggaggaagaagagcaagaugccaguuccaaugauaacuuuucuguguguccuucuaacagugugaaucauaacuccuacaauggaaaggaaacuaaaaauagguuaguuucaguauuuuaauuuugugcuuaauuuaagaggcucaggucuuuuugacugacagcaagcacuucugcaguucuccaagccaacugaauguccuacaacucaauucaauuuuuacacuaacuacucagaguuagugcagaccccucaaguuaaggggcucaguucaguaagacugcccucaccucagacuucaauuucaacugcuugguccccacguuacccacacuucugugcaacauggcuagaaauuugggaguucuuacaauccccuucagguuuauuugcuagaacaacucacgaaauacaggaaaagacuuacuuacguuuccucauuucuuauaaaggauucugaacugccaaauggaagagguguguuaggacaguguguggguuggggaggugugcagagcuuccaugguuuccucugugugucccacccuccccagcacuuugauguguucagugacccagaagcugccugaauucuguuuacgguuuuuuaggagauuucauugcuuaagcgcaauugauaaaauuguugacuguuggugauuguucucauuagcaaaaauucacaucugguugaaaggggcuuguuacggauaacaaaagacauuaucacuugggagauuccaaggguuuuaggagcucugugcuaggaaccaggcacaaagaacagauagauauuuuauuauaccacaagaauguuguuccaguagauccagguaaacuggaucagucuucacuccugcuguugagaauuaagcaaaaauaacaaauuguagauagugaaaagagucugccaacaaagauguuauuacauuguuacuaauaauuauaacugaaaauuucuucaugaauaacagauggugaaguagauacaguagcuccacuugaugaaauacuaugugguugaacuuaaagcgugaagaauggaaaacuacuugugacauaauaaauauuuuuauuuugcagaauacuuaauuauauggacacugcuguguaaaaacauacaugaaaaagacuggagacuaaugaaaacuaauaauuguacaaagcuaaagaucuggacuucuccccccucuauauuuuuuaauacuuuguauguucuuuuaauuuaaaacagaauauuggcccauaggccugaguaucagaguuuauugcuguauuuuaaaaaccaaauuauuauguaugaugacuuaaugcuuucaaucuuguguuagguggaagaacaauugcccuuuuucggcagaugaaaauuaucguccuuuagccaagacaaggcaacagaauaucagcaugcaacggcaagaaaaccuucguugggugucagagcucucuuacguagaagagaaagaacaauggcaagaacaaaucaaucagcuaaagaaacagcuugauuuuagugucaguauuugucagacuuugaugcaagaccagcagguaaaauuugcuaugaaaguauauuuuucgucuauuuuuauaacuucugaagcaauacaaauuuuucucaagucaucaguaacuauuaacaaacauuuucuuucaauagacucuaucuugucugcuacaaacucuucucacggguccuuacaguguuaugcccagcaauguugcaucuccucaaguacacuucauaaugcaccaguugaaccagugcuauacucagcuaacauggcaacagaauaauguucagagguaaucuguuucuuagaaguauugagacuguauaagagcuaacauugagcagagguuuuacaguuagcuucugggagaaaagagcaagaccaaauugcauauuuggacauucucuuucccuugagaauuuuauaaguggugauuuaccuaauguuuccuuuuaauaccauggauuucuguuuuuauaaauuuauguuauugaauuuuacuuauauuuuggcagauuuuaugguguguaaauuguaccacagugaagcuauaaacaaacaaaaaagugauuuucuuacaguuuuaccgacugucggacagaaguacuaaguucauuucuuguuccagagggaaaguuauugaauuaagccuuauagagcaagcacguauuuguuacaguaucagagcaguuugucugcaugcuuuugaaucauuuuuuuacauguauucuuccugaauguacuuuauauauauggcaauauaacugauucuuagauuacugacuuaaaucuuuguagguugaaacaaaugcuaaaugaacuuaugcgccagcaaaaucagcauccagaaaaaccuggaggcaaggaaagaggcaguagugcaucgcacccuccuucucccaguuuauuuuguccuuucagcuuuccaacacagccuguaaaucucuucaauauaccuggauuuacuaacuuuucaucauuugcaccagguaggugacuuaaccuaaagagaaaauaaauaaaagcaaaguguuuggaacaacguaauuugucuauugccuagauguuuuaacauuuucuuuuggagugggguaggaaauguuugcaaagaaaguuacaaacucuuuuuuuuuuuuuucuuuuugaggcggaguuuuacucuucuuguccaggcuggaaugcagugacaugaucuuggcucacggcagccuccaccucccagguucaagggauucuccugccucagcuuccuaaguagcugggauuacaggcaugugccaccgugcccagcuaauuuuguauuuuuaguagagaugggguuucuccauguuggucaggcuggucuccaacucccgaccucaggugauccaccugccuuggccucccauggugcugggauuacaggcaugagccaccgugcccagccuacguuguuccuuuuaaaccaaacuuuaauaauacgguugcuaaugaaauuaaguaaacuacuuaggaaugauugcuucaacuauuuauuaagaggaaagagaaccuguucaauggcugcuguauacuaggcacuguguaaaacgcugggagaguaaagaugaauaagacagugcucuccuaaaggaguaccaugucuuguuagggggaugcuaauagacuaaaggagagcacauuuagcuuaagcuuuucuuuggaugguuuuuucugcacucauuauguaccagacacuauguaaguuacugggaucuaaagaugagugacacugauccuuuaaggaauucagggucuagugaggaugcuguuaaugaaugcuuauaguacagugccacgggugccauaacaguagugcaaaugcugggaagugucagcaaaucaguuccgccgccaaaaaaaaaaaaaagaguugauauuuaagcuaaagaaugaauagaauuuauuuccagagagauuagaaaugaaagggcuuucuaauagaaccacuuagaguuauaaagcaaugaaauaguacaucacucagggaauuuagagguauuuaaguguggcuaguauuuaggggaagaguaauugaugugguugaagaguggcagagagauuuuaugaugugcaaacaagcuuagguuuuauauugcagacgagggugccauugaaggacuuugagcaagggauaacaugaaauuuauauuuuagaaagauuacacuggugaaaguguucgggagaaguuggaggaaaggagugaagauuuagcuggugaacagaaggcugucauaauaauauggaaagaaugauagcuuggccuuaggccuugucaguagggaucaagaaaaaggaguaacugaaagacauuauagugauagagugaauaaguuaagugaccgauuauaugaggugaaucaugaggaggaguuaaagguguuggcagggaauauaggaggagaaaaaagguugagagggcuuugugaauauauauauauauaaucacaauauauauguacucaauacuucuuacauacauauauuacaguguuaugcccagcaauguguauauauauggauguauauauguguguguguguguguguguguguguguguguauauauauauauauacacaccacaguguuuuuucuuuauaggauuuucaagacaguggcauaaaaaauuuaagagacuuuuuaguucuugggugucaauuaauauuggcagcaaacaucacaugaguagacuuuuaaguaauaagaaauugcaaaugcucuuccuuuuuacuaaaauauacuucauacccacaccaacucuauauaaaggcucuucauucuucuuaacaguacaauuuuugugaaaccuucccagucucuuuccccacacguuguuaguagccucuugcaaauagcucugauacauaacaguauuugguaaguauuuaauuauauucuacuuucccaauaaaaauagaguagaaacaacauaagcguaggagucauacagaccugagaucuaaucaucuuuuucauuuauuagacguuugauuucuaaccguauuugcucacugguaaaaugaaugcaguaucuauuuuauaaguuacuugguuuuaaguauuaaaccaaguaacauguaaagugccugcaguagagugugucacccaguaauugauaaaugucagguaccauuauuucuaacuuuuagcucuuaagggaguggggauuauuaauugucuuugaccaaugccuaaaacauaguggccuaagcugugaacagugauuggauaaauauuagcuuuuuuuuuuaauuaacaguuuuuuguuuugguggauuugaaugacauguuuaauuaaaacugucuuuuaauuucauuuuaaagcuaaagacauuuauuuauuuuucucuuacccauugcuuuuacugauuagguaugaauuucagcccuuuauuuccuucuaauuuuggagauuuuucucagaauaucucuacacccagugaacagcagcaacccuuagcccagaauucuucaggaaaaacagaauauauggcuuuuccaaaaccuuuugaaagcaguuccucuauuggagcagagaaaccaagguacugauuguaaacagucuuuuauugcuuaaacauucacuuuugugauuacaucuaauuauguguaauuugaaaacacaacuagggaggacguuugugaugauuuggcuugaugauguuggaaauaugaaacuuugacguaucaguagaugagaugccagauacuuccugguaacccugguacauuaaaaguuguuuggaaggauguggcguaacucauaggauuuguuuugucucuaauuugauaccugucuuuacgguuaaagcaguuugcuguucaaugacuuagggcuggaaacuaauauuaacugcuagaagauaguuguuaagugaugaucccuuuuuuugauuccuagcucuugauuagaaucacuuccuaaagccuauucaaauauaauguugaguacuauuagauuauaaaaacaacuuuugucucauaaguuuugaggaugcaugguauuaaugauauuuaggauuucuucugaaacagaguuuuugacucagugugaaagguuggcuccguugaaccuagucugucagauguaucucucugauugucuuuccuacuccauaaaaauauauauaauucacauuauauuucucuuuagcuaugugauuaggaaggucucaggcucuuauauuagcauuuugacacuguuuaauuacugagucauuaacugggauuuuuuuuuuuuuuuacucgauuaaccaauaacucugagaauuccaacuuuguauucaccacuaggagugcuaugauuaacauccguuacuuuguugacuccuuuuuuuugguuguucuaucuuuuuccuguuaaaucucauguugcucuauaaagguauucuguugucagaagccuaacacaguguuaguucacaguugccauucagaaaugauuguugaaugaauauccaucacgagcaguaaacauuuauucaaagcuucggugaauagacuuuccuauuagaaugucccuacuucauuauuuucauauaauugauaguaaaaaauuacucugguuuuaaauuauuuauaucauuuuuaggauggaucugaaugucuaauauuauuuuagauauuuggccuacuucagauuagaccucauuucccaaaaucucaacuauuguaauuucauggaauuaaaugacuagagauaaaaagucagauaaaauccuguagucuuauucaggggucagaaaacuuuuccuauaaaagacuagauaguauuuuaggccuugcuggccauauaguguuuaucauagccauucaucugugacaguuuugcacaagagcaaccauaggcaauauguaaacaugaguauggcuguguucugcaauaacacuuuauuuaugggcacagaaauuuuauuuucauauaauuuucauuugucacaaacuuuuaacuuuuuuucuuccaacuauuuaagaauauaaaagccauucuuagcucucaggucauauggaaacaggcagcaggcugaauuuggucuguaaguuacagguuucuaacccuugucuugaguuaaauccuguaggucacugucucccagacuauuaggagcaguguuguuguucacgcuagguucugugauaaaguuuuggacuuguugcccacuaccacuuuuaagagauuuauaaagcacauuggcauauuaaaaguugugagauauuuuacagaccuguuuaacuuuguuuuauguguuuucuccccaaccuagacgaccgaugaguaccuauuaaauauuaagggaugcuaguguucagcagauaaaauuugagaaaugacaguagacuaauagaacuacggacuuaaggaguggagaaauaaauugcuaauugaaugaccaauuguauucaccaaauucuuguucuacuugaacugcuuuaggugaacacaaauccauguauguucccaagcccucugcuauagcucuuuuugagccauucuuccaacuuuugggucuuguauaucccauccucccuugauuuuucuuuuuguuguuuuuucuagaggcagggucucacuuuguuacccaggcaggaguacaguugauaacgaucauagcucacugccuccuugaauuccugggcucaagggauccuccugccucagcccccugagugucuaggacuggaggcacaugccacugugccuggcucauuuuuaaaauuuuuuuuagagacggggucucaccaacuugucugggcuggucuugaacuccugggcucaagcauuccuccugccuccgccuuccaaagugcuggaguuacaggcaugagccacugcagcuagccugauuuuucuuucccacuguuuuccauugcuaaugcuagaucuuugauaaggaacuuuugccaguaaaagugguuuagugagauggguccagaauuaaaacuaauuuacuaccuuagcuuaugugauauuugcauauuuaauguguauuuuugugaaaacauuuuuauagccuguugacaauuuuauucaccuaaaucuacucgaguagacuauaaauucaguguauuuggaguuuuuguaaacuauaguuguuaacuuauaaaaacuuguuuucauugguaaggaauaaaaaacugccugaagaggagguggaaagcaguaggacaccaugguuauaugaacaagaaggugaaguagagaaaccauuuaucaagacuggauuuucagugucuguagaaaaaucuacaaguaguaaccgcaaaaaucaauuagauacaaacggaagaagacgccaguuugaugaagaaucacuggaaagcuuuagcaguaugccugauccaguagauccaacaacagugacuaaaacauucaagacaagaaaagcgucugcacaggccagccuggcaucuaaagauaaaacucccaagucaaaaaguaagaagaggaauucuacucagcugaaaagcagaguuaaaaacaucaguaaguguugaaauuuguugaauguugaucaguguaaauuuugguaaucuuacuuugacauguugacauagauauaguuucaguaaggcuagaugugcaggugcuguucuagacuuaguugaacagucauuuuuaguuaccuuuauauauauaauuuuuuuuuacaaaauaauauucgaaauaggguuuaauuuucuggauuaauguuguaaaacauggcauuuauuuuuuguacuucuuaaagcuucaguuuuguagauuauugaaaaauugccaaaugcccacguuuacuauuuuuuuucuuuugcuauuguaucagauccugcauccaacucuuuggucaugacuuuuagauggauucuugauugauuaguuuaaagaauagugggcuucuaaauacauugcaguuuuugaauaucauaugauaaaaccaguuuuaaaacaggcuggcuuaaguccuucuggaaguaaacucauauuuuacucagucuugccauugaaugucauauuaaaguuguuuaaaaaauuuuuuuaaaauuuucuuuaugguguuagucauaccucuuacaaaaauagguuuucugugauuuuugaauuauuuacugaaguguaguacuagguuaaaaauaguuucauuagcuaaaaucugcaguguuacagcugaaggauauucuuuuuauguuugcaaaggaugggcuauggccuugaaagguuguucugaguuuaaggagauaguauuuggugccuaaggcuaguugcgguggcucaugccuguaaucccagcacuuugggaggcugaggcagguggaucaccugagagcaggaguuugagaccagccugaccaacauggugaaaccccaucucuacuaaaaguacaaaaauuagccgggcauggugggcgugccuguaauccagcuacuaaggaggcugagacacaagaaucgcuugaaccugggaggcagagguugcagugagccaacaucaugccacuguacucccagccugcgugacagagcaagucucugucagaaaaaaaaaaaaaaaauugguguuuaagaacaaaguauucuaggcuuauaaucaggaaaguuugaaaugcauugcacacugcuaacucccuuucuuggaaguucacaacacauacaaguauaguaaaugcccugagaaauccuguaguaagaaaauacacuuguaaacuuuggcaaccuucaucuuaaucacuuuuggauaaugaaaccuuagaaaaaucuaaugaaaaccacagauacaagagaauauuggcacauuuuuaaaaauuucaguaauucaucuauccuugaaguccuuggcuccuaccuugaaccccaugugaagaaucugacggaugguuuaaaaagcaaguuugaacaggagugaaagaggugacauuuuucuuagcauacacauuaucagccuugaaguaauuuucugguuauaaagguuuaggagaagcugguuuauuuaguaaauuaauugguaaucugaagcuauucagaaaguuacugcgcuuuuccaagauuacuguuggugcuaccagagaagauuuaaguagauaauggccauuuagagacagggccguuaggcaacucagaacuuucuauuuccuagugcuuugcccucacagagaugcucuuugucauauaaauaaaugaagaaaagcugacauuuuaaauuucagcauugucucauucagauaguuaauuugaaucugauagggcaauacuucauaaacuugaguuucacaugaaucuccuuaggaauacaguuuuaagugcagauucugauucauuugacuuggaagggacuugagagucugccuuccuaacagacucucuuguguugccaguauuggucuguggacuacacuucaaguagcagauuuuacaggaaccuuagcuaauuuauggcuaugaccaccuaacccuagaaauauugguauguuuuaauuuuucugaaaccccuuuauucucgggaauuacuuuuccaaauauauaauucagccuuuuaacuucaagacaaagauugacauucugaucuuugugcucuuguccuucauauugaaguauaaaaauaccugcuguuugaaauguacagucacauuugcucaacaagcauucaagaccaucugucagugagugccccacuuuaaggcacacacacacacacacacacacacacacacacacaaauaaaaggcuugauagcagaaucaaacuauacauagcagagccgaaguaauaugggguaaaaucaaauuagcucaauccuugcuauucaaacucugaacuguggacaagcagcauuacaucaucugggauauuauuagaaaugcgugcuuuugggccucaccuuaugccaacuaaaucaguauguauuuuucuucaguaugcauuuuggcaagauuuuugguaugaagauauguacgugaaagucugaaaaguacugaacuagaacacugguuuaugugguuuuuguuccuuuugugcuauaggaauggucaagauuuguuagaaaaaaggauuuuuacuguaucuuuaaccuccaccucccggguucaaacaauucuccugucucauccucccgaguagcugggauuacaggcaugugccaccacacccggcuaauuuuguauuuuuaguagagacgggguuucuccacguuggucaggcuagucuugaacucccgaucucaggugauccacccccauuggccuccggaaguggugggauuacaggugugagccacagcgcccgaccaauuuuuauuauaucuuaaaggaagugguaaauagagguggguggggaaaaguuuagaaagccuuucaaauuguuacuacaguaagaaaaguauagaguggggaacaagcaggaugagaggaauugggaacggauaugacagauauuucagcauagugggaauuacacugcugucuugagagauaugguacagccaguuauacugucccauacuuacuagacugauccaaauauauauguguuuuuugugcauguugacauucuuucagaaguagcuugauaaaucucauauaacuuuguuucccaugaugguaauguguuuuaauccuuagaaggucuuuauauaugaaaauagauauugcauaugagguaagaauauauaaauuauguaauaaucguauuuuaaacuugaguucagacuuagaccuuaugaguugaaggugauuuccugccuuacugaguuuuucuguuaucagaccuauaauuuguuuacacuauacucuucugauauuauuaguaguagccaagauuuucuucacucuuuucuuggaaaauuggauagaacuguuaagguacagccuucuggguucuuacuguccuugaaucuuuucauuucuuccuuccucccuuuccuguugcacacuaaugaagauggacaugaaauggacgugaaacauuaggcaaggcaaggccugacagauuuggcugguaaacaacuagucaacuuuuugaauuuagacaguuauuaauuacuuaggcagagaaaaaaguaguccaaggugccauuucucugugccccuugucucacacuugaaaagagugacaccgaaauaaaaggggcuagcuaacgauugucccuugaauggugggacacccuguugcugaggaaucauuguuauacugcagcuaagccuguuuagucugcaaauguacccuacaagguugaggaagaaaggucucauguuucauuagaaccugagaggagaugggaaacucuccugacagaagcauccuggggcaagagagaggugaguggaaaacguccauccauauagcaacuucucacaagccucucuuguccauguuccaggaugauuccauggccuucugccaagacagcuugcacugugauucagaccuuaaccucucugcgcucuuuggacaugugcaaggucuccagagugccauggcugaucucuuucccuucaguggaggcucaaguagaaguacuguuucuucuacuaaugucacccccucaugcugagaaaaacagaaugagaaagggaaagaguggugaaguggcauaggcgauaacauccuuaucucucaucagucacacauuaguaccuuaacuuuggaaaucuagccuuugauguuuuuaauuugggacucauauauaaaaccaguuuuuuuuuuuucucuuuucguagcaucuuaauaauuauagccuacuucucuucacaguuucagcuauuuuggaggaugacuguauguauuccuuuuuaaaguaccuauugggacuccccacugagaauuucguauaugccacauuaagugcauuuuaauuuugauuaaaauuuauucaucacuuuucaugugauacaguaacagcauuuaaauguuuaauuucacuuauauaaauguucauguuagaauaacauacuuaaaaucuuuuucuuuagaucauuguauguuauuaaaugagcaauaguacuaccagucaugucauuuuacauauugcuuuuggcacucauacucuuuauugcugguuuuauauuaagaucaauaauaaucaagaggucucucuuuucaguaaauuucaugcagacucgguggcagaggcuaaacuuuaguuugagagaccagugaaaaaaccuggaaccuaaaguugagaugaugaagucuuacauaauggccuuggaaauagagagggagggcugaaucuagaugggauaucacagauaauaaauugacaauauuugggaaaauuauuuguuguuaguagaccugugcggugaucuggaagaugcaagcaaggcuuuagggucugcuggcuuuuuccuagagugucaggagcauggucagaucuccaugauucuuggagaaagcuauguuggaggagauccuugcaauuccuccuguuauuaacccuuccccuuacccccaagaguagcaguguuuugcuacugcaagcuacuaguuggcagaaagguuauugaguaaguagguggcagucuuccuuaacccuguacaugggagagcauuagucuuugcagcugaagagacuaagcaguagagaagauuccucucauugucuugaugagggacugacagcuugcuagcgaaaauguugcuugaccacaggaaugagacuuccaugcacccucaucuugccauuauuaaagcuauccagcauuuggguccagccuuaagagaaggugagagucaugacuaggccagugaauauaacagugcauauaaaagggaccuaguuaccagggagaaaacagaaguagaccacugaaagaggcaaaaccuagugaaaauagaauuauugaacaaaauauugaacaaauacacuugaacaaaauaauaagggcacauaagcagauugaauuauaacaaauucuuuagagcuagaaaaaaaugacauuaaguuuuaauguuuagauuauuuaaaaaagaggacacgugcuauuaaguuccaaauuacaggccuagaaaaucagggggaagaauuaugucauuaaauggaaugaaaguacuaacagauaaaaucaagagaagacgauuagagacuuacaagaaguucugaaggggaaaauaaaaaaccagguggacaagcaauaacuaaauaauagaugggaugaagaaagacuugagacugcagaucagaacagcuggcuguugucuagccaggagagaagugagggaaacacacaaacaccuaugcagagucuggcaaaaucccugaauuccaaggaaaaaguaaaaauccucuaagcuuccauaugaaagaccaaguugcauacaaagaaaaagaaccaaaccgacaccaggcaaucuuccuuaccacacaagcagaaguagaaaaaaguggaaugacgcuacacaguugacaaagaacugcaacucaggaaccuuguacucagccaaaggacccuccacaugucagaaugaaaaggagauacuaguuuauccuaucugaggaaaacuaaagaaacaaccugugaaucaaaauagagaccuuuauacaggggaagauaaagaagacagagaacaguuuaauaaagaaaacaguagaucagucucacuaauauaaauucaaaaguaaaaauaaaauauuagcaaauugaaucugccauuguaucaaaagaauucuagacuaucaacacuagaguuuauuucagacauguaaugaugauuuguuaccaggaaaucugucaacauaauuuauucuaucaaagggacaaauaaucauagaagcuauucucaugagaauuugaaguaaaauggguauaagaaggcaguuaugccuguaaucccagcacuuugggagggcgaggcaguuggauugcuugagccugguagguggaguuugcaaugagccaagacugugucacuguacuugagccugggcaacagaaugagacucagucucaaaagaaaagaaaaaaaaaaaaaaagcaguuauuugaguguaauaaagacuguuagccaguguacaucauuguaaaugaaaguacuccagagauauuucuaucucaguuaggaacuaaacagggauuccuucugucccaccaucauuauuuaccauuauuugggaagcauuaggucaaauaauuggaauuauaaugguaguaaauauuggaaaaggaaggaagcaaguuuuauguguucuuuucuaguggcauuuuuguauacuaagaaagcccaagagauacuggaaaguagcuccuagaguuacaagguaaacuguuaaaguggcugguuauggaauaagugugugaauauuuuucucuguuguaauauccaguagcaugaaaguggagaggaacgcucuucucauaguaguacucuaaguguuugagugggggguaugaaauguaaggaacaaauuuaacaaggaaaguacuaggucuauaaaaagcuauaaaguauuuuugaagaacaucagaaagauugaacaaauauaaaaacauaaccauguucuuaagauggaaaagauggaaaugcauaagauuauuaaauaccauuucuccugagauuaauacauacuuuuaauuugauuccauuuugaguccccagagauuguuuuuaaaauuaaaaacaaaaaacaacaaagcuuauguggaaggacagaugcccaagaauagucaagaaaaaagugaagcuagugggacuugccuuagcagauauuugaucauccuguauaacuuguguuucuaaaugaauaaaaauggcauuggaauagcuaaguugaacacauaaauguccaaaaguaaaaccccaaauauuggaauuuaauauauugaccgauguguauuuuaauucaguggaaagaggguagguauagccaccuauccauguggaacaaaaaaaaaaaaggaauuucuaccuuguauauauaccaaaauauuuuaaaaacuugaaaauuuuauagaauauauguauaaccuaucaguggguaagaccuuuuaaaccaagucaugucacauaaaagauaacaauaagaaaggcaaauguauuugacuacucucccucuauaauggauauuuguauauaucggaugugauucuuaugucuccuaauauuaaaaauugcuaacuuggaauucuaguagagauuuggggucauguaaggucugccauauacuucgaauuggaauauacucauuaagaugaguaucaaagaacagugaagguuagauuuauuacuguuagcucaugcuuccaaaggguauugcaaagauaccuccaagacauauuuacuguuuuguauucuauuuauaccaggccuuccuagcauuguaaauugaguuaccuguacuguuacacaauggaaaccgauuucccuuuuaguuugaguuaguugcaacugauaacaguugucacuuuuuuuacucaaggguaugaaagugccaguaugucuagcacaugugaaccuugcaaaaguaggaacagacauucagcccagacugaagagccuguucaagcaaaaguauucagcagaaagaaucaugagcaacuggaaaaaauaauaaaauguaauaggucuacagaaauaucuucagguauguucuuuuuugguuugcauuaauauaaggagguuuucagcuuagauuugaaaagcuauaauaaagcagguguuaaaauugguguuucacacguaucuaucauguggaagguuuuauaguggaaauuauaguacacauuccuugauacugaaaaauaaaaacugaaaauauuuuguguuauacuauuuaauaguuuuggacacauuuuaauaaaauucuaaacaaaggauaguuacaauuguggaacucuucaaauucugaaaaucuuaucugauuaagaauuagauaugaaaucaugucaucuccugcuucaauccuuuggcuuacugugccuacaggauaaagucugaaugccuucauggaacguacauggccaucagggauuugguuccuuccugccucuccagacucauuucucaacacacucugccuugaacuuuuuucuuucuguggcacugaacuggaguuuuuguauagcuaucacauucuuucuuaccuugguagcuguuuuucuaucucaaguccuuucugccuuuuuuguaaguucguuucucugcuggacucuuaauacaauuuuaauucugaaacuccauucuaauccaagcuaggauaguuuccccuuucuccuguuuuccuuguagcuuguguaaaccuauuuuguugccuuaaucacauuauuauaguauuucccuguuugucacuuuuuugagucccuuggcagcagauaaaagcaccaguaguuuccuaauuuguaaagagcaucucaaagaaauauggagagagagaggcaauaacaugacauuagacuauaguggauagaccuuaaucuaguagcuuucauugacauuaguauaaaaugcaugcguuuuuuguuuaaaaaugauaacagcagcuaucuuuuguaccaugcuccauuauuuucaaauuaccaacaaaucucauuugagccucauaaugcugaguugguuuuauuuccauuuuucggaggaaacauggucaaagagggaacuuuuuuuuguuuuguuuuucaguacucauaaaggcucaguaauguaaacugguacaacuuuccuggaaagcuucagaagucaugcccuuaauccaguaauuguacuuguaguaauccauccuaagaagacaaaaggggaaaaaaaaaaaagacauuaagauuuaguguugucucaacaguaugguuucaacuauguauaaacaaaaauuugaaagcaaaaaggccggaagaaaaugcaucaaaauguuaauagugguuuuaucaucuuuaaacucauaaugagcauuuaucauuuuguaaucagaaaagaaacaucacauuuguuugcauuuugaaaugaauuucucaagcuuacauugcuaggaaaugguaaagcugaacuuagaagcugggcuucuguuaagucuguguuccuuucugcaaaaauaucaauccuauucuucugaacccagaauuuuacuaaaauuuuauaauuuucaucuccuuuuacucucuaccaaauagugauaucuucaaaaaauaaacaguccgguagaggucgaagaaggacacuaaacugaaagucuuaauaaacugaguaucaauuacuuaaauaauaauuggacauaguacuucaggcccuauuacuguuacuuagugaaauauaaugauugaauuuuggugaauuaaaaaauguuugaauauauaaauauacacaaguuuacauauuuacauucugaaaagauuaaaaaaaaaauuuuuuuuugagaccgagucucgcucugucauccaggcuggagugcaguggugcgaccucggcucacugcaaccucugccucccggguucgagcgauucuccugccucagcccacugaguagcugggacuacaggugcgugccaccacgcccggcuaauuuuuuguauuuuuaguagagacaggguuucacuguguuagccaggauggucucaaucuccugaccucgugauccgcccgccucggccucccaaagugcugggauugcaggcaugagccaccaugcccagcccugaaaagauuuauuuuuaguuuuaaucauuacccuaaaauuccuuauagcauguaaggcauguuacuuuuuguaacuguacucauaacauaugauuauuagaguauagcauaauaggacugcuaguauuaaauuacgcagucuucuucucccguggguguugugggagguucaccuugauguguaugcuucuaaaaaugaaugauagaaguuuauuaugauagucaucaucggucgccuuaauauacguuuauagcaaaccuuuugagauuuuuuuucuugagauuauuuuuaaguagagcguaagccuuaguucaggcaaacaauuuuaaagaaauucgcuuauuucuuuuuuucauucacuuauucauguuauagacccugucuuuacuacucauacacauuuuauguucauccuuaugucugcccuuuccuacagcacaugcuaggagaauacuacagcagucuaacagaaaugcaugcaaugaagcgccagguaacaaucugcguaguuuugguguccacuuuuuguuaauuuuuucccauugguccuaaagguuuuauuguccugauuuuuuucuuuuuuaaauuuagcugagaguauauauguuaugugacuauuguaaaagauaauuuauauucauaaaauucugaacccauucauuuauaauucuugguaaaauuugcugcuuuuguuuucauauucuguuaguguauguaaccuaacacauucauaaggguaacagaaaccuuuuuuacgguuuaguacuugauuugagguuauuuuguacuucuucaaagcauuaguauuucuuagaccuagaaauauaguuacuuuuauaguuuaucuuuccauuucagucagcaucuuagaaaagucaucaaacaaaacaaugauuacaugcaaagacgugauaaauaaagaucauggaaauuacaaagauucccaaauacuauuuuagucucuaauauaaguauucucauuaaaugugguucuuugugauuuagaguuguaaauauuuuuuuaacuccucuugcagcuuuacaugaaugaaaaguaaaagccaguuugaauggaaccuuuaggggaaucuaaagauacaaaacaaggauccagaacugacaaagcugaauauaucaguggcacuuugaaaauaaggaacucugaaaauaggauauaaaaacaagauggaauuagagaaaccugauuaagauuagggauuuuuccagccaaagcuaauaaauuucaguucaggaggagaaacuggcauaaacuuuccaccucuugacugcagaaguggugggggaaugaagcuuguguuuaaauggcauauucauuauuugagaauaauuuaauuuuuaaugauacgcaauuuagauugauaauuuuaucacauacagagguauuaaauaugucauuaaacaguuauagcuuugaaaugaauuuuuuaaauuaaguaugauuaaacugcaauauaguauauaagauaaaaguuugcauaucaaaauucuuuuuaccuggauuuuucccauuagaagagauugcuuacagagauaauuuugguuccugcuuauuauaauaagugucauuuuugugauaguucauaccuuaaaacuacgagaacuuuaguguaucacuugauuuuauaccuguaacugaggcaaaauagggaaguugcauauuuauuguuacauauaauuaauauauuuuucuauugauaucuuauauuaguaauguuauuauuucaugcuuguggaaauugagaccugaagauauuaaauuauuagccaaguaguggaaaauuuuucuauuagagcacauucuuuuuccauuuucuuauuccucucacaaaaaugaguuuuuaugaucuuguauacuucuuugaaagcgcaauguauuaagauacucaacauuuuaaauggauaccuuugaguguaauaauuuuguguuaucaacaaguaaauuuagccgaauuguagcuaaauaauagagugaugccuagauucugugaaacugaaaacuucaguuggaucacuugccugcuccaauauacacugaguauguaaauaagacacaauggugaaauugaccuauuauguuagguuacagauuugguuacucaucaucacagcacuuuucugugugauguaugagauuugauaauuaguagacuauacuggauagaccuuaaucuaguagcuuucauuggcagcauucaguuuauucuuuuuaacauuaacaaaauauacaaacuuccuuuucuguaaugaaguccauauuagcaaaagcaaaaaagaaauuagcacuuagcuuauuucuaaguguugaaagauuuucacugauuuuuccuauaaaauguauaauauuuucuguauauuuuauaugaucagaaauaaacaugguucuuaguaaugcuagguaauguuauucauuaaaguuucauuuuuaguauaaaaugcauaucuugauauuuuaagauuuuauuuaucuugguaauauuaagcuucuuuucuacuuuaaaagcucugaaauagaauugucuaaaauagaauuuuuagauaauuuaaagcugagaguaaugauacuagcuaauaaaaguugucaugaagguacuucaucaauauuaacuuucuggucuuuuauguauuccagaaacugggagugauuuuuccauguuugaagcuuugcgagauacuauuuauucugaaguagcuacauuaauuucucaaaaugaaucucguccacauuuucuuauugaacucuuccaugagcugcagcuacuaaacacagacuacuugagacagagggcuuuauaugcauugcagguaucugguaccuaacauaauuuuuccuacccuauuaucaccuucuucaugauuaucucugguugcugucuuagacugaagcaugugccauaugaauuuucaucuguucucuaugugcuuucuugacauuuuauuuaaaauuuuuguauagcuuaaguagcauuaaaguauuuuuuuugaguacuuuuucaguguuuugucuacuuccucacacuuaaccugugaggguagaaacaguacauuuuuccuuccaucugcuuuuauuuuugaaucuguaauauaaaugaaugauuaagcauguauguuuuauauaaaugaugaucuuauuuucuuauuuaggacauaguauccagacauauuucugagagccaugaaaaaggagaaaauguaaagucaguaaacucugguacuuggauagcaucaaacucagaacuuacuccuagugagagccuugcuacuacugaugauguaagcugauaaugauuagugaauuguagauauaauuuuaguaugcaguaaauaaaaguuaaauagauuauugucaaauuguagguagaccuaauauauuugauuuucagcuuuuuuuaaaacuuggguauaauguguuauuuuauuuugagggcgagauauaauaugcaaucaaaauaugguagcaaacaccaaaaauuauguauguaugauagauuaugaggucugagauagccauauuuauguuguuauuacccaguauaggggcugacucuuaaaagacauuuacaaauguauguuguauuuauuuaagacauucaguaaaacagguaucagauuacaguaaaaacacuugaaugaauaaauacaggauaaaucaggucuuuggguuaaaaaaaaaaaaaaaagccuagacaaaagucuuccaggaaaaaaauuguaauuuaauguauucuaauucauggagaaaauuuugaauagaguaaaaaggaccuggaaauggagaagagugcuaaggagaaugguauaaauucaguaagcuguguccuccaaauagcacuuagcacaucguugauugaauaacagugacagaacugcuaguauauugaggagauaaugugcuagguguuugggaaucaccuauuucaagguucaggccuugauuuuauuguaaaauauuucauguggucgugggauagcaaauacauuccuuuuuuuaugacaacucuagcaccuagagauacauggguaagaguuucguaguugauuagcaaauaucagcuauagguagagaguuggaauuuacuguuucugccuuuuguugaaguguuaauacuaaguuuuuucugaagccaguguuuucucaaaggauugucuuuccuuuucagauacaguaauuucugaguuuuucugaauuuuugcucuuuaacuucuacucguguuuaaaauaauaacuuccccagcucaucuuuucuguuuaaaauguuuucccacuggacucugacuccuuuaguacuauaacauaaaccugugucuaaaaacuacaugguuuuaauuaacuuugcaaugugaaauguaaauuagugucagucaguguuugcuccuuuggauuguuauaacuaauugaaaauuguguauuccuuuuugugggaaaugaaaugcgaccugcuugaauacauuaaaaauagauguuaaauuauauuaagguuuauugggcacugaaacaacuugagagagaaugaacagucuccauuccuagacguauuuuucaauaauuuuauauccuuaauuccagugcuuucacuuuuauccaaguuucauacaggcagcauuacuuccauuuauuuuaagagauuggagcacauugguuugcaccaucgauagcacauuuugaaaguugagcuacaguuuaggauaaaguuaaccuaagaagguuuuaaaguuaaaugaaauuuaaagaugcuguacuacuugauacguaaggacuugggauaguaauuguauuuaguauuacuuuuaauuaaguaacuaaaucaguucuuugauauuucuuccaaaacuuaaauucagcauuaaggucaacaucuucccuuuacuaaugccauuuaaucagcagcaccacaauauccaguguugauacucacagaucugaagcagcaguguccaguagaacuuucuauagugauggaauuguuuuaugucugcauugucuaaugcuguagccauuagcuacauguggcuagcaaguacuugaaguauagcuauuguaacugaggaacuaaauuuuaaauuuuauuuaaauagccauaugguguuuuuuguauuggacagauucagagccucauucucuagaugcuucuaugcuucuugagcuucauuuuuggagcuuuuacaaacguauauuaagauguguaagagauaccucucuugccuagggaagagagaaaugaaagugaaacugggaaucugggagcuguaagucaaggaggauggaguggagacacugagguuuaggaagaagaaaacacacuuugugucuccugcucccgaugauaauaaaaugguaaaagcacaucugucuugaagacuugaagcacaucaagucuuacuugaaacaguaaaaaaaaugguuucccuauuccuaaaauacguuccuuaaugucuaaauuuccuuuaaucagggacaaauguuugauuucauaauugaagauaggaaacuuuaaaaagaucauuaguuaagggaaagaacacaacuguaaaaugucauaaucaaaguguaagugagacacccuaccaccaucacacuauacacaaaauuaauuugaaaugaccuaaagucguguaaaagccaacacuauuaaaacuuuuaaaagaaaaugggaaaaaauuaugaccuugacauaggcuaaguuuucuuaggacagagaaagcacuaacuauaaaagaaaaaauuaagaaauuagacuuaacaaaaauaggaauuuucugcuuuucaaaagauacuguuaugggaaaauaaucccaguauauauaucugacaacugucugauauauagacuguauaaagcuuacaacucaguuguaagacaacucaguaaaaacugggcaagagauuugaacaggcacuuaaugaaagaagauauaugaauggcuaauaugcaaauuaaagccacagaaaauaccacuucacaucaagaauggcuaaaaugaaaagauugacaauaagaaguguuggugagaauguggaacaguuggaacucucacaguccuuaugagaauguaaaauugcacaaccacuuggaaagcaguuuggcaguugcuuauaaacauaaacguggcaugugacccagcaauuucucuucuagguauucauccaagagaaaugaaaauaugcaucacaaaaacacuugcacauuaauguucauagcaucuuuagucaugauagccucaaacugaagcaucaagagauaaauggauaaacaaacugugguauaucuauacaguggaauacugugcagccauuaaaaaauaauuucugaacuucugaaacacaaaacauggauucauuucagaaacauacuaagugaaaagucagacaaugaagaguguauauuggcugguuccauuuguaugaaguucuacaaccagcagaacugaucuacagugauagaaaucaugaguagggugugguggagauugacuguagaggguugugaagaaacguccugggccaguggaaauggucuuuaucuuuagggaaucugguuacaugaguguauacauuugucaaaacucaucaaacuguacauuuaaagugagugcauuguauauuaauuauauuucaauaaaguuuauuuuuuaaaaaugcaaaugauguugugauguuuucuuuucugaugugagacaaccagguagaguaagcuacuagacauuguuagcauuuggagauaggagaaugucccugagaguauagaaauaauguaaaauguuaacuuugccaaauuagaauuuaaucaguagcugucuuuguguguguuuaucuacauaauaaauauucugcaaggcuacuuauaucacuguucucugugacucuguauucagcguuuaauaacuuugguuauauuaucaucuuguuuggacagaauacugaggaaacuuaugaauaucuuuuaaguguacaauuuuauguaaauacuuaguuaucucuguuagauuauuaauaugaaauucuuagaaguauuagugauuuuuguuuguuuuacuguaacuuaggaaacuuuugagaagaacuuugaaagagaaacccauaaaauaagugagcaaaaugaugcugauaaugcuaguguccugucuguaucaucaaauuuugagccuuuugcaacagaugaucuagguaagcagaauuguuuauaaucuuagaaacaacuuuaaguugaucugguccagucuuugaauuggcguugauaaggaaacaagucuagaaaggcgaagugugugugguugaaagaauguggacuuaauuaucuaucagucuaaaaucaagaaucuucugacucuuaacccugugagcaaaucauccaacauuuuugacucugcauauacuaaggaaaugggaauuuuaaccuaccuugcuauguucuugugaaaauauaauguaacuuacuugcuugaguucagaaaauguuaauuuccuuuuccuuaaaggaaaggucaucguuuaaggucaucuaguuaauucaugggaacaauucaggccucaucuaaucauauuuuuaauaaaaauauuaacuuuguaauuugaguuaagcagucaguuuucuuaaauaaccuguagugaaaaccucaaguaauucucaggcauagcaaaugguuuugguuguuuuuuuuuguuuguuuggguuuuuuuuuuuuucccccucucccaucagcuguaaaacaaaagagguuuagaggguugccuggcugcaguggagaaaaaauucgaguccuagacuuggaaaggaaauuuaaggaaaagaaaaauauguagauacuugauacguuucuagacuguggccaaucaaaagagaaccugagaauucagucauuugccauccagggugcuuaguugauaaaauaauguaauguccuguuacucuaguguuuguucacgugaugaagagaagacuuagauuauuucaaagguauuuuuccacuauaaagaaaaggacuuagccuugcccuaucauuacauuccuacuguucgccaaaacaaaagucuuccuuuugcuuauuguaauuauugaggacucagccuuagcugaccucuaaguaaaugcuuauuugggucugcauugaguucaucccauuacagagaaaaauuacuguguggccugccaacccucaccccuuagguugucccucucuuucugaguugccagaauacuucgacuccuacguauuuucuuucauuuacugguauuuuuuuuuuuuucuuacaaaccugcaccaguagcugugucugaaguagacauagaauugggaaauuucauugauaggccuuuuucuuaccuaauuugcuuguuuuagguugcguuguuuucaucagaauuugcaugacauuuuggaauucacuuguauuguuuaaaugaaacaacaaaaugaaauaaauaugggcuucagaguuugauaacuaaguuuaaauccuuguuccuacauugaacugucugugaaagcuugagcaaguuacuuaaauuuucugcaaaugaaaguaaugucaucuacuauauaggauuauuuuaaggauuaaauaagugugacaauguauaugaagugcucaaguaguauaguguguagaacuuguuaaagcuaauuuuccucccuuuuguuuggacauuuuuuuauuaaugcauuuugaggaauauaugaaaaaguucacuuuuacauacucaaaaaauauuuuuguuccaaauguagguaacaccgugauucacuuagaucaagcauuagccagaaugagagaauaugagcguaugaagacugaggcugaaaguaacucaaauaugagaugcaccugcaggauuauugaggauggagauggugcuggugcagguacuacaguuaauaauuuagaagguauauauuuuuguuuucgguagguuuuuggagaacaggugguguuugguuacaugaauaaguucuuuaguggugauuucugagauuuuggugcacccaucgccugagcaguauacacuguacccaguguguauuguuugaucccucacccccuucccacccuuuccccugaaaccccaaaguccacuguauccugcuuaugucuuugcauacucauagcuuagcuaccacuuaugagugagaacaugcaacguuugguuuuccauuccuaaguuacaucacuuagauuaacggucuccaacucuacccagauggcugcaaaugccauuacuuuguuccuuuuuauggcuaaguaguaugcugugguguauaaauaaauaaacaaauauaucugucuaucuacacauauauacauauaccacauuuucuuuauccgcucguugauugauggacauuuggacugguuccauauuuugcaacugcagauugugcugcuauaaacaugcacgugcaaguaucuuuuucauauaaugacuucuuuucuucugggcagauaccuaguagugagauuguuggaucaaaugguggaucuacuuucaguuguuuaaggaaucuucauacuguuuuccauagugguuguacuaguuaguuuacaugcccaccagcaguguaaaauuguucccuuuuuaccacauccacacuaacaucuauuauuuuuugauuuuuaaauuacggccauucuugcaggaguaggaugguaucacauuguaguuugugcuuugauuugcauuuuccugauaauuagugauguuagagcauuuuuucacucaacaucaccaaaaaguuuuuuggccauuugugugucuucuuuugagaggaguugucuauauccuuagccuacuacuacuacuuuuuuuuuuuuuuuuuuuuaauuugagcacagucuugcucuguugcccaggcugcaaugcaguggcacaaucucagcucacugcauccucugccugccaggcucaagugauucucaugccucagccucccgaguagcaggcauuguaggcaugugccaccauguccagcuaaguuuuguauuuuuaguagagaugggauuucagcauauuguccaggcuggccuugaacuccuggucucaagugaucugcccaccucagccucccaaugugcugggauuacaacugugagacaccacacuuggccuuagcccacuuuuugaugguuuuuuuuuuuuuuuuuuccugauuuguuugaguucuuuguagauucuggguauuaguccuuugucagaugcguaguuuacaaagacuuucucacacucuguggguugucuguuuacucagaugauuauuucuuuugccgugcagaaacuuuuuaguuuaaguuccaucuguuuaucuuuguuuuuguugcauuugcuuuuggguucuuggucaugaagucuuugccuaagccagugucuauaagggugucuccaauguuaucuucuagaauuuuugugguuucagguauuagauuuugaagguauauuuuuuauugauuacaaguaauaauaauucuauguaaaaaauuuaaauaugugauaucuaauggugguuuuauuacuacuuuauuuuaauugauaggggugcuuaaacuacaaacauguuucuuuguauuauguuagcauaaaaucaucaaauuuaauauuuuucaaauuucaacauaaaggcauauauguauauauaauaggcuuuguuaggcuaauguauuuucuuuuuaaaaauuagaaacucccguuauugaaaaucguaguucacaacaaccuguaagugaaguuucuaccaucccauguccuagaauugauacucagcagcuggaccggcaaauuaaagcaauuaugaaagaagucauuccuuuuuugaagguaagcaauuauuuuaaaaaauaaacgaaaccuucuauguuuuguuuuuuaauucauacagaagaccuuauugugauaaaguucaacgguauagguaaacaacaacaaaaaaacuaucacccauaauuuuuucacccuaccaacauucucugaaccuuucaguaauauuuuauacacaugugcauauucugccuuuuucauuuacuauaucauaaacuucuuucuagaucauuauuuuucugcugcauuuuuucaggauuuaucaccuuuauuuuuaguuuuaguuuuugugaguguauaguagguguguauauuuaugggguacaugaaauaguuugauacaggcaugcaauauguaauaaucacaucaugguaaaugggguauccauccccucaagcauuuaaccuuuguguuacaaacaauccaguuauacucuuuuaguuauuuuaaaauguauaauuaaauuauugacuguagucacccuguugugcuguuaaauaauagaucuuauucauucauucugacuacuuuuuguacccauuaaccaucuucccuauucccuacuaccuuucauagccucugguaaccauccuuauacaguuuaucuccaugaguuaaauuguuuuaauuuuuagcucccacaaguaagugagaacauaugaaguuugucuuucugugccuggcuaacuucacuuaacauaaugaccuccaguuccauccauguuguugcagaugacaaggucucauuauuuuuuauggcugaauaguacuccauugugugucuguaccacauuuucuuuaucuguucaucuguugauggacacuuagguugcuuccaaaucuugguuguugugaacaguacugcaacaaacaugagugugcagauagcccuuuaauacacugaugucuuuucuuuucuguauauacccagcagugggauugcuggaucauaugguagcucuugcuguauuuucaguuuuuugagcaacuuccaaacuguucuccagagggguuguacuaauuuacauucccaccagcaguguaugaaaguucccuuuucuccacauccucgccagcauuuauuauugccugucuuugggauaagugccauuuuaacagaggugagaugauuucucguuguaguuuugauugucauuuccgugaucauguugagcaccuuuuaugugccuguuugccauuuguaugucgucuuuugagaagugugucuucagaucuucugcacauuuuaaaauuagauuauuagauuuuuuccuauagaguuugaacucuuuauauaugcugguuauuaaucccuugucggaugguuugcacauauuuucucucauucuguggguugucucuucacuuuguuguuuguuucuuuucuugugcagaagcuuuuuaacuugaugugaucccauuugucugcuuuugcuuugguugccagugcuugugggguaucacucaagaaauuuuugcccagaccaauguccugcagaguuuccccacuguuuucauauaauaguuucauaguaugaggucuuagauuuaugucuuuaauccauuuugauuugacuuuuguauauggugagagauagaggucuaguuucauuccucugcauauggauauccaguuaccccagcaccauuuauugugaagagacugucuuuuccccacuguauguucuuggcaccuuuguugaaaaugaguuuauuguagguauguggauuuguuucuggguucucuguucuguucuaucggucuguguuucuggguucucuguucuguucugucggucuguguuucuguuguuuguaugccaguaccacgcuguuuugguuacuauagcucugugguauaauuugaaggcagguuaaugugauucuuccaguuuuguucuuuuugcucaagauagcuuuggcuguucugagcuuuuuuugugguuccuauaaauuuuaggauucuuuuuucucugugaagaaugucauugguauuuugaucacaauuguauugaaucuguagauugcuucggggaguacagacauuuuaacaauauugauuuuuccaauccaugaacauggaauaucuuucccuuuuugugucuuuuuaaauuucuuucaucaguguuuuauaguuuucauuguagagaucuuucacuuauuugguuaauucuuagguauuuaauuuuauuugugucuguuguaaaugagauuacugguggcauauagaaaugcuacugauuuuuguguguugacuuuguauccugcaacuuuacugaauuuguugaucaguucuaauaguauucuuguggagucuuuaggcuuuuccaaguauaagauuauauauauaucauauacaaacaaggauaauuugauucuuccuuuccaguuuggauccccucuauuucuuucucuugucugauuacucuagcuaggacuuccaguacuauguugaauaacaguggugaaaguggacauccuuguuguguuccagaucacaaaggaauggcuuucaguguuuccccauuuaguaugauacuagcugugggucuguuguauauggcuucuaguauguugagguauguuucuucuauacccaguuuuuugagggcuuuuaucaugaaaggauguugaauuuuaucaaaugguuuuucagcaucaguuaaaaugaucauauggguuuuguccuucauucuguugauaugauguauuacauugauugauuuaccuauguugaaccauccuugcaucccugggauaaaucccacuuggucacgauggaucaucuuuuuaauguguuguugaauuccgagguaucgguuguaaugucuccuuuuucaucucugauauuauuuggguuuuuugucuuuuuuucuuagucugguuaaugguuugccaauuuuauguaucuuuuaaaauaccaacuuuuuguuucguugcucuuuuguauuuuauuucaauuucauuuauuucugcuuugaucuuuauuauuucuucuauuuuggguuugguuugcucaugcuuuucuuguuuuuuaacauccauuguuuucguaucuguuauauguauguuuuuggauuucagguuaccaugaggauugcaaauacugucuuauaacucaguauuuuaaaccgauaacacugauugcauaaacaaacaagcaaacaaaaugaaaacuuaugcaaauguuaacuuuguuucccugcuuuuuaacucuuuguuguuucucuuuauaucuuacuguaccaugucuugaaaaguuguuguagcuacuauuuuugguugguucaucauuuugucuuuccacuuaagaguaguuuacacaccacaauuacaguguuauaauauucuguguacuuucuauuacuggugaauuuuguaccuucagacgauaucuuacugcucauuaaugucuucuuuuagauggaaauaaaguauuuaguauuucuugucagacaggucugguguugaugaaaucccucagcuuuugucugggaaaguauuucuccuucguguuugaaggauauuuuugcuggauguacuauucuaggguaaaaguuuucuuccuucagcacuugaaacaugucaugacacucucuccugaccuguaaggauucuagugacaagucuacugccagauauauuggaaccccauuauauguuauuuguuucuuuucucuugcugcuuuuaggguccuuucuuuauccuugauguuuggcaguuugauuauuaaaugccuugagauagucuuauuuggauuaaacuauccugguuuucuguaaccuucuuguacuugaauguuguuaagcuuacuaccucugucucucucuacccccucuuuaaggccaauaacuuagauuuguccuguugagguuauuuugcagauccuguaggugugcuuuauuguguuuuacuuuuuuuuucuuuugucuccucaaguuguguguuuucaaagagccugucuucaagcuaauucuuuagcuugaucaauucuauugagagauugaugcauucuuuaguaugucaguugcguuuuucaacucuagaauuucugcuugauucuuuuaaauuaucucaaucuguuuauuaaauuuaucuaugaauauagaauucugaauucccggccaggugcuauggcucacaccugugaucccagcacuuugggaggcuggggcgggugaucacuugaggucaggaguuugagaccagccuggccaacacggugaaaccccgccucuacuacaacauacaaaaaaaaaaaaaaaguagcuggacaugguggugcgcaccuauaaugacagcuacuugggaggccgaggcaggagaaucgcuugaacccgggaggcggagguugcagugagccgagauugugccaccacacucuagccugggugacagagcaaggcuccgucugaaaaaaaaaaaaaaaaauucugaauucccuuccuguguuaucuugaauuuguuugaguuuccucaagacagcuauuuugaauucucugucugaaaggucacauaucucucuccaggauuggccacuggugccuuauuuggucccuuuguugaggucaugauuuuuggucccuuuguugaggucgugauuuucuguauggucuugauguuuguggauguuuguuggugucugggcauugaagaguuauauauaggccuuguaucuuguaggccucacagucugggcuuguuugugcccauucuucuugggaaagcuuuccagguauucaaagggacuugggucccaagcccaaaaacacugugcuuuuugcagacucauagcgguauaccacuuuggugauuuuggauaagauccagaagaauucucugaauuaccagguggagacuucuguucucuuccuuuacuuucuuucaaauaaauggaaucucuguguugaaaugccuggagcuggauggagauggggugauggaggcaccccuuuggugacuuaccacugugacugugcugggucauaccuaaagccagcacagcacagcacuggggcuugcccaagacccucuguaaccacuaccugacuaccgccuaaauuugccuaaauucgcucaaggcccuaggguuccuacuauuagcagguggggaagccagccagguuugugucuuucccuucagggcagugaguucccccaggucccuaauggguccacagauacuguccuugagcuuagaaaucuaccugguauucuguccuacuguggcuaagcuggccuuuaaaccacaagacaaaguccuucccacuuuuaccucugcuuuccauaagcaaaggagucucuccugguggcuaccacugugaccaccggcccaugaguucugcuaauauucauuuaaagcccaagggcuuuuuagucagcuuguggugaaugcugccaggccugggacucacccuucagggcagugggcucuccucuggcccagggcagguccagaaaugcuguccaggagccagguucucgaauugcggaucccaggagccugcuuggugcucuaccccacugugaucgcucugguacuuaaggugcaagacaaaguccccuuuuuccucuacuuuucucaagcagaaggaaucuuucaccauagccaucacagcucaguauacguuggaucucaccugaagccagaacaucucugagucucacccaaggcccauggcauacuacauggguaucacugucaguuauucaagguucaagggcucuuuagucagcagguuaagauuaagccaagauuaauccuuccaggacugggucuuucccuuuaaggcaguggguuuccuucugggccagaguguaucuaaaaaugucaucuuggagcuggggccuggaauggcgaccucacgacucugccggugcccuguuguagcuguggcugagcugguauccaagauacaacacaaaguccuuuuuacuccuugcucucgucuccucaagcagaaggagucacuugcauugcugcagucagugcugccugggguugggggagggguggcgucagcaauucaagauggucuuuccuacccucagugucccuuucagcaauacaaaguuaaaagcagguaccaugauugcucaccugguuuuuauucuuauaauggugcuuuuuuuguguguaguuguuaaaauuugguguuccagaaggggaagaugauugguggaggcuucuguucugccaucuugcuccaccccugccuuuuuuuuuaauggauccacaacauucauuccaaaauauuuauaaaaugccuacuuaaugccagguuuggcagaccuagcagugaacaaggccuuuguucucauggagcuugcaugcuagagugggaauacacucugaaauaacauaaguaaauaaaagacauauaaguaacuguuuaucaguuaaugauacaggccaugcucagaauuaaaauuuggugauaugauggugucuguuuuauauuggaugaucagggaaagcuucuaaugagggaacauuuaaguagagaugugacuaaggagccaguguaaaccaggauuguucuagacagugcacuggccuuaaggugagaauuagcuucgcguguugaaggaacuagagggaaagucuauaugguuggaggauauuuguaugagacuaaguugaaagggaggcaagggcuaauuguauaaaauauuacaggccaugguuagaaguuuggacuuugcucaaaguuugaagggaaacuccuagaagauuuuaagcagagaaaaaaagucuggcuuguuuuuagaaaauugauuauaagggggucaggagugcagugagaucagaagagaaaugauaguggcuuagauaaggguggugauaaagaaauacguaauugggauauaguuaggaaaucaguagguccuacuaauggguagagugucgagagagagagaaaacuggcuaggaggaaauacgauuuaccaaaaugaagaaggcuugggagaagggggagaugaagagcucuguuuuuuuugaggggggugggguuugagacagaggcucacucuuaucacccaggcgggaaugcaguggcgcgaucucggcucacugcaacccuugccuucuggguucaagcgauucucccaccucagccucccaaguaucugggacuacaggugccugucaccaugccuggcuugcuuuuuguauuuuuaguagagaugguguuucccuauguugaccacgcugaccucaagugaugcacccgccugggccucccaaagugcugggauuauaggcucgagccacugugccagccaagaguuuuauuuuguacuuuaaaauugaacugucuuuuagacaaucguagagaggucaaguagucauuugguuacucagcuaauuccaggcacagcuggagauagacauaagguagauuauagcauauagcugcugccuaaagccagggcauuugauuugagaauagaaaggggccuugcaacugugaugugggaccaggugauucagcauuuguaaguuguacaaaagcggagccaggguugaccaagaaggacugcaaggaguuaguuauguugauggcugcuaugaggucaaguagucauaaaauacaauuuucuauuaauuauuuuuucagucccuguuguuaaauauuuguguuuauucugguuucuuuuccacuauuacaaacacuuauugaaugauugaagguaaucuguuuacuuuuguuucucuagaaacaauuuuuagacauaaaauuuuuaguucaaaggucauaaacauuuuuaaagcuuuuuagacaagcugauuguccuucagagaaacuaaccaguuuauauucccaucaacauugauaguaucagacugguaagcaguacuauuaauuucauuuaacaacauugaucagggcagauggagacaugugcaacaaauggaauaggaagacaggacuucuuucugagauggcauucauuacauucuaauuuaaaauggaaguuuuaacaauuagaagugaaaaguaauuguuuucuuuucaucuagauaugguaaacuacaaaauacauugucacugggcuaguuucuuauauuguacucauacuuuucuuuguaagacauguaccacagagaauugcuuccauugugcucauauuucuucccucagcagaaguaauugcuuuuuuuuggaauguuuugagagaagagagaucuuugagaaagcaccuguagaaacugcuuucucuguaucugacuuuacagcugagaggaaaaagucagcugaucguguccagauuauuccauguaaaaacagaaacacguagccuuguucugggcaauugcaacaguuccuaaauggccuuacuauccuuuugccgcugcuucuaaccuuucuuuuuuuuuuuuuuuuuuuuuuuuuuuuuuuuuuuuuuuuguggagagaucuguuaaauuuuuuuuuucuuuuuuuuuuuuucuuuuuuuuauuauacucuaaguuauaggguacaugugcacauugugcagguuaguuacauauguauacaugugccaugcuggugcgcugcacccacuaaugugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggauaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauacucauuuggguauauacccaguaaugggauggcugggucaaaugguauuucuaguucuagaucccugaggaaucgccacacugacuuccacaaugguugaacuaguugacagucccaccaacaguguaaaaguguuccuauuucuccgcauccucuccagcaccuguuguuuccugacuuuuuaaugauugccauucuaacuggugugagaugauaucucauagugguuuugauuugcauuucucugauggucagugaugaugagcauuucuucauguguuuuuuggcugcauaaaugucuucuuuugagaagugucuguucauguccuucgcccacuuuuugaccuuucaacucuccuacuagaguuguuagcacuucugaggccuuggcacuugcuaauacuucugccuggaaugcucuuccuucacauaccuaccugcauggcuuguuuucuugaacucaacuguuuggucaaauguuaacuuuugcugaguaaaccucugccuuauccuuuaccugcuuagugcuugcacgccaccuuuaaccuauguaauauuugucugccucuccaugcuaaaauacaagauccaugacaucugagauguuaaucucuuuuggucacuguccaaaaauaguacaugcacauuguagacacucaguaaacauuaaugaauuaauaaaugacuggaaucuucaacccucaacuguaguugagcucuuuagacgcucuaagugugaaaacaacuggcccauaggauaaagaccagguucauugucacucauaaaaccuuuuacagcuuggucuggccucuuaagccuuguguccuacuugacauuauugaaaaaggcacauugcccacauuauguccuuuaccuagaaugaccuucuccucuuucucugucaguuucuccuguuuuucaggagccagcccaaauguuauugcauguguuuacaggcagaauuccuuccucucuucacuguuccugagauacuggauucaugccuucauuauagcacuuaugacaaaggaucauaauuauuuguaucuccccccuagaauaguaucucauaguaccuacagccaagaagcacuuaagauacuggauaaaaagaauuugagggauaaggcauaaauacaucaguuuuaccaaguguuuugugaauuuauuuccuguuacuuauaaauauauguauauauuuaccuuccauaaaagaauauacuuauaaauuuuaagaauauagauuuuuuauauagauauuuaucucagagcuugaaaccauugccucaagugaauugguuuaaauuuucuuaguuaaugcuugcuuucaucuuaggccuaaaguauugccuuuuugcuuuuauacuuuuauuuuagcauuaauaguacaauaaauauuugucaacaugucuuuuaaaaacuaauagguaugcuuguaguaauauuuauuugauauguacaguuacuuuauaaggguuaaaaaaaaagccuaaaugaucuauccuuaugcuuagggagugcagccuucaguuaggaaauugauuguuuuuacuuuuuugugucugauuugauggaagaauuauguaaguuacaugcuaucugcucagaaacuguuauacaauaaaauauuuaauacuugagcgaaauagaagucaccuugagucugugaaauguuuaaaaagucuugaauuuaaaagaauuacauuuuuuaaagugauuuuucuuaaaugucuaagauauuaggaaauaucaaugguauuuuaguuggcuaaaguggcuagugacacucauuuaauagguuuuccauuugaccuuuuaagcgcuacuagcauaucuagaguuaccuaaaucacaacacuuaucuugucaccuuguguaaaaucuaaauuguuccuucucacuuuaccuguguagcccugauuuaagugauuucauuucaugaggaaaugaaauaauaaauacuaauuuagcauuucaaaaagugucugaggccaguaaagaguagaacuaauaaucugauuuuaauuauuuaugaugucucauuucacuucagaucuugacuuuuuuuguaggacuguagaacuucuuuguuaauuaugcccaggcagcauuacacccagucaccugaguuagacuucuugacucucuuuaugucaucacuagugagucaaaaauguauucuccuccuuagagucaucaauuugacuucacuuucuucuuucuaguagcaugaccuuaauucauauucuuaccuuuugcuuagacuaccugucguaauaggcaugaagugcauuuuuacuaagccguguccuacccaaacuccuuagucuucaaguggcuucacugcuggaucuggugugcuuucccccucuagcuacucuccaucuagguacauucacuucacauuauucaacauuuuccauaucuacuguuacuuuuucacguauuagcuguuuguacaaguugucuugucuauccaagagguaaaauacuuucacucuuuucugccuggcugaaauauuucuucagaaauauuuguuguugccuccaguaugcuccuacagcuccuuagagcaccuagugggugcuuuuuaaaaauauuuauuuauucaguaaguaaugucuccugugagccacuguauuuugugauaaauaagaauaccugcaguuaaaaaaguguuaucuaccagacagcacggagcuuauagugauuauuuauauacguaucugacuccugcauaguauuugacucucugaagacagggacaguuguguuguuguuguuguuuuuuuuuuuuuuuaaaucgccugucuugacacauacauuauuuuaaaugagcuuaagucugagaggggaccuugaacaucuaguuuggcacccucauuuuauagauauguauuggugggggggacugaacugagaaaagguuuaggauuugcuuaaauggauuuaguagaauaagaaggauuagaaccuugagauuacuugauaucgaugauuuauggacucaaccucagaaaguuaaccaugauucauauuauuuuguagcucacacaugcuucucaaggaaguuuaagaagagacacuugacugaagugauuuguuaagaaaguuagggggugauguuaacccucaagacauuucagaaugucuaaagguauuuuuaguugucgaggugguguagggaggagguguuacuggcaucuaguggguagaggccaggaugaugccaaauauccuacaaugcacaggaugucaauaaugugaagguugagaaacccugaguuagaaaauaauagggaauuggguacaaggugaguaugcuuguaagaguauuugaaauuaacugaaugaaaacagaaagauuggcaaaauggaaacuagcaugaauaguucuccuuaagguacagaaaaguacagaaagaaagugcugaaaaguacuggaucagccaguucuuuuacuggccaucaucugcuuucgugggucaaaauugccaaaccucucaauacguaugaauaaaguaggaguuuggcuuuucuuaugaauggauauuucuaaacagacaucugaaaauugaggagcaucuacggcaagaaaauuaaaaauuaacauuuuguauuauauggauugauuuucuuuuuuuaaacaauagguaaguuuauauucuaaccaacuaggauuuuucucaggagcacauggaugaaguaugcuccucgcagcuucuaacuucaguaaggcgcaugguuuugacccuuacccagcaaaaugaugagagcaaagaguuuguaaaguucuuucauaaacaacuuggaaguauauuacagguaagaguuuauacuuguaugauuuaccaauauguacugugugguaagguuuuuuuucggggggugggugaggcauuuucuugcauuacacaauuuauucugguggacauccaaucuagcguccauuugggaugauguuguaauacuuuuuaguugucacuugguuaaaauaauauuguauuauuagguccuguuuguaucuucauuuaauuuggucaucucuaaggcaugucucuuauaagcuuuuacugguuugguuuaucuucucacugaaaacauuuugaguuugaaauguuuacaaaguauucuguggcuguuucuaaaauaauuggcuaaaguaauuugacuaaucagggaaauuuuggaagccagagaccagcugguuguagagacuuuuuaggguguaccaguacgcuuaaauuauaguaagucaguaacugggagagaauuugccuucuaggagacauuuagcagugucugcagccauuuuguuuaucacagcaaguaguguggagaagguaggagggcugagaggaggacagguacuggcaacuaauggguagagaccaggaagaaucuugauaaacauuugacaauacacaggacaguaccccauagcaaaguauuaucuggcccuaaaugucaacagugccaagguugagaaaucccauguuaguguuaauaaaauuaccuuguuuauuccauaugacaaacaucuuuaccuuuauauuuaccugaauguuuuuccauugagauaguucagugauguguauuuuuacuccacauuaggugauacauuuuucuucucaucuuuauuacagaauuuucuuaugaaacuuggcuuugcuucuuauuucuguguuuaaacugguuuuagauaaucacuauuaacuuuuuuuaaaccuugggcuugaugcaaauuuguaucacuguaauuuuccauuuuguuaguauuaggacuaaaggacaaauuguccuggccccguuagcaguuauuaguacuaacagauaauuucuaaggacuacaaaacauugaugguguugugcauuguaggaaacuccauuuuagaauaaggcugaaagagaaauuauaauuuaaauauuuuuuaucaagauccauguagcccuuccucaguuuugccuucuaugauaauuguggacagaucccaaagcauuaauuucuaaagacuuuuuucucagucuaagguuugacugcuuuucuuucaucccguucuugauuuuuucacaagaggacauacaugaagaauacaaguuaauuuacguuaaauauugcccagaguauugaaaaauuuuuaugagcuagagcuuaaauuaccaucuucuacauuuuuccuucugaaacccguucaagaauuguuuuuuccacaaagcacccagcauauguacguuuuuaccauaacuguacuagauaagauagucuuuuggugggggagaggagcaggcauugaacaucauaguuguuugccuguuugcuaaauaggguaguccauauuuuagaaggaaaaagaggagugguuuuacuaaaaauguauacaguauacuuccuuauuugaagauucucaaccuaaaauaaucaaaagggucagaaucuacuuuaaagagaguuuauucaagcacaguguuggagggauagcugccugggaagcacagauuccaaagaauagacaucagaaguuugggaucauuuauaucagggguccccaacccccaggcuggugagcagcaggcgagugagcaaagcuucaucuguauuuacagucccuccccacggcucucauuaccgccugagcuccaccuccugucagaucagcagcagcauuagauucucauaggagugugaacccuacugugaacugcacgugugagggaucuagguuacaugcuccuuaugagaaucuaauuccugaccugucacugucucccaucacccccauaugagaccaucuaguugcaggaaaauaagcucagggcucccacugauucuacauuauggugaguuguauaauuauuucacuauauguuacaguguaauaaagggcacagucagucaauguaaugugcuugaaucauuccgaaaccuucccccaagcuaugguugggggaaaaguugucuucugugaaaccagguccuggugccagaaagguuggggacugcuaauuuauguggacagaguuuagagaagcuuaacagaguuucagcaucuuucuauauaaggcuuuaaugcauaguuacaacagucuaauuaguugaggugauguuuuuguuucagaaaagguggaagaugagucuuuucugcccccugaucugacuuagguacaggacaguaaaggaggcaguuaaucuguaacaaacaucagugguugggaggcaggaggucuggucucuugaucuuuccuagucauuuacagaacaagaacagugaggaaaagaguuaauguguugucuaagaagaagaaaucaccaacguucaaguugccagggcuuaacuuccuccuugacauaauaaauguagagggucuugaaauccuauuuucuuuuacaugauccuauauaucaacuugaauagaacuaauguuuacuuuugaagaaaaauuuaaauuagaaugguugucuuaaguaaaggaggaagcuuuaaacaugauccuauauaucaacuugaauagaacuaauguuuacuuuugaagaaaaauuuaaauuagaaugguugucuuaaguaaagguggaagcuuuaaaaguauucuaaugguacauuuagagguggaagauuuugucuuuuccuuucauagcacuuaguauuuauuacuguaguauauauuguaucuccuguacugucagggaacuuucugguauuagaaaucccugucugaauucauuugugcccagcaguuacaucaaauagggacuaaauauagaugaccauauauguucuucccuuguguauacucuuuaagcaggacuagcaacauucccacuuaguaauauagcaguauucuuuaguaauacuaacaaccuaucuuuccuuaguaaucauaaacauuaguuuuaaguuuuucaguacuuaaaaguaauaguauuuuauaauugaaguuuacugucuuuaaaaauuauuugguuuaucuuugaauaggauucacuggcaaaauuugcuggcagaaaacugaaagacuguggagaagaucuucuuguagagauaucugaaguguuguucaaugaauuggcuuucuuuaagcuuaugcaagauuuggauaauaauaguauaacuguuaaacagagaugcaaaaggaaaauagaagcaacuggagugauacaaucuugugccaaagagguaaauaacguucauuuugauuuuuaggauaauugacacauaaauacaguucuugaucauuauuauuaacugaaaucacauuuuaccucagcaaaaguaguuguuuuuaguaauaccaguuaaucacauuauaagucauuacauaugcuagucacuuguggaauuugaggacuaacagcaguugcuaaagaucaggaaugcgggcaggaauugauguuaaauguacauugucagauaaccaguucacauuauuguccuguauucaggucuugaaagaugagagaaggacugggaucugauccugggccagugccaggugccugccaugucuguuauugaucccuguagauucuucgagaauaugcauuacccagaggucacucccagucaacacaaaugcuuauuaguuagggcuuugguuuuaccucccuguaguuuguucugccuugucaaauuaauuuugaucacaggugagauuggaugacuguucugccucaaguugaggcauaccaggaagccuuuucccuagauguguacccuuuuccugacccucuuuuaugagaaggaaacaagccaagacccaaacagagauggcucuucuuucuuagaaucuaaaguagacgaagucaggcuguccauuucacacuuuucaugauauuuauuuucuggauauaaauaaauuucagacguugcuaagagcuugaugaaaauaaaacagcaugauacuauaauaaaugauuagaaaguaauacaggccaggcuuaggucuauaaucccaguacuuugggaggcugagacaugagaaaugcuaaauuauguaucuaaguauguugcuaaauucuguguaauugauuuguuuuaaaggcuaaaaggauucuugaagaucauggcucaccugcuggagagauugaugaugaagacaaaguaugugcuaauuaauuuuugccuaaaaauauggcugggcgcgguggcucacccccguaaucgcagcccuuugggaggccaaggcggguggaucacgaggucaagauuuccagaccagccuggccaacauggugaaaccccguccauacuaaaaauacaaaaauuagccaggcgugugccuauagucccagcuauucaggaggcugagacaggagaauugcuagaaccugggaggcagaggugguauugagccgagaucaugccacugcauuccagccugggcaacagagcuagacugugccucaaaaaaauaaaaagccuacaaauaaugcuuuugaaacaauauaaaauuauuuuaacagcuuucaccuuaauguuugaaagcagacuguaucaucaaaugaccuuuuuccugacacuuuuuuauuuuaaaaauaaaacuagacuaucaaaaaugguucuuuguauuuuuuauuagauaaugaucauuauuaauacgauagacuuacuauauaccuuuuacacauguacuuuaaggaauuaauuacucaaauauuuuugugucuaggacaaggaugaaacugaaacaguuaagcagacucaaacaucugagguguaugauggucccaaaaauguaagaucugauauuucugaucaagaggaagaugaagaaagugaaggauguccagugucuauuaguaaguuuaaaggcucuguacuaucuuuauacuuuaguuuuuuguaggucauuuauuggaacaguuugguggaguguaacaaguauaaaauuaagugucaaagaacucugauuuugaauuucacugugacccugacuaaauuaucuagacuuucugcacuguaaguuuuuaauacauucuguuugaggauuucagauacuguauauaaagcaucugugccaugcaggaaugcaguaagugguagcuauuguuaagauuaugugcugaaauuuacuaaaaauuguguauuaaucaacuuagauuugucuaaagcugaaacucaggcuuuaacuaauuauggaaguggagaagaugaaaaugaggaugaagaaauggaagaauuugaagaaggcccuguggauguccagacuucccuccaggcuaacacugaagcuacugaagaaaaugaacaugaugaacagguauucccguauugacugacacacuuccaucagccuuauuuuaacuaaucaaacuuccaucagccuuauuuuaacuaaucaaaguagauccuucuaaauauucagguuucaugaaugcaagccucauuaauaugcuuauuaaaaucugaaaaaccaguuuauuuuuuaugauuguuuuuuagagacagggucuugcucagucuucugggcuggagugcagugguguaauuguagcucauugcucauagccucaaacuccugagcucaagcgauccucccaccucagccucccaaaguucugggauuacagacaugagccaccacacccauccaauaauuuauacguuuuaaauuauacacuguuuuuaguggugugauuaaauuucacaccggcccucuccuuccuauuuggguugugaaucauuccauuguccggcaugucuacacuguauacacuaccugcuuguuaaucacuuaauagccaucuaggguagcagauagacuugcaguauaacaguguucaaacaacccuuauuugacuuaauggccccaaagcacaagagaauuaauuauucuauuauuaguuauuguuaaucucucacugugcuccauuuauaaauuaaacuuuaucauagauaaguguguaggggaaaaacaguauaaaugggguuuggugcuauccacaguuuuggaacauacacucuauggaugaggcggugcuuuuuuauauguuauuuuccucccuggucuagaucuuuucuucuggaguuggauauuuuacugugaugugccuuguuggggucuuuuuucauuauuugcaguggauacucagugauuguuuucaaguugguaaauuuuuaaauucucuuuauuacugccacaccauuuucucuuuucucuccuucuguaauuaucagauauuauuaguacucauggauugaucuucugauuuucuccucuuuuccuuaucuuuugguuuuacuuugagagauuuucuuugacuuuaacacuuguaugaaauuauuuuuauuucagcugucauauuuuuaacuucugaacacuuucuuuuuuucugauuguuacuuuuuaauagugcccuguuauuucacagaagcauuaccuuccguuuucaaaugucugcugaaccuugguucuuuauauugaacagugauauaucaaaaagcaaguuaagguucuuuugggcuucacugcagguagggcauuuggggagacagccagcauauuccuacaaacuucuaaauguuaguaucuauuggucuuuucuuugagaugguuuagauucuucaaauuaggguccuucacugucguccugccuggaguguaugagcuuggcugcugauauucugaagcuagauugggaauggggcugaggucccaccguuauacaggcaugcacuagauuauucuguuuucaguauucuauuuagguuggugcaaaaguaauugugguuuuggucauuuucaauagcaaaacccacaauuacuucuacaccagucugauacuuuacugugucauuugugucuccaccucuacucccaguggccccagguuuggggcucacuaguuuaauuucucuaaaauauaaucugccauuuucuguugaggugggaggagagaaccuacguaggcacauuuuccuuaaacaguuuuaaacaacuaccaccaccguuucaucuccagcuccugccccaacaucaucaugucuuccuuucuagaucuguuacuuacaguuaugaggugaaucucaguuuuuguuuccucucccugcugaaggcauuuagcuuuguucaucuuccucucgucacuuccuccuucauucccuucuugucugcauuaagugucuuuuagagucugaaaaaaaaugaacagugcagucuguucguuccaguuguauuauacuguguguguguguuuuuaaggcaacaaggaaacccuuuaacuuagccaucuugaaaucacaaccaaagccgccuccuugaaauaguuuuagaagauacuuuuaaauuucuuuguaugaaggucuuggguuggacaaaaacuacacacuaguaaucaucucuuuuauagugaccauauauuucaggcccugcuauuaaaacauuuuucccuucuagguccuacaacgugacuuuaaaaagacagcagaaagcaaaaaugucccauuggaacgagaagccacuaguaaaaguaagaaaucuaaauaagucuuugauuuuaagauaauuuccuuuauuugcuuuaaagcuaaaaaaaaaaaaaaaacacacacagaaaacacuaaaauucuuaguuugaaaguacuuuggaccugauguauguuuuucuucucccuauaaauccuuuguagaaaacauaagaauuuguuucuauaaacaauaaagaaaaggugacaaauauuuaccugcacagacaaaaauucugucaagagcaucgcaucuuuagauacaaauaaugguagauuuaaaaaaaaaaucuauuuguaggccuuauuacugaaaguccuaauuuuuuagaaaucagguggauuucaggaaucugagucuuaaaaugcucccaggugauuuugaucaacuaaauuugggaaccauugauaaggaaaauuuguaguugccuuuucuuuuuggucuuaaauaucuugauugcucuuauucaggcguauugucuuuauuaguauaauaguaaaauuuaacauuuuuugcauuacacuaauguuaagacuuucuuuugaugacagaugaccaaaauaacuguccugugaaacccuguuaccucaauaucuuggaagaugagcaaccuuuaaauagugcugcccauaaggagucaccuccuacuguugauucaacucaacagccuaacccuuugccguuacguuuaccugaaauggaacccuuagugccuagagucaaagaaguuaaaucugcucaggaaacuccugaaagcucucuggcuggaaguccugauacugaaucuccaguguuagugaaugacuauguauguaucauuuacauuuccaaauauuuuuacuuuucauuucugugcauauuucuucauuuucagauuagcauucuccacauguaaaccauuuuguguuuagguuuagaacauguuggaacauuuuucuaauucacacuuuaacuuuagcagaaggguaauagugaauuaagaugaccaucucaaaacccacaugcuguuuuauaauuuugagaaccaaagggauaaaaagauuucaucuuaaguucggcucugaagugguaaugaugcaugaauccuccuuuauccuuuauacuaccuauucuucucaacuguuuagaauauauugcaaauuuucaauaaacuuaaagguuuacacuugggauaggaaauaaaacaguuugacaacagaaucuuuauacagugaaugauaaaaaaaaaaaaaacuaggaaaucuguacucaugauaguacuuacuaaaugaaaauucaagugaagcccaggucugaaaaauacuugagcagaggaaagcaaaaaccuuuaaaguaauuaaucuugcuuaagcugcaaacauaaaugaaacuucacuugggucauuucugauaaaugcuucuguuagaaccaaagcuuaaccccagccugucauaaguagcccccuaacauauggauaugugacuagggacuuucugagaagguacuugauaaaagacaauuuuguaauugcaaaccaagcaaauaauuuauuuuacuuccacauuuuccaaauaaauacuugccucugauauuuugucaguggaacacuaaaucucuuuuggucugguguucccacuuccugaauugcuucuuacucaaauaaacuguaaaauuuuauugugucucagauuugucuuuuacaguuuggugucagaguaggauuugaaagagacccccuguggccucuggaagcaucgaggaaccaggcaaaagguguccauugugcucacugcuuucucgcugcaucuggagguccuggguaagucccucucggauuucaggcuccacaguuuguguccugagcucucugaguuuaucugaguaauuuuauuuugagacugagucucgcucugucauccaggcuggagugcaguggcgcgaucucggcucacugcaaccucugccuccuggguucaggugauucuccugccucagccucccgaguagcugggauuacagacgugugucaccacacccggcuaauuuuuuguauuuuuaguagagacaggguuucaccguguuagccagaaugaucucgaucuccugacauuguaauccgccugccucagccucccaaagugcugggauuacaggcgugagccaccgcacccagcuggguaauuuuauuuuuuacuggauccagaggucgaacuagauguuugacaguaacuagacuggguccaguuggcagccucagguaggugagguuuagaaagauaggguauuauggguucauuaacaccuaaagacucugggaccccucuuucuagaacucuagcaaauuuuauguuuagaaauuaggaacaugaaacuaugccuuuaacuaugccuuucuggagaaaugguuacacuuuaccagagaagagaagaguuaaaguuacaguggagaaguuuuaaucuagauaaaauuguuuauggggacauuagaaaagaagggauccuaaaugccuuagaaacaaugggaagcaguuuuugauuguuguauacaggcuucuaaaagacauaauuccaaaauugccuugcuaaaagauuccuugcuaaaggcaaauaagacagaugaaaagcuuaagcagugaauugacaaccaaaauaaaaugaauuguauguagggagugauuucacucugaccuguuacucugcuuauccuccucuaauuauucugaguccacuaacccauuuguucagucaucuuaauccuuuugcacaauuacccuuucacucuggacgaugugacagaaaggaaguuaggcuaaugcuuugcuuaguuagacccucagccaggacaccgaggucuggcuccuguaaguacuuuuacuucugggucaaaagcugaacucagagccauagcaaaagauuuuccaaaucccaaggaaaauccaaaacaguuugcugaggaauguagauuuagaaugacccugggcuuccugauuucugucaguuucuacgcaugauauuagccacuggggaagcauguuaauggaugacuacggcaggauggcauaagccucagaagaguauugccaacccuuuaagagcuacuucuguggauagcccaaaagaugcuacaaaaacaacuggaaaacaucuagaagcuauccccauggucuuuccacaaaagauugacuaguccaaaaaguugaaucuauuucugauuacacggcuaaauuggaaaucucauuuguuaaacauucuggucuuaaaauacagcagggaguauuuccugcgggaacugaaaugguuuuuaugguuuuauucauuaauagucucugacuagagucuggugacuugauuaaaaaacacaagauuggauggcaagucacugauauggcuauauuagucaccauagcugaacauuuugagagaacauuagaacuagaaaaaaaucaguuucuguaaagaggccauugaagaaaagagucuccacgcuugaccaguccucuaauggaccuaccuguguugggccagacuauuuccucauuagaugaaguucccaaggcugggccaggcauggugguucaugccuguaaucccagcccuuugggaggccaaggcaggcagaucaccugaggucgggaguucaagaccagccugaccagcaugaauaaacccugucucuauuaaaaauacaaaauuagccaggcguggugacacaugccuguaaacccagcuacacaggaggcugaggcaggagaaucguuugaacccaguggguggagguugucgugagccaaaauggugccauugcacuccagccugggcaacaagagcaaaacuccaucucaaaaaaaaaaaguucccaaggguuugacucugaagacaauaaucaacaccaaugggacaucaagggauucucugguauguuacucuccauaaggcccuuaaacaaacauggggaggaaacuaagaucagcaucagugggagucacguacaguguugguggauaccuuauccacuuucaaccccaugcuaauaaaucagccagucccuuggaggaaagaaaauauuucacguuuccaaucaaguucagagaauccucugugaaccagucuaaaugacaguuggacuaaucucagaaaagcaugccuuccuacaauaugacacuaaauugagagggcacuuaaaguucucucuggaaggaaaguuaauuuuagagcuuccugacccuucuaaaccugaacugcucuguuuccuacaagcaggaauugaucauauugaaacucacucuuauaccaaccuagaccuuucugaaguacccagauguuugugggcuuguuucucaacugacaaagggaagauuaaaagugguaagccuauaaaaauacaaauacauuauuccaagccauugccuaaauugcccucaugcccccuagggucagaggcaauccaagggcuuuacccaguuauagaggauuuaauaaaacaauuccuuguacuugucucuauaauacuauaauccuacaguuaagaaauccaucacaccuuuaaucccagcacuuugggaggccgaggcgggcggaucaggaggucaagagauugagaccauccuggccaauauggugaaaccccaucucuacugaaaauauaaaaauuagcugggagugcugauguacaccuguaguccuagcuacucaggagacugaggcaggagaaucgcuugaacccgggagguggagguugcagugagcugagaucgugccacugcacuccagccuggccacagagccagauuccgucucaaaaaaaaaaaaauauguauauauauauauguguguguguguguauauauauauauauauauauauauauacacacacauauacauacacauauauauauauaaauauauaacauauaauauauaacaaaguuggagauuuguucaagacuuaaacauacaauaaauugucaauccaagauuuccugcuauuccaaauccuaacacuuuguuaucuaaugugccuacagauucuaaaugguucacaguguaaucuuucuuuccucugccuuuuucaguauuccaguaagccaguaguucucugcuuauaccuggaagaaccagcaauauacuuggacuguagugccacagggguucgcugaagcucuaucuuguuuuucucagacauuauaccaagaccugucaaccuuacaauuccauagaaauuguauucugucuauauguagauaaucuuucauacuuuuagcuuacaauggacauaaggccucaauggcaaaacuuuaguucuguagagcggcuguccucagccuuuuuggcaccagggacugguuucauggaagacaauuuuuccauggacugggguaagggggaugguuucaggaugauugaaaugcauuacauuuuuguauauuuuauuucuauuauuauuacguuauauaaugaaauugguauacaacucaccacaaugcagaaucagugggagaccugagcuugucuuccugaaacuagauggucauaucuggggaugaugagagauaaugacacagcaucaggcauuagagucucauaaggagcacgcaaccuagaucucuggcaugagcaguucacaauaggguucaagcuccuacaagaaucuguugccgccagugaucugacaggaggcagagcucaggugagaaugugagugaugggaguagguuuaaauaaaggugaagcuuggcucgcuggcuccccccaccacucaccuccugcuauuuggccugguucuuaacaggcccuggacugguacuggggguugcagaucccugcuguagaguaaagguccauuacauaggaugugaucugacugcagagagaauuuuccucuuaacugaaauaauaaaaacaauccaaggguucccuaggcccacaacuaaggcaguuaagggaguucauuggucuuaugggauacugcagaucuugagucccacauuucucugcuggcuucccccuugccugaauuuagaaaaaucucugucccagagcuuugccaugggaagauaauuaggaacaagcuuucaauaaaauaaaccuggccuuauaaccccuucagguucaggauacccaaguuauuuaaaaccuuucacuuugggauuaucaaauaugauaauccauccuuaggaguccuuacucagaaacguggaggaagcuacugacccauugcuuauuauacguuacaguuaaaucgaguugucagagcauauccaaaccaucuaaaagcagugacagcagcagcuaaauugauaggaacuuuaucugaccuaguauuagggaauaaauguuaccuacaaguuacacgugcaguugaaagcucauuaccuuccagucagauccaacaugucuuaauaaguagacuaacauuuuaugauauccuucuccugucaccuucuaaucucuaucucagaugucagucugcuuaacccuaccacuuugcugccucugucugaacaauaggaagaccaaaacugugugugugguaucauaacuauugacuccucacauugacuuauggaaaacuucauuaaauaauucugaauaaauacauuuuauugauggauccuaugaaaaaacuguagagaagaaauacugagcaagacaugcuguaacaacucaguaugaacuaauagaaaagggaauucuuucucaguuuaagucaggacaacccgaagaauuacgugaucuaagacuuaaccauauagcaaaaugccaaucauuuuccauuuauacagauaauagguaugccuuuggagugagugaugauuuuggaauguuguggaaacaaaggguuucucacuuguaguggaacccccaucaguacuggaccucugccagaugagcuucuuucagcuauucugcugcccucacaaguagcucuuaauaaaaaugaugcucaugcucguaggacugaaccugaguaucaaggaaaugcauguguggacuuuuauggccaagucugaaauugacaaaauaugcauuuugaaugaacuccacagaauugaccaagaucaaaucacucaggauaauuuguucaguaaacaaugcugugcacuugaguugaaacaacaaaaauggaaucuuaaagguugcaaauuucaugcucaacaaggacucagugaaggcccagacagccagcugguccuuccugaguccuucaaacugucauuauuauuaaaggcccugcacucuacaaaccaucauggugaagaaaaacguuucagauuaugaaaaagauuaugaaagcagaaauggcuuacagcaguguggcuugucaaacucauaaagcuggaaagacccuuaagauuucugccaccugcuagaccauauguaggucugcagauggauuucauucaguugccacccucauugagguaucaguacauucuugcgguaguguaccuguuugcaagauagauugggacuuacccuuauagaaaggcugaugccacaacaguagcaaaaaauucuuaggaaauguauuuccuuuauggggcuuuucuggagagaucuccaguaauaagggaacucauuuuccugaacagguuaucagauaaacaggauuuucaaacucgguggcacuaccauuggccuugucauccucggucuucuggaaagcuugaauggacaaauuguaucuugaaacuaaaauuagcuaaauugucagcuggauuaccuuggccaaaaauuuuaccacuagcccuaauggcaauuacaucaaccccuacagaaaaacacaaauuugaccccuuaugaaauaacuggaagaccuaugccuuuaauaccagaaccccauguaucaccuguauuuguuagcucugaaaugacucaauacucuaagaccuuaauggauuaugcaaaagucuauuucuaccagcugaaggaggcuuuuugugaacugccuaccagugaugaucuaugacuggcuuccauaacuuagaacguggagauuggaucuuuuggaaacaacagcagagaaaaauugcccuugagccucauuggaaaggacuguagcagacagcucuuacuacucacaaugcagcaaaacuucaggguuuucagccuuggguccaucuaucucaaguagagagagcuuccuuagacucuuggacuugacaaccuauaggugacuuaaagauauaaaagggaaagccuuucccuaggagcagguggcaucgugaaguaaacaacuuaccaccacaaugaaacgacuacauuuaaaacuuuucucauuaaguuuugauuugguuuugcauuaacacaaaauguucaaacuuuuguugggaacuuuuccuacucaaacagaauauccucuaaggucugauguucaaagaauagccacucucacucaaccaaagcaauugcuggccauguagucauauagaugaauggaaucacaacuaauaccgaaaucuacucccacacacacuugggugagcaauugguuuuaugaaaagguuugguauccuuccccuagcagguugguugauauuuaugguugacugacuucgcacugggaagaaguuacagaagcaaagguauguccuguaacuacuauugauuuuauugcugguaauuuuaucacuauggacagaaaaccuuaauggaacugggccuaaucuagccaggguuccagucucccuauaugcagucagacuuuaugauuuaacaccaauuagggagacugcucuccuauauaaugacacauauuuaaaaucagaacuucaccaugauacccuugacuauauuaguagagaacggacugaaacugacauugguucaaaggaaacucuagaggcaaauggaauaccccuguaguuucacuguauacaauaggguuuuuaagaucaguauucagggcauauuugaaaaggaaacaagucauccuuauuuggcgaugguacccauguguaauacauagaaguguuuuuuuauuccucuuucuauuuaaaucauaaccauucuaccuggcagugugcagaugcagauaugacagagaauaaccaugacaaucacaucauucccaauugguggguaauaggaucuccuuugccccuuucucucaguaauacuggauuauucaucuuguauggcaacaaaauauauaaauguuuucaccuauauggucuggacacugugguuugggcuauuuccuaccuaaaaugaccagauaugacucuuuaaaugguugugaaauucuuaaucugggguuguuuguacaugaagugaucccuuacaaaagaacucccugugaucucccaaacucgaauauaugaagggguucuagauuuuguucuuugguaagaucgcuuuuucuuuagcuggcagucucugaauuggaaaaauggcuuauggauauuucagcaacccuugaaaaaaaguuuuaaugauacuuucgauacucuucaagcaauacaaucugagaugagucauuuggucucacuggaacuccaguagaaguuuagcugcucacagggaugagcuuugggugaaacguauuguuuuuauguuaauuagauauuguugccccaaauuuaaaagaucuuaauaaaucagaauuuuuuuuaucagauaagcaaggccuccuccauugauuuauucaguugguuaaauuuuaggccccugggaaucuuugcuuagagggaucuuuaaguucuugcuacaguuacuguguuuucuuccuuugugcuuuauauccccacaagggguucaaaugcuuuccagcagccacucacacgucagaugauugccaucagggaagcuaacacuguguaaacuugauggagggugcaugacugaaucccaacauaacuuuugaugauaacaacuuuaccugacuuuucaucccaacuucugugucaguagugguuacaggauaaugcuacuccauuuggccacccucaagcugagagggcagccaaaaggggggaauuguuaaagcaaaauuaaaauggagaucaggccugaaaauaccugaccaaaacccccauaaaacaaaggccuuuaaaacagccuuaaucuuccuugaauugcaaacauaagugaaacuuaacuugggucauuuccaaucaaugcuuuuguuggauagaacuaaaaggaguuugagagcaaccugggcaacauaguaagacccugucucuacaaaaaauuaaaaauuagccaggcgugagagugcaggccugugguccuagcuacucaggaggcugaggcgggaggaucacuugagcccaggaguucuagacuauggugaacuaugauugccccugcugcauuccagucugggcaacagagugaggcccugugucuuaaaauuucuucuuaaauauauauuuacaguuaugauucauaauuucuuagaaagggggcuuauaaucuuugaaaaacguuaguacaaagaguaacucuucuaacucuuuuguuugccucacuacgaguacaauuauacauuuaaaacuucgaaaauuacugguuagauuuauucuuaucugaucauugucuaguugccauagaagacauuuaauugaaauuaagucaaagguagauuauaaaagcucuugaauuugaauuuuagucagggauccuacugaauguuuuugugcaaggaagugaaauggucaaauuuaugggcugugaagauuaaucugcugacuauagcauauacuaucaagcuagauugggggaucuacuauuauauaaguaugaaauauaagcugaacaggagcagggugagaaacagugcaagaagaagaaaaaccuaagauuucuacuuggauaauugguagaauuaugauacuauuaaaaaucagaagggagaacuaggagggaaaaaaauagaauucaaguuuaggaaaaacaguuuaaggugaucacaaaagacaguuacuaaauucauaccucagcuuucuaacagccccaucagaguugauacacugaaaaguuuguaagugguuacuuacauucugcuggguacagcucucguguucaguaaacauaugaaaaaacaagaguugucuuucuguuuuuaguccugguuguaacuauuucuucagcauguaugaacugccccccugccuuuuuuuuuuuuuuuuuuugugacaaaaugguaacagcuugacaguauguuucacagcugugauuguagcuuuuccuaugaacugcauauuucuaaauuauucauagagcugaauguagaagaaaacgaaaugugauagaauuacugagaaaauaauucacuauuucuuuacauggaugacugguuuggaucuagaguauguauuuuuuuuuuucauuacauuacaggaagcagaaucugguaauauaagucaaaagucugaugaagaagauuuuguaaaaguugaagauuuaccacugaaacugacaauauauucagagguauuuagcugucuuuaauuaaacuugucuuuacauaacaaauacuguuaaaaugaaaaaugauuuguauuuuuaauuuucauuccaaaggcagaucuaagaaagaaaaugguagaagaagaacagaaaaaccauuuaucuggugaaauaugugaaaugcagaccgaagaauuagcuggaaauucugagacacuaaaagaaccugguaagaguuaucaauuuaaaucuugccauauugaaaaaucauugaaucuucauacuacuauuguguuuuauuuuuuaaauaugcuacuacugaccugggagauuuaagccaaauacuagaaagaaaguguaauucuguaagaauuuuaguucaacuauuuauaaaacagugucagauaauuuuuuucuauucacaucuuuaguuuuaaaaaauguagacaugcuggcugggcgcgguggcucacgccuguaaucccagcacuuugggaggccaaggcggguggaucacgaggucaggagauggagaccauccuggcuaacauggugaaaccccgucucuacuaaaaauacaaaaaaucagccaagcgcgguggcgggcgccuguagugccagcuacucgggaggcugaggcaggagaauggcgugaacccaggagguggggcuugcggugagcugagauagcgccacugcacuccggccugggugaaagagcgagacucccucucugaaacaaaaaaaaaaaaaaaaaaaaaaaaaaaaaaaauguagacaugcccaugguuuaagaaagguacaaaaauauuauaaauagcaaaaacccacuuuuuuuuuuuuuuuugagacagagucucugccaccgaggcuggagugcaguggugugaucucagcucacugcaagcuccuccgccucccagguucgcgccauucuucugccucagccucccaaguagcugggacuacaggcgcccgccaccacgccuggcugauuuuuuuguauuuuuuaaguagagacgggguuucaccaaguuacucagauggucucgaucuccugaccucgugauccgccugccucagccucccaaagugcugagauuacaggcgugaaccaccaugcccagcccaaaaacccacuuuuuauuauugauuuuuaguucuuuaggagacuauaacucuaaauauuaugauucuuaguuuuuaagaugcagauaauaccucuuuucuacccgaugacaaguauguaucuagcccuaccucucucuccuccuccucucaguguucauauuauuuuuguuuguucuauuuuuuacuuucaauuuugguuaaguauaugugcauuuuguuccaucaacuuuggucauuaucccuugcugcuccuccucugcuuucuuccugguucucuguucaguuuuacccauauucuuacauuacuaaggcuauuauauacgcuuacauuuuguuuucguaauauaauuaaaugguucuauaccuucucugagguugcuucuauauaaauaucauucauuguagagccaagcgauagucucagauuuucuguaugagucuaauaacacagcucuggagccacucaauguuucuugcaucaggaucaaaggguuuucuuuuuguuguucuccaucaguucaucaguugaugaaaauugcaugauaucucauuguuuuuguuuuuccuggaaauggaguugaggagaaggaaagacccuucagauaucagaccuucaguuaauuucuguuuucagcccacuucuaccuguuagaauaugguacccuucucaguugcagccucuugcaaguguuugaacugcagcuuccuccacugucauuggguaugcuuccaucugcauugagcauucugguaauuuguugauauccccucuucuguuuucucacaaccagucuuuuguugguguagauuuauucuauucuauaguuguuuucuuuucauaguggaguguuuuuagagagacacgaaguaucugcucagucugccuuguugaaucagaaacgccucaccuauucuuuuuuuacugugugcuauuagggaauuguauuagcaagcuaauuuaggauuucuuuuauaauaacguuauauuaaaaguaaaagcuuuaaugacagagaacaauguuaaauucuaguaauucgauaaguaauuuauaaagcauuuuuauucuguuuuucagaaacggugggagcccagaguauaugagaugucuucagaggcucaucuaacucuguccuuacauacucaaugcauauaugaaaacaauacuaaauaaacaucugaucuguauaaaaauguaaauuaguuugacacugcuuuuuugauagguguggucauuucuccccaugguaguuuaaaacaucagaaacugaauucuggacagauuuaagccuugacacacuguguuuuuuuuuuuuucccccuucuuuuuugggucuucauuuuuuuccccauugugauguuugguaacgaauuuaaaauguaguuuuaaauaaaguuuggacuuaucuauaaaguaucuuuuuuggaaauuauauugaauucuauacagcaagucaauguuuuauauaacuuuaggcugcucagagaagagcaaugguuaagaguuaguuagagaaauauauuauuuguuauaaagcccauccauuaggccagucuuccaacuaaugccaguguugcugcuguugggucugauguucuucuuuuagauaccugcagguccuauuccugugcaagaauagggcagauuaucaagauauccaggauaccuaugaaguuauuauagaauauuuauuaauccauugaaauuggauaauaaguuuagaacauagguucucaguaucuagaacuuacaucauuaucaucuguuuguuaggauuugaaauucuggaaaauauuuaucuacaucgccucagacuaaaaguaaaaaaaauaagcuuuauauaauuagggagauuucugcacagagaaguaacauugugguuaauuuuaaaugaaaaacuuaacuuuuucaaguggggauaaauaauacaacuaaauuucuguaauaguaagauucuguaugccuucagauaaacuugccuauugagaugguaauuuaaagccaaagcauagcaguuucuuuuguguguagugagguugaagcagauuugcaggugaaguauugaaaguuuaugugacuuuaagucagcuuuugaaaagugauugauuugcuuuuuaucccaaacuguccauauacccaguaaggcuucaaaaaaccagucaacaaugaguaagucaaucuuauagauucuucuuccucgaauaaaauacaaagaauuaguuccaauaaguauuuuaacuuuguuaacaacugaaauaccccauaaaaaaagaacuuguugagaguauuucuuuaaaaugguuacuugcugcccaggcaccauggcucacuccuguaaucccagcaccuugggaggccgaggcgggcagaucacgaggucaagagauugagaccauccugcccaacaugggggaaaccccgucucuacuaaaaauaaaaaaauuagcugggagagguggcacgugccuguaguccuagcuacuugggaggcuaaggcaggagaauagccugaacccgggagguggagguugcagguugcagugagccgagaucaugccacugcacuccagccuggcaacagagcgagacucugucucaaaaaaaaaaaaaaaaaaaaaaaaaaguuaacuugcuguauaccucaguguaauguccauucaaggaguauuaaaugaggauuucccugcgaggacauuuacuguauugcuacuuaaauuauggaagacaauauaucuucaacuuuaauaaaaccuauucagaaaauuaccaauucagaauucggaguucuuauccaggugcucuaacuaacuucagggaaauuggaacaauaaguuauguuacaugcacacucaaauucuuuauuuucuccacuuuaagcaggaaaggguaaaaacuguuuugguacucaagcccagccuuacauacuguguuucucucucugucugcaugcauauuaaaguggaaaaauuguauuuauaucuuaguuauuaccauaguaccuaugaaccuuaucaaaauugcuuauuugacugguguuacagcugcuauuaaucuaagucuauuguuuuucuauuuuaguagauaauuuaguuuuaaaauacguaggguuugagagcagauauauuuauuuaaucuguuuucucuaguaacuauugcugaaggguuaggcauucaguauuccuauuuguccuaauuuugaaguuaaaaauuuugguuacagauagauagagggagaaaaguucaaaaugagugagagagaacuuuaugcagguugagauaaugccuaaaauaaugagcuggccagacuguggagguacucuuuguauuuuguaacauugacuuuggguaaaugcuuuuucacuguuaauaaauauauauccuguauacaa

SEQ ID NO: 191866 - RNA, 8052 nt, Homo sapiens
ggggugggguuacgggaguuuauuucagaucaccugacauuaauacugucgaugccuucaucgucuuaauaguugugucuuggucucagacaucgcccgcugugacggcucagggcacgccccucagacguggcuguucagugagcagauggugagagggucuguguuuguccccucauuugggaggcagggggaaaagauaggccugagggccucuuggaaagaagccugcgggaagcuguagaugagggauucauccgucccguuguagaaugcuauauguccagauucauaguccaggaagacaccaaccuuacacacaggcucucugacgugcugaccuuucaaaggugacgagacccagaggcuguaaucaucuccgauuuuuaaaccuauuagugagaacagguccccagguggcuuggggagauuccccuuucugcucacagaguccuugcagaugcccacuucccacucggucuuguuucccaccuccaccucccaguagugucucccacuggugaagaucugaguacccagcacagucgcagacuggucaaaucuuuccggguugucggguagcugcugucugcuucccccauauuucacacucuucagauccuccgacaacacgagauaggcauuagcuguggcuggguccagcguuaucuccgcugcaagaggaggaaagaagagauuucccuugggcaugcuugaaaaaccucuuagguaugugagauuuccauugaauucuuaguauuuaguccugguuuuuuaaauguaauuuggggccgggcgugauggcucgcgccuguaaugcagcacuuugggagggugaggcaggcagaucacaaggucaggaguucaagaccagccugggcaacauggugaaaccccgucucuacuaaaaauacaaaacauagccaggcaugguggcacgugcuuguaauccgaacuacucaggaggcugaggcacgagaauugcuugaacccaggagguggagguugcagugagccaagauuauaccacugcacuccagccugggcgacagagcaagacucaguuucagaaaaaaacaguauuugguugagaacaaaauuucugagcucuucuuugacuguuccacaacacauagcaugaagcucuaaauggagacagagagaagagccacguggagaaggagcuuuagccugccugagguggggaggagaaucccuguggguggaaugggcgucgcucuguucacaggacaucuuuagagcuccgagcugugcguccacauagggacacccuugguuguucgcaucauauuagccaugggagguucugguucuucaguuugggugggagagaaaauagcacuuaucuuuggcugaacuucuaaugugccaaacauuuucuguacauuaucucauuuaaucacugcaagcauucuuuucuauaauuuuuacaaaaaagaaaacagguucaggaagguuaggaaacuucaccaagauuacacgguuacugaguguucaaaucacaaaucacaaucccuaaucagccuuuuucauuaugucaugacaaaugcagcuuccugugaguucagugcagcacccagggaccaugugaugaagcacacauagucugugaaccgacagucacauauggggccuccuuuuauuuuuuuauuuuuuuccugagacaguuuugcucuuguugcccagccuggacugcaaugacgcgaucuugacucacugcaaccucgucucccagguucaagugauucucuugccucagccucccgaguaguagucuuguccaccaccacgcccggcuaguuuuuuguauuuuuaguagagaugggguuucaucaugcuggccaggcuggucucaaacucccgaccucgggugauccacccaccucagucucccaaagugcugggauuacaggcaugagccaccaugccuggcugaggauuccaacuuccacucacuguccagacaagaucagguaccccagucauuccauuucugacuuuuuuuuuuuuuuuuuuuuuuuuuuuuuuuuuuugagacggagucucgcucugucgcccaggcuggaaugcaauggcgccaucucugcucacugcaaccuccaccuccuggguucaagugauucuccugccuaggccucccgaguagcugggauuacaggugcccaccaucacucccagcuaauuuuuuuuuguauuuuuagcagagacgcaguuucaccauguuggccaggcuggucucgaacuccugaccccaagugaucugcccgccuuggccucccaaagugcugggauuacaagcgugagccaccgcacccggccccaaucauaccauuucauacuuuuauuuauagaccagaucccaccauaacuaauuaucugugugauuaaugccuuccuccucaauuucauugaaaauucuacaaaaggaaaggcaaaaucugccuuacuuaucauuguaaguaagcgcagagcccaguagcauagugccggggcccauggcagggcuuuauucagcacucuggaguucaaagcucauuaggccucuuccucugaaggucagauuguccacaagauaaaagcugagaacuaauccugacgucucucaguguuggcuggacuaaacaucuggagcauucuacaaggacaguucguugaaugcacccucacugggauuuuagaauuuaagucagcuuucauccuaacgggaucagagcuagaaauguagacgccccugcaugaggggggcgugucugcacgugcaagggggggauggaaaagacaaugacaaaaccaacaaagaaaggacuaggauuggcugggcgcaguggcucacgccuguaaucccagcacuuugggaggccgaggcgggcggaucacgaggucaggagaucgagaccauccuggcuaacacagugaaaccccgucuguacuaaaaauacaaaaaauuacccaggcgugguggcgggcgccuguagucccagcuacucgggaggcugaggcaggagaauggcgugaacccgggaagcggagcuugcagugagccgagaucgcgccccugcgcuccagcccgggacacggagugagacuccgucucaaagaaaaaaaaaaaaagacccuuuagacagaaaacaaagccagauaaagccugagucaagucucacugcuucucucugcucacgcucagagacggucuguggccccagcccucccugguguuccgugcuggcccggauuccuuaaccaggagccucgugucagaucgugaaugucugacacuggaagaagguaugcugaaguuaauucuucgagccccggagggguaacaaaucaggcugacuuacugcugaauuuucuuagcaucuccuucauucccgugaugcggcacagacucagcucuguggugguggccucuggacacugaagcaagaguggcucgcuccugcaagagagcagagagguucacuccucggcacagaccgcgugaccugcuccagcuggagaguccaccucauuucucccccagcaacagcgcagaccuccuauccccacucagaacuguccaucagcaccacugccccgcagcuugcauaacugaacacagaaugaaagccuaccuuuccagggcuccucucacuuccuacggguaaaaaagaaagaaguuagcauggugcgcuuugaucauaacacagacgaaauucauuuugcauacaguccuugcaaagcucacagaaucugcuucccaugaagcacaccaugagugggagcacagagagcagagaaaagcguccccaguuucuuccagggaugugcuguggugaacacaagguguuucucacaaugacuagagaauacuuuguccuuuucuuuuucucguaucaucaccuuguccagggaaccuguucugcaaacaagccaaccuguuagucucgaucauccagugagaggcagagauaacaaaggaaaaugggcuggugagaacugaggcuaaccaagccugugucaggucggggugguguguuuggaaggcacuaaauuaaauaguagcacucuguggaaccagucuacaaaacagaccugaagcuggaguuggaucacauggcuuauguuuaagaaaguccacggccgggugccgguggcucucgccuguaaucccagccuuuugggaggccaagguggauggaucacaaggucaagagauagagaccauccuggccaacauugugaaaccccgucucuacuaaaaauacaaaacuuagcugggcaugguggcacacgccuguaaucccagcuacuugggaggcugaggcaagagaauugcuugaacccaggaggcguagauugcagugagccaagauugcaccacugcacuccagccugggcgacagugcgagacucugucucaaaaaaaaaaaaaaagguccugaagaaugcagcagccuagaagggcaguagaccaaagguggugagaaauaggagcucccugcacagaacaggagggcucuccugucuauuaacuaucaggcgggcagaucucguuaguaccacagguaugaauaauuaaaucagugccgcuauuaacccauccuguagaugacagucaucuagaccuagaguucauaucauaaugguacuuaucuucaucaggucuuugugaagauuaaauuuaaugugcccagcacauaguaaauacacauuaauaaacuagaaaaaaaaauuaacaaagcugagguugcagagaggcagguacagaagaaauugaagccacucucaggcuuguuugggauaguuauuccucuggauguguuuuuuuuuuucucucucucucucuucuauaaggcuuuauugacauauagaaugucaauucuuuaggaaaacuacuuuuggaccagaacuuaguuuuuaagaugaauaaagaaaacauuauuuccuauggcuugaaguacuaugaguuacuauaauuuuucccauuacucucaugaauguuauucucaccucaagagauucgaaagccgagcuuugacuugaggacucaaucugugcgaucauuuugcuuaggcuucugauuugcugggucaguuugaucucauuguuccucagcuuccucauguucucuuucucuuccuguucuaguagcuggaguugcagcugcuccucuuccuucaggaacuggugcauuuucauguauucugacacaacaaccuguuuacaagucuuuguuucuuccugccaaaacacacacacacacacacacacacacacacacacacgagauaaaguuaguaagagaaaugcccuugucuguagauuuuuaauccuuacaaguccuagaguuucuuucuuucuuuuuuuuuuuuuuuuugagauggagucucacucugucgccagucugaagugcaguggcgcaaucucggcucacugcaaccucugccuccugaguucaaaugauucuccugccucagccuccugaguagcugggacuauagucuaggagugugccaccacgcccagcuaauuuuuguauuuuuaguaaagaugggguuucaccauguuggucaggauugucucaagucucuugaccgggugacccacccuccucagccucccaaagugcugggauuacaggugugggccaccaugccuggccaaguccuagaguuucauggcaacaauuccugaaauccaacauauaauacauuuaaucuguugaugcgcuggguguagagguugauguuuucggagguaugugcgcuauagauacaauaguaaacaaaaccaaaaucuccauucccaggaggcggucguucuaguggagaaaaccaaaaaugaguaagaaauaugacaaguagugaucaggacuaugauacaaauaaaacaaaauuaagaaaaauuaugaaaaauguguguucauuuauucaacaaauauuuauucaaugaaaguaggugucagauaaccaaaaaggaacagaaacauacauggcaaauacucucacuuaagaauucaaagucuacggccaagcacgguggcucacaccuguaaucccagcacuuugggagaccgagacagguggauuaccugaggucgggaguucgagaucagccuggcuaacaugguaaaaccccaucuccacaaauauacaaaauuagcugggcaugguggcacacgucuguaaucccagcuacucagaaggcugaggcaggagaaucacuugaacccgggagguggagguugcagugagccgggaucgcgccacugcacuccagccugggcgacagagagagacuccaucuccaaaaaaaaaaaaaaaaaaacagauuucaaagucuauugggagaaucagauacaugguuuuaaaaaauauauaauuugauauuuaguccuuugcuuugacugcuggagagcucaaauccaaguccgugaccaaccuugaggacuugucagguaucauuuaaaccacuauuuugcuuuuauaucucugucucuuuauuuuuuuuaauuugcauuuuccccuccauguuuuugagauauuucuuuuuaaaaucgcuuuccgucucauguuacaugucuauaaguaucacuuguguuuuaaauaauucuaccagagccaucauagaggaagccacagcguugucuaguuaugcaaaggaggcuccuagagggggcgaauugcagcugagccuugagacucccacgaggacgcucagaagaaggcagcccaaugcaaggaaacugcauauuuuagaggugagacuggaaaaauuugucuuuuuuuuuuccugauauuucacuaaauuucccuuuagucccccuuauggggucauauacaagcagcaaaagucagacagacaccgaccuggcacaguuucacucucuccuucucauggguuaguacagccugagcuuccuuucuccuuacacgcaaaagauucaggauuuccuggaguuucuccugcaauagaaacaaacccuuucuggcaaaugagcagagucccaggucaugaaggggcuuugaagaccaguaacugcgcaguccuaggccucuaaaacaaagggcaggcugggugcggcgccucacgccuguaaucccagcacuuugggaggccgaggcaggcggaucaccugaggucaggaguucaagaccagccuggccaacauggugaaaccccgucucuauuaaaaauacaaaaaauuagccgggcgugguggugggugacuguagucccagcuacuggggaggcugaggcaggagaauggcgugaaccugggaggcggagguugcagugacugagaucgcacugcugcacuccagccugggcaacagagcaaaacucugucucaaaaacaaaaaaagggaaaaaaaaggguguaaacuggacccacgccaguuugugauguggugcucagaugggcccucgugacugucccccacagaggacguuaggaaacgucaggaaagcuaacggaguuagcugcgaugagucgugggguucaugcugagcagcugucuuacucugugaugcuccucagccucgcuggagagaugcacucuguuugcaccauggcucugggcuacgaaggcgcuuccacccugcucgucaucggagagcgccuuggcaguggugggcauccucccguagcugcccugcucauccucgcucugcagcaccugggaccggagcugccuggcgaugcuggccagccuccccagacgcucguuugacuggaaaugcgggcccuccaagguccuccagcacucaggacaagauaaagguguguuauguuccucccagcuccugaggagacacaccagacaaaagcugugcccacacucgguggucacugggcugcugaaauagucuaagcagaugaaacaggugaguuccucccugagguucuccaucagaucugcuguagacauuuucucgaggcuggauaugcagccagguuacaccucuguucugggauuagcaaagcccucacugccguccuacaguuuugaguaacacgcgggugaccuguuccuauguuguuau

SEQ ID NO: 191867 - RNA, 8052 nt, Homo sapiens
auaacaacauaggaacaggucacccgcguguuacucaaaacuguaggacggcagugagggcuuugcuaaucccagaacagagguguaaccuggcugcauauccagccucgagaaaaugucuacagcagaucugauggagaaccucagggaggaacucaccuguuucaucugcuuagacuauuucagcagcccagugaccaccgagugugggcacagcuuuugucuggugugucuccucaggagcugggaggaacauaacacaccuuuaucuuguccugagugcuggaggaccuuggagggcccgcauuuccagucaaacgagcgucuggggaggcuggccagcaucgccaggcagcuccggucccaggugcugcagagcgaggaugagcagggcagcuacgggaggaugcccaccacugccaaggcgcucuccgaugacgagcaggguggaagcgccuucguagcccagagccauggugcaaacagagugcaucucuccagcgaggcugaggagcaucacagaguaagacagcugcucagcaugaaccccacgacucaucgcagcuaacuccguuagcuuuccugacguuuccuaacguccucugugggggacagucacgagggcccaucugagcaccacaucacaaacuggcguggguccaguuuacacccuuuuuuuucccuuuuuuuguuuuugagacagaguuuugcucuguugcccaggcuggagugcagcagugcgaucucagucacugcaaccuccgccucccagguucacgccauucuccugccucagccuccccaguagcugggacuacagucacccaccaccacgcccggcuaauuuuuuguauuuuuaauagagacgggguuucaccauguuggccaggcuggucuugaacuccugaccucaggugauccgccugccucggccucccaaagugcugggauuacaggcgugaggcgccgcacccagccugcccuuuguuuuagaggccuaggacugcgcaguuacuggucuucaaagccccuucaugaccugggacucugcucauuugccagaaaggguuuguuucuauugcaggagaaacuccaggaaauccugaaucuuuugcguguaaggagaaaggaagcucaggcuguacuaacccaugagaaggagagagugaaacugugccaggucggugucugucugacuuuugcugcuuguauaugaccccauaagggggacuaaagggaaauuuagugaaauaucaggaaaaaaaaaagacaaauuuuuccagucucaccucuaaaauaugcaguuuccuugcauugggcugccuucuucugagcguccucgugggagucucaaggcucagcugcaauucgcccccucuaggagccuccuuugcauaacuagacaacgcuguggcuuccucuaugauggcucugguagaauuauuuaaaacacaagugauacuuauagacauguaacaugagacggaaagcgauuuuaaaaagaaauaucucaaaaacauggaggggaaaaugcaaauuaaaaaaaauaaagagacagagauauaaaagcaaaauagugguuuaaaugauaccugacaaguccucaagguuggucacggacuuggauuugagcucuccagcagucaaagcaaaggacuaaauaucaaauuauauauuuuuuaaaaccauguaucugauucucccaauagacuuugaaaucuguuuuuuuuuuuuuuuuuuuggagauggagucucucucugucgcccaggcuggagugcaguggcgcgaucccggcucacugcaaccuccaccucccggguucaagugauucuccugccucagccuucugaguagcugggauuacagacgugugccaccaugcccagcuaauuuuguauauuuguggagaugggguuuuaccauguuagccaggcugaucucgaacucccgaccucagguaauccaccugucucggucucccaaagugcugggauuacaggugugagccaccgugcuuggccguagacuuugaauucuuaagugagaguauuugccauguauguuucuguuccuuuuugguuaucugacaccuacuuucauugaauaaauauuuguugaauaaaugaacacacauuuuucauaauuuuucuuaauuuuguuuuauuuguaucauaguccugaucacuacuugucauauuucuuacucauuuuugguuuucuccacuagaacgaccgccuccugggaauggagauuuugguuuuguuuacuauuguaucuauagcgcacauaccuccgaaaacaucaaccucuacacccagcgcaucaacagauuaaauguauuauauguuggauuucaggaauuguugccaugaaacucuaggacuuggccaggcaugguggcccacaccuguaaucccagcacuuugggaggcugaggagggugggucacccggucaagagacuugagacaauccugaccaacauggugaaaccccaucuuuacuaaaaauacaaaaauuagcugggcgugguggcacacuccuagacuauagucccagcuacucaggaggcugaggcaggagaaucauuugaacucaggaggcagagguugcagugagccgagauugcgccacugcacuucagacuggcgacagagugagacuccaucucaaaaaaaaaaaaaaaaagaaagaaagaaacucuaggacuuguaaggauuaaaaaucuacagacaagggcauuucucuuacuaacuuuaucucguguguguguguguguguguguguguguguguguguuuuggcaggaagaaacaaagacuuguaaacagguuguugugucagaauacaugaaaaugcaccaguuccugaaggaagaggagcagcugcaacuccagcuacuagaacaggaagagaaagagaacaugaggaagcugaggaacaaugagaucaaacugacccagcaaaucagaagccuaagcaaaaugaucgcacagauugaguccucaagucaaagcucggcuuucgaaucucuugaggugagaauaacauucaugagaguaaugggaaaaauuauaguaacucauaguacuucaagccauaggaaauaauguuuucuuuauucaucuuaaaaacuaaguucugguccaaaaguaguuuuccuaaagaauugacauucuauaugucaauaaagccuuauagaagagagagagagagaaaaaaaaaaacacauccagaggaauaacuaucccaaacaagccugagaguggcuucaauuucuucuguaccugccucucugcaaccucagcuuuguuaauuuuuuuuucuaguuuauuaauguguauuuacuaugugcugggcacauuaaauuuaaucuucacaaagaccugaugaagauaaguaccauuaugauaugaacucuaggucuagaugacugucaucuacaggauggguuaauagcggcacugauuuaauuauucauaccugugguacuaacgagaucugcccgccugauaguuaauagacaggagagcccuccuguucugugcagggagcuccuauuucucaccaccuuuggucuacugcccuucuaggcugcugcauucuucaggaccuuuuuuuuuuuuuuugagacagagucucgcacugucgcccaggcuggagugcaguggugcaaucuuggcucacugcaaucuacgccuccuggguucaagcaauucucuugccucagccucccaaguagcugggauuacaggcgugugccaccaugcccagcuaaguuuuguauuuuuaguagagacgggguuucacaauguuggccaggauggucucuaucucuugaccuugugauccauccaccuuggccucccaaaaggcugggauuacaggcgagagccaccggcacccggccguggacuuucuuaaacauaagccaugugauccaacuccagcuucaggucuguuuuguagacugguuccacagagugcuacuauuuaauuuagugccuuccaaacacaccaccccgaccugacacaggcuugguuagccucaguucucaccagcccauuuuccuuuguuaucucugccucucacuggaugaucgagacuaacagguuggcuuguuugcagaacagguucccuggacaaggugaugauacgagaaaaagaaaaggacaaaguauucucuagucauugugagaaacaccuuguguucaccacagcacaucccuggaagaaacuggggacgcuuuucucugcucucugugcucccacucauggugugcuucaugggaagcagauucugugagcuuugcaaggacuguaugcaaaaugaauuucgucuguguuaugaucaaagcgcaccaugcuaacuucuuucuuuuuuacccguaggaagugagaggagcccuggaaagguaggcuuucauucuguguucaguuaugcaagcugcggggcaguggugcugauggacaguucugaguggggauaggaggucugcgcuguugcugggggagaaaugagguggacucuccagcuggagcaggucacgcggucugugccgaggagugaaccucucugcucucuugcaggagcgagccacucuugcuucaguguccagaggccaccaccacagagcugagucugugccgcaucacgggaaugaaggagaugcuaagaaaauucagcaguaagucagccugauuuguuaccccuccggggcucgaagaauuaacuucagcauaccuucuuccagugucagacauucacgaucugacacgaggcuccugguuaaggaauccgggccagcacggaacaccagggagggcuggggccacagaccgucucugagcgugagcagagagaagcagugagacuugacucaggcuuuaucuggcuuuguuuucugucuaaagggucuuuuuuuuuuuuucuuugagacggagucucacuccgugucccgggcuggagcgcaggggcgcgaucucggcucacugcaagcuccgcuucccggguucacgccauucuccugccucagccucccgaguagcugggacuacaggcgcccgccaccacgccuggguaauuuuuuguauuuuuaguacagacgggguuucacuguguuagccaggauggucucgaucuccugaccucgugauccgcccgccucggccucccaaagugcugggauuacaggcgugagccacugcgcccagccaauccuaguccuuucuuuguugguuuugucauugucuuuuccaucccccccuugcacgugcagacacgccccccucaugcaggggcgucuacauuucuagcucugaucccguuaggaugaaagcugacuuaaauucuaaaaucccagugagggugcauucaacgaacuguccuuguagaaugcuccagauguuuaguccagccaacacugagagacgucaggauuaguucucagcuuuuaucuuguggacaaucugaccuucagaggaagaggccuaaugagcuuugaacuccagagugcugaauaaagcccugccaugggccccggcacuaugcuacugggcucugcgcuuacuuacaaugauaaguaaggcagauuuugccuuuccuuuuguagaauuuucaaugaaauugaggaggaaggcauuaaucacacagauaauuaguuauggugggaucuggucuauaaauaaaaguaugaaaugguaugauuggggccgggugcgguggcucacgcuuguaaucccagcacuuugggaggccaaggcgggcagaucacuuggggucaggaguucgagaccagccuggccaacauggugaaacugcgucucugcuaaaaauacaaaaaaaaauuagcugggagugauggugggcaccuguaaucccagcuacucgggaggccuaggcaggagaaucacuugaacccaggagguggagguugcagugagcagagauggcgccauugcauuccagccugggcgacagagcgagacuccgucucaaaaaaaaaaaaaaaaaaaaaaaaaaaaaaaaaaagucagaaauggaaugacugggguaccugaucuugucuggacagugaguggaaguuggaauccucagccaggcaugguggcucaugccuguaaucccagcacuuugggagacugagguggguggaucacccgaggucgggaguuugagaccagccuggccagcaugaugaaaccccaucucuacuaaaaauacaaaaaacuagccgggcguggugguggacaagacuacuacucgggaggcugaggcaagagaaucacuugaaccugggagacgagguugcagugagucaagaucgcgucauugcaguccaggcugggcaacaagagcaaaacugucucaggaaaaaaauaaaaaaauaaaaggaggccccauaugugacugucgguucacagacuaugugugcuucaucacauggucccugggugcugcacugaacucacaggaagcugcauuugucaugacauaaugaaaaaggcugauuagggauugugauuugugauuugaacacucaguaaccguguaaucuuggugaaguuuccuaaccuuccugaaccuguuuucuuuuuuguaaaaauuauagaaaagaaugcuugcagugauuaaaugagauaauguacagaaaauguuuggcacauuagaaguucagccaaagauaagugcuauuuucucucccacccaaacugaagaaccagaaccucccauggcuaauaugaugcgaacaaccaagggugucccuauguggacgcacagcucggagcucuaaagauguccugugaacagagcgacgcccauuccacccacagggauucuccuccccaccucaggcaggcuaaagcuccuucuccacguggcucuucucucugucuccauuuagagcuucaugcuauguguuguggaacagucaaagaagagcucagaaauuuuguucucaaccaaauacuguuuuuuucugaaacugagucuugcucugucgcccaggcuggagugcagugguauaaucuuggcucacugcaaccuccaccuccuggguucaagcaauucucgugccucagccuccugaguaguucggauuacaagcacgugccaccaugccuggcuauguuuuguauuuuuaguagagacgggguuucaccauguugcccaggcuggucuugaacuccugaccuugugaucugccugccucacccucccaaagugcugcauuacaggcgcgagccaucacgcccggccccaaauuacauuuaaaaaaccaggacuaaauacuaagaauucaauggaaaucucacauaccuaagagguuuuucaagcaugcccaagggaaaucucuucuuuccuccucuugcagcggagauaacgcuggacccagccacagcuaaugccuaucucguguugucggaggaucugaagagugugaaauaugggggaagcagacagcagcuacccgacaacccggaaagauuugaccagucugcgacugugcuggguacucagaucuucaccagugggagacacuacugggagguggaggugggaaacaagaccgagugggaagugggcaucugcaaggacucugugagcagaaaggggaaucuccccaagccaccuggggaccuguucucacuaauagguuuaaaaaucggagaugauuacagccucugggucucgucaccuuugaaaggucagcacgucagagagccuguguguaagguuggugucuuccuggacuaugaaucuggacauauagcauucuacaacgggacggaugaaucccucaucuacagcuucccgcaggcuucuuuccaagaggcccucaggccuaucuuuucccccugccucccaaaugaggggacaaacacagacccucucaccaucugcucacugaacagccacgucugaggggcgugcccugagccgucacagcgggcgaugucugagaccaagacacaacuauuaagacgaugaaggcaucgacaguauuaaugucaggugaucugaaauaaacucccguaaccccacccc

SEQ ID NO: 191868 - RNA, 9275 nt, Homo sapiens
aguuucuccuuuguuuuacguuugggaggagguggcauuggaaauagcagagugcuucgcgguaacaggggugagucuuguuucauggaacuuuuuucaaauggggagaaggggguuguguugcucacuacuuggaaugugucggucaaagggguuagauagucagggaggggaagcguguucucauccugggaccaggccggagccggccucgccgggagacuuguagcccucgcccugcggugacccguggcuggccacuggccucaaauguugaaaacgggcagaugggcaaguaauacacucucaagaaagcaagugucuggcggugauuuccuaaauugcauuuuuuauuuuauuucaaaacuucauguaaauauguuuccuuacaauaucuggcuaagucuuuucuauauuaacaugcuuacauugugaucaagacaccagucucuucccuuucuuuuccucuccucuuaucucuggagauggcaauacccccaacucaaauuacucuagcaaaaaaccuaggagacucuuucuuuucuuuuuucuuuuuuuuuggagacagucucgcucuguugccaggcuggagugcaauggcgcgaucucggcucacugcaaccuccgucucccggguucaagggauucuccugccucagccucccaaguagcugagauuacaggcgcccuucacugcgcccggcuaauuuuuguauuuuaguagagacgggguuucaccauguuggucaggcuggucucgaacucgugaccucagaugauccgcccgccucagccucccaaagugcugagauuacaggcgugagccaccgcgccgggcgagacucauucuugauuccuguuucccuuccgcucuucauccaauccaccggcgagcugcagggcgagggggugguucuuucuccuguuuucccgcucucccugcauuucaucuccucugccgccaucugcuccaaaccccuggcagcccuucgcgggauucccaaaucuaauagauuuuucuguucuccccaaauccauucuccaugcagcuguccggcccaucuucuaaccuaaaaaaacuugcuguuugcuuguuggaagcccuguaaugguuuccuugggaccugggaugaaaugcaaauggucccggggcucaccgucagccccgcgccugggccucgccccagcccccaccuuccugcccgccauagcuguagggagcauggagcauggagcguggagcguggagcauggagcauggagcguggagcauggagcauggccugcagcccccggggagcgccggcagccuggaaccagcaggcuucgcucgucucuucccacccccgugcacuuuuccuccugcccacaucuggcuccgauggcccccuccuugggggccuuuuccagacauucaugaugaagguggcguccucgguuacuuccccucucauauucuuuuuuuuuuuuuuuuuuuuuugagacagaguuuugcucuugucgcuugggcuggagugcaguggcacgaucucggcucacugcaaccuccgccuccuagguucaagcgauucuccugccucggccucccgaguagcugggacuacaggcgcccgccaccacgcccgacuaauuuuuuuuauuuuuaauaggguuucaccauguuggccaggauggucucgaucuccugaccucgugauccgcccgccucggccucccaaaguggugggauuacaagcgugagccaccgcucccggucccaccccgccccgaccuuuuuuuuaauagcauuuuucucaaucugacauuuuuuguuuauuugcccuuuacugucugucccacaccaaacuuuguguuaacgaggaacuuugcaucuuuuucccuaaguucagcaccuagaacgaauacuaaauguauaugaagauuucguccacauccgcuuuuaccaguauguuuuccauguacagucaaguuccauauaaggccguuucagucagugagcaaccccacguacuaugguggucccauaagauuauaaaagagcugaaaaauccccauggccuagugacaucuucaugauccugaauuuguguaggccuaggcucauguguguguuugucucuucguuuuuaacguaaaaguuuuuaaacagacaaaauuuuacagaauaagaauauaaagaaaaaauauuuuuguacaggugaaaaaauguuuguguuuuaagcuaaguguuauuacaaaagagucaggaaguuugcacauuuuuaaguuuauaaaguuaaaaagagucugggcgcgguggcucacgccuguaaucccagcauuuugagagccugaggcaggcggaucgccugaggucgggaguuggagaccagccugaccaacguggagaaaccucauuucuacuaaaaauacgaaauuagcugggcguggugacacaugccuguaaucccagcuacucaggaggcugacgcgggagaaucggcugaaccugggaggcggagguugcugugagcggagaucacgcuguugcacuccagccugggcaacaagagggaaacucugucucaaaaaaaaaaguaaauaaauaaaugaauuuaaaaaguuacaguaagcuaagguuaauuuauuauucaggaaagacaaauuuuuaaauaaguucuaaaauuugccuaaguguacagugcuuauaaagccuacaguuguguacaguggcgucccaggccuucauucacucaacacucacucacucacucauccagagccacuaccaguacugugagcuccauuaugggaaugugccuacacagguguaccauuuuuuaucuuuuguacaguauuucuucuguuuggauauguuuauaugcaaauacuuacuguuguguuacaguugccuacaguacucagaacuguaacaugcuguggagauuuauagccuaggagccaugggcccuacuguguaaccugggugaguugcaggcugugccauucgggucugcguagcuacacucugugauguucacaggaugacacagcaaccuaaagauacauuucucagaacauauuccugucuucgagugaugcaugacuaguuauuucugcuaacagaaauuggcuugccauauaaauaguuuucuuuuaguaaauuaauaaauuaccauuucaauguuauaugucauccucacaagcuuguauacugcuaugagaaauagcauaaugcucggagaucugacaaauaagaauuuagcuuagaaagguaaggaccauacuugaaccuuaguaaauucauaaagaaaacaccucucuuaggagaugccuuucuuuuuuuucugucacccagguuggagugcaauggugugaucucagcucacugcaaccccugccucccaggcuccagcgauccucccaccucagccuccugaauagcugaccaccagcacacuaggcaaacccaccccacucacggccucccuugggaauucagaccuaaccaucgcugagcugaaguguagguguggucugauuagacucauuuuuucuuuuuuguagagaugggguuucaccguuuugccgaggcuggucaccaacuccugggcucaagggauccacccaccucagccucccaaagugcugggauugcaggcaugagccaccaugccuggccuuaggaaauuccuuucuauguaacacccugcaucauuaauagccagcuuuuuugaaacuucuacauuaaauugucuaaacucucaaauaaauuccuaguaaaguaauuauauaggguuguuaaaucagagaucaacagcacaaugacuaaugcauacucaugauuucaucucacuagacaaauguacugaggcuggagccugugugaacagaacagaagaggccuucacucuaguagugcucacaguccagcagguaagacagacuugaagcaagggacaccagagcucugaucagugugaaauagggagcuaggagaacguuuagcuuugggacucaacugagcugaagaauccagggaagccugccugaagaggugauguuugcgcauuugaaguauggaugggaagcaagccucuguguguguguuggaggauaggugguauuuuagugagaaaaaagaacauuuguaauggacugaucugaugcuuuacuggagaaaguuuauuauggcugaauagugaaauacaagagcuauagauggcaggaggugagcuuggagggaaaagcagcagucaauuaaauugcaguuacagguugaguauuuuuuauccaaagugcuugggaccagaaguauuauggacaucagauuuuuuugaauguuugaguauuugcaaaauacccaauaugagcaucccgaguccgaaaauucaaaauccaaaaugguccaaugagaauuuccuuuaagugucaugauggcacucaaaaagguuucauacuuuaagcauuucagguccuagauuuucagauuugggaugcacaagcuguuuuuuaaauggacuaauuggggagagcagcucuguguuuaauccuaguaauuacccuccaaaggugcuaauauugugcuucauaaauauuuugagaucucccugguuaauuucaccucuauauuuuuguuuucuuuuuuuuucuuuuuuuuccgagaaagucgcucuguuguccaggcuggagugcaguggcacaaucuuggcucacugccuccgccucccaggcucaagugaucuccugccaguagcugggauugcagguguacgccaccacauccaguuaauuucuuguauuuuuaguagacaggguuccgccauauuggccaggcuggucuuaaacuccugaucucaggugauccgccagccuugugcucacaaagggcuggcauuacaggcacgagccacugcacccagcccuaauuucaccuuuuuaaaggacacaggccuggcgcaguggcucacgccuguaaucccaguacuuugagaagccgaggagagcagaucaccugaggucaggaguucgagaccagccuggccaacaugaugaaaucccguaucuacuaaaaaauaacacaaauuagcugggugugguggcggggcgggggggcgccugccuguaaucccagcuacuuggggccugaggcaggagaaucacuugaaccccagaggcggagguugcagugagcugagauugcgccauuguacuccagccugggcaacaagagcgaaacuccaucucaaaauaaaauaaaaggacacaaaaaauaacauuaguagcauauaacauauauguauuacauauuuuuaaauacauuuuaagaaaucuuaaacuuuuccccuacaguuggaacacauuuuguuuuuauuauauguauuuguuuuuuaccaaaaguaaaugacaugcuucuguugagguguuuuuuuuuuaaugugguuauuuuaauuuucauccaacaacuuuuaccuuugccucuuuuuuaaaggcauauaauuuuucuuccuacagaaagacaucaggacaauaaauagggagaucuuuucucaggcacacaauuguaacauuaaguaagagacuuuuauagucaaagcaauaacauauucaugcuauaacuuuuauaacgucauugcuguuaaauguuuaaggaaaugauaggaaagucuucagggccaagcuaccccgugccuuuauuuuggcauggauuccuaaaagugggagcaccauuaauuucaugugucuuauucucuggauccccauuuuuuagaacaaugagugggcacacgauggcccaugggccagucucccuguuuuacuggaacacagccacccucauuccuuuauguguuaucugacugcuucugugccgugcuacaacggcaaaguugaauaguuucaacagacaccacaggacccacaaagcuaaaaucuggcccuuugcagaaauaguuuaccaccccagucuagaaagaaccuggcguguagcaggaugcaacauauacuuguagaaugaauaaaaagguaauaaaauaacacgagcucacauagcggccagcauuugcugugcaccauaauccgugcuaagcacuuugcaugcguuauuuaauuugaauuucauaacaguauuacauaagaaaacaauagggccaggcaugguggcucacgccuguaaucccagcacuuugggaggccgaggcaggcggaucacgaagucgggagcuccagaccagccugaccaacauggugaaaccccauuucuacuaaaacuagaaaaaguagccaggcgugguggcgugcgccuguaaucccagcuacuugggaggcugaggcaggagaauugcuugaacccgggagguggagguugcaaugagcuaagauugcaccacugcacuccagccugggcgacagagugagacuccgucuccaaaaaaaaagaagaaaaagaaaagacaguauuuugcucccucaccgccuucaggcuuuuaaccaacugccacuuaccacccuagugaagguuugcccgagugcccuauuuaauauugcaggcuucuguuuccuaccagccccuuugcuuacucuuucacacuuagucaccuucuaacguggcauacauugcuuauuuucuaugcucaugaguaugucuacuccauggaggcauagauguuuguaugccuguuuacugauggaucacaaacuguguagccuaaaauagagcuagcacauagucccacccaacacgugucaggugagcaauuagauauagaggguuccaauaacuuguggggacacccagauaagaucuguuuaugacucaugucuuacacagagcucauucuuggucucuugguuaguuuaucagagaagacaaauguauuauuggaaaaugugucuuaggucauuuuuugacaguggcucuaauacuggaaucuauuuuaacuaaagguuauuaucauaaagcagguguuugcugaagacagcuuacucagaucacuacugccuggaggugguugauauauccugguguaaaccuucaagaagggcacaggcaggaaaacaugagccagcaacugaagaaacgggcaaagacaagacaccagaaaggccuggguggaagagcccccaguggggcuaagcccaggcaaggcaagucaagccaagaccugcaggcggaaauagaaccugucagcgcggugugggccuuaugugauggcuaugugugcuaugagccuggcccucaggcucucggaggggaugauuucucagacuguuacauagaaugcgucauaaggggugaguuuucucaacccauccuggaagaggacucacuuuuugaguccuuggaauaccuaaagaaaggaucagaacaacagcuuucucaaaagguuuucgaagcaagcucccuugaauguucuuuggaauacaugaaaaaagggguaaagaaagagcuuccacaaaagauaguuggagagaauucgcuugaguauucugaguacaugacaggcaagaagcuuccgccuggaggaauaccuggcauugaccuaucagauccuaaacagcucgcagaauuugcuagaaagaagccccccauaaauaaagaauaugacagucugagcgcaaucgcuuguccucagaguggaugcacuaggaaguugaggaauagagcugcccugagaaagcaucuccucauucaugguccccgagaccacgucugugcggaaugugggaaagcguucguugagagcucaaaacuaaagagacauuuccugguucauacuggagagaagccguuucggugcacuuuugaagggugcggaaagcgcuucucucuggacuuuaauuugcguacgcacgugcgcauccacacgggggagaaacguuucgugugucccuuucaaggcugcaacaggagguuuauucagucaaauaaccugaaagcccacauccuaacgcaugcaaauacgaacaagaaugaacaagagggaaaguaguccuccaacaggaugaagcagauuaacagaagagugaucagugacaaacaugccucauugauuauuguuucuaggaaggaauuucuaaaucaauauugcaaccccaaaagcgguuauaauuugguguuacuaagaugcuccuacacuuugugauaccguuuuaaggacauggugcauuuuuuuuucuuuuauuuguuuuauuuagaacuuuuuuuauuuguuuuauuuagaacuuuguguguucuuaaagugugcuuccaacaggaaggucagugauaaauuuucaaaagcauaaccuucaauauauuaucuguuggauuauuggauauaagacuuauuuucauguacuauaaauaugaaaauaacuuugauuuuuaauuguguaguuuccauuucuuagcuuuugccuuuuaaauuuauacuucagccaggcauagugacugaugccuguaaucccaacacuuuguugggaggccaaagcaggaggauagcuugaggccaggaguuccagaccagccugggcaacauagugagauccugucucuacaaaaaaauuuguuuuuauuuguauuuauauauuuuuauuuuuguuuuuguugguaggcgucucgcucugucacccaggcuggagucuagugucgugaucuuggcucacugcaaccuccaccucccggguucaagugauucucuggccucagccucccaaguagcugggacuacaggugugugucaccacgcccggcuaauuuuuguauuuuuaguagagaugggguuucaccauguuggccaggcuagucucaaacuccugaccuccagugaucugcccaccucggccucccaaagugcugggauuacaggugugagccacugugccuggccccccacaacauguuuaaacuuagcuaggccugguugcauacgccuguguucccagcuacucaggaggcugaagcaggaggauagcuugagcccaggaguuugaggcuacagugagcugugauugcaccacuguacuccagacuggauaacagcaagagcccaucuuuuaaaaaaaguaaaaauuaaaaauauacuucaugguucaugucauagcccuagagaaugaaaaauuugcaguagauagucaauaaaugaaucaguaguuaaauauuccuuaaagucaacuguauuucauugugauuuuuguuuucuuuuuaucauuguaucaaacuauauggaaaucauaugguuagaugugauuauuugauaauguuaguccauuugaauccauuuuagauauuucacaauuaaagaauaugaaacuuc

SEQ ID NO: 191869 - RNA, 3551 nt, Homo sapiens
uagacguuccuuuaauaacuuaaaagacaaagcauacacaaccagcauauuauaggcauguaaauacauguguucuuaaauggaucuucacuuggaagaaaguuuuucguccuucucagaaggagauuagacacaacauaugguaaagccaaaagcaggagcuuauagauuugcaugaaaugaaggcguucuucagacuucuucauaacccacgugacaucuguuuuuaaaaacacguuaacauuaaaaacuuuuuuuuaaaaagaguuuuauccccaaacuuccaccaugcagucccauuuuuggucucuagacucugguaaguauaaccaguacuaaaauguuaaugagaaugaaacaauacuacuagaaauacgagugucaguauuaaauggaauaauaaaugcuaugcaaacaagagaucacugcgggaggaaaaaagcagcagcucugaguuacuuaccagcacuuccuuuucccacugguauuuucuacacuuccgagacuccguuucugucugagcacggcaacacaaucauuccugucaggguguucacuugcuuuuauugucugcauacauuuaauuguuguaagaaacuuggcacagucuggaaauccacaugaccaagcgagaucuucagcuguuugcccguucuuauuacauaaacugaaaacaggauaaaaacggagugaaaugaaacauugaacuuaagucuuuuuuuuuauaucuuacaagggaauuuugggcucauacaaauguugguugcagaacagaagagguaaaggaugcauaaggaaauugcauuuuuggucacuauuguauccucagcaacuaacagaauccagcauagagcgggcauuccaguucugaaugaauguuagaauuaucugauguuuaauacaguguaugaguacccaaagguagucaaugggaacuauagaauggguuuuccugaaccgaaacugaaguagaauacagucauaaugaacaaaauugcaccucugauugcucaggaucugacuuuuuacuuacucgaacugaguauuauucgauagcaccaacaaccuaaguuaacauuuaaaugauuaacacuaaauuaucaauuacgcaagcauuauuuuuaaaagcacauguaacuaagcuucaggagucugauuaguuuaauccaagaaaacauaaaaugugaagccacuguuuucauacucacucaauuugggcaucacuggcuacaagcaggcuuaggcacuccaggcuuccaacuuuugcugccuuguguaguggagcuucuccuaaaacauccuuaagguaagauggugcauuuuagagucucccaaaaacacuuuuugugaaaguugaugagugacauuuaauauuagcuauuuaaggaagcuaguuagaacugcauuguacuggacagggaauuuuuuuuuuuuuuuuuuuuggcagagaacaccaaaaacuuuucguggguuuauuuuguuaauauucauucucaguuccgguuuuggguuuguuuucagaaauaagaagucuuagucacuuuuaagacuaagaagucauguguuuuugauacauauaaaccugcaucaacaucucuucuaauuaaaaacacuacugauaaucguuugcaagugcaacacuucagaaaugcagaauuaaguaacuaguggacuauuauaacuucagcauucuagcauacgcucugaaaugaucauuccuuuauuuagaucuucuagauacuuuuagugauuacauuagggauagccaacuccaugggcuaauuugaaacauagaaauguacuaugcuugcauauucauuucaguauggaaccuucuaaaaaucuccuccuuuggacugaauuuuuaaauucaagcuuuuuauuuuuguuuuuuuccucgguaagcugcaaaagcuuuuuauuuuugauuaguucuuuuaguuugcuuuuucauaccguuuucauuaauaaaaauguguggcugggcgcgguggcucacgccuguaaucccaccacuuuggaaggcugaggcaggcggaucaccuaaggucaggaguucgagaccagccuggccaacauggugaaacccugucucuacuaaaaauacacaaauuagccgggcacgguggcgcgugccuguaaucccaccuacuagggaggcugaggcaggagaaucucuugaacccaagaagcagagguugcagugagccgagaucgcgccauugcacuccagucugggcgacaaaagcaaaacuccgucucaaauaaauaaaaacguguagccauaugcacauacauuaaaauguaagcaaauaaaaagaguucuuccagaaaaguuuacaauuuaaaauucaccaugcuuuaauauucaguggaagaugcaaacuacaguaagaaaacucuuuaggaaauuagaaugcuuguggacauagcuccuaaguauuucaauugcugcagggagacuuuugguaauguagcaauuacuucuuuugaaauaaacuagaucugugcuguucaauaugauagucaacagccacuuaaggcuagaguauuugaaauguggcuagucugauuugagauacgcugucacaccagauugugaagacagaauaaaagaaaguguaaaauaucuaaucagcaauugcuuugauuacauauugaacugauaacauuuuggacaaauugggucaaauacuaaaauuucauguuucguuuauuaauguggcuacuuaaaaacuucaaauuucucauguccucacaucaagacuggaaaaaaacucuuaaauuacaucugugucuugcauuauauuucuguuggacaucgcugcuauagacauguuuuuaacagcugaaacaacucuuggcgucugagaaauguuugugugugucuggguuggaggggacggcuguacacagcaacaguuaccuaguuaccugcugguugaggucagcgcccguuugcagcugccagagaagaaagcaagcaaggccgcuuccugcggcuaaguggacaggcgacugcuugcagggauccgggggugcguugaccgaggccccugucuccagcaaaugcuucagaccauccaccugcaggaagagaacagauccagcacccuucccaccuuuguccagucccgcgccccuccgggcuggaaaccuccccgcccuucacaaccagcucugaccaggcagcgcccagugguccguccccgcauuaacgagaagacgaaucuagaagcuugagccugcaggacaaaagcucgggcucugugagcccgaaucucaccucgggguugcaauccagcaacagcauuucccgccuaaggcagaugacaagaguccuuggaagugcagagaggugagacacucgccgcaccccgacagguaagaaugcgcaggcuggcccuagcacgggagaauuuaaagaccgcugggacuuccgggccggcccuuggcagccgcgccccagcuccgguuacgcccgagcagccuaauccucaacgacccggacccuguccagccccgccacggccgcacguacacaaacacug

SEQ ID NO: 191870 - RNA, 3551 nt, Homo sapiens
caguguuuguguacgugcggccguggcggggcuggacaggguccgggucguugaggauuaggcugcucgggcguaaccggagcuggggcgcggcugccaagggccggcccggaagucccagcggucuuuaaauucucccgugcuagggccagccugcgcauucuuaccugucggggugcggcgagugucucaccucucugcacuuccaaggacucuugucaucugccuuaggcgggaaaugcuguugcuggauugcaaccccgaggugagauucgggcucacagagcccgagcuuuuguccugcaggcucaagcuucuagauucgucuucucguuaaugcggggacggaccacugggcgcugccuggucagagcugguugugaagggcggggagguuuccagcccggaggggcgcgggacuggacaaaggugggaagggugcuggaucuguucucuuccugcagguggauggucugaagcauuugcuggagacaggggccucggucaacgcacccccggaucccugcaagcagucgccuguccacuuagccgcaggaagcggccuugcuugcuuucuucucuggcagcugcaaacgggcgcugaccucaaccagcagguaacuagguaacuguugcuguguacagccguccccuccaacccagacacacacaaacauuucucagacgccaagaguuguuucagcuguuaaaaacaugucuauagcagcgauguccaacagaaauauaaugcaagacacagauguaauuuaagaguuuuuuuccagucuugaugugaggacaugagaaauuugaaguuuuuaaguagccacauuaauaaacgaaacaugaaauuuuaguauuugacccaauuuguccaaaauguuaucaguucaauauguaaucaaagcaauugcugauuagauauuuuacacuuucuuuuauucugucuucacaaucuggugugacagcguaucucaaaucagacuagccacauuucaaauacucuagccuuaaguggcuguugacuaucauauugaacagcacagaucuaguuuauuucaaaagaaguaauugcuacauuaccaaaagucucccugcagcaauugaaauacuuaggagcuauguccacaagcauucuaauuuccuaaagaguuuucuuacuguaguuugcaucuuccacugaauauuaaagcauggugaauuuuaaauuguaaacuuuucuggaagaacucuuuuuauuugcuuacauuuuaauguaugugcauauggcuacacguuuuuauuuauuugagacggaguuuugcuuuugucgcccagacuggagugcaauggcgcgaucucggcucacugcaaccucugcuucuuggguucaagagauucuccugccucagccucccuaguaggugggauuacaggcacgcgccaccgugcccggcuaauuuguguauuuuuaguagagacaggguuucaccauguuggccaggcuggucucgaacuccugaccuuaggugauccgccugccucagccuuccaaaguggugggauuacaggcgugagccaccgcgcccagccacacauuuuuauuaaugaaaacgguaugaaaaagcaaacuaaaagaacuaaucaaaaauaaaaagcuuuugcagcuuaccgaggaaaaaaacaaaaauaaaaagcuugaauuuaaaaauucaguccaaaggaggagauuuuuagaagguuccauacugaaaugaauaugcaagcauaguacauuucuauguuucaaauuagcccauggaguuggcuaucccuaauguaaucacuaaaaguaucuagaagaucuaaauaaaggaaugaucauuucagagcguaugcuagaaugcugaaguuauaauaguccacuaguuacuuaauucugcauuucugaaguguugcacuugcaaacgauuaucaguaguguuuuuaauuagaagagauguugaugcagguuuauauguaucaaaaacacaugacuucuuagucuuaaaagugacuaagacuucuuauuucugaaaacaaacccaaaaccggaacugagaaugaauauuaacaaaauaaacccacgaaaaguuuuugguguucucugccaaaaaaaaaaaaaaaaaaaauucccuguccaguacaaugcaguucuaacuagcuuccuuaaauagcuaauauuaaaugucacucaucaacuuucacaaaaaguguuuuugggagacucuaaaaugcaccaucuuaccuuaaggauguuuuaggagaagcuccacuacacaaggcagcaaaaguuggaagccuggagugccuaagccugcuuguagccagugaugcccaaauugagugaguaugaaaacaguggcuucacauuuuauguuuucuuggauuaaacuaaucagacuccugaagcuuaguuacaugugcuuuuaaaaauaaugcuugcguaauugauaauuuaguguuaaucauuuaaauguuaacuuagguuguuggugcuaucgaauaauacucaguucgaguaaguaaaaagucagauccugagcaaucagaggugcaauuuuguucauuaugacuguauucuacuucaguuucgguucaggaaaacccauucuauaguucccauugacuaccuuuggguacucauacacuguauuaaacaucagauaauucuaacauucauucagaacuggaaugcccgcucuaugcuggauucuguuaguugcugaggauacaauagugaccaaaaaugcaauuuccuuaugcauccuuuaccucuucuguucugcaaccaacauuuguaugagcccaaaauucccuuguaagauauaaaaaaaaagacuuaaguucaauguuucauuucacuccguuuuuauccuguuuucaguuuauguaauaagaacgggcaaacagcugaagaucucgcuuggucauguggauuuccagacugugccaaguuucuuacaacaauuaaauguaugcagacaauaaaagcaagugaacacccugacaggaaugauuguguugccgugcucagacagaaacggagucucggaaguguagaaaauaccagugggaaaaggaagugcugguaaguaacucagagcugcugcuuuuuuccucccgcagugaucucuuguuugcauagcauuuauuauuccauuuaauacugacacucguauuucuaguaguauuguuucauucucauuaacauuuuaguacugguuauacuuaccagagucuagagaccaaaaaugggacugcaugguggaaguuuggggauaaaacucuuuuuaaaaaaaaguuuuuaauguuaacguguuuuuaaaaacagaugucacguggguuaugaagaagucugaagaacgccuucauuucaugcaaaucuauaagcuccugcuuuuggcuuuaccauauguugugucuaaucuccuucugagaaggacgaaaaacuuucuuccaagugaagauccauuuaagaacacauguauuuacaugccuauaauaugcugguuguguaugcuuugucuuuuaaguuauuaaaggaacgucua

SEQ ID NO: 191871 - RNA, 219358 nt, Homo sapiens
cacacgccagcgccggugacgcgccggccgcucucccuuaguccgcauucgcuccaggguuuugggacccuagguugcggaguccuuacccuacccuggccucucgagcaguuguccccauaacucggaaucuagagccgcuguugcgaggcaggagcacguggcagucaaguagcuucccagucccgaacgccgcccguccccaccccgccguggccacuagcaacgaccucugugaaguuggagaggcgguaacggaggcacucccccugcugcaccccgccguuucuacggggcucagaaaccaguuuguuuguuucgucgggguagugucgaccugucuuacgggcgucgcccgagacaggacggagucaaacccgugguaucaacugaagacgagugucagguguggagagucucagugcccccuuucagucuggacugugagcugcugcugguuagacagucuugguuucucuuucaggaugucauuuucaaaaugcgggaugguaccucugcuuuauuaagccccguaggaagacugccacaccuagacugaugcuuauuagucaucaccguuauuccuacuaacguccugugucacugaggugaguuccacuugggggaaggaaugacaugcaaaaugguaaaaaucauccuggaaaugagaugugcguagaacugcuuauauugagauuacacagauaccuuaaguguuugcagggaaaauaccuuaaucucauuuaaauguuaauucucuaagacacucuguauuaacaaagcgauucuuggacauuacgguauuuuuaaaaacuagagcgguaaugggauuaaaauaauaggaaucuuaguauggauaagcaagcauuugcauugcuuauguuguguccaaucuuaaauuacugauaaauuuuaauuaggaagcgaauaugaguaguaguuagcugguuacccuguaaucuuagauuucuguuuccaugauuugacacaguuuccauauguaaggcauuaauuguuguacuacuuuaagaguuuaucauaacuuuuuuugcaggccuauuuuuuguucuuuaagaucugcuuuaggaagcagaaauauuuuuuauugccuugguauguuucauuagaaauguuuaugaaggauuaaaaguggcauccaaucuaaguuaaugaccuuuuuuuaugaugcagcaguauuguagagcugauggaggggagccaaauuuggagagaaguaacuccuuguuucuaguuuacauuugucugguuuuagagguucuacagaucuguuucacuuaaaauauccauuguucuaggugaaauguaaggagccuauuuugugggaaaacagguuuuuuucacguuaaaagucacugucaggaauuuaauaaaggucgucggacuugaccacagaaguucuuuugaggucgugugaauaguacauugacauuguauuccaaguaaauuuugcccugucuaaucuccugccuucuagucuaagucaugaacaugacaccuuuucacgaauguacauucuuuauuuaccuguugguaguuucuacuacaaaaucuguugaauauugucugaauagacuuacagagaagaaaaaauauuuugaaaaaagucuaauagaaauuccauuuuugcuuucugcuuuuucgaauaaaggaagauaaagaacuuuuuuccugagaagauaaauggauccccucccacuauucaagaugguauuuauugcuuaggcagaacuguauguauggauuguagcugcauacagcgccaaaagacuucuugaaaccuguugccaugccuuuaccauguuucccuucaagacagccugucuauagaauaucugaaacaccugaugagagcuuaaugcuuaaccuaaguauguguuccagauugaucgaaguugagcuuuuccauucauauacucuaaaauuguuuauauguggcucacaaaauuuuauuauguccaaaauugcuuauuuguggcuuuaaagaaauucuuaguggcugggugcuguggcucuuaccuguaaucccagcaguuugggaggccacgguggguggaucacuugaggucaggagguugagacaagccuggcugaccuggcgaacccauaucuaccaaaaauacaaaaaauuagacgggcgugguggugcgugccuguaaucccagcuacuuggaaggcuaacacaggauaauugcuugaacccgggaggcagagguugcagugagccgagauacugccacugcacuguagccugggcgacugagugaggcuugucucaaagaaaaaagaaaaaaagaaagaaauucugggucagacgcuguggcucacaccuguauucccagcauuuugggaagccgaggcaaguggaucauuugaggucaggaguucgagaccagccuggccaguauggcgaaaccccgucucuacuaaaaauacaaaaauuagcuggguauggugucacacuccuguaaucccagcuacuugggaggcugaggcaggggaaucacuugaaccucggaggccgaaauggcaccauugcauuccagccuaggcaacagagcaagacucugucucagaaaaaaaaaaaaaaaaagaaauucuuaguaaaaugugaggaaagcugucuuauuugacuagaggcugagguacuuuuuucuggagcauaguucauauacuugaaaagaagcaugaugccauaagaaaacuuugaaugucaaaagugaggaguuuggagauggggaauuguugaaggauuuuaauuggagaaauugauuuagccaguauucuuacuauuucuaucagauauuauuguuuuaauauuuauuguuuugaauagauaauacauuuguaugguucaaaauucagaaaguacaaaagauugaaaaaucuuuucaacuauuaaaugccuucuuuguaggcaguauuacuaguuuauuguguaucucuccauagauauuauuuaauacaagccaggggugcauguguguauauauauacauauguauauuuauacacauauaugaguaacuguaagcauauauacuuauguauuuccuuuuacuaaacaaaugauagcaugccauauuuauuauucugaucccuaaaaaucuaacaguguauuaagaaauuauaucaguuuaaaaguugcuguguugacuguaugugaaugauuacauuuugcucuauuagaaacagugcugcagaggauaacuuuguagauacuuuguuuuccuacauuuggaaauauuuguaggguaaauugcuagaaauugaaucacuacaucaaaguuucuguccccuuauaauuuugguagauguugccaaauuauuuuccuuagugcuuguaccaauuuauagucccaccauauuguuuccugcuauucccccacaguacaguacaauaaucaacugugaauuuugccauucuaauugaugaaacaugccgucucuugugcuuuuuuaaaaaaauugugguuaaauauacauaacauaaaacuuaccccuuguauuuuaaaauuguauuucuucuucuuuuuuuuuuuuuuuuuugagaaggagucucgcucugucacccaggcuggaguggaguggugugaucucagcucacugcaaccucugccucccagguucaagcgauucuccugucucagccucccgaguagcugggauuacaggccugcaccaccacacccagcuaauuuuuuguauucuuaguagagacaguggucuuaccauguuggucagccugacaucaaacuccugaccucaagugauccgccugccucggccucccaaagugcugggauuacaagugugagccaccaugcccggccaaaauuguauaucguuuuacaggagauuggguaucguggcacauuuuaacauaauuuguauucauucucaguguuaacguuuaacuucauauccuuuguccacuuuucuuuuggauuguuguguuuuuuggucuuauaaauauguacgaguuuuuuauuuguuagaaaaaugagaucguuguaauagcuaaaauauuggucuagucauauuaaucccucaagguuuuuugauuuuguguugugcuucagcuaaccacucuaagacagaagucauucucccauguuuuauuuuauuacuauuaugcuuuuauuucuuacauuucaguauuuuagcaucuagaauuuagguugguguaaaaugagggaauaaauuaacuuuuuuuccccacauggcuacccaguugucucacugcuggcuuugaacuuuuuauuucaaaauucaucuuuuuuccuacugauuugaaaugucacuaugauuauuaaccaaguuuuaaaaguuuuuugauuucuggacuuccugugauuugccuauuucauaauuauuguagcuuuguaauguguuuugauauuaagccaaacaaauuuuccuucauugcucuucuuuuucaauauuucucuggcuguucuucuucuucuuuguguguguguguguguguguguaugugugugugugucugaacuuuaaaaucagccugucuaaucacccccagccccaaagcuuauguuuuuauuaggacagcauuaacuguagagauuaggaaugaaaaucuuuaugauauuaagucuuccuauacauuucuuucuccacccccacccccaucccgguguguguuguuguuuuuuaauauuuuucucucaguuuuuuuguugaauauuuucuauugguucauuuuauaggcuaguaauccugccuucugcuguguccugucugccguaaauccaugaaugaguucuuaauuucagauauuuuauauuguaguuuuagaauguccacuuuuuagaaauaaauuuugaggccaggcgcgguggcucacaccugucaucccagcacuuugggaggcugaggcgggcggaucacaaggucaggagaucgagaccauccuggcuaacacggugaaaccccaucucuacuaaauauacaaaaaaauuagccgggcgugguggcaggcgccuguagucccagcuacuugggaggcugaggcagaagaauggcgugaaccugggagguggagcuugcagugagccaagacugcgccacugcacuccagccugggcaacagugcgagacucugucucaaaaaaaaauuaaaaauuaaaaaaaaauuuuaauucuuuguugaaauucuccaucuuuuaaaaaaucuguuuuauccaucuuuuuaucuuguuuucuuagacauauuaauuaaucaugguuacuuucaaguccucuauuaguaacuucauguuugagucauuugugagucuauaucuguuuuuguuuaaugugcaucauuauuuuuugaugggauacuagacauugugaaugaaaagucuuagagacucugaaacauguaucuuguaaaaauuguuaguuuuguuuuggcagucugaugaaguaucagugaauaacuuugauuuuauccaugguugcuuuuaggcuuuguuaggaugagacuguuucaguccuccuccauguaugcacaguuuaggaacagaauaacaggagcagaacuuacuguagauuuuuggacuccuucuauuauuuuuccucuucaggauuuugguagcccugaacucugaccgcuuucucuccucagcaagacugcugcuuuauacuugagcuccauuguacuguagcacaguuuggaaacucucuucagggaaaaggcugggaugaauguagaacccacuaguauguuuccaccuuucggugauuauagccccucaaugcauugcuguuucuuuauauauuuuguucagguuuuaaguuguuuuggaaggugaggugaucugauacuaagaacaccaucaugguugaaagagagucucacgauuuauuauguagacuuucacuuaaucuccuagaucauagaugggauuuccauucuuaguugugccugguguacccaaucuagagauaucuguggucuucuuucaagaugggagaggaguacuuaucugacugggagagguggaggaggcaaacuaagugucugacacuucuuacacaagcucuucaccaauccuguuugaguccuaauauuauccucacucuuagaugccccaguacuuccaauuauugagcuaguuuguggugggaauugacuuguuucugacuuauuucccacugcuggcuuaagguacagcuuuucucuauucuccuaagucaguugcugcauguucuuuuguguuugccagcuucuagaacuguauugcuguugccuucucuucuguuuugccuuuuugguaaucccuuuaaagucauguuccucagguuuggacaaguaguagagguaaauauguacgggucaaucuaguaugcuuaacuguagauuacaguuuauuuauuuuuacuuuuuaaauaauuaggcuaaagaaauuaguaugacuucuuuuaauuuuuugauggaauggcuuuccccaucacucuuacucuuuguggcuaagaguacaauucuaaacaguguugacauuauauauuuucugacuuuuuaauuuucuucuccuugagucauagacuagucgacuuggcaaggucuauaaaauggcauuagguuuaaaucuuucguguuucuagauaaagaaacugaaguccacaaaaggcagaugguuagcguuugauuauguagcuagucuugucucuugauucugaauucauugcuuuauuaggugacauaacucuuuggaaagcucaaauaucaaaaaagucucugauuuuuuccuuguugcuuaucuucaggaucagcuauguauuauagagauugaauugauauaauuauuagagaccuuaagaacacuauagagugaguaaaguugguauugugauuuucauuugauguuggaaacugaaugguagaaaaggcaaacauuaauuugaguuuauuacaauacugaaguaaacaggauucguauguuccuucaguuauaaguuaugauuuuguauguggaagccuauaguacaauuuguuauuguuuucuauuucauuugguaugaaaaauuuuauggaauuauaauucaguugagaagucucacaacuaggaaguagcucaguuaaauauauuguaagaugcugaaaguaaucuauuuuuucauguuuucccuuuuacuuccuuuauuguacacugacauuacaaaaaaggagaguuugucuguuuuccugaaagucaucuaccacaagucuuuuguuguucagaaaagugucugcauuugacauauuugauggcaauuagagucaucuuucuuuacuaacaggaucaguaggucugcuuuauagaguuagaaccacaauguucaguaauguuguuggcaguagaaugcaacacuggggacuuuuggagcuucugucuuauuaguguggucccuagaaaggaauuggcaacuuaauuuuaaggaauggccaaauugacuaauuuuguuucccucucuuggcagaaagucgcagaauaaugaugauugugaaguaaucucauuauauggcuauuauuuaauuuaauuuuugaaauuuagauuacuaagaugaguuuaucuugauuuuuuuuuguaaguagcauaguaauguaauauauuaaacauucauguucuggaaaaaucauuaaauuguggcuggugcccagauagccauuauauugugccaguuaacacaacuugggcuugaaaauauauuuggaacaacuuuucuucuuuaacucacugaugcuaaaaugcuauaauaaugguuuauuucuuguuucucuuaaaguugcuaaaggcaaucuuguuuucuaagguagagaaaggcucuuucucacaaaauuucaugagucauacuuaucucaucagugcuaccacaggcugaguucuggccuguggucuggucuuguaggcacagcauaugauguuugucauuuaaggagauuggaucauuuuuagaggcaaaauaaaguuaaaaacaaauuuggcacugauggaugagauaagaacauggauuuuuuaauuuacaaugagaaauaugguaaacugccacagaaauuuaaaaagaguuucacgacaaacuuauuuucuccuagaaaggaaucacacauuggaagccugcuaugaauggaaauaaaaaagagcaagcuaggugaauuaaauguuuauuaguuucagauuagcauaguaaauucauguaugucuacaauaagggugauauugccaauagguuguacacauuauugcucuuaugacucuuucucacacuuuuuucagcuuucacuagcuagcuuauuguauucuggcuucuccugaaacuaccacucuuuugaaauuacuauuccuaaagauacuaaugaccuuaaucaauuguuuugguaugguaaggguuuaagugugauacuaaaaguagaaauauaaagaaaagauuaauacauuuguuuauaucaaaauaaucuuuuauacuuaaaggcaacuaggauauaagggaaaauaauuuaugacagauaaggacuucauuacauaaggaguuuuuacaaauuaaagaccaacucaguauaaaaugauuaaagaacauggaugaauaguucaaaagagaaaaaauagaaauguucaauaaauguggccgcucaugguggcucacaccucuaaucucagcacuuugggaggccaaggcgggcagaucaccugaggucaggaguucaagaccagccaacauggcgaaaccccgucucuacuaaaaauacaaaaauuagcugugugugguggcacacaccuguaauccuagcuacuugggaggcugaggcaggggaaucgcuggaaccuggaagguggagauugcagugagccgagaucgugugacugcacuccauccugggcuucagagugagacugucuuaaaaaaaaaaaaaaaaaaauguucaauaaauguggaagaauuuuucaaauucacugguaagcaaaagaaaucaaaauaaaaacgaaacaccauuuuccccauuagacguauggaguaacaacaauaacaaauagugacacaguguucauaugugccaaguacuguuuucaguacauucuuacauuaacuaauucuuccaacacuucuguaaauauguacuaugguuauucacauuuuacaugugaccaaacugagcacauagagauaaguaacuugccuaaguuuacauaacaaauaagugauaaagcuaagauuuaaacuuuuuaguguucuuuaacuacuacccuuuauugcuucucaaagauuuuaauaaauaacaaccaguguuuuguuguuauaaaugacauuacaguaaacaucucccuaaauacaagaaauaauaauaaccaguguuaaugaggguaccuaguagcaggcacuacuggcuaaauacguauuaguagacaguucuguuaagacacuuaauauguuugaaagccauacuguaacaugggcauauucuuugaauucagaauuuauccuaaggaaauccuuacaauaagcacauuaaaauauguguacaaaaacuauccaaaauuguucuauacuagcaaacauuuuaaacgaauguugaauaagaggggauuaguuaaauaacuucaagaaauaguguauuauuagguuuucauucuuuuuggagaaaauaaaguaaugcuacuaauuaauucauguaaguuugccuuucucuccauacauuaaguauaugcaguauuuggcuuuccaaagcauucuuauaaaauugaaauaucacauuuuuuucucuuuuuuggauguaauuagguuguacuaguaaaguauauaaaguguaacuuuuagugaauauauuaaauauccuuuuuuaaaauguuagcaaaucacuaaagaauuagaauuugaauuaaacauuaaaauuguuaugaaguuauaauguuuuaucucauguuauaaaugcuuuaucuuuuuuguuaguuuuuuaaaugucuagcauaucuguaaagaugccuuagaaaaagaaucauggagaaguauguuagacuacagaagauuggagaagguucauuuggaaaagccauucuuguuaaaucuacagaagauggcagacaguauguuaucaaggaaauuaacaucucaagaguaaguauauuuuuaguuugguuucaugaguaaugguuuaguuacaauagagcucauuguuagagauuuucuuuaaaaaaaaaaaaaaguaaucgauaaccuaaagcaaaagacuccuuuauucccgcuaauaucagaauagccuauauauucuuucagauuuuuucuaugauaugugcuuauguuuauguguuuagaaaaauauacuugcuguucuguaaccuaaucuaguuuggacaucuuaaaauguuucuacuuacagauucaacucauucuuuuuaacuucuugcuauauuuuguugauugaacuguauuaauacuauuauguuuuaaccacucaccuauugauggacuuuuagguuguuuauuaaugguuucauuuacuauuuucuuuuuccucccauuuaagauguccaguaaagaaagagaagaaucaaggagagaaguugcaguauuggcaaacaugaagcauccaaauauuguccaguauagagaaucauuugaaggucagauaaauuaugcgagagaguuaaaaaauccuaagacauuaauaaaucuuuuugugaaugcauucuuaggaaaaagauaccauuuuugcuuaaaaacauacgcauaugaauaucagcuugauucaaggacaauacugauaucaugccugcauuuuuuuuuuuuuuuaaauugagacagucucgcucaguggcccaggcuggagugcaggggcaugaucucggcuuacuccaaccucugccucccagguucaagugauucuuaugccucagccucccaacugugccuguauaauuuaauacuggcuguuauuagugauugcuuuaaaagaagcaaugcaguaagugcaagaauuuggacagagcaagaacaguaauuuacauauuuuuuaacugaacuuccuguaagugcugccaccacuaccacugagaaaauguucugaucuuuagaaaguauccucacucaguaugcuccucuguaccucacuauuauaauagugagguauguugaaaguuuucucagguucuuaaaguauuauagcuauaaugcuguuuuggaacuauaugcauuauauuuaauaaugcagguauuaagauaaggcaaagcuucucuaaaggcaggucaaagugguuuauugaaguccuacccaaauauucucauuauuauaaauuucuguaacuuaauuucuguaaacuaaaaaccagguaaucuagauugaaaguagaagauaauugaaaugacucagggacauaucacauaccaguuucagagucugaauuagagcuaaaguuacuacauucccagaugaacucugugucuacuauaagucucuucuacuuuuauaaaaaugugauucaauuaauacauuaugucacaagguacuguauuuuuuaugcuggcagugaaaugaagauuuauauuucaugugaaagaguacaaaauuaaccaacucuuccuuuucaggaccuugaauuuuccuuuaucuuucuccuggcaucuauccuuuaguuucuuuuuuuguuguuguuaacaaaauuuuaauauuucaaguuaaaagguuuugagcaaauauuccagcagauguuuuggauuuauauugacugcuucacauagaaacaucugugugauucaaaagggguagcguauuuuaaaaauaaggcuuuauuauuucucuuaguuuuagaagaauacaugcuagcaucaaacauaaaugauagcauaguauauguaauuuuuugcuuuuuguuaugcuacauacauuauaacaucuauauacauauaaauagugaauuauaguuuucaggaguuuuuuucacauuauaauuucucacauguauauuuggaugaucuuuccaggucaaucauaaaaagucauacagauucuuaauuagcuuuaucauauagauucuuaucccaguggcacauuacaaacaguagaucaaaagaagauaugugcaccacgagugacaagaaugucaccacaaaguauaagaaauaaauacuccuggaggcuggaugcgguggcucacaauuguaauuucagcaacuucgggaggcugaggugggaggaucucuugagcccaggaauuugagaucagccugggaaacauaggguguuuguagaccccaucucuacaaaaauuuaaaaaauuagccaggugugguggugugugccugcgguuccaccuacucuggaagcuaaggugggagguuugcuugagcucgggaggucgaggcuacagugagccaucaucgugccauugcacucuaaccuggacccugucucaaaagaaaaaaaaaauacugcuggaaauaaggccauagcacagucagugaaagaagugagaacuaggaaaacuguucuuugaguugugauagucucaguacuauguagugauucagaaaauguuaaaagugauauuggccacucuuccuuacuuaagaaguaagggauggaaagaaucaucaaaguguucuucuaagcuggacacaguagcaugggcuuguaguccuagcuauuggggaggcugaggcgagagguucccuugagcccaggagcucaaggucagcaugagcaaaauauugagacacuuuuucuuaaaagaaaaaaaaaagccuaaauaaaaaaaagaaguauucuuguaguccuuucuauccauaggaagaagcacagaaguaccuuucuuuguggaccgagacauaaagguggauggggcagugcccaucuucauguuuguucacaaaucauaugcaauuuuuuaaaaagugcauaaaauuaaggaaagcucaaagaggguggaaacaguguauccuauacacuguugaauccucagaguuuaucacaacacuuauuauuuuauuuauuuaauaaguaagugauuaaaguggauaaaacaaagcagagaauuaauggccagucagaaaacuaagauaacccaucucugaugugauauauugguggaaaaacaugauuuuaugugugacauuuaaggaauuguauuuauugaaugaaaucaaguaugucugcauuuuguuuauauuucagagauguuuaggucaaugcaaacagcacuauucaauaaaauaguguauuuuuaauagaaaucauuaaugauggaguuuucuguuaaccuaagucauuauacaaucuuugugaccgguauaccuugacuuugugcccuaauucuuuugaguaugguccuguuuuuuguucagcagcugcuuuuuaguaagcuuuuaaguacuuuuaauuuagccaugcuuuugauguacguuuuuaaaaguggacuguaauguuuauauuuuguagaaaauggcucucucuacauaguaauggauuacugugagggaggggaucuguuuaagcgaauaaaugcucagaaaggcguuuuguuucaagaggaucagguaaguuugcauuuaggaaauugacucuuacucuauuauugagaaguaguucaaaauuuguuuauguguguauuuguuuuuaacuacaaaugcuaaucaaaauuacuagggaaguuuaguauaucaauaguuuacucauauuuaccucuaauuagcugccaccuuuguucaguugcccaucucauuuauagucuguaaugauauauuguuaucucugugauguauguuauauauaucaugcgucuauguauaugccuuaauuauucauuauaacugacuagucuauauucugucaaucuggcuuacugcugccagacuauauauuccuaaaauguggcuuugccagguaacuccagcucuagaagccuugcaccgacaacugcauuaaaucuaaucucucuuuugauuuccaggaucucuaaaauauggccguucccuaccuaagcagccuuauuuuuuucuauucccuaaucuguaccucuuuucauuugcuuuaacagauauuuauugagcaugugcuuuguguuaggcaccgggccacauguuuguacaucucauucuccuuccuguguauuuacucugauuauuucauuuauuuugguaagccuuuuccccaaacuuuguuauuaauacucuaccuuuuuuuuuuaagcucaguucaagucccagcuucuuuaaauuuuccauaacuacuuuaaucugugauauuuuccuucucuacauuccuaucacauuucucauuaucaccaguucuuaauuuuaauugcccgcuuuuacauaggggaguagagggagcacugugcuaggaguguuguauuuguuaucucuucuaauuuggauaaguuuuuucaauuuauaaggaauccaagagagguuaaguacuugccccaaaucacauagucaguguuugaacccaccucuaacucuaaaguuuauaacauuuucuuuucacacacuugaauuauaaaaguauugaaguauacagaaauggaaagucuucuuucuccacccuuuuguuccugagauuaccacugcuuuuaguuugguguauucuuccagacuuucuuuuccauacuuaacacauguacauauauacauuaagacacacacauucagaaaugggauauuauuauuauuuauuuauuuuuauuuuuauuauuuuuuuugagacggagucucacucugucacccaggcucgaguggaguggcacaaucucgacucacugcaaccuccgccuuccggguucacgccauucuccugccucagccucccgaguagcugggacuacaggcgccugccaccacgccuggcuaauuuuuuguauuuuuaggagagaugggguuucaccguguuagccaggguggucuccaucuccugaccucaugaucugcccgccucagucucccaaagugcugggauuacaggcgugagccaccgcgccuggcugggauauuauuauuuuuaagauaggcucucgcucugucaccccagcuggagugcaguggcaccaucacagcucauggcugccuugcacuccugaacacaagcaauuuucccaccucacucucuggaguagcugcugcuacagaaacgugccacuaggcccagcuaauuuuuuaaaaauuuauuuuauuauuauuuuuuuuuuguagagaugaggucuugcuauauugcccaggcuguucucaaacuccuggcuucaagcaaucuuccuaccuuggccucucaaagugcugggauuauaggcacgagccacugugccauuucuggccaggcacagacauggguuugaguucuugcucuacuuaucaaguugguaauuguucuguuaacaaguucugagauuauuuucucauuuguuaauagggagauaccuacuauacauguggugaaggucaaauaguaauguauguuaguauauacaaugcuauuuuuauuagaacauugucagauauauuucauuguuugugcuuauuuucauucauuuaucccuaucgaacuuuaaaauguuugcuauuaaaugauauucccuuauaaagcacauugauauuuuauagauuugauucuacucuuugauaaguacucuuaguacauaaugugguguguguguguauguguguguguaucuugucuuccuggaaauuauuauggagauuuguauaguucauccaucagugaaguuauuuaucauaaaugauaaaaauuuggcaagccauucuuuuaaguuaauagcauuuuuucuacccuucugaauagcaaguucuguuagcacaaauaaggaugcuauuuauuuuagccuauuuaaaauaggaagaggucauuuaaacuacuuucugggcuuugaaacaggaaaacuuagagcuccauuaaacuguagcuuagcaucaguuugagaugauuuugucccuuucuagaauguaaguggggaacaggaagaccugugaaacagaugauucuccagcuacugaagccauucucuucagugauacuuccuguuugcaucuuuacuggacaaaaaucuagucagguuaagaagcaaccugagucuaugacuuuauuaauagaaaauaaugagaugaacuaaguacguucccuuggacagucucuacauagauauuuuaaagauguaccaguauuuuugccuuauuugaaaguuuuggaugaguuuuuuugauagucuccccacaugugaccauaaauaauuuucagaauauauucuugaucaaaauaaaaucuggcuucauuaggguugguccaaauaguuaggugcagcaagaauguuaauuaaacaaagaacuugaguuugcucugaaaaccuagagcauuauauuaucaaacaacuacuaagguuacagaauugauuucugucuauaaauuuucauaaagaaucuuugauuggauuuuuaaaaacucuuauuauuuguucuucuauccuaacgucaggaaacugagcccgauacauucucuaccaaauuucaccuguaguaccuauaaauuggagugaaguuuuuucuuuuugagaaucuccaaauaugccaaggucccugguugcuagaaagugacuuuaccauuuacgacgcagggacccuguaaguuagauaacaggacaguuuccuggcagcacuauguaaguauugguuccacauauauuuccuuuuuuuuuuuuuuuuuuuuuugagguggagucuggcucugucccccaggcuggagugcuguugcgugaucucggcucacugcaagcucugccucccggguucacgccauucuucugccucagccuccugaguagcagggacuacaggcgcccgccaccacgccggcuaauuuuuuuggauuuuuaguagagaugggguuucacuguguuagccaggauggucuugaucuccugaccucgugauccgcccgccucugccucccaaagugcugggauuaugggcaugagccacugcgcccagccugguuccacauauauuucuuaguaguagguuugucauaacugauuacaugaaaaucaucucaaauaaggcacuccagguauggccuugguugcacaauugauuuguccaauuacauucugauaaaaaggaauauagauucuuaucgaacccaugaaaauuaccaauauuguccugaaaaguaaaaauauguaaaacuauuugcuucugaauucugaguaaauuauuaagaucaaauaucauuuuaaguuuauaaaaacauaaucuaaauugagaauuagauauagcuuaagaaagaaaaaaggcuuccucaucuauucauuaaauuuugaacauuaaaaauaauaccaaucauauuccaaacaaccacaauuaaauuuuauuuaauucaguuuauucauuccuaguaauucuugaucuuggaucaagcaguuagcauucaugauguuugucagcuuauguacaaaaaagucuugaagaaauucugacucaguucauugauaaguuccuugaucauuuaagcaauguuaggucagaaacuuguacccaagagucuauuuucugaagugccaguaguuuggcauuccuaguguaguccuuuucaggagcuuucuggcaagcaucaagcagcaaaggccuauuugauaaugagacugaaaggcugugguuaguuuauuauaguaaccaauaauagaauaaaaugcucuguuggggcagaguacauagauuugauaagggcuugaugaauguuuuucuugaggauaaaaauggagagcaaaguuacugacaaaucuccagggccuucucuaaagcaugcauuuugugaaauauuaauaguauuuuagcuauacagacuuaaccuaggaaagacugagcaucuuuuuagauuuggcaagucuucccaggcauguuguauagcaguguugagcuaauaguuuuagugagaaguauccugaaaauuuuuuuucuaacaaauagguaacauucuuugguuacuuauuuaaucaaagugacaaaauauuguaaaauguagaugaaggaaauaaaauuauaaggaucuucacagugaggaacuuuuguucaaaaaacauaaccaaaugauaaaaucaguauaaagcagagaaaauuauucugguagacaugaaauaucuacucuuugagcaaauuacacagacaguaaaugguaagcuuacuuucuucugguuagaaguuccaagaucaguuuaccauucuaauagagaagccaaguucaaguuuuuccauuaguauaauguuuggcaauaaaagcucaugccuuuaaaaaauuaaugcauaaacccaucaaaacugagcauacuuugggaaaauucuaauacauuuuauuacacauagaaaucucaguuuuggagcagagaagaugaauugugguacuguuuggugcuauaaggccgucuguacuaaugcaaaauaacauacaacuguaauucagacaacuauaugauaauuacuguaugguucuugauauaauacaacauaacauuugaauuuaaaagucuucugagcaagagaaucccauuuucgaaacaguauuuuguaaauauuaauauggaacuaaugugugaugaaauaaaaugcacagauuagaagcaggguuacaauuuuuuuuuuuuuuuuuugagacggagucucacucugucgcccagacaggagugcaguggugcgaucucggcucacugcaagcuccgucucccggguucacgccauucuccugccucagccucccgcguagcuaggacuacaggcgcccgccaucacgccuggcuaauuuuuuuguauuuuuaguaaagacgggguuucaccguguuagccaggauggucucgaucuccugaccucgugaucugcccgccuaggccucccaaagugcugggauuacaggcgugagccacggcgccugaccaggguuacaauuuuaaagggcuucccucuccuccaaguccaaccccauguggucaaacccuaauguagcaagagucugaacuaggguagacaaagggaaugaaaauguaacauuuauauuuuauaagcugugccuuucuucucugcuuugcuuacauauuccaucaaaacugagcucagaaaucaccucuucuguccagcuuuauuuuaucaccuccagacuguguugccgcuccuucuguaugcuuuuucaacucagggcauuacucccuuuaauuacugguuuacuuacccaucucccccaguagucuuugauauggaucaauaaacaauggcccaugaaccaaauuuggcccccuaucucuguuaguuuuauuagaacacagcuaaacuuaauuguuugcuuauaaucugugguugcuuuuaugcuauaauggaagacuugaguugagacagaaaccaucuggccugcaaaaccuaaaauauuuacugucuggccauuuauagaauaaauuugcugaccccugaucucugagcucuuucauuaauuuuuuuuuuuuuuugcuaguuccugcacauaucugguacauuguugguacugaauaaauuuuugucaaauuaagaaguacaaguaugggaaauaugguaauagaagaacacugucugugaaaugagacaugagugguuucuaagauguguuccauuucuacugguaaacuccauuuuaucaguaauacucaacuuaacauaauuuucacuuucuuuuuccugaccucucccuuguugaauuaauugcugucuuauuguauauaucucuguuaaaaagcuuaugcaauuauuauagguauuugugaguauauuccuuaucacuguacggacuccuuagagaacuguuuuugaucuuuauacuuaaaaugccuuacgugaguauagaaaggaacuuaacaaucuauguaauccucauuaaauaaauaucuauagaacugaacugagaguuuuuuuuuuuuuuaaagaaaauuguuuuuuaaaaaaauacugaagagauagaguaaaagguaaacauguuaccuuucauucccucuucugccaauccacuucccugagguaaacacuguuaacugauugguagcuauccuucuaugcuuccuuccuuuauuccuucuuuccuuccucagugcacacacacaauuacauagauucagguauggaauauaagcauauuuuuuuaaauagggguauacuaugcauacuguuuuggaacuuccuuuuuucacuuaauaguacauaaacaguauacauagaagugcuucauucuugucagugacugcauaguauuucuaguauagggaucauacaauauauuuaaucaggccccuugaugaacauucagguuguuuauauuuuuggguucuggcuaacagugcuguaguaaauaucuuauauacaugguuuuauauuucugauauuauuuguaggauaaauuugaaauugaaauugcuguuucaaaugguaugugaauuuaaaauuuucacauauuuugacaaaugauuauaauuaaccuuuucacaaacaccugugacaaaaaggcuucuuuucccaacauucugacauacaguauguauuauuucauuuuaagcaagauaauauaguaucuuaauuuuuuuuuuuuaauuugugagggaguuuaguacuuuguauaugcguuuuucgggcauuuuuucgccccgucauuugcaucuccagucuuuuguccacuucuuauuuugucugccaguacuuuucucagugauuugaauaacuuuugcaucuuagagaacuagcaaucuaucauuuauguugcagguauuuucucaaauuauuauuaaacuugauuauauguauuuugcucuacaguuguuuuaaauuguauguagucaacuuuaucagucuuuuucguaugacuuaagcauuuuaugucauguuuugaaaguccugcuuuagucaauuauuacagauaauuaaccuauguuuucuuuuauuauuuuuuuuuaguuuaaaaaugccauguacuuggaauuguuuugauguuaacaaugagauagaaauuaagccuuuuuauuuccaaguggccgucuccagagaagaguguuuauauauaauaaaugugggaagagaaaaaaagucagagaugucuuccaaauuuccagcuugauuuuuuuccuuuugugauuuuuauauuuuuaaaaagcauuauagaggucagaugcaguggcuuguaccuguaaucccaguacuuugggaggccaaggcaggaggaacacuugaaucucaggaacuccugagaccaggaguucaagaccacuagccugggcaacauagugggacacugucucuguaaaaaaaacaaaaauaaaaaacuagcugcucgugguggcaugcaccuauaguccuagucccucggaggcugaggcuggaggaucauuuaaacccaggaguuugaggcugaagugaacuaugauaacacgacugcacuccagccugggugauagagcaagacccuaucccuaaagaaguggggggggggcguuauagaaaaaagauguauuaaaaacaaagaagaaucaccuguuugucuuaauauuauaaaauauaaauuauuugcauuuucacucauaaaguuacuuuccauguuuguuuugauuuauaagagaugacccaguaacaucucuuacauuuuggauuuaguaugugcagagcuuguguugacuugaauaucuauuuaaugucagugccuacaaaguuaaaagaaauuguagccuaaaauaucuuuuuaaggauuuaguuccucucaucccuaaauauucuugaauucuuuuaauggucaaagagaggcuugacagaucugauuuuucuuccuagauuuuggacugguuuguacagauauguuuggcccugaaacauguacaugauagaaaaauucuucaucgagacauuaaaucucagguauguuauucugucacugauaacuucugaauggauaaagacauggaaccuucauuguuuugggccaaaaauuuuugaaccugauuuagugugcaucagauuaucugucuugucucuuccuuuuuauccuauucaucugcauccuguauuagaucuccugcuugcuucccauacucuaaaaauuacuuuccuucccagucucugaaacuuacagaacauuuuuuauaacuccaaaaagaaccucguacccauuagcagugaguucccauuccucuccaccuagacucugguaacccuuaaucuuucugucuguguggauuggccuauucuggacauuuuauauaaauggguauuaugaaguaugugccuuuugccugucugucugucugucugucugucugucuaucuauuguuuuugagacggagucucgcucuuuugcccaggcuggagugcaguggcgugauuucaggcucaccacaaccuccgccucccagguucaagcgauucuccugccucagaccaacgaguagcugggauugcaggcaccugccaccaugccuggcaauuuuuuuuaguuuuaguagagaugggguuucaccauguuggccaggcugaucuugaacuccugaccucaagugaucugccugccuuagccuuccaaagugcugggauuacaggugugagccacugcgccuggccccuuuugccuacuucuaagucauacuauuugguuuuuuuuguuguuauuguugaguuaugcaagcccuuuucuugauaaaaguuuuuucucaaauauaugauuuguaaaaauuuucucucauuuuauggauugucucuuuucuugaugguguccuuugaugcacaaaaguuuuuaauuuugauaguccaauuuauccuuuuaauuuuuuugcuugugcuuuugacgucauaucuaagaaaccauucccuagcccaauggcaugaagauuuauuccuauguuuuucucuaggaguuuuguauuuuaguuuugauauuuagaucuagacuccauuuugaauuaauuuuuguuuaugauuugagguaggggacuucauuuauucuuuuguaugugaauauccaguuacucuagcacaauuuuuuuaacuggauuuuaaauuuuaugaaaaauguugacuuagaacuggacuguaacaauauuucuaggguuuuuuuuuuuccugucuuuuacagaacauauuuuuaacuaaagauggaacaguacaacuuggagauuuuggaauugcuagaguucuuaauagguaacaugaauuuuaaacuuuguuuugauauaauguuuucagcgaaccuucaauccaugaugauguauaugugauaauuuaugguaucuuuaaguacauucuuuacugggauguugcuuuauugggacauguucugagaaaggcaucauuaggugauuuugucagugggugaauauuauagaguguacuuauacaaaccuagaugauagagugugcuacacaggcaggcuguaugguguagccuauuguuucugggcuacaaaccgguacagcauguucuguacugaauacuguaagaaauuguaacacaaugguauauauuuguuuaaacauagaaaagauacaauauaaaagauaaaacaugauauaccuuuaugggacacuuaccaugaauggagcuugcuggacuggaaguugcuuucugugagugagugaguggugagugaaugugaagaccuagcacauuucuguaugcuacuguagaguuuauaaacacuguacacuucggcuauacuaaauuuauuaaaaaauaaaguaauugcucuacaguguaugucagucaccgugucacuaggugauaggaauuuuucagugucauuauaaucuuaugggaccagcaucauauaugcgaucugcuguagaccaaaaacaacauuaauguggcacaugacugugucuuuaacuucuccaauaauuuuauuuuucuucuaguacuguagagcuggcucgaacuugcauagggaccccauacuacuugucaccugaaaucugugaaaacaaaccuuacaauaauaaaagguauuuaaaaugauauucauuaugugauguauuugcuuucaauuuuuuuguugucauguuuauuaaccuuuggaauacuauucuaaaauaaauaauacauacauguaaacacauauguauauauaaaauguugcuaauauauggugaggggaauuguaaaaaagcuauuugauuaucuuacuggaagaacagcagaaagaaucaccuuauuauuuauguuauaauugaaaguagagugcuuucuuuggucuuuucuucaugauagucacuucuuauuaaauuauugcuaguauuucuugaacacacuauaagccagguacuguuucgaguucuagguauucucuuagucuucacaauaauuuugggagauguagguauuaaucauuccuccucuucuuauaaggaaaccaaaagcagagagaggcaagguaacuucuuugaaauccuugagucuaauaagugguggaaucagcauccaaacuagacaucuggcucccaagcccauauuucuaaucacagcacuguagucuggcuagcagacuauauaauaugugcguagaaagagcaauucuaccauuaaauuccagcuacccuuuauuuucucucucuaauuggaaaaucccaaccaagguaacauuagucaguagcuguugcaaauuucuuaauacauuuuuaauguccauuaaauuaguauuuuguuuuauaauuuuuaaaaucaugguauuuuacaaauaauugaaaaaaguuugaguuuuaugaaauaaaaauagaauuuacgugaauuuuuuugauauuguucuuuuaaauauuaaauuucuuuaaugaagcuucaaaguaauuguuggggcaaccauuuucuuuuuccaaucugggacagcuacuuuugucauuugauuaugguugaaauuuuuaguuuuaaaggaaauuuuuucuggagcacauauuuuuccaaaacacuuuuaugcuguuuguguuuccuuuaaaugaaaaaauuugaaauacuuagaggaaauuucucauuuuuaucuucuccagugacauuugggcucugggguguguccuuuaugagcuguguacacuuaaacaugcuguaaguagaaguuucugaaauacuuucaaaguuauguuaaaaagcgacuauaauguuuuuauuauauuuuaaguuauauuaucuuucagguaacccucauccuagaaauucuccucuaaguccauuuuugaauuucucauuuuuucugaaguauaaaucgauuucccuuuguauauaugcauaucugguauauuugcuauuuuauaauauuucauauuuuccagaaaauuauuucuaaugacagaaauaaauuuugcuauuuucuuaauguuaaauuuuguaugaauuugauauuucagcuuaauaaauuuuacuaguuuuguuuuagugaauucuuucaaaacacccagauugaguuuggaauugaacuaauuuaaagaauuucauuccauauacucacugaugacuuuuaucaauuugaguaaucauuaauucagaguauuuaaaauuuuuacuuuugagacuuuuuuuugaaauaacauauaacacacuaaaaagggggaggguucuuguccuaaguagguuuaaucuuaaaaaagcaguuuuuugaaauggaaagugauuaacauuuuuuacccacugauuaaacaauauuguauuuucauuacacaaaacuucagaaaauauaaauaagugaauaagguucauaagcaguucuuccagccaguauugacuaccuguaaaaugaaauuuuuuuuucuuccccaaaaguuugauuagacuuuauaagaaguuuuauaaccugacuuuauugcuuaauacuauuuggggaauauuuuuucuugucauucuuuuuaaugguugcauacccuuuuacuauauugccuuaguuuuuuuuuucuuucuuaaggaaaaaagcauaagcugacaaaguaaugugggauggugguuaucagaugcuuauuugaaauaauugaucaguuuuucugcaacacaguuauuugagcuuuaaaccauugguuuguggguuuuuaaaaaaucuuugcaacuacauuguucugucaccaucucuucuuuauuuugggauuguuuacucuuaaguagcaugugucuuaagauacaugaaauucaguaacuuacccuuuaugaagagcgugucaauugagagauaaacgaaagugcauuggaauagagaaccacaucuuuucugcauuuaggauuccuauuuagguguacagauguuucuguaagauugaauuuacucaaaugacauuuaggagagcucaacauuuaguagaacuuuuguaaucacugaugccuaauuuauaguacauuuuauuuuauuaauauguauauuaagaagauaucaacauuguacaauuguucuguaauauuuuaguggagauaucaaaagcuuaauauugcccucuuucaaaaugaaaucuucagauuuuaaacugcccuaccucuuguuuucuuuuuacuuuaaaguuuauauuguguuuaauucugacauauauauuccuauuaagauauuuuuuauauugcugauuuccauagcuuuuaggagcaucacacgcacacauaauagugagcauugucuaaaaggaaaguauuaguaguuuuauuuauuauauuuucccccaauacuuuuaguucuguaguuaauuucuuguucuagucauuacaacagaggcacuaaaagucaggucuuaaaugaagaccagcagguuguucuuuuucugcuugugguucuuuggcccuaauuuugcuaccucugaggcauaaccuuucaccauuugauuauuguuauaguuuaugaaacguuuauuuaauacaucccaucuuuaaauauuucgaauaaguaaaaauuacucuuauuuuuugagggcugauauuaauuuacagauaaccaaguaaacuuugcucuagaaaacauauucuaauuauuuggaagaggauuguguuucuauucuauauugguaggaaaagaacuauuucucauuaccgauauucucaguuucaauuuauauauguuuccuauauguuauuuauuuucuggaauuuaguuugaagcuggcaguaugaaaaaccugguacugaagauaauaucuggaucuuuuccaccugugucuuugcauuauuccuaugaucuccgcaguuuggugucucaguuauuuaaaagaaauccuagggauagaccaucagucaacuccauauuggagaaagguuuuauagccaaacgcauugaaaaguuucucucuccucagguaaguucuuuuuccuuuaaaauuaaacaguaggguuauguugcuuagcuaagacauggccuccaguguugaggagaacacaucuggaucuuggaggaauggugugccuuuuucaaacuacauuagugucacuuuccuuuccauggucuuucuuuuucuucagacagaguauugcucuguugugcaggcuggaguacaauggcaaaaucauagcucacugcagccucaaacuccugggcucaagcaguccuucugccucagccuccugaguagcugagacuacaggugugcaccaccacacucagcuaauauuaaaaaaaaauuuuuuuuagagacagucucauuauguuauucaggcuugucuggaacuccuggccucaggugaucaucccaccuuggccuuccaaagugcugggauuauaggugugaaccaguucgcccagccuuuccauucuuauauaacuguuuucuuaauguuugcuuuccaguuaugcguuauuccucuguucucuggauuucuaacuguaaaaucauugagcauuucugugcuucacucuccucaccugugagcaaagggauuauuaaauguaucuauaagguuauugugagaauuaaaagugauaauacacauaaagugcuuaaugucuagcauguaagugcucaaaauauuuaaugucuuaaauaucaccuacauaucaauguauuuuacuaauacaaauuuuuuuuaaauuauuuuugagacagguuguaguucuguugcccaggcuggaaugcaguaucaugaucauagcucacugcaacugccaucuccugggcucaagccauccuuccaucuuagucucccaaguagcugggacuacagccacaugucaccaugcccaguuaauuuuuguauuuuuuguagaggcagagacucaccauauugcccaggcuggucuugaacuccugagcucaagugaucuguccaccuuggccucccaaagugcuaggauuacaggcaugagccaccacgccuggccuauaaauguguuauuaacguaauuuauauauuauaguuauauucuuuuugauaggaaaugacuagaaaccauuuauauguagguauacuagauuacugacucaugauuucuccuuuagugcacacauguaggugcauaauauuuguugaguuuaacugaauuuuaauuucacaagauuuuugaagcaaucuauaucaaaucaauuagcauaaguuauucauaaaaauuugaucaccugagauuggaauuguuuuacuuuucugguuuagugaggucuuuguuaaauaacuguuaaccucuucaguaaauaagauauucagcaaaacuauaguuuuuuuauauuaguuuuauaugcucauggagaagaaggaaguaucauauauccuucugacuuaacagaacaugcaugugaccaaauacucuucagaaaacagauguugauuuuacuguuacuaccaggagaaugcauuaguaugcaagaaagccaaauaaaauuuggagauuaaagguuacuuguauaggucauagcagcagcuucugaaaugugggugucuuacaagacuccuuuguuauaaauaacguuugcgaggacacuuuuauuauguagcauacuauuguuuuuuuggcagccacuagagaauaaacaaugacuucauuuagucuugcugagguuucuuucucccuauaccaggaguugggacauacugucucaaggcugaaguacuggaauuuagcuagcuagcaaugaaagagaaaauauucaagccuaaaaugugccaaacuuauaauaugaaaagaaacaaggguagauugugauuauucacaaaugggauauuugacauuauguguuuauuauauacauagacccuacuuguuacuauuuaagcaccacuuagauuucauucuucaugaaaaccuuuaucugcuguuucucagauuuauuuucuacuauauaucgcuuguuguuuaaagauaaaaaccuuuaucugcuguuccucagauuuauuuuguacuauauaucuacuuaggugagaagcuuugugauacuuuuuuuuuuuuuuuugagauggagucucacucugucacccaggcuagagugcaguggugcagucucagcucacugcaaccuccaccucuggagcucaagcaguccucccuccucagccuccugaguaguugugauaccuuuuuuuaaaggcuauaacuuugaaacaauucaugagcuuuaguguaacauauaaacuauuauuuccaguaucacuguagugcucccuaccauuuuaauaccucaguccucucaaggccaucaaccgugguugauagggccuaguuuucagucuugggcacuguggcaacuucuuccuggauauggcuugaaaaaccauggguaaguucugauucauuaggaauguaggggcuguccaguggaaugcucugugaugaugaaaauguucuauaucugcauuguucaauauugcagccacuagccacaugugguuaguaagcacuugaaauguccuugguauaacugaaaagcuucauauauauauaccuuaaauuuuaauucaaauaggcgcauguggcuaguggcuacucuauuggaaaacauaacguaggguuuucaggaucuucuuggauucuauaugccccaucucucaauucacaugagcauuaacacaggaaaacaaagacuucuccaacaguggaagaaaugauuagauuuggggacaagauggagaucauaaaccaccuguuuucuuccaagaaaaagaaaaggaaaaaaaugcauuuguugagaagagaacacacguucacaugguugcucuaaauugccugugagccagacuuggcucuuaacauuuguccacuagugaaaagguucucaaacuuuagcaugcaucagaaucaccuagagggcauugcugagucucaccacaacagucucgguuucaguaauuuugaaguggagccugacaguuugcauguuuacuaaguuccagguaaugcugauccugcugguaugagacuuugagaauugcucuagggauuuucuuaaugggaaaaacaacccccucagaucauguauuuuuuuuugccuauuggagugucuggaccacuguuaauauaggaagauucucucaccaagaaucaguucucuugaaaaaagagaaaauucacuugccuuugccuuccccacaaaguaagaaaaaaaagcauaaaucgaguuaauucuuuguugguaucauaguuuugaagugaaggagagaaaaauauggaguaaggagaaaaaauuacuugcagaaaauguaaaugauuuuuguuccugauuuauaaacaucuauguuuauaaaugcuggagaauauauaauggagcguuuauacuaauauuaaauggguacauuuguugaauuaagaauauuuacauauucaauaacuuaauaaaauuaguuauaauuuauaauuaugagcuacaaaacucauuggagauguuaagaggauucagaguaaauuaaaauaacugagagauuacuagauaauuucuuuugauaaugaagagauucuucaguaguuuugaagaaagugaaggcuauggaugcacacagaauauagagauuuuuccagauagguaguuguguuaaauugcugagagaugaaauaggcgaguaauguauggaugccuaccuuguucauuacauuaauuugagaagaaagccucuaucuggagaacuaauaaaaauaaauuagugcugggcacgguggcacauaccuuuaaucccaggacuuuggaacacugaggaaggagaaucacuugaucccauacauucgagaccagccugagcaacauaaggagacccccaucuccauaaaaaauaaaccaaaaaaaauuuuuuuuaaaucagccuggcauggugacacacgccuguggucccaacuaauaggaggcugagaugggaggauugcuugagccuaggaggucaaggcugcagugagccauuguugucucacuguacuccagccugagcaacaaagugagacccugucucaaaaacauacacccacagauacauacauaaauaagauugggagggaguaagcaugagaggaauuuauugaauggauuuuuuuuuauuuuucuuaauuuuuaaaauagagacgagaucucacuguguugccagggcugaacucuaacuccuugcucaagcgaucuuccccucagccuccuaaagugcugggauuucaggcaugaaccacgacaccugggcuucuuuuuuuuuuuuuuuuuuuuuuuuaacaacuugguuuuaguacaguuuauuuggcagcauaauuacuacugaaaaaggggaagauguauuauaauuaauggguagguuuuuuauuuugaaaauguaacaucuuuucuaauuuuuuucucuuucaaucucagcuuauugcagaagaauuuugucuaaaaacauuuucgaaguuuggaucacagccuauaccagguaaaugaaaucugauaugaagccuuucaucuguuugcaauaaucaacccuaauuaaacuggaaauauauguagauguaguaaguugggauaauucuaggauaaauuuaauccagagaaaaugcaccuuagaauuauuaauguuuuauggcaauauacaguuucuuauaaauuaauaacauucucauuuauuguucauuuuauuuaaaugaaaucuggcuugaaaucuuaugucuuuaucaaaugccuagcugauauuuugagaacguuguuauagaauuguaaaauguccaauuuuuguguaaaucuuuauauaaaauauuaucuuuuuuuuuuuuuuuuuuuuuugagaugaaguuucgcucuugcccaggcuggagcgcaguggcacaaucucggcucacugcaaccuccgcuucccagguucaagugauucucuugccucagccuccgaguagcugggauuaccggcauccaccaccaagcccagcuaauuuuuuguauuuuuaguagagaugggguuucaccauguuggccagacuggucucaaacucccaaccucaggugauccacccgccucggccucccaaagagcugagauuacaggcgugagccaccgcacccaguuguaaaauauuuucuuugagaaauauuucauauucugaauuuuuuaaauuaagugaauguaaagucaagcacuucauuaaagauagguuuucuuuuaaacaaugugaccagugguauuagaaucauuguaagauugugaauaugguuauauacuauguauauguauuuagauguaucuaugugagagggaaauuauuuuuuuccugaauagaaugauuucagaauggauuucuaaaaucaauggaaguuauuuaauacgugaaggguauauuguuuuucaaacguaauuauuuguacuacuccauuuugaauuuggacaaauuaauaaaaauauguaucauaaaaaugagcccauuuagcuagaagugguaugacagugcguucucaggaaggcaagcugcauuuagcccgucuuuuuuuuuuuuuuugagauggagucuugcucugucgccgggcuggaguguaguggugcaaucucagcucacugcaaccucugccucccggguucaagggauucaccugccucggccucccaaguagcugggaauacaggugcccaccaccacgcccagcuaauuuuuuguauuuuaguagagacaggguuucacccuguuggccaggauggucucaaucuccugaccucgugaucugccugccuuggccuccgaaagugcugggauuacaggcaugagccaccagcugcauuuagcccuucuuaaagacccuuacacauccucucauugcagagaccaccaaucccugagaagucaacucacuuagaauuuacaagagaccaagaaucagcaugauuucucugggcagugggcagucaagcuucguagaagucauaucuuaaucaaaaggcucuuugucacaaaagcuggaaauacccagugucagcacguucuuuccacauggauaaacccauauaggaauuagaaaguaauuugucguaagagcauuugguugaaugaaaugcuuaauaggaguaguauuacugauaaauacuuugucgccuccaguccccuauguuaaacuucaugccauagguagccuugucaaugauccugaaaaauacucuaaaaucagauaaguaauucuuucuuuucucuggaaaguagaugggacuguucauauuuguuucuuagaaaucuuuauuuuuuaugcuuuugcgccucuagccccuuuucuggcaugcgcuguauuucuuugauucuauuaacacguuuagccagguugcaguauugugacuguguguguauauguguauguguauguucuaauuugauuguacuguugaacucucaaagggaaaucuuuuuuuucucaugcuuccugguuucugggucaagaugcaguuggaguauguguuuggaaaaccuuacccuaucacgucguauaucccauauugucaacaaaaauuacuucugaaucucuaaaaugccgacuuaauggcuuauauuguuuuuauuuuuaaaacaguuuacuaaauuauaugcaaaauagauauuuauuauaaaaauguuuuaaaagaaaaauuaccccaauuuuaacacacacuguuauauuugauauauuuuucugugaugauauaugcauaacuacaaauugagaaugcguuauuagaaguuuuguuucuuuuaauuuauacuauuauaugaugaacauuuucuauuacaauuacauuuuuuugaagaacugaguuuagucguaggauuucauuuugaacuaccaguuaaauuuuuuucuccuuuccccuccuaaaaaguaagaacacuucuggaagagauugauuuaaauugauuuagcacaauauaaaauccugagcuagagagcagucugcaaguggaagaaagcaagcugcugcuuaggcuuuaggggaguuugagcagagggguaucuuggcagauauuaaaaauaagagagggaaagaggguuucaauaaggguuuauguagacucuacucugacuucuuuuaauauccuccagagaugugaauaaauaguagaauuuccuuuuuauuaccuuaggguguuuuucuugaacuuaucccuucuaagacugaaccucaucuaggcuucauuaaggguuaaauacauaauacugcaggguuuauucuugugcauggaguuucucugauuauuucuuuaauaaucaauucauaaauaauauucuuaauauagauugcucuccagaaaguguaaccaauuuauauuucugccagcagucuuuaagguacccauucuguggaacccuuaaugauaaugauuguuuuaagauauuucuuuuuugucaggucuguagguauagauaccauucagacauuauaugaaggaaaaaaguugcuuauauugauguaauuaaugcuuaacaguggcucuugauuaucuucugauuuugaaaguaguuucuaaaaugugaauuuuuuaaaaacuauuauuauuauuauuauuauuauuuuugagacggagucucauucugucgcccaggcuggagugcaguggcgcaaucucggcucacugcaagcuccaccuccuggguucacgccauucuccugccucagccucccaaguagcugggacuacaggcgcccaccaccagcccagcuaauuuuuuguauuuuuaguagagacaggguuucaccauggucuagaucuccugaccucgugauccacccgccucggccucccaaagugcugggauuacaggcgugagccaccgcgcuuggccuuuauuuuuaacagcucuauugauacauaacuuacauaccauacaguuuauacauuuggugucuacaauuaaauuuuuuuuaguauauucaugauuaaauuauuuuuaguauauucaccgauacgugcaaccaucacucacagucaauuucagggauuuuuuuuuuuaauauuaaaaacuucaacauguuagaggaauuuggcuuuuagcuucugucaaaaagugacuuuaggguaaaauaguuaaggcauuaguaaauacuaagggaugaauuaagauauuugauagaaaguuuaaaauacuaucaaugauuaugaaaauuaaacagugcuaucuugaagaauucugaaaguaaagaguuaauguaaagaacugcagacaaaauucuuuguaucuuuucaucuagcuaaaagaccagcuucaggacaaaacucgauuucuguuaugccugcucagaaaauuacaaagccugccgcuaaauauggaauaccuuuagcauauaagaaauauggagauaaaaaauuacacgaaaagaaaccacugcaaaaacauaaacagguaugaucauguuacauaccauguguuaauaacaaauucaauucaaccuuauuucauugcagcucaauucaguuaccuugauauuauaggauuacuuuuauuaaguuaccaaggaauguccuccuucuguguuuuaccaguccucuaaaacugagaagccuuacaggagucauaaaaagucauuaaguaaauauauuaaguaauauaauuaguguaauaaaaagcgagugacauuauaaaugaaauaacuuuugagcaaccuaagcagagccauuuguuuuugugcauaaaugaaauaaauaccuaugacauucuugauaaaaaucuggaaauauuugguauuugagaauucacaaucagauaaacagaaucauagagcuggaaggaaugugaucauauaaucuacucugucauauuucagaugaaaaaugaagaccuguagaauuuaagcgacaugcccaagaacacagugauaguugcaggaauuugacauuuucuuuaugucaguagcugcaugcuuugguauauggagcuuguuucauuuuggauuacauacacauacauauacauauacacagccuuagauauguauguauacacacugcuguaagauaaacuuuauauaguaggaaugaucagucacuuuguuuaaaaucuaucauaggucagguguggugguucacgccuguaaucccagcacuuugggaggucaaggcgggugggucacuuggggucaggaguuccagaccagccuggccaacauggugaaacccuuucucuacuaaaaauacaaaaauuagccaggugugguggcgcacaccuauagucccagcuacucaggagucugaagugggagaaucacuugaaccggggaggcggagguugcagugagccaaagagugcgccacugcacuacagccugggugaccaugagauucuguuucaaaaaaaaaaacaaaaaagaaauuuagaaaaauuauaauaauaaaaugagagauuguaaaaaaauuuuuuuuuuaaagcaugcaguaauagcagauacaggaagcagcugcuauuccuagugcugaggcagaguacccaaagaagacacaaauuuuuaaagaaacccuaaccccaucgcgaaggcugagauucagaccuuacuggguaggguauggcaguagcucacucgauggccccacagucuggggcuggcaaagaggaaaguguccacuguggagcugacgaaacucccugcgaaacugccuggagugucaguagaauguacugggaagccacuugaggagccguugaacucacugggaagccugcuggggugccaguggaacuuaucuggugcugcucuagcugggaugcuggcugaggcaccagcagaauucugugggaagcucuucuugcaggugcugcugaaacucacagggaagcugguaggggcacuggccaaacacuccuggaaggugccuguaggggugagugcugcuguuugucccacuugcugcaguaacaggaagaaaggaaacacacuaaucaggaagagaagcuucugccuuugcagugacccucucaguuuuacugacaaagcuuaauauuguguuagcaaucaaagaagaaauguuuacaacguccagcucuagcaucacaagcuggacaaugaagaguagauuuggagcugaggggcaauaugguaacuggccugcugguuuuaucuaucuuuaaaaagauguauucaaaccuaagugggccaauuccaucuuaucguuuuaucucucuuuacuucagucaccacaggaagccuaggacuccagcuuucccucacugccuagacucuccuauugcuguaagacucuggucauacucugaucugcccccaccccugcauaguuuucuauagguuggugcaaaaguaguugggguuuuugucauugaaagcaaaaccgccauuacuuuugcaccaaccuguaaucucuuccagaaaacucucuuauaguacauucuuggcaaaauccacuguauuuuaaacuucuaaagaugucuucaccuuuuuugcuugaaaaccugguuugucccugaacacacuguucugcagcugucuuacaugcuggcuguuuucucuaaucccuuaauauuauugggucuagagguaggaugaaggaaauguuucccuugcuucucauugccagacucucccugcugccugauccugccauucuccucaucucucuaccuugaugcuuuugcuaccagacuguaucaccuacugcucuucuguguuaggaucaucuguagacacuugucuuuuuuuuuuuuuuuuuucuuuugagguggagucucccucugucgcccaggcuggagugcaguggcacaaucucagcucauugcaagcuccgccucgcggguucacgccauucucccgccucagccuccugaguagcugggacugugggacuacaggcgcccgccaccacacccagcuaauuuuguuuuuguauuuuuauuagagacgggguuucaccauguuagccaggauggucucgaucuccugaccccaugauccgcccgccuuggccucccaaagcgcugggauuacgggcaugagccaccacgccccgccaacccuugucuuuugaagaguuuaacaccugacucacugucacuccuuccaauauugucauaauucuuuacaguuuuaguauaaaaaaagaugauacuuccuauagaacauggccuuuuguuuucauuuucuuucuuucucuuuucuuuucuuuuugagaaagagucuugcucuguugcccaggcuagaggacaguagugcggucauggcucacugcugccuuaacuuccugagcucaagcaauccaccuccucaacuuccugaguagcugaaccacaggcaagugccacuacacccagcuaauuuuuuauuuuuuguaguggugggguugcacuauguuacccaggcuugucucaaacuccugggcucaagcaaugcucuugccuuggcugcccaaaaagugcugggauuacaggcaugagccaccgugccuggcuuauuuucuugaucauucucuuucaaauaucuugucucccacuuuaacuugaaacucucaccuauggccaugccauuaaaauuuuuauuaucaauaauaacaacucuuucuuagccucauuuauaaucaucccguucccugaucaccacuuccuguguuucuagcuuacuucuuuaggagucugccuccaaaacaucugucccauuuggauccaugaauccuaauaacuuccuuuauucccccucuuuguuucuauuuuccuuaccuggcuuaaauuccauauucauuuauaauaauuuccaaauggucagcucucuugcccucucuuccauuauuaccaauaaccaaaaaacuuaacuuugugaaauccaacucuccacuucauuugugccugaagcuggucaguggaauauggcuggagaaagcauaugacuauuguaacuagucuaacuuucaauauguaaccaacaauaucaaauuagcaccuucuggucacccuauuauauuuccucaguguauuuacucuucuacuuccuaggugauuauuuuuuaccuucucuuugcuuuucacaaggaccaauauuuucuuccuacuucacugagaaaauagaagcaauuggaagaaaacuuucccacaauuacuucugcuagucagucuuaccuguuggcaaauauuuuaccuuucuucguuuuacuuuggaugaccuguuucuguucccaguuaggaucaacucaaucauuugcauacugugauucuuuuuugccugcuaaaggacuuugcgcucucuccugcaucauuauaguuuuuucucucuacugaaucauucauguuagcaaacaaauauccuauaucuuaagucuuuuuaaaaaggaacuuucccuuauguccuuccaacuaccucucuauauuucuggucccuuuaacaacaaaacuuucccaaaagauugucuauacugucuccaguucauuucauuuugaacccacuucacucauggcuuucuuugucacagcuguuaugaaacagcuguugugaaauggcuccugaugucuauauuauuaaauccaugggucauuuuucuucuuccuugaccucaguuuuugacucacuugauugcccccuccuucuugaaauauuuucuucauuugagucccugguauuacauucuucugguuuucuuccuaccucauugacugcugcuucucagccuccuuugcaaguuccuccucaccuccagggcuuuuaaaugcugaggugcucaaggucucaggccucagauaucuucuuuuuuguauccauacgaacuuucuaauggauaacaucuauaagcugacucucaaauuuguaucuccaccuuggacuccuuuccugaacuggagacugauaccugucuuaacaucuccagcuguguuucuaauagacaucucaaaauuaccauauauaaaaaugaacucuugauuucauucucucuccaaauugaucuuacuuauuucaguaaaugggaacucugcccuuccauuuguucucaucuuccauauuggagucauuauugacuacucuuucuacgucauauccugucaauugugacuucaaaauauauucacggucugacuacuucucauuauuuuuaccaccauauuaguccuagccacccucacuuuccaccaggguuauaauaaucucaugauuagucuaacugcuuucagacuuacccucuuagucuguucucaugugagcagcccaaauguuccuuuuaugauggaagucagaucguuacacucuccugcuugaaacuuuucagugucuuuucaucccacucaguaaaagccagggucggccgggcccgguggcuccugccuguaaucccagcacuuugggaggugggccuugugaccuugaucucacgaugucaagagauugagaccaucauggccaacauggugaaacaccuucucuacuaaaaauacaaaaaaaaaaaaaaaauuagcugggcaugguggugugugccuauaaucccagcuacucaggaggcugagguaggagaauugcuugaaccugagaggcagagguuacagugagcugagaucaugccacugcccuccagccuggagacagagugagacuugguuucaagaaaaaaaagcaagccagagucuuuacaacugucuacaaagcccccgacagccucauuaccuuuccaagucucauuugcuacucuucccuugcuagucccgguacagccuugccaaaccuguuguccuuaaacaugccaaguacuuaccugcaaaaacaaguuuguacuugcugcugucuuuucuuugaggucugugcucaaaacuugcuuuaugaauagagccuuucuugaucacacuauaucaaguaauaaccaucccucuacgccauucccacguuucuacucuacuuuacucugcuuuguuuuucuccacaauguuaucacuuucuaaucuauuuucaauuaguuuauuaccaguuuccuccacuacagugcagaaauucaugaggguagggauuuuuguuguuguucacuaguuccuggcaaauaguuccuggccucaaguaauccaccuaccuuggccucccaaaguucugggauuacagguaugagccaccgcaaccaggcuaagcuuuuauucuuuuuauuuauuuauuuauuuauuuauuuauuuauuuauuuauuuuuuuauugaucauucuuggguguuucucgcagagggggauuuggcagggucauaggacaauaguggagggaaggucagcagauaaacaagugaacaaaggucucugguuuuccuaggcagaggacccugcagccuuccgcaguguuugugucccuggguacuugagauuagggaguggugaugacucuuaaugagcaugcugccuucaagcaucuguuuaacaaagcacaucuugcaccgcccuuaauccauuuaacccugaguggacacagcacauguuucagagagcacuggguuggggguaaggucacagaucaacaggaucccaaggcagaagaauuuguucuuaguacagaacaaaaugaaaagucucccaugucuacuucuuucuacacagacacggcaaccauccgauuucucaaucuuuuccccaccuuuccccccuuucuauuccacaaaaccgccacugucaucauagcugguucucaaugagccgcugggcacaccucccagauggggugguggccgggcagaggggcuccucacuuccuagcaggggcggccgggcagaggcaccccucaccuccuggacggggcggcuggccgggcggggggcugacccccccaccucccucccggacggguaugcuggccgggcggggggcugacccccccaccucccuuccggacggggcggcuggccgggcggggggcugauccccccaccucccucccagacugggcggcuggccugguggggggcugaccccccaaccucccucucggacugggcagcuggccuggcgggggcugacccccaccucccucccggacgggguggcugccgggcggagacgcuccucacuucccagacgggguggcugcugggcggaggggcuccucacuucucagauggggcgguugccaggcagagggucuccucacuucucagacggggcggccaggcagagacgcuccucaccucccagacggggucgcagccgggcagaggcgcuccucacaucccagacggggcggcggggcagaggcgcuccccacaucucagacgaugggcggccaggcagagacgcuccucacuuccuagaugggauggcggccgggaagaggcgcuccucacuuccuagaugggauggcggccgggcagagccgcuccucacuuuccagacugggcagccaggcagaggggcuccucacgucccagacgaugggcggccaggcagagacgcuccucacuucccagacgggguggcggcugggcagaggcuacaaucucggcacuuuggaaggccaaggcaggcggcugggagguggagguuguagcgagccgagaucacgacacugcacuccagccugggcaccauugagcacugagugaacgagacuccgucugcaaucccggcaccucgggaggccgaggcuggcggaucacucgcaguuaggagcuggagaccagcccggccaacacagcgaaaccccgucuccaccaaaaaaauacgaaaaccagucaggcgugguggcgcgcgccugcaaucgcaggcacucggcaggcugaggcaggagaaucaggcagggagguugcagugagccuagauggcagcaguacaguccagcuucggcucggcaucagagggagacuguggaaagagagggagagggagaccauggggagagggagagagggagagagggagggagggagagagggagggagggagagagggagagggagagggagagagcuuuuauucuuaauguuuaaaagcagcugcugacgauaucccaguuacucuuauuugaucauuacacauuguaugcaugugucagaauaucacaucuaucccauaaauauguacaauuauuauguauccauuuuuaaaaauaaaaucuaauguaaaaaaacuacuucagguugagguaaugaaaaggaagcucuagaacauuugaaauugauucuguaccuacauaucuaauucuugaaauagagacuuuauuaaaguuauuugguucuuugaaguaauuugaguaguauaacuuugaucuguaauuuuuuucugugaaguauguauuuuaauaaacuugcuauaacuuuuagugugcuuuuaagaguuuuauauaauaaaagcguaaaacauauccccaguauuuacacacgcauuuaauuuuacuaaauuuuguuguggaccuuccuauuuguuuuuuggguuuucuuuuuuuuuuuuuugaaauggaguuuugcucuugucccccaggcuggagugcaauggcgugaucucggcucacugcaaccucugccucccagguucaggcaauucuccugccucagccucccgaguagcugggauuacaggcaugugccaccaugcccggcuaauuuuuuuguauuuuuaguagagaugggguuucaccauguuggccaggcuggccucgaacuccugaccucaagugauccacccggccucccaaagugcuaggauuacaagcgugagccaccacguccagcgggccuuccuauuuauauucaaauauauauugcccguauuuuuaauauagcucagaaaguuuauagauaauuuuguguucuaguguuuuuacuuaguguuauauauacuuuuuguauauuuuuacuugugauuaucaguaguuguauuucauugguaugaaaucagucagguggguuggauucuuauaaauguccuuuuuuaaaaaaaugugccguggaucaaaauuucuuuggaaauauguuuuauguuuucuaauagaguucagugaaauaugaauucaaaguaaauuuauuucauggaccauuuuuaagaugcuuauuuauucuaaaugguuuacaaauguaauccauuuuaauguuuggaauauauacacauggaauucucugucuucccauggaauaaaacuaccauuguggggguagagagagaugggaaguugggaguguuuguaucuuuacgucauuaugucuguaaggaauacacgcucgaguggacuuguagaagcgaguugccuuaucucuuggccauguaucagccugacugaauggagagaucagaacuguuggugaaucuggauaaaugauaucauagaaagucccuaguguuuggguaggauuguagccaaguguauaaucuguuucuucauauggcugacagaaucaaguaauguguugguuuucuuaauguuuuccuuauuuuccauuaauauucaguauauaaaagcagcaugcuuuggaauuuucagauuucaguuaauaauauucugaauaauaucucuacuaucaaauauucugaaucauaggcaaaugauucagaugguaguuauaaauguuuugaauuucaggcagagucguugcccucaaacuucaucaggcagacaaguauggucugagcuagaccauugagaacuaaauaauaaucagcccuugaaguauuauauagcuuauuuuaaaaacauuucacuggcuaggugcagugccucaugccuguaaucccagcacuuugggaggccgaggcagguggaucacuugaggucaggagaccugccuaaccaacaugguaaaaccccgucucuaguaaaaauacaaaaauuaaccaggcauggugacaugugcuuguaaucuggcuacuuuugagacugaggcagaagaaucacuugaaccugggagguggagguugcagugagcagagauggugccauuacacuccagcccaggugacagagcgagacugugucucaaaaaaaaaaaaauuuuuuuuuucacuuaaaacuaaguuucugugaacaacaaugugaaaguauuuaaugccacagaacugcacacuuaaaaaugguuaaaaugauaaauuuuguuuuauguauuuuaccacaaugaaaaaaacauuugaagaaaagaaaaaguaaguaggaaaaaaaagaaacggcagucgauuguguggaaaguuuuucaaaucuucuaacaaaagaauuaaaagaaaauaaaccccagauuucugaaguauuuuaaauaugauuuuugcaugauuguaaauauagguuuuucccuugauuuuuuuuuucuuuuuuuuugagacaggaccuucacuacacucaagccauagugcaguggugcaaucuuggcucacuacaaccuccaccucccaggcucaagcaaucaccucugccucccaaguagcugggacuacaugugcauacuaccacacccagcuauuuuuuguagagacggggucuugccauguuguucaagcuauugucaaacuccugggcucaagugauccacccaccucggccucccaaagugcugggauuacaggcaugagccaccacacacggccuuucccuugauuuuuuuuuaucucauuuuuuuaaaagacuucuuuucccccuggaaauuaaagcaucuuuuagguugaaauucacaauggcccguuagaauuuuuaacuucaagccugaaaaaggaaagcuuuaaccacuuaagauacugucauguuuuaauugcacaaauuuaagcuaaugugcauuaaguuguuauuauucaaccuguccacaaaauauucauguauugugagacuuuuuuuugcuccaguuccuguaagucauagguuuuuuuuuaaaggcucuguuaaagcaaaggaguggccauuaagccaccagagggagcuccuugaauauauuauguuauacuucaguacuuuggcugugauuuuuaaaaagaacacaaacaguucucucaguguggauguuuuguguuucguauuauucucuucacuauagaaauaguguucugaaaauaccugugugaucuuagaggaacagcuuaguauuuucauuucauaaauauuugaauaucuuauauguaaggcaauaugaaccauuagaagaugaauacaaucuuggccuuuauguaacuuacccaagaguauaugaauauguaaacauucucuucuuauuccacacuauuguguaauauauauauaauccaguuauuuauauuaaguugcuguauuaauguuuuuaaauugcuuaauuguuugguguuguaguucacaaauuuugagaauggugcuagacuggcuacuaaaguuaaccugugcagcaugucaaaauauggaauguagggcucuauguccaaagauuaugauuuaguaacucuugggauauguauuucuaaaaaauagcuuuauugagauauaauucacauacuguacguaauucagccauuaaaaguuuucaauuaaaugguuuuauguauuuauagaguugcauaacgaucugcacagucaauuuuagaacauuuuuaucaccccaagggaaauccuuuuuccauuagcagccacuccccauucuucccccaaccccgcagcccuaggcagccucuaaucuacuuucuguuucuauacagauuugcuuaaucugaacauuuuauauaaauggaaucauauaguauguggucuuuugugacuggcugcuuuaacucagcauaauguuuucacaguugaucuauguuguagcauguaucaguacuucauuuucuuuuuguugccaaauauucguuuguauagaaggaauauguauuuuuacaaagcuucuggguaauguuccccacuguuuaaauucuguauacauagaacauaccuugaaauguuaacuguguuuuuguaaugauacuaugaggagcauuaucuacaauuuuuauuucuuguucuucaacaauagugcccccagagaucucucauaauuauuuuaaaacaagggguugcuauccauuagugguggcaaaaacauuguagugggcaaagagcagggaauuuuuuguuuguuuguuucaagugauagaaaguagcagggucugcuauacauauagugaagauauuuuaugaaacuuagggguguguauguaucuuccugaguccagaugggaaauauauuucuuauugugggucgccuuuagaaaaaguuugaaagcuaauguucuuuaaauauuucaguauuguuuuuaucucaucaacucuaaugucuuuucugagguaaagugguaacguaaaugguuagcuuaaguaagaguugaauugaaauaacuagccaaaauuagagguuaggaguuaggaacuaauaauacagugagggugugggauaguucuaagaacccacugcuuggguuauuuugucagagaguaaaugcauucuuuaguuagucauaagaguggaaucaggugugagauuuaguaccgcuuaucacuuuguugcuauagccuugaguuaaaacauaccaauaaaauuggcuuaugaucauuuaauuaaaaugccaaagcacauuacaaaagacucauuauuaucauuuauaaguuuauuaacccauugggugguauuacauauuuuagauaucagcauuuuccuggucucauacucaauaauauauucauugaaguaaaauaguuguguuucauuagaaagaaauaugcaguuuaaauuauaccauugcuuucuaaagcagaaauguuauccucuugaauuguuuucagugaaaguaaauuuuuguaugccuuucuaauuuuuuaauauauggugacacauuuauuucaaaaaugaugugagggucauguuuauuuuguaauauuuugaauuugcuuuucaggguuagaauuuuagugccuaucuguuauggucauucuacauaauuuagaaaacugaagcacaggauaauauauaaaacuaauuuuauaucaaugacuuauguuaaaauauagcugcuguuaaaauggaauuguuaguagagacaacuuuuaaugauauaaucaaaugcuggauuauuuuacuaauaauguaaaugaccaucaaaauauuuuucccaaguaauuuuuuuaaguaaugucugcuuuccuuuguauugaaauccaguguaggugaaaaauuguacaguaugcuuuuuaaaucuuuuuuuaagguggcugaaaaauguaaacacugguacaugauagaauaacuuaaacuuuucuauaaauuuuuaucuuuuuugguauauagaauuguaguuagaauuguuugaaaaauugaucauacauuaggcuuaaccuugauuacaaaauuguguaguuaacacaggguaaaacaaaacuguagaucacuuguaagaacauaugcagaaauccuggaaaaaagaaaaggacuuaaaaaggggaaaaucaggcauuuuaucaaaaaauaauguaauaauuaucaaauaggauuuauuacagcaauacagggacguuucaacaguagaaaaccaguuacuguaauuuuacugcauuagcagauuagagaagaaaaccauauaaaaaucaucucaguagaugcugaaaauucggugaaacuuaacacuaacuuuuguuuuuaaaaguuugauucaagaaacagaagguaaguucuaauacaguauguauacacaccugaaaccuauggcaggcuuuguacauaaugaugaaacauuggaagcauuaucauuaaagucaggaacaagacagagggauuugcugucauugccaucguuaaauuaugccagagguucuagcuagagcaauuaaaaggaaagaaauguaaauauuggaagaggagagaaaacauagacauaucguauuuacauuugauaugauuaccuaccuagaaaaucguggugaagcagcauuaaacuauuaauaaauuaaauaaaguggccugauggaagggcaacauguaaaaaauaaaugauuagaaaauaaauggaaagaauuacccacaaaccccccagauacuugauuuuuuuauuuuuauuuuuuuuuuugagacaggaucucgcucugucaggcuggaguauagugaugugaucauggcucaugguagccucuaccuccugggcucaagagauccuuccaccucagccuccugaguagcugggacaacaggugugggccacaugccuggcuaauuuuuaaaaauuuuuuguagagauggggacucacuauguuauccaggcuggucucaaacuccuaggcucaagcaguccuccuaucuuggccucccaaagugcuaggauuacaggugugagcuaccacaucagucccgcccccaaauacuuuagaauagaccuaaugaguaaaguauaagauaauugugaaagaaaggaaucaaaauuaauagaaugcuauauauccaugaagaaaacagaugcagauauaaauaauaacaugaaugaaccuugaaaacaguguugagcaaaagcaagauacaaaagaauauauauuguaugaguccauuaacaaccccaaaguuagguaaacaguauauaaaagaagaaauguaaauaucuaauauauaccauuaugcauuucauccauguaaccaaaaaccacuuguaccccuaaagcuauugaaauuuuaaaaauuaaagucauuuuauuaacacauuaauauuacauguauguaaaaaucauagcuaaaauuguuguauguauauaguugaacuguauauauaaguacaaaaauaaucucugaaggacacuaaugaaaauauuaacagugguuaccguuacucuggagguggagagcaaaauagacccuaaauuuuuaaucuuguuugaauuuuauauacugaauauauauugugucacuaauuuuuuuaaaaaaauuaucuccaucauugggcuuuucaaaugauagucuaugauaauauuggaaaacuuaaacauccauaccugaacacaaaacuguuuaguugaugauuggggaaggacccuuuuccacaguuucuuugaaucuaauguuucucuuuguuuaacagcauaucaaagacuacgauuuuuuuuuuuaagauaauguaauuuggaagagaguuauggaaguauugacuuuaccuuuuucuuaucuuaaauuucuguaaauuugggauuuucaaauaagugccucaaaaucuuuauuuaauuuguaguuuuacuuuuuguccaggcccaucaaacuccagagaagagagugaauacuggagaagaaaggaggaaaauaucugagguauaaagacaucugucugguuauuuuaaagcuuugcaaacauaauuuuaaaaaagaaacaaaaucuuacuauaaagccuccaaaccuuuccuuauuucuuucaaacgaauaccuauaacuucuuuuuuuuuuuaaaaaaaaaaccucauugaacauaccucugccauugguguacuaacuuuccugaugaaacuagaaaaaacaggaauuauuauggauuaaaauguucuuuuuuuuauuuaaggaagcagcaagaaagagaaggcuggaauuuauugaaaaagaaaagaaacaaaaggaucagguaguuuuuugcucuuguuuuucuaccuuuggcaaguuguuaagugauaauagguucaagaguuguaagaagcuugucuuuaaaauuguuacagauuauuaguuuaaugaaggcugaacaaaugaaaaggcaagaaaaggaaaggguaagaggauaaucuauuaaauauacuuuuuucuuaaggaauacacugauuuucaguuuauugcuaaauguauuacguguauuuuauauuaaauacuugaaaugguguuuuguuuauuucuuuuccccaaaguuggaaagaauaaauagggccagggaacaaggauggagaaaugugcuaagugcugguggaaguggugaaguaaagguaggcauuuuauaccaauaugguuauacuaccauuuuccccuccaguuccaccuuguucuauaaaaugcauguacuugggauuuucuuucuuucuuuaguguacaauuaauuuuuaccuagaauucuuuaacauuuauuaugaauacuuagcuuuccugcauguaucugauauguaacuuguguugcuguuaugugacuauacucaaaauugcuuuaaaaguuuuuugugaagacuaugauaacauuauuccugucaggaauuuuuaaaaauuauguacaauucaugacacugcagccuaaaaucguucuguaauuucauguagccuugaagauuaaguucucagaagaugcuucuuaaucugaucccuguugucucuccaacuucaucaccauccauucccuaccacauacuguaugcucuauucaugcugaaaugaagacuauauuuguaguuucauuacuauaugugguuugccaaaucucuuugucuuugcacuuguguuuccuuuuacuuaauagcacucuccaucccuccucacccucacgucccaccuccauccauuuagcuaaauaaccaguuacauagaugaguuaaucuaaacauuccuucuggguagauccacccuauuuaaccuugggcacauuacugaacuuuucugagcuuugguuucuugauuuaaaaaaaaaaaaaaguuuuuuuuccaagaacagugccuggaaccugucuggcaagggcuucuauaguaauuucccuuuccuuucuuuguucugccagucugaaucuuauacuuccucuuuuauucauacagcauccuauacauaucucuauuuguaguugguagaauucuaagauggucuccaagauucucaacugcgguauacacaccuuguguuauuccauucccuugaguauaagugguaccuguaaauacuguaguauagcagcucacuugauuagguuauguuauauggcaaguggugaugggauggucucucccaggguuacguuaacauauaagacuccuucauagcugacuggaaggggaaaagaaauuagagagagagaauucugcucaccuggaagauaguaaacauucauguggcaaaacaguagagaugaccucuacaaguaguggucucuaaugagcaacuagcaagaaaauugugguccuagucauacagccacaaggaaauuaauucugccaagaaccaguaaacuuggaagagauccugagucucaggugagaauuguaacccuggcugacaccuugauuucugccuggugagauccugaggaggggacccagcuaaaugcacccagauuccugagccaggggaacugagauuauaaauagauauuguuuuaagcuacuaaauuugugauaguuuguuauacagcaauagaagaugaaugcacuaauuuguaucauugaauaaacuguaagucaauacaucuuuuuauuuuuuugagauggaguuucgcucuuguuacccaggcuggagugcaauggcacgaucucagcucacugcaaccucugccucccggguucaagcgauucuccugccucagccuccggaguagcugggauuacaggcaugcaccaccacgcccagcuaauuuuguauuuuuaguagagacgggguuucugcauguuggucaggcuggucucgaacucccgaccucaggugaccugccugccucggccucccaaagugcugggauuacaggcgugagucaccgugcccagccuaagucaauacaucuucaaacuauaaguuucacucauguacacccauuaaucuugauauuuagauguacaauagauacuugucaaauuggaucaauuauaauucuugguuuuuuuucuccaaaaguuauaauuugaauaaaaguuuguuuuaucuagacauauacauucugcccuggauuuauagauuuguuuuucagucucuugaggugcagaaguucuucauaucauaguaauaauucauuaagaguaacuuuuuccaaauuuguauuaauauagauuauacaguguuuuuaguaguauaauuuuaucuuaccuuuaaguagaacuuauuaccuccugaaugaucaggaaugacuuagaaucugguccauucuaaaauaacuaaccucacaucuuaccugauuggaaagagaaagcuuaucaacuuguacuccuucagaucucaagcauuuuuuuaucaaguccgugauuagcacugaaguuuugaugauuuauucuucucccuuuuguguaauaaagugcuuuuuccuaugaugucuaauacaguauuaaucaguuuuauuaauguuuaauaacugagacaauuuucaaguuacauacuguguacugaauagauuucugcaucacuuuauaaacuucuguaaugcuuucauugaagauuaauaaaacaauuuauuuuccaugauuuaaaggaaauucuauguuaguuucuauauuuauuccucauugaauuugaaauauuuuaacuuguuaggcuguuugauuucuacauaguugauaaggaccuggaggcucaguaucauaugaaucaaauuaaggagauuccccaaaagaaagauaaaacuaaaacuaaaguauuucaaaauuaauacuauuauuacguacuucuaaauaagaggcauuuuuauucauaguauaaauauccaauguaaauguuuuugauuauuuaguaucugcaaaaucuggaccuucuuuguuuuauccauuuuuaaugugucuuuuaugaauguguuuuuagaaaaauuauauauuccacauguaugguuauauggugauuauaauauggaagagguguaucucuuguuugaaaauauauuggaauaccauuuggcaguaaaaagaauagccuguuuauacaugcaacaccauggaucaaucuuaaaaaccugugagugaaagaaaccagauaaaagaguacauauuuaugauuuuauuuacaugacauaaugggaaaggcaaauccaaccuguagugacggaaagcagaucagugguugcugacagugcgagcauuuacugcaaaggaacacaagggaacuuucugggguaauggauaugcuuuugauuguaguagugguuaugugagugucuacauuugucagaauucagccugugcuuacaauuggugaauuuuuauuguacauaaauuaugucucaaacaaacauauuucaucaguauucucauauaguauuuucaacauuauuuugaguaugagcaucuucugagauguuuaccuacuuuuguuuuugcuaaagagaaauggagcacucagucaaguuaagaugauauuagcauugggcuaaauucaaagaguaaccaguuucauaggaaauaugaccaccuuauaacugaauucugauucuugacuucagauguacauuuugaggauguauguaaggaccaccuugauggaagacaaauuuugucuuauuggguuacacugaaguuucuuuuauuggauucugacauuuuucuuuguuucuuuuauuauuauuuuauuuauuuacuuauuuuuugagacaggaucucacucugucacccaagcuagauugcaguggugggaucaugacucacuguagccuugaccuccugaguucaagcaaucuucccaucucagccuccugaguagcugggacuacagacacaugccacugcgcccggcuaauuuuuuguauuugcagggauguuguuucgccaauuugcccaggcuagucucgaacuccugagcucaagcaaucugcccaccucagccucccaaagugcugggauuacaggcaugugccaccaugccuggccuuuguuucuuuuuuuaaccaggcauuuuccuuaagauguuaucaccuggaaguuuucccuuuuuuacucucauuauuguggcuucuguucucaucacuucacacacucagaaaaugguuuuuuuaaaggcuuccacucagccuuagucauaucugguggucuuauucucagauaagaaaaguuaaaauaaguugaccuuugcauuugagguuauugauuucuucuuaaugaaauucuuucaccaugacuucuguagcauuauacaguuuuuauuuacuuuuacccuuauccuuuucugacaucucuauuuuuuacuaugaguuuuccaugugguugaguucuuaugucucggugguugagucuuuaagucuuugccuuuauccuuugucauuccugcagagaauccaaacuuccuucagcaguuacuuuuucauugauugccuuucuuggcuuuccaggcuucuuggcuuggugucagggcagcaacauccuucuaauuaauuccucugccuuacuuucuuauuucugcuuaccaugcauaauauugacuuacugaccuuuaaaacucuguugauauacuacugcugcuagaaacuuuauaaauccuuucuauuguuauuuauuauuugaacgcaaacaccaagggcagauagcauuuagcauuuagcuauaccaagcuuuuauagccaaacuuaauacuuaauacuuugccuuccuuguauuugucaucauacuuccuuccucuuccaccuuccauaccuaaauauauacauacauugauuauuuuuacuuuaaugccuuggcucauauuuacucuccuuacauugcuaucaagaccagauuaaacaauaucucuccccaaggccuuuuuucuaaauaaggauuuuacuguugauuuuuuuuuuuuuuuuuacuguuuuguggauuugcucagcacuuacuacuuuggaauuucucuguugucacuuguuuaccauagaauugaauguuuuucuaguuuugugcuauuuuucccaacuuacuuggaaacuaaagauagauaugacuuuuugccucuuuuauauacauauagaacauguuuuaauaauguuuauaccuucauaucugcuuggugaauuuaaagauuugggguauauuaaaagccauaugcagauguuuuuguuaaauauaauucugaguguuauauaaaaggaggcucucauaagcuauacauaaacaacggaacagaauuacaugaaauguauauuggaagcuuguuucaaaaccuguuaauuaagaucaaauuuuuccauauuuacaugaaauuagugucauuuugcuguuuuuguuugucacauuaugcuuuauuaucaauuacaaaguauacugcuuuuugguuguuaauaguuauaauaggaaaacauuuugcuuuaggcuuuauguuuguuaguauguucauauuaaguaauuacuuuuuaaaagugaagcauugaaauuuacuuuuucuuuugagacuaguacaggccuguuaggccuuauaagauaaacaugugagagcucuuuguuuaaucccuaggcuccuuuucugggcaguggagggacuauagcuccaucaucuuuuucuucucgaggacaguaugaacauuaccaugccauuuuugaccaaaugcagcaacaaagagcagaagauaaugaagcuaaauggaaaagagaaauauauggucgaggucuuccagaaagguauggcuauguucugcagaaguugcuuaugcuuugcuucugagauaguaaugaaagucacugugcauauuuaucuacagaggaauucugccuggaguucguccaggauuuccuuauggggcugcaggucaucaccauuuuccugaugcugaugauauuagaaaaacuuugaaaagauugaaggcggugucuaaacaagccaaugcaaacagguuggacugugaugauccaugaauucauccauguguguaauuuugucguuugucauacauagcuuaguaccuacacuuuguggauguuuucuccauuguucacauaugauguuuuuugccucuuggguacaauaauuuucugaggugcaaauuuggcccuugauuacucugaaagcauguagcuuuccaguucagccugauuuuugugucuuguuuguggguuuagacugaauauacuauuuaaaggaacaugugauaacauucugccaacauaauuauaacauuuuaucacccacuuccuuuaaauaaaucaggauauaaaucuaaauugaaucacacuuuaugcagaaccccagugcauuuuucgcccuuuucuucaucacuucaaagccuacuuuucucuuuguugucuuagcaugcuuucucuucaccuucaucucugauuuauaacucuuugugauccuguucaucauauuauuucuuuucuuccauugaauuaauaaugguaacugauuaauauguacuugagcagagauaaaugauugagguaaauauaaauuaacguuuauauacacauuauaaauuauauacagaagccugauauaugaagcaucuauuuuuugagaaaggaagguuacagacuuacacauaugcauauuuuuuaugaauagugagacaaauuuugugggaggcuuuuauucuccagaauuauugaucuuucuaguauauauauuguuuaauuaguaaacuuuauuuuuagagcgauuugggguucacagcaaaauggaguggaaaguacagagaguuccuauguaccccuuccucacacaugcacaaccucuguauugacauccucauuugagugauaacguuuguuaugaucaaacaucgauccauuaucacccaaaguccauaguuuacauuagaguuuacucuugguauuguacacuccauggcuuuugacgaauguauaauuauagguauccaccacuguaauaucauacaaaauaaugugacugccuucaaaauccccugugcuccaccucccuccaaccucccucccaacucuuggcaaccacugguugcuuuacugccuucauaguuuuagcuuuucuagaauaucauauacuuggaaucauauaguauguggccuuucacacuggcuuuucucacuuacuaauaugcauuuaaggugccuccguauaucuucauaguuucauaccuuauuucuucuuaacacuaauaucccauuguauuuauguagcauacuuuuuuuuuuuuuuuuugguaauuuuuuuuuuugagacagguucuuguucuauccccaggcuggagugcaauggcaugaucauggcucacuugcagccuugaccucuggggcuuaagugacccucccaccucagccuccugaacagcugggacuacaggugcuugccaccauguguggcugauuuuuuaaauuuuuuguagaauggagucuugcuauguugcccaggcuggucuugaacuccuggguucaagcaguccuccugcacuggccucccaaagugcugggauuacaagcaugagccaccaugcccagccagaauggauguacuacacuuuauccauuauucuacugaaggacaucuugguugcuuuuaaguuauggcaauuaugaauaaagcuucuacaaacauuuguguguagguuuuuuuguggacauaaauuuuuuaaguauuuaaacagaugccaagaggaugauugcuggaucaugucuuaagaguauguuugauuuuguaagaagucaccaagcugucuuccaaaguggcuauaccauuaugcguuccugccagcagugauuaagaauuccuguugccccacauccucuccagcauuuaguguugucaguguuucggauuuuggccaauuuaaucaguguguagugguaucucauuuuaauuacaauucccuaaugacauauucaacauuuuuucauaugcuucaugccaucuguauaucuuucuugaugaguugucuguucaggccuuuugcccauuuuaaaauucauuuuuauauuguugaguuuuaaaaguucuuuguauauuuuauuuaacaguccuuuaucagguaugucuuuggcagauauuuucuuuuucuuuguggcucaucuucucauucccuuaauauuuuguuuugcagaguggaacuuuuuuguuguaaugaaguccagcauaucaauuguuucuuucauggauugugucucugguguuauaacugaaaaguuaucaccauacccaaguucauuuggguuuucuccuauguuaucuucuaggaguuuuauaguuuaauguuuuaucuuuagaucugugauccauuugaguuaauuuuugugaaggauauaaggucugugucuagauucauuuuuuugcauguggaugcccaguuguuccacaucucuugaaaagacuauauuuguuucuuugaauugccuuugcuccuuugucagugauugguugacaaaggauuuuuaugucagucuauuucugugcucucuguucuguucuacugauuaagucuugaaaucagguauuuucagucauccagcuuuguucuucaauacugaguuggcuauuccgguucuuuugucuuuccauauaagcuuuauaauaaguuuguccauaucuaaagacuaacaugcugggauuuugauugggauuguguugaaucuguagaucagcuugggaagaacugacaucuugacgauauucaaucuuccaauacuucauguuagaccugaaauauaucuuugauguauuucaucagaauuuuuuaguuuuccucauacccgugcauauuuuuuuagauuuguaaccuauguauuacauguuggggggugcuaaugaaagugauaauguguuuuuaauuucaaauucuacuuguuccuuguuuauauauaggaaagcaauugacuuuuguuuauuaaccuucuauccugcaacuuugcuaucaucacuuuuuuugagagggguuuugguguuucuuuugaauuuucuacauagacaaucaugucaucugcaaacaaagacaguuauauuucuuccuucccagucuguauaccuuguguuuucuuuccuugucuuauugcauuagcuagaacuuccaauaugauguugaaaaguaauguugagaaggacaucuuugucuuguuccugauguuggccggaaagcuucaaguuuccauuaaauauguuagcuguagguuuuuuggagauguucuuuaugaaauuguggaaguuccucucuaauuuagguuuucugagauuuuuuaaaaucagaaaugggugcuggauuuugucaaaugcuuuuuuuuuuuuggcauguauagauaugaucaugugauuuuucuucuuuagcuuauugaugugauggauuacauuaauugaucuucagauguugaaacagcuguauuuuauuauauuuugcuauaagaauaaaaaugcccuuuccuuucauagcugguaaucacuuauaaggaaaugauuuaauuacuauguguauaauuuucucgugaucucuuucuuaauaauacucauugucuuagauuuacauacacacuguaaucuuuucacugacauggagcaacaacuuucacuacuccaaauuuaaacuauugucuuuguucuucaguguuuugcuuuacugaaaggcauuuaaucuuuuuuuccuuccucucauucuuacauucuuuuuaauacucuuucuuuugcugaauauucaagaauuuucacguauuucuguuuuaaaaauaccaacagcuaacuaccuuauuauuguccuuucauacaggguucucagucaccuguucauaccuccuuuuucucuccuuuuugcucaguaaaaaagaaaaccugaagaaaaaucacaagaggcuuuuuuuuuucuuguuuuacugcuugcuaagugauguagguuaguuuuagaaaaauuggaguguauaggaggagaguguuaggaaacaggaaagaaaauaauuccaaaucccuauagugguggucacugcugaugaagacuuugguuaauuuucuugcauaccuuuuccuuuucuuuuucccaagauaguggaaacaaaaucauacauacaaauuuuuaucuuuuuaaauuuaguguucuuaccauacauauuucccauguuguuuucaauuuuuuaauaucuacauaagauuccagugccugaaugugcuaugauuuaucuaacaaauccccuaguauaaccaguuguuuguaauccuucaccuuuuugaacauuuuucugccacauuuuauucuucauuuuuuauuauugccuugaaauauaaucuuguaagggcaauuauuuugcuaaaagauuuggucaucuauguuccugaugaagauucuugaaagaaauauuacuaaguuuuuuucuagaaaagugccaguuuguacuuaacccaacaguguaugauagugccuguuuuauugccccugggccaguauuaauaacuucuuaggagcuaaagaaguuuuuuuuguaauaaaaaguuuaaaaucaaaguagcauaggagaugaaguuuucacuguauucugcacuguuuaaacaauaggguaaugacaaacuagauuccuauaaguaaaagguagcaacuaauauuuaauugggcacuugugcaaggaccuguucuaaguaauuuacauauauaguuaaucuuuacuauuguggauuccguauuugcgaauuuaccuacuugcuaaaauguauuuguaaccucaaaaucaauauguguagcacugucauggucauucaugggcaugggcauaggcucagcccaugucauucaugaaccuggggucauucaugggcucagaauagcaaaaguggcccaaaagcauagugcugaaaugucaaaaggcagcgaugugcuuuagggagaaaauauguguguuagacuucauuugggcauuaguuaugccacuauuggccaugaauucaguguuaaugaauccacaauauaauggauccaggagucuaacucugcauuuacccuaggagcagugguucuguucaguauucauggagaguuuauagaacauagcuaugagaauaaugagaauugaauguauuauuaacucauuuaaucaucaccaauacugugaggcaggaauuauuauuuuugcuauuuuacagauuaagaaauugaggcuauguguaauuaaguaacuuguugaaggucacauuacuauuagugcaaccaggaguugaagcuggacaguuugguuccugaccucacucacuuaacuguuguaccauauugacuuuauuaaguguauuagucuguucucacacugcuaacaaagucauacccgagacuggguaauuuauaaagaaaaagaggucuaauggaaucacaguuccacauggcuggguaggccucacaaucaugguagaaggcaaaggagaaguaaagucaugucuugcagcagacaagagagagagcauguguaggggaacucuccuuuauaaaaccaucagaucucgugagacuuauucacugucaccacaacagcucaggaaagacccgccaucaugauucaguuaccucccaccaggucccucccacaacacaugggaauuaugggaguuucaauuugagauuuggguggggacacagccaaacuguauugcuaaaucuugaaaaauuuuaugaggaauaauuaaagaaucugagaauugcacuuugggaggucaaggugggcagaucacuugagaucaggagcucaagaccagccugccaacauggugaaaccccaucucuacuaaaauaaauaaauaaaugaacugggcaugguggugggugccuguaaucucagcaacucaggaggcugaggcaggagaaucacuugaaccugggaagcggagguggcagugagcugagaucacgccacugcacuccagccugggugacagagugagacuccgucuuaaacaaacaaaaaaagaccgggugucguggcuuacaccuguaaucccagcacuuugggaggccgaggcaggcagaucaccugaggucaggaguucaagacuagccuggccaacguggcaaaacccugucucuacuaaaaauacaaaaauuagccaggcaugguggcgcaugccuguaaucccagcuacuuggcaggcugaggcaggagaauugcuugaacccaggaggcagagguugcagugagccgagaucacgccauugcacuccagccuuggcgacaagagcaaaauucugucucaaacaaaaacaaaagaugggcagcuggcaagauggccgaauaggaacagcucuggucuguagcucccaacaagaucggcacagaaggcgugugauuccugcauuuccaacugagguacccaguucaucucauuggaacugguuggacaguguguacagcccaaggagggcgagcugaagcaggguggggugucaccucacccaggaacaccaggguuuggagaacucccucuccuagccaagggaagccauuaggaacuguaccgugcacucuggcccagauacugugcuuuuccgacggucuucacaacccacagaccaggagauucccuccagucccuaugccaccagggcccuggguuuccagcacaaaacugggcugccguuugggcagacaccgagguagccaaaggaguuuuuuuucauacccuaguggcaccuggaacaccagugagacauaacuguucacuccccuagaaagggggcugaggccaggcagccaaguggucuggcuuggugggucccacccccacagagcccagcaagcucagauccacuggcuugaaauucuggaugccggcacagcagucugaacucuaccugggacacuguagcuuggagcggggagggguguccaccauugcugaggcuugaguaggugguuuuacccucaugguguaaacaaagccacugggaaguuugaacugggaggagcccaccgcagcucaucaaggccacuguagccagacugccuuucuagauucccuccccucugggcagggcaucuuugaaaaaaaggcaguagccccagucagggucuuauagauaaaacccccaccucccugggacagagcaccugggggaaggggcaguugugggcacagcuucagcagacuuaaacaucccugcuuggcagcucugaagagagcagcagaucucccagcacagaguuugagcucugauaagggacagugggccuccucaagugggucccugaccccuguguauccugacugggagacaccuccccaguaggggccgacagacuccucauacaggagagaucuggcuggcaucuggcgggugccccuuugggacgaagcuuccagaggaaggaacaggcagcaaucuuugcuguucuucagccucugccagugauacccaggcgaacacagucuggaguggaccucuagcaaauuccagcagaccugcagcagagggcucugacuguuagaaggaaaacuaacaaacagaaaggaauaguaucaaaaaggacauacacucagagaccccaucugaaggucgccaacuucagagaccaaagguggauaaauccacaaagauggggagaaaccagcgcaaaaaggcugaaaauuccaaaaaccagaacaccucuucuccuccaaaggaucacaacuccuugacagcaagggaacaaaacuggacagagaaugaguuugaugaauugacagaaguaggcuucaggagguggguaauaacaaacuccuuugagcuaaaggaacauguucuaacccaaugcaaggaagcuaagaaccuugagaaaagguuagacaaauugcuaacuagaauaaccaguuuaaagaagaacauaaaugaccugauggagcugaaaaacacugcaugagaacuucgugaagcauacacaaguaucaauagccgaaucaaucaaguggaaaaggauaucagagauugaagaucaacucaaugaaauaaagcgagaagacaagauuagagaaaaaagugaaaagaaacgaacaaagccuccaagaaauaugggaguaugcgaaaagaccaaaucuacauuuguuugguguaccugaaagugacggggagaaugaaaccaacuuggaaaacacucuccaggauauaauccaggagaacuucugcaaccuagcaaggcaggccagcauucaaauucaggaaguauagagaacaccacaaagauacuccucgagaucagcaaccccaagacacauaauugucagaugcaccaagguugaaaugaaggaaaaaauguuaagagccaccagagagaaaggucagguuaccgguaaagggaagcccaucggacuaacagcagaucucucugcagaaacccuacaagccagaagagagugggggucaauauucaacauucuucaagaaaauaauuuucaacccagaauuucauauccagccaaacuaagcuucauaagugaaggagaaauaaaauucuuacagaaaagaaaaugcugggagaucuugucuccaccaggcuugccuuacaagagcuccugaaggaagcacuaaacauggaaaggaacaacugguaccagccacugcaaaagcauaucagaauguaagcaccauagauacuaugaagaaacugcaucaacuaaugggcaaaauaaccagcuagcaucauaauggcaggaucuaauucacacauaacaauauuagccuuaaauguaaaugggcuaaaugcugcauuaacagacacagacuggcaaauuggauaaagagucaagacccaucagugugcuguauucaggagacccaucucaugugcaaagacacguguaggcucaaaauaaagggauggaggaauauuuaccaagcaaauggaaaacaaaaaaagcagggguugcaauccuagucucugauaaaacagacuuuaaaccaacaaagaucaaacgagacaaagaagggcauugcguaaugguaaagggaucaaugcaacaagaagagcuaacuauccuaaauauauacguacccaauacaggagcacccagauucauaaagcaaguucuuagugaccuaaaaagagacauagacucccacacaguagugggagacuuuaacaccccacugucaauauuagaucaaugagacacaaaauuaacaaggauauccaggacuugaacucagcucuggacugagcggaccuaauagacaucuacagaacucuccaccccaaaucaacaggguauacauucuucucagcaccacauagcauuuauucuaaaauugaccauguaauuggaaguaaaacacuccucagcaaaugcaaaagaauggaaaucauaacaaagagucucagaccacagugcagucaaauuagaacucaggauuaagaaacucacucaaaaucgcacaacuccauggaaacugaacaaccugcuccugaaugacuacuggguaaauaaagaaauuaaggcagaaauaaauaaauucuuugaaaccaaugagaacaaagacacaacguaccagaaucucugggacacauuuaaagcaguguguagagggaaauuuauagcacuaaaugcccacaggagaaagcgggaaagaucuacaauugacacccuaacaucacaauuagaagaaucagagaagaaagucauugguagcuugauggggauggcauugaaucuguaaauuaccuugggcaguauggccauuuucacgauauugauucuuccuacccgugagcauggaauguucuuccauuuguuuguauccucuuuuauuuccuugggugguuuguaguucuccuugaagugggcgaaggacaugaacagacacuucucaaaagaagacauuuaugcagccaaaaaacacaugaaaaaaugcucaucaucacuggucaucagagaaaugcaaaucaaaaccacuaugagauauuaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauauguuuauugcggcauuauucacaauagcaaagacuuggaaccaacccaaauguccaacaaugauagacuggauuaagaaaauguggcauauauacaccauggaauacuaugcagccauaaaaaaugaugaguucauauccuuuguagggacauggaugaaauuggaaaucauucucaguaaacuaucgcaagaacaaaaaaccaaacacugcauauucucacucauaggugggaauugaacaaugagaucaccuggacacaugaaggggaauaccacacucuggggacuguggugggguggggggaggggggagggauagcauugggagauauaucuaaggcuagaugacgaguuagugggugcagcgcaccagcauggcacauguauacauauguaacuaaccugcacaaugugcacauguacccuaaaacuuaaaguauaaaaaaaaaaaaaaagaaucagagaagcaagagcaaacaaauucaaaagcuagaagacaagaaauaacuaagaucagagcagaacugaaggagauagagacacaaaaaacccuucaaaaaaucaaugaauccaggagcugguuuuuuuuuaaagaucaacaaaauugauagaucacuagcaagacuaaugaagaaaagagagaagaaucaaauagaugcaauaaaaaaugauaaaggggguaucgccauugaucccacagaaauacaaacuaccaucagagaauacuauaaauaccucuacacaaauaaacuagaaaaucugaagaaauggauaaauuccuagacacauacacccucccaagacuaaaccaggaagaagucaaaucccugaauagaccaauaacaaguucugaaauugaggcaguaauuaauagccuaccaagcaaaaaaaaaaaaaaaaaaaaaaaaaccaugaccagacagauucacagccgaauucuaccagagauacaaagaggagcugguaccauuccuucugaaacuauugcaaacaauagaaaaagagggaauccucccuagcucauuuuaugaggccagcaucauccugauaccaaagccuggcagagacacagcaaaaaaagagaauuuuagaccaauaucccugaugaacauuguugcgaaaauccucaauaaaauacuggcaaacugaguccagcagcacaucaaaaagcuuauccaccaugaucaaguuggcuucaucccugggaggcaaggcugguucaacauccacaaaucaauaaacaugauccgucacauaaacagaacuaaugacaaaaaccccaugauuaucucaauagaugcagaaaaggccuuugacaaaauuuaacagcccuacuuuccaaauaauaacuaggcauugauggaacagaucuuaauaagagcuauuuaugacaaacccacagccaauaucauaauggacagaaacugaagcauucccuuugaaaaccagcacaagacaaggauacccucucucaccacuccuauucaacauaucauuggaaguucuggccagggcaaucaggcaagagauagaaauaaaggguauuccaauaggaaaagaggaagucaaauugucucuguuugcagauaacauggauuguauauuuagaaaaucccaucaucucagcccaaaaucuccuuaagcugauaagcaacuucaacaaagucucagcauacaaaaucaaugugcaaaaaucacaagcaucccuauacagcaauaacagacaaacagccaaauuaugagucaacucccauucacaauugcuacaaagagaauaaaauaccugggaauccaacuuacaagguaugugaaggaccucuucaaggagaacuacaaacuacugcucaaggaaauaagagaggacagaaacaaauggaaaaacauuccaugcucauggauaggaagaaccaauauugugaaaaugacuauacugcccaaaguaauuuauagauucaaugcuauccccaucaagcuaccauugacuuucuucacagaauuagcaaaaacuacuuuaaauuucguauggaaccaaaaaagagcccacauagccaagacaauccuaagcaagaagaacaaagcuggaggcauccugcuaccugacuucaaacuauacuacaaggguacgguaaccaaaacagcaugguacugguaccaaaacagauauauagaccaauggaacagaacagaggccuuagaaauaaugccacacaucuacaaccaucugcucuuuaacaaacccgauaaacaagugguggggaaaggauucccuauuuaauaaaugguguugggaaaacuggcuagccauaugcagaaagcugagacuggauccccuccuuacaucuuauacaaaaauuaacucaagauggauuaaagauuuaaacauaagaccuaaaacccuaaaaacccuagaagaaaaccuagccaaaaccauucaggacauaggcauggucaaagacuucaugacuaaaacacccaaaacaauggcaacuaaaaauaaaauugacaaaugggaucuaauuaaacuaaagagcuucugcacagcaaaagcaacuaucaucagagugaacaggcaaccuacagaaugggagaaaaauuuugcaaucuauucaucugacaaagggcuaauauccagaaucuacaaauaacuuaaauuuacaagaaaaaaccccaucaauaagcgggcaaaggauaugaacagacacuucucaaaagaagacauuuaugcagucaacaaacaugaaaaaaaaaaagcucuucaucacuggucacuaaagaaaugcaaaucaaaaccacaaugagauaccaucucacaccaaauggugauaauuaaaaagucaggaaagaacagaugcuggagaggauguagagaaauaggaaugcuuuuacacuguuggugggaguguaaauuaguucaaccauuguggaagacaguguggcaauuccucaaggaucuagaacuagaaaugccauuugacccagcaaucccauuacuggguauauacccaaaggauuauaaaucauucugcuauaaagacacaugcauauguauguuuauuguggcacuauucacaauagcaaagacuuggaaccaacccaaaugcccaucaggauagacuggauaaagaaaguguggcacauauacaccauggaauacuaugcagccauaaaaaagaaugaguucauguccuuugcagggacaugguaaccaucauucucagcaaacuaacacaagaacagacaaccaaacaccacauguucucacucauaagugggaguugaacaaugagaacacauggacacacgaaggggaacaucacacacuggggccggucgggggcuaggggauggauagcaucuggagaaacaccuaauguagaugacagguugauggauacagcaaaccuccauggcauguguauaccuauguaaccugcacuuuuugcacauguaccccagaacuuaaaguguaauaaaacaaaaagagucugggaauuuagccaucauuaaagaaaucaugguuaaaggagcaaacuuggaagaauugacugacuugucauguaaaagaggaacuagacccaggguggaaauauaaagacacauuucggucagauaugaggacuguucaaagguuggaucaucgugggguuuaaugaacaucuucaaacuggaaguauuaaccaaagguugaaaugacagugugucaugggcuauuuagaugggaauaugggaauauuuuauucaaugaaaacuuggacuaguuaauaccgaagguugcuuccaaucugaaugguucuuuugucuuguacuguuuaguggucacuggcauuauaggacauuuucucugcacgcugucacaauuucugauuauuauaauuuguaugucauuuucauucuugauucauuccuuuccaugauucaaacugaaucagcaaacugaaaucuguaggcaucuaagacucuuucagauucucuuuucuucauaaucaccuauauuugccuguuucuucuuuaugguaguaguuauuuuuccucuuccuuucuuaucaguaacucugaccagucuaccuuugcuuauaugcaauuucuuaauaacauaccucuucuguuaggauuuuuaauauuauaagcucaagccauguacuguugaaauggcugaagccacuuuuuaauaaauuacagagugccaccuaacauuuguguuuuuauggugcuuuuacuuuuuccaaguccuucugucuguauugcuucauuuaauuuggauaaaacuaacaacaguuucguuccauuacaucgacaugccccuuaagaggaagcuaaaugaauaaacccuucuacaucauuuuuucaucucaguaauccuguaccaccccaucucuucugcccaauaccacauuacucauuuuuauuucucagauuaucuccauuaccuagagugcuacuuauuuuuauguugucuucaacuuuauccuugagaaguuuuaaauuuucuuuaucaguaaagaauuugaaccauggaugugaggcaugcaguucccagccaaaucuuguugcuuauucauguguuuacaauaagaaaaggaaagaaaauaacuuacucccuuuuccuccccuucucuugucagggcuaaaaaaaaaaaggaaaguuugucuuggaauaauuauuuauugauaaaagaacacuauacuucuguuaucucuuuguuugaugucccuuauccuguuacauuauacuuuuuaguccauuuuaaugucuuuguguuuuacuauccaauuccuaauuucuuacuauauuugcauuuauauuaucauccucuuauccuuaaucggggucaguguuuuacugauuuuaagugguauaauucuggaacucaaaagaaauagucuaauuuuuguaaaacagagcaugcucacgugaauucuuaauaguguuuaaugaagaaaauuacuaucaagaaguaaacugacuguuuucucuuaauccccaugaucccagcacaagcguacuuuauacccauaguuuaguagaguuguauuacuuuagagaggacuaagcauguggguuauggacuauuuuugguguaugugaaguaguaaacacuaaugcauaugaaaaauaaggacacagauuuuauagguuuuuaaacaguguaaggagccauaaaauugauuuugucuuuuauucuauuaauauauguauuacgcugauuuucauauguugaaccaaccuugccucccuggaacucuguuuuauucaucuuuauaucuuuuggcagauauaauguggcaaauaguugacacucaauauuuguuuaauaaauuauaggaaaaaagaauuaguguuaaacaaaagcacuacaguuauuaaguuuguguuugaaaguagccaguaauguaaaccugcuuauuuaagccagcguaggaagcagcuguucaaugaagcaaaauuuauaaaucauauaaauacauagagcaaguaguguuauauaugcauaaauggugugaaaaucuauaaaucaaagcuguuauacagaugaccagguucuuaguaaacaauuuugugcaaccgcuguuuaaccuaugccaauuguaaguucaggcuaacaaucacuggacacagaaagcaucuuaagaugggaagucaaacaugcuuuacuuccguaaaaguuagagaaggaaguugauacaaucaggauacacagcagagagaucaccuaucuugucuacuugcagguggugguguaaacuuccaggaccccccaaaagugccuuaucuguaaccauagaguuucagaugacaugucugagcaucauaccugaagguucaucugccuuccucaggccuagccuuacguagacgggcuauagcaaaacagaauacagccuuaccuugauauaugcaggaaacaaguugcauuacgaccagauauaccuuauuaauuuuaugucagagcauuacuccugaagauuuaucugccuccucaggcccagccuuacauagauggggauguggcagaacaggguacaguccuacuuugauauauacaggaaauaaguugcauucugaccagauauaccuuauuaaucucaugucagagcaucacauuugaagguuuaucugccuuccuuaggcccagccuuauauaaauggggcuauauagcaaaguaggauauagccuuacauugauauaugcaggagauaaauugcauucagaacagauaugcguuauuaaucucagaauuuuccaguggcuaaugggacuguuaggggauggcacagguacacuacagaggcauuguguucagccuacucaagcuaacauggcauuggugaaguggauuucuggauuuagcgaugugaaacuagauuaagauuuagcuacccagacacaucugagagcaacaguaauaggccuucaaaccagcuauagagauuaucuaauucuagaaaauucccaugauggaaauuucguaagaaucuuuuuuaaguacuacaugagguaaaugaaccuuagaucacugucauucauaguuaugugauggaauagauuuuuagguuuuacagcuuaguuucauauuucaaauauuuuuauguuucaguuaguaaucguugccaaagaauguaaaagaagcaguuauuugguauaugaaaaucagaagugcucaaaucuuacuaggagacugagauuuauuucauguaauuuucaggacauaauuuaguuauggucccaaagaaagucuuuauaggaaguuucugugccuuacuagccaaaauacaaguagaaacacggccaacaacuugcucaucuuucuuccuuaccuccaaaauuaacuacaauugaugccaugcuaugaguucucugauuacuggggcuggguuuuauuuauauuuguaucuuccauacuuagcaagguaacuaacacaauauauaguagaugcuuaaucaguguuuguuauugauacuuuuuauuuauagucuaagaucagcauguuuacauucuuucauaauugucagagaaagacacaaaaguaaaauuggaaaagauuaaaacaaauaacuguuuuuaaucuuuucccuaaucuauccacuuuacuuuuuuauaguugugauauuuagggaauucaaacauagcuuuuuacuguauuuuugaaaauucauacuuaaagcauuuguucuuuuuguuaauuuuuuaaauugcugcuguacugcuuuuauuugacuucgcugcuaagauucuuauuauauuugauacagaguucugaaauaaacuuggaaacuucucagauucuuccguaauuaaguguaucuaaaauaauuguauauguuuaaauaaguagaauagaucaaauaaauauaaaagaaacuaucuugugaagacuuagaguagaauuauagauuuuacuuguauugaaaauaauaaagaaugugauuuagguaguagaugucaauauauauauagugauuucuucauuacagagauaguguuucaucagccuucauauucugaaaugaaaaaaaaauuuaggauaaauguaauuuuuaacuuuuuagaauauuuucuguucaggauggcugacuuugugauuuguccaaauuaggcaaaaagggcagcuagcuguagaaagagcuaaacaaguagaagaguuccugcagcgaaaacgggaagcuaugcagaauaaagcucgagccgaaggacauaugguaugaauuuuguuuguuucugagauuuugaauguauuaguauuccaagugaaggucuggaauaagguaaguguaaguaaaaagaaugacagucuaacaaucuaggcauaauaagaggcaguaaagauacucagaagucauuugcagaguauaaaauugugauaucuuaacucauuuaccuucucuuuugcuaucuuuuauaccagggguggaauucuauuguugcuuugguuaauugggaguaaguucauaccuguauccuuccuuuaaaagaguagaaauggguauagcaacccagauaaagaaauaaguucuuggauugcugcauguuuuuuuuccccaauaugcuuuugguuuuacauacuuuuaaguggcaaagaauuuuagaagaaaaaugggaaauaaguauuuggguaaguauauauguaaacuaugcauuugcucaaaagcaaauuagaaguagaauuuuaguaaagucuccaguuaugccauuuaacuaaauuaaguuauguauccaagaaaauauuaaguuuuuagguaaucauuucaaucauuaaaacucuguuuucucuuugguauuuaacaggauuugagguaguuaaaacucuucauaguuugauuuguagagguucacaaaugccuuuugacauuuugucuacagaacaacugaugauuaugucuguccacucagcaacccaugaagcagcacacucauauaagaaauagguuaauuagaugguaauauauuuuaauuagacuuauuacauaucuguuguaaguucguaagugguaucuuugugaguuaauguaguucaauauaguauguuuuuucuuugaaacaaugucauagaaacauaguuaaaauuuuugaacaguuacccuuuauauuguuaacacagauacuuaaauuuguuuuucuacauccggaauuaaucuauauuuguaucuuuccucuagauaguagaugagaaccuccagccuuuuccuuugcucauaucucccauguuaauagcagcuggaauuuugguuauagauuuuuacuuaaaauauuuuuaaaagaauugguaggcuuacugaaauuuacuaauuuauuuucucaacaucauuccuuaugucuuacuauuccccccucaguuuauuuuuuuucaugcuggagaaucugguaauuuuuuuuuagaggaacuuuccaagauuuauuggaaaaugcucuuauuuuguccucaugcuugaaugauaauuuguaaugguggucugcuggugaauuugauuagcauuuguaugucugaaaaaguauuuugcuuuuguuguuaacaaauauuuugacuggauauuguauuauaguugaaacuuuuuaccucuggcuugcccuguuucugacaagaacuaagcauucauucuuaucuuuuuccuugguauauaauguaucuuuuuucucuacuuuaaaauuuuucucuuuaucacuagaaucaauuugauuaugaugugguuuguguauuuuuuuuuuuuuuuuuugagacaaacucucacucugucacccaggcuagagugcaguggcgugaucuugggucagugcaaccucuaccucccuggcucaagugauucucaugccucagccucccaaguagcugagaucacagguguguaccaccacgcccaucuaaguuuuguauuuuuuuaguaaagaugggguuucaccauguuggccaggcuggucuugaacuccagaccucaggugauccaucugccuuggccuccgaaagugcugugauuacagacaugagccacugcacccugccuuguguaguuuucuucauguuuauuuuguauagggguucauugagcuucucagaucugugguuuaugauuuucaucaaaucuggaaauuuuucauccauuauuucuuuuucuuuucuuuuuuuuuuuuuuuugacacggaguuuaacucuuguugcccaggcuggaaugcaguggcgcagucucggcucacugcaaccuccgccucccggguucaagugauucuccugccucagccuucugaguagcugggauuccaggcgucugucaccacgcugggcuaauauuuuguauuuuuaguagagacagggcuucaccuuguuggccaggcuggucucaaacuccugaccucagaugauccaucugccucggccucccaaagugcugggauuacagacgugagcccacugcgucuggcccauuauuuccucaaaaaauguuuuucuguuugccucucucccucuucuaggucucugguacacauauauuagaccaguuuguacacuacuaaccauucacugaugaugcucccuauuuuguucagucuuuuuuuuuuucucuguguguuucauuuuggguuguucuauugcugugucuucaagugcauuaaucuucugcugugucuguuaauucuauacagacauuauauguuuuccaucucagaaauugguuuuuguuuguuuauuuuuugagacagaguuuucgcucuuguugcccaggcugaagugcagagacaugaucuccgcuugcugcaaccucugcuuccuggguucaggagauucuucugccucagccucccgagcagcugggauuacaggcaugugccaccauagccggcuaauuuuuuuguauuuuuuaguagagaugggguuucaccauguuggccaggcugaucucgaaccccugaccucaggugaucugccagccucagccucccaaauugcugagauuacagacgugaaccacugugcccagccagagauugaauuuuuuauguuaaaguugauuuggauuguuuuuauaccuuccaugucccccacuuuucuucauguuguuaaacauacggaauauaauuacaauagcaguuuucauguccuuaucuauuaauucugccaucuuugucauuucugagucucuguugauugauuuuuuccccuaauuagggucaucuuuuuuucuuuacaugucugguaauuuguaguuggauaccaagcguugcguauuuuauaaauauuuguggacuuuuuucugggauugcaguuaaguuacuuggaaauaguuugagucuuucaaaguuugcuuguaagcuuuggccaggccaguacagaacagucuucagugcuaauuuggccucacugcuauagcacuacucuuuugaauacccaaugcuucauugauuuggaggucuuuucaguuuggcucuuggaaacaugagacauuugcagcccugauugaaccucagguauuauugacaauaugcuguuugucauuuagcaggaagcucuagggacccucuuuagaucuugagcacccuucccccgugcagcucuuucuucuuugcaacucuguccuggaaauuugaguguucuucaauuuuccaaggucugaaugauguuuccucaacuaaggggacugccaagcucuguuugguuaccuucucucugugcugcagccaggaaacccuugccagucaguaaggugggcagcuguuggguuuaccaccuuuguuucccuucucucaaggaucacucuccugugcugucuguuguccaguguuugaaaaccauuucauaugcuuuguucagacuuuuaguguuuaagaugggaggguagaucuguuacuucauuauggaugcaaaugagccucaaaugauaauuuggcuggauaaggaaauauaaguuugaaguuuauuuuccauagaacuuuaaagguucugcuuuauuaucuuccuacuuacauuguugcuaaugagacaugugauguucuggaucuuguuguuuuauaaggaauucuuuccuuucucauaacucuuaggacuauuuuucuguccuugacguucugaacuucacuugaauauuucucaguuguuuuguuuugucuuacuggcuuaaguuuccacugaaugcuuucaaugugaguacuuaucuucaauucuagggacauuugaaauuaaaaguucuucaaauauugcuucuacauuuucuccucaagaggacuccuauuagacugauauauuagaaccucugcauguaauguacuuuaaaaaaucuuuuucucucuuuuuacuguguuuuggaaggauuucuaggccugauguuccagcucacuggaauauauucuuugguuuugucuacucugccauucagcucaucuaaugaguuuccuuuuauuucaaaaauuuacguuuucauguccaugaauucuaauuaguuuucccauagaacucuuuucuuauguuuucauuucgcugguaguauauaauuguuguaaagucuuguucuuagugugcuguugacuauguuacuuugguuucuuccacuuuaaaguuuguuagguauuucauaguguugguacuccucaaauguucugcaccuuugcuaguguguucaugauugggaguaugaauuuuacuguucauugccuuuguuugggugacucccugggaagauggcauugugcuagugccacaaucuguucucugcaguuuucagugagagugaaggaugagugggacauacugauauucuguccuuucuacaaccagccagagaagacuaugauuuuaaaaggcucaggugauuaggucagucccaccagauaaucucuuuauguuaacaucagucauugcauuuaacacaaaaucugucauauucacaguccugggaauuaugcaggguugacccaauggaguacagggagauaacagaaaccuuggaaguuuccuuagaauucugccuacuauacucccuuugcuuauaauuuuagagccuacaucuggagacaguagauuagacuaaguagaggagcuacucuuuuuuuuucuuuuaguucccuuucccuuucuccuuuccuuuuuccuuuccuuuccuuucuuucuacagggacucacucacucccugacuggagugcaguggcacaaucucgguugauucuuccaccucagccucccaaguagcugggacuacaggcgcgugccaucaugcccggcuaauuuuuuuuuucauauuuuuuuuuucaguagagauaggauuucaccuuguugcccaggcuggucucaaucuccuggacucaagcaauccacccuccucagccucccuaagugcugggaugagccacucagguaugagccaccaugcccagcaaauagacuuuauuuuuuauagcaguuuuagguuuguggcaaaauugaguggaaaaguacaaggauuuucuauauaccucaugccuccacauauguguagccucccucguuaucaccacccuuagcagagcaguacauuuguuacaauugacgaaccuacauuaacacaucauuaucacucaaaguccauaguuuacauuaccgcucacucuuggugcuaacauucuauggauuuaaacaaauauauaaugguauuuaucaccauuguaaugucauacacuguaauguuucucugcccuaagaggagcuacuuuuaagugcuguuuuuagcaacauacuucguguuagaacauaguaacccaggcuaccauacaagagccuuuuuuuauaauuggcuuuauuaacauauaauuuaaaugcaauaaaauucuaaguguauaucucaaugaguauugacaaauauauauaguuacguagccgccaccaucaucauauguaaacuguuccauugccccccuaaaaguuucuucaugccccuuugaagucagucaccuacucaccgccaucagccguaggcaaccacugaucuauuuccuguuacuauaguuuuguccucucuagaauuuaauauaaaauuaugaaucauacaguauauaguuuucuugugacuggaguguuaucacuaguuaguuguuuuuuauuccuaagucauauuccuuuguauggaugugccacauuuuguucaauuucucuguugaugaacauuuguguuguuuccaaaauagaugcuuuuaaagcucaucggauuuaugugaucauuaaauucacuuauuuauauacauaccuauauaauuggcuagccugucuucccuauggaacccuauuuucugaguuagcauaucccuccucguuauguguaacugaacuagugacuguuacuacacuuagacuucugaacacugcuggagaaaauuaaagcuaugaugauuaauaaugucuguuucucugguuucagccauuuccuucuauucuaugccauaccaucucuuacuuucgggccuuauuccaucacuuaucugcuuaagaaaguuucuccucgacuuugcuucuuuaccgguacucuccuauagcauauacacauacauauauauaauauauguauacauaauauauauguaauacauauauguauguaguauauauauuuucaaauuucucacaucauuaacucugcauacgucuguaguuaucauccugucucuuuccuccuguucauagccagacucuucaaaugaaugaaacaccugcugucucuccuuucuuaucuacuauuuaguuuucaauuuauuguuaauaguuuaucaucauaucaaagaagucacugcuauccaucuugccaaauauaauagacuauuuuuaauccucaucuuacucugccgcucugugacauuugaucaugaacuacuacuucaaaauuuccuucuuccacgauaccacauucucuugauuuacccuuuauuucucuggcuacaauuucuuaaugccuucuauagaauuauuuucuucucagucuuuaaaugccaauauucucugcagcucuguccuugcuauuuucucacuauaaauaauauccuggagugaucucacugauaauucuaccagaugacuugaaaaucuauaucaguaacucagaugacucuccuaacuucuguccuguuuaucuaguugccuuccgaauguuguuucccagguggugcacuggcaccucauuuuuugcauauuuuauuuucaaaugaucauauagugauauagacuuuuuuccaggaauuuuaacacauguauaaauucaugcagccagcaccacaaucaaguuacagaacaauuccaucaccccccgccaacccuuaugcuaucuuucuguagucacaucucucguucuacccccaacaccuuggcaaccauuuuauauuuuccagagugucuuguaaauuguauguauguauacauacauauguuccuugacuuacgaugggguuacauuuugauaaacuauuguaaauugaaaauauuuagucaaaaauguauuuauugcacuuaaccuacaaaacauggcuuagccuggccuaccuuaaacaugcuaagaucacuuacauuagcccacaguugggcaaaaucauuuaacacaaagucuauuuuguaauaaaguguucaauaucucauauaacuuauugaauacuguacugaaaguggaaaacagaaugguuguauggguacuuaagguacauuuucuacugaaugcuugucacuuucacaccauuguaaaguugaaaaagcauaagucaaacuaucauaagugggaaacugucugcacacguaaugguauguuguaaccuuuugugacugguuucuuuccugcacuguaaugauauucaugcaaguuguugcauguauaaauagcuuguuucauuucgcugcugaguaguacuccauugaauggauguacaacaguuuguuuauccauuugccaguugugggacauuugagauguuuccaauuuuugguaauuaugaauagagcuguuuugauuauuuauuuccauaggauaaauacccaggagugggucugcugggucauauuguaaguguacauuuaacuugauuuuuuaaaaacucuuuuuuccaaaaguguuucaaacauuuugcauucccaucagcauuguacucgaauuccaguugcucugcauccucaucagcauuuguugucaguguuauuuuagccaucuaaaccauguauaggaauaugucacuguggcugaauuuggauuucucuaaauguuaaugauguugaaugucuuuucauauuugccauccuuauauccuuuuagagaaaggucuuuguccauuuuaauuguauguuuucuuauucuuuagcuuugaaaguucuauuauauguucugaauacaagucuuauauuggauaaaugauuugccaauacuuucuccuagucugaaacuuagcuuuucauucccuuaacagaaucuuuugcagaggaugaggcuuuaacuuugaugaaguccaguuugucaauuuuuuuguuuggaucaugcuuuucguguuaugucuaagaacucagcuuauccaacaaucaugaagauuuuuuauuuuuucuucuaaaguuuuuauaguuuucauuuccaccuuuagauuuaugauccaggaagaagacguuuauuguaauaaaauacacauaacauaaaauguacucccuuaaucauuuuaaaguauacaguucaguggcauuaaguacauucacaauguugucuuccuugauuucuauuuugcucuuuuuuuuguuuuuaaauuuuuauugauacauaauaguuauacauaucuaugggguacaugugauauuuugauauaagcauacaauuugugaugucuuguuuuuugagguagcaacuuaaaacauugaguugagaccuuucuucuuuucugauagugguauugcauuuuauaaauuucccucuaagcguugcuguagccauauucuacaaauuuucuauguuguguuuucauucucauucaguucaaaauguauucuaauuuuucuugagauaucgucuuuggcccauggauuacguaaaaguauucuguuuaauuuccaaguguuugaaaauuuucuuauuaucucuguugucguuuucugguuuuauuucauuuuggucauaggacauacuucguaggauuucaguuaguccuuuuacguuuguuaggguuuguacuuugaucuaguguaugaucugucauagugaauguuccacauguacuugaauggaaugguuuucugcuauuguuggguggaauauuacuuuuauuagauccaguugguggauguuuuauucuucuugauccauacugauagccuaucuacauucuauuugauacuaaggaagucuucaaauauaauuguggauuugucuguuucuccuuuuaguucugucaguuuuuucuuucuuuguuuucuuuugcaguguagcaaguuaccacaauuuagcaguuuaucucacaguuucuguggauuaggagucuggacacagcuuagcuauaucuucuaccuggagucucacaagacuguaauauggucagccaguaugcauucuuaucuagaagcucauuugaggaaaaauuuauuuccaagcucuuucauguuagugagagaauuuauuuccucguggcuuaaugaacaagggucccagcugcuugcuggcuguugacuugaggucucucucaguuccuaggggccaccugcauuuguagagacauuucuugacacaugggccucuucaacaugucugcuugcuuuaucaagcaaaggcaaccuguggaggguguaugcuagcaagggcagaaugguauauaaugugacaauuacaggagugacauccauuacuuuugucauagucuguugguuaaaagcaaaucacagguccuccccacacucucaggaggggauuuuacaauauuauaaauauuaggagcugggcaucauggaggccaucuuauagucaguaaggcauauccuugguaauuuuuugguuugaagauaauuuuuuuuauaguauuauacccauuccagcuucugucguguacuguuugugugguauaucuuguuuccuuuuacuuucaauuuaccugaaugauuguuugaggugaguuuuuuauagugaauuuauaguuuuuuuauguguuuuuaaaaaauguagucuaacaauuccuaucuuuucauugguguguuuaaguaauucauuauuauacuuaaagacguuuaauguaauuauugauauguuaggauuuacaucucacauucuauuauuuguuuuguguuuauacccuaugauuuuguuucucucuuuccauuucccugcugccuuuagauuauuugaacacuuuaauauuccauuuuaauuaaucuguugugauuuugacuauauuuuucuuuuguauaauuucuuugugguugcucuagggguuaaaaauacauacuuuacuuuuuacaaucuguuuauaaacaauauuguacuauuucaguuggaacauagaaaucuuuccaacauaguagcuuuacccucuccccuuuaugguauaguugucuuguauuacguuagcagacauuaaaauaacaccaggaaauguuauaccuuuucuuuuaacugucagacauguuuaauaacagagaaaaggaauacuuuguuauauuuauacaaauacuuauuucuauuacuuuucuuucauuccuaauguuucaaguuuucuucuuuuucccuuucccuaaagaaauucguuuagcagcucuuagagaucaggucugcugacuguagauuucuuuacuuuauuugagaaugucuauuucaucuucauaucugaaugguguuuucacaggauguaauauucuugguugacagcauauuucuuuucucacguaaaaauguuacuuucuggcuuucuauccuccauaguuuucagugagaaauucucaccugaauguucaaaugcuuuuucucuuguaguuaaucuuuuguuuuccucuggacgcuuucaguauuuuuucuuugucuuuaguauucagcaguaugauuaagucaucucuggaaauggauuuuuggggauuuuuucuauuuaugguuugcuaguuucuugaauuuacaagguuauggauuacaccaaacuugucauguuuuaagccauuauuucuucaaauauuuuuccaacacugcgcucuuucucuucuucugguucucugauggcaugaaauguuagacuuuuuguuuuucucccacagguuuguaaagcuuuuaaagagguucuaacagauucaggucuuaaacccaauauguguuuucugauauuuuaaaauaucaaauaagccugaacaauuaugauuaaauucugagucugaaggauuaacccucuggaauuaguaaccugcuauagucaaguuauuugaacaguauauuuauuaacugcuuugggaaaccacagugaauuaaaacagguuucuaugggaaaauguaaauaguuuuuagguugaauuauaguuuaaagaaaucguguauuucaaaauaauuuuaugugcuuuuguuuacuuuuauuuuuguuuuuuuuagagacgggguuucccucugucacccagguuaaauugcaguguugcaaaucuguagcucacugcagccucacacuuuuaggcucaagugauccucccaccucagccuccugaguagcugggucuauaggugcuugccaucaugcguggcuaauuuuuuaaucuuuuuguagaguuaggucuugcuguguugcccaagcuggccucaaacuccuagcuucaaguuauccucccaugucagucuaccaaaauacuggacuacaugcaugacccauugugacuggucucaugcuuuuugaugaauuuaaaauuuucccuguauagguaacugaaacuuugaaacaaaaaaugcaguuuagggaaacucuaucaagaagacuucaagccacauguuuuuuguugguggugguuucguguguaugugugugucagagggaagguggguuugcucugaaccuuauuaauaaaauuaauuaaaaugacugaaaaucuacuccugauaguaauucuuuguaguggggauuuuuauuccaguguuacugguuuuaaaacuggcccagaguuacuaguacuuugcccaagaucacguaguaaugcccagaaacagggugcaaacccagaaugucugacucucaagauuaugcuuuuagcuguuugacuauguuguuuguuccuuuuuaaauggcauauuacuguuugcuuuaguuuagguaaaacuuguagauaaggcagcauugcaaagugggggcaggcagauauuuuccuguaaaaggccagagaguaaauauuuuaagcuuuaaaccauaugguguuuuguacaacuguucaacucuuaccauaguaguaaaaggcuaaacaaauuaguguggcuaugcucuaguaaagcuugauuuuggaaauaagacagcagacuagauuugacuuguugauaauaauuugcugaucuuugcuauagauuauccuguauaguaaauuaguucuucaacgcuaaguuuauuuugaaaagauuauuuuuuucagaucuucuuuaaaaauauuccuuuauuauucuaaaauaacguuugggcugggugcaguggcucaugccuguaaucccagcacuuugggaggcugaggcaggcagaucaccugaggucaggaguucgagacccgccuggccaaacaugauaaaaccccaucucuacuaaaaauaaaaaaauuagcugggcaugguggugcgugccuguaauucuagcuacuugggagguugaggcaggagaaucacuuuaacccaggagguggagguugcagugagccaagaucgcaccacugcacuccagccugggugacagagcaagauucuuucucaacaaaauaaaauaaaaauaaaauaaaauaauguuugguacauggaaaagaauauguguaauauguguguaaauuaaaaagcaaaauaauauacccagaagauugaacacuaauaaguagccucuguacucuucccuaacucaaggauuggcaaacauuuuucuguaaagggccagauaguaagcauucguggcuuugcuuggccauaaggucucuaucauagcuacucaacuuugcauuauggcacaaaagcagcuguagacaauguguaaaucaguaagcaugaauguguuccaguacaccguuuauggacacugaaauuagaauuucccauaacguucauguguugugaaauauccuuuucauuuuuccauaccauuaagaauuugaacaccauucuuagcuuuuggaccauacaaaaacaagugaugggcuggauuuggaccauggaccauaguuuuccaaccccuauuucaucuuuuuucuccaccuuucccugcagguagccauuauccugaauuugaauuuaucauuccuguagauuucuuaaaauacucuuuuuucacacacauaugcgugauuaaucaguaccuuguucuguuugauuugaguauuauaaaaauuuuacuguauauagacugagacauuuuucauucaacauuuuucuuuuuuuuuuuuuuuuuuugagauggaauuucgcucucauugcccaugcuggagugcuauggcacgaucuuggcucacugcaaccuccgccuccuggguucaagcaauucugcuuuagccuuccaaguagcugggauuacaggcaugcgccaccacacucagcuaauuuuguauuuuuaguagagacaggauuucaccauguuggucaggcuggccccaaacacuugaccucaagugagccacugugcccggcccauucaacauuuuucuaagauucauucauauugucaaguauugcuguaugauauuccauugugugacuguaccacaauuauucuccugacaguaauuauuuagguugguuccaguucaucuuugaacauuguuguagauauauccugguacacaugugcaagaguuuuucuugguuaucuucuguugaauaacuuaacagaagaaccucugaauuuuacaaaaaugaugaaacagcauuauuucccuugagaaauguuacuuucuuauuaacucaucuuaaaucauacuguguuuauuuauacuaauggaaaaccuaccuuacaaaaugugcaguuaacuguuaaaacuuuucauucauucuuucauugauuuaauuuuauacagaaauuaaugacuguaauauguuagguuucaugcuagcaggaacauauaagcaguaaagggagauagacaauaaaccaacaauuaaguaauaauaacuauuuauugaaagcuuauuaugccaggcaucguguuaagcaauuuauaugcauuaccucuauauuagucugcuaaggcugcuguaacaaaagacuacaaacuaaauggcgucaacaacacaaauuuauuaucucagaguuuucagggcaagaaguccaagaucagugugucagcaggguuguguccuucugggggcuuugagggagaaucuguuccaugccuccuuccuaccuuuugguuauuggauggcaauuuuugaccuuccuugguguauauuaucagcauccugaucucugccuucaucuucauguuguguucuugcugugugugagucugucuucaaauuuucccuuuuuauagggacaccaguccuacugaauuaggaccuauucugaugaccucauuuuaacuugugaaacauccuaucucuaaauaagguuaauucugagguacuaggguuugagacuucaacauaugaauuuaugaggggcacaguucaacauagcaaucucuuagucuuuccaacaauccuguguaacugugucaaacuuugaugugcuagucauguuauagaguauguugcaguguaaaaaccuuagcuaucaaaaaguaguuucugcccagguccaaaaagaauggcauagacucacuuuucccuguuccuucccucuaaauauaacuaaauacccuggaaauuauuuagcauacaauuauaauuggauuauaaaugccagaaagaaggugagcuggcuagagaccucgggacuugagaaauaacaccaggguucucuggguuuucugucucccguauaucuuggacuggguauuagagaggccugcaacccagauccacuagacaaaaaacaauauuaaacaagaaaagccugcucuuacucaccaaaggacuggaaaaggggaaucccaacaaagauagggaaccucaacauuuuccugacaccagggaccugaugagugauucaagcucaggacaguggugaagccucaggcuaucccugccccacuccacaacuuauucaugguaccuccaccauggaagucucccagcaacagccgguagcccagagaagcaacuuccauucucacaagacagcagcagcagugauugaacaggagcucuggaagcaccagaagaaugaaucagaccagaagaguaucacaaguuuucagaaaaccgaacugcaauugaaacuaaagcccacaaaaguaggcuagaagccgauugcuaaacuuugacaggcuacuuccugcauaaaauagauuaagcaggacuaugagucuuuuaacauaauaacuugucaaaccaagcugaaugcagcaaaaacacaauuugugugagaaaugacauugauuugacauucauaucaagaugaaucagauguaggaauuaccugacaaggguuugaaaguugcugugauagaaaugcuucaacaaucaauuaucuuaaauuaucuuaaaaugauaaaaagggaaaaccucagcaaacaaauagaaguuuuaaggaagaauuaaauggaaauuauagaacugaaaaacacaauaaucaaaauuaagauucacagauuagacucaguaguacaguggagaugaugacagaagauagaaucaaugaacuugaagacauaccaguucaguucucuaucugaacaacagagaguaaaaauacugaaauuaucagucccaagaauuuauaggacaauacaaaaauuuaacauuguaucuucaaagcuuaaaggacaggagaaaguaugugaccgaaaaaugaagaaauaaugacugaaaauuucucaccuauagauuuaagaggcugagcaaauccuacaauaagauaaacucgaauccacacuaagaaauguuuuuaaaaagacaaaucugaaaaaugggagagagaaaugacacauuccauaugaaaguacaccaauuugaauaacagcagguuucucaucugaaaccauggaguuuagaaggaagugguacaacauuuuucaggugcugaaagaagaaaaaguacuaucaaucuuuaauucuauaucugaccaaaacuguccuuuuggaaugaaguagaaauaaagacacucucaaaugcaggaaacuaaaagaauuuguuuguaauagagcaaaauuaaguuacuaaggacaaagagauaaaaagagacaagguaacaaaagaaucaugcacuaagaaguuauugcagggggaggaaccaagauggccgaauaggaacagcuccggucuacagcucccagcgugagcgacgcagaagacgggugauuucugcauuuccaucugagguaccggguucaucucacuagggagugccagacagugggcgcaggccagugugugugcgcaccgugcgcgagccgaagcagggcgagcauugccucaccugggaagcgcaaggggucagggaguucccuuuccaagucaaagaaaggggugacggacgcaccuggaaaaucgggucacucccacccgaauauugugcuuuucagaccggcuuaagaaacggcgcaccacgagacuauaucccacaccuggcucagaggguccuacgcccacggaaucucgcugauugcuagcacagcagucugagaucaaacugcaaggcggcaacgaggcugggggaggggcgcccgccauugcccaggcuugcuuagguaaacaaagcagccuggaagcgcgaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagcuggagaucugagaacgggcagacugccuccucaagugggucccugaccccugacccccgagcagccuaacugggaggcaccccccagcaggggcacacugacaccucacacggcaggguauuccaacagaccugcagcugaggguccugucuguuagaaggaaaacuaacaaccagaaaggacaucuacaccgaaaacccaucuguacaucaccaucaucaaagaccaaaaguagauaaaaccacaaagauggggaaaaaacagaacagaaaaacuggaaacucuaaaacgcagagcgccucuccuccuccaaaggaacgcaguuccucaccagcaacagaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagaaaaaagaauaaaaagaaaugagcaaagccuccaagaaauaugggacuaugugaaaagaccaaaucuacgucugauugguguaccugaaagugauguggagaagggaaccaaguuggaaaacacucugcaggauauuauccaggagaacuuccccaaucuagcaaggcaggccaacguucagauucaggaaauacagagaacgccacaaagauacuccucgagaagagcaacucccagacacauaauugucagauucaccaaaguugaaaugaaggaaaaaauguuaagggcagccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauacagccaaacuaagcuucauaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucaagacuaggaagaaacugcaucaacuaaugagcaaaauaaccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaacccaucucacgugcagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccucagugaccuacaaagagacuuagacucccacacauuaauaaugggagacuuuaacaccccacuguccacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacucucucucagaccacagugcaaucaaacuagaacugaggauuaagaaucucacucaaagccgcucaacuacauggaaacugaacaaccugcuccugaaugacuacuggguacauaacgaaaugaaggcagaaauaaagauguucuuugaaaccaacgagaacaaagacaccacauaccagaaucucugggacgcauucaaagcaguguguagagggaaauuuauagcacuaaaucccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuauuaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucauagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacgcuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucaaggguaggaagaaucaauauugugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaauagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaaggccuaauauccagaaucuacaaugaacucaaacaaauuuacaagaaaaaaacaaacaaccccaucaaaaacugggcaaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggaggaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaagaaguuauugcaauccuaaauauguauacaccaaauaaccauacuuuaaaauauagagagcagaaacuaauagagcugaaagaagaaguaaacagguucacaauuacaguugagacuugaacauccugcucucagcaauugauagaacuacuagacagaaaaucagcaaggauauagaauagcuaaacaccaucacuaaccaccaggaucuaauuugcacuuacagaauauuccacuccacaauagcaaaauacacauuuuaagcacccaucaaaaauucaucaagauaauauacugaauuauaaaaccuuuacaaauauagagaacaguggaauuaaacuagaaaucaguagcaggaaggugacaggaaaaucuccaaacauuuaaaaauuaacacacuuuuaaauaaaccaugggucaaagaggaaaucugaaaggaaauuuagauguacauagaacagaauggaaauagacacacaacgcacaaaaaugugugagagcugaagcacuucugugagggaaauuuauagcacuaaaugcagacaguagaagaaaugucucaaaucacuguaaauuccuaacucaaaauacuaggaaaaaaaagagcaaaauauucccaaaucaagcagaaugaaguaauuaagaauagauacugauaaaauugagaccaguaauacuauagaguaauguaaugaaacaaaaaacugacucuuagaaacauaaaagugaauuugauaagucucuagcaaaauugacaaagauaaaaaagacgcaaaucaccaauaucagaaaaaaauggguauaauuauagaucuuguaacaauuaaaaggauaaauucaacuuuacauucauaaauucaacaacuuagaagagaugaaccaauccuauaaaauucguaaacuaccaaaacuuagccaaguugaaacagauaucuuaaauuuuccuauaacuguuuuaaaaguugaauucgugauucaaaaacuauugaaaaucucugggccuagaugguuucacuggaaaauuuuaccaaacauucaaagaagaauuaacaccaauuugauacaacacuacaaucuguucccagaaguaguaguggagugaauacuaaucaacucauuuugagacuguauuacccuaauaccauaaccaaagacagcacagaaaagcaaacuacagaccaguaucuuugaugaaauuaaauacaaaaauccuugccgggugcgguggcucacgccuguaaucccagcacuuugggaggccgaggcagguggaucaccugaggucaagagaucaagaccauccuggcuaacauggugaaacccugucucuacuaauaauacaaaaaaauuagccaggcgugguggcaggcgccuguagucccagcuacucaggaggcucaggcaggagaauggcaugaacccgggagguggagcuugcagugagccaagauugcaccacuguacuccagccugggcaacagagcaagacucugucucaaaaaauaaauaaauaaauaaauaaauaaauaaauaacaaaaauccucaauaaaauuuuaguaaauuauauccagccccaaccaaguggaauuuagucuagauguacaaguauuuuacaguauuaaaaaaucaaugugauucaccauaucaacaggcuaaagaaggaaauucauaugauuacaucaauugauacagaaaaucuuuugaaaaaaaucagcacccauucaugauuuaaaaaaauaauaacugucagcacacuagaaauacaggggaauguucugaaccucacaauaggcaucugcaaaaacccugcaucuaauauuauacagguagaagacugaaggauuucccucuacaauuagggaacaggcaagcauguaacuuuuaccacucauauuugacauuguacuguaaguuguaguuacugcaauaaagcaagaaggggcauacagaauugaaaagaugaaauaaaguuguugcuauuucaaguugauaaugauuaucugaaugggaaauucccagaacucuacaaaaauacuccugaaacuaaaaagugaauucauuauaguugcaggauacaagaucaguacacaaaaaucaauugaauuuauauauauugacagcaaguggaaacugauacaaaaaauguaaugccauuuacaguuguuccaaagaaugugaaaaagaaugcuaacaaaacauaugcaauauuaaaugcaauuaaaugacaaaaugcuggugaaaaaaaucuaagaagaccuaaauacuuggagagauacauuguuuaugaaucagaagacucacaacaguaaaaauggcaauucuuguuaaauuggagagauaaugcaauucuuacuaaaaucucagaaaauauuuuuuaauauagacaggcuuauuuuaaaauuuauauggaaagagaaagaccuuaaaguaacuaaaacaauuuugaagaacaacaacuugggaagaauaacucuuccugauuuugaggcuaacuuauagcuacaguaaucaaaacaguauaguaguggcaaagggauagacacauagaucaaugaaacacuauggagagucccagaauagaugcacacaaauauauaugccuaacugauucuugacaaacacauaaaagcaauucaguggaguaggaguaaccuuuucaauauuauugugggaggaauuggacauccauaagcucuaccaaccuugaccuaaaccucaaaccauauaaaauaauuaccucaaaacagaucaugggcuuucauaugaaacugcaaaacuucuaguaaaaagagaagaaaauuuggggaccuaguacuaggcaaagaguuauuagacuugacaccaagaguauaauccaaaaaaggaaaagcugauagagcaggcuuuguccaaauuuaaaaauuuggcucugcaaaagacccuguuaagagaaagaaaauacaaauuacagguugagagaaauguuuguauagcacuuauccaacaaaaggcuuauauuuagaaaauauaaagaaguaucaaaauucaacauuaaacauaaaagauccaguuagaaaaugaggaaaauuuauacaaaacauuucaccaaagaggauauacauauggcagguaacacaugaagagauacccaaaucauuuggaaaaugcaaacuuaaaccacaaugauguuaucacuucacaccuaucaaaauggcuauaauaaaaaaauagugauaaaaccaaaugcugaugaaguuuugaagaaacuggucaccuauacauuguuguuuggaauguaaaaugauacagccauugugcaaaauaguuucacaguuccuuuuuaaacuaaaaauggacuucauaccaagaaccagcgauuucauucuugugcauauguuccagagaaaagaaaacuuguugucacuuagaaacucauucaugaauauucauagaaacuuuauuuguaauagcaaaaaaacuuaaaacuacccaaaugcccuuuaaugggugaaugaaugaaaagacuguaucauaacacuauauccaccccauggaauacugcuuugcaaugaaaaggaaugaacuauugaugcauugcaauaccauagauggaccauauauaauuauauugaaugaaaacacucagucucaaaaggacacauauugugagucuauauagaaauuaugacauaauuaucaagauggagaacaguuuaauggucgauggguuagggauggagguagugaauguggcuaugaaguguuccaguaauaauacagcuaagcaucuugauuaggguggaauuaacauaagaugacaugagugacaaaauuguguagaugcacggcacaaauaaaagauuauaucuauaauuugaaucaaugucaguuuccugguuuugaugguguaauguagcuaugcaagaugagaaauuugggaaaggcugggugaaggggcacacaggaccucccuguauauucuuuucaccuuucuguauaucuauaauauuucaaaccaaaaagguuuuaaaacuucagaguaacucagauucuugcauuucucaaauaucaugaaaggaaguuaucaucuauagcaauacucaauucacuaccacccacuccccuuaacuuuguagauacucccauaugccuuuucagaauuuaucucacaucuuugcccagcgcugcuuauuucuuauuuuccuucaucuccccaacucuuugaccuauauauaucucaaaagcucaaauacugauaagcuauugcaagggccuucuugaagaggggaggaaacugagugaguaaaggugcuuugucaugcugcaaaagaaaaaagguagggcaugcucuuacaguaauacuuuuuugcucugguacacccaagaaguagguguuuuuaugccuagacuuaacaacaaguuuaagcaguuuuguuuaagaucaacagugcuuaugugauguugacaaaaacagauuucagagucuguauuucauguucuuaacuaaaauauacugcgcuuccaccauuauaaugcacucuaaugagugcuacugugagagguuucuauaaagaaaugguauggaaggucaaaggaagcacacuuaacucccuagagaaggcuuugaagaggcuucuggggugagauacuugguuugaguuuuggaagaugaguagaguuacccaucuuaagaggaugagugagaucaugguacaguuuacagaccacaaguaguugucguagccagaauguaggauuuaugacugagcaguggcagagaugagacuagaaauggcgagaucacaaauggcuuuaccugccauucaacagaaugugaauuaaagucugaagauaauaguaaccauugaaggauuugugugggauuugaugugaaagagaaagguuacucucagggcauuguagagaauggaauugugggaugugagacuagagguaggaugaguugggaaacucauuuagcaauuuaagagucaaaagaagagaggcugagcuaaggcagaaacugaaaugaucaauuauagaauuauuaggagauagaauugguaauuuggcauauuugaguauaguagguaagaggcaaauguaauuccuaguuugcugacuugaguggcugaucauguucaauaacugaauugggaauaagauuauauaguaaaaagaaggauaaagucagguuuauaaauugagguagcuuugcugcguaagaguggaguugcccagaugucaguuuaacauacacagaaagcuguaaagagaaaagggcugcaagguuugggaauuggcagcauauguuaaagccuggggaugagaagagaaggagggccagcaaaugaaacucuagaaaauauugacauucagcaacaagccaaggagagaaaagccugugaaaaauagugacaauugaaagaacccaagagagagugccauuauaaauacugaaagagaagagagacuuuuuaaaaaugugugaauuauagaacauuuguauaguggaguguuaugaauaguauauagucacuuaagaauaguguuuguaaggaauauuaaauggaugugggaagagauucaggauauaauauugucuggauaacuaguaaaauaccaguuuuauaaaaauaaacauguauguauuauacauaugcagagaaggaaauuuggaagacaguacccucaaauuuuaaguuucucagauggcagaauuauaaaugauucacauuuucuuuauuuuuuaauaaauuuucuauaaugaguauguauuauguuaugacagaaaaaaaugcauauauaaauuaaguggauucagucaaaacuaauuuccaguggaaauguuaaaugcaaaaaucacucagaagggcucauuucaguugugaaguagaaagucauuggugaccuuagaaaauuuucagucauaaugggaucagaaacuagauuguagugagcuaaaaaaugacugggaagcaggaaaauugagaugaugaauaaaaaaaauacacauucaauaagccaauaaaaagacauuugacaggaaagugggacuaaagaguuuuuuuuaagggaguaagucgaagcaugcucguaugcugaaggaagagaaauauauaaacuauguucaaaaaugaguccauuuuugauuggguuugaacauuugcuguauaguaacugaacaugccugagugcacagaguuugauugagaucucuuaauuaauauacaacccauuuguugaauucagaaaaagugaucucaaauaucuuauuuuguauguguuuaguauauauauagacauaugucgaaauggauuggcuguuuguagaggaaaauuugguuugggguuuaaccuccaaagcagugauuuaaaacaaacaaacaaacaagcaaacaaaaaaaaccccucuuaagugacuaacacaaagauagcuggucucuguuuugaauaauuauguuuggggcuuaauugcuuccuucuguucucacuaaauauauauuucaaguugacauaggaaaacgccaggguuuguuaucacaguuuaucaucaauaaauggucaguauuugccaaaagaaauaaaguagcaccuggauauuccuugguaagauaauaauguagccuuagucauucuuuaaacuuaguacauuaaaugauaaacagggaauccugcaaaaccuggcagcuauguauggaggcaggcccagcucuucaagaggagggaagccaagaaacaaagaggaagagguaugcuucccgcauguucgcuaccuccaucacauagccauuuuugaauuuauugccuucuuuucuugcaugguuuaaauucuuaacaauuauuugaagauuuuguaggucuguagggaccuguuaauauauuuuugacugacauucuguguuauaauuuugccccguaacuuauucaauauuaugauuucaguuucuuuucuuuugauuaaauuaaaaauuuguaauuuuauaauguauuucuuucuuuucagaaauaaauuguucuuaauuaaacacuugaaagcuaauauuacauuuccauuaaccggauuucagaacuuuuauuucuuguguucaaauuaacacuguuccuuaaauuuaaaaaaaaucuagcaguaaaaaugucaauagcuuugcuuuuacauuauuauguugggguuuuugccuccuuguagguuuaucuggcaagacugaggcaaauaagacuacagaauuucaaugagcgccaacagauuaaagccaaacuucguggugaaaagguagguugaaaagcuauuuuuuugaagaaauugaaugaugucauaguagguuaacauuuaaaaugcugugccauuaacaacaacgacaacaacaacaaaacugaugacgacaguggaaguucaaagaucaaaaaacuacacauaaaguaaaucuuauauaugugauuuuaaauugauaagaccauuuguuccagagaaauucugagaggaaaauauaacuaguauucaugggaggauuaaaaugcauuuuauaucauuaucuuuuuguuccauuguucugaaaggcugauagugguggagaguucaguugcagcuuuaggagaaaacuaacagcauuaaaugauuuccauuuuauauuuuuagauuuuaguuuauucauuguuaucuuucacagagcucugcacucaauuugaugauucuauccuaagugauuugcuuaucuacuuauuuuguagaaagaagcuaaucauucugaaggacaagaaggaagugaagaggcugacaugaggcgcaaaaaaaucgaaucacugaagguauagacuagaaaugauacagguuuucuuagagaaaauugaaagcugagauagcaaauuguguucuuaaguuuugcauaguuauaucacuuuagucucuuccuuuaauuuuucuuucaucuuucuccuccacuuuuugguuucuaaaaauaguauuuuucucuuuuuguauuauguuuaugaaaauagauaaaaccauggcauaaauacaugaaacuaucauauaaguaaucuugaaaaaaaugguaaccuuaaaaauaaaaaauauacgaauauacauccccaugaaggcaaaugaagucuguguauaauaauuguuuuaaauuuuuacauuuuuuucacauucaaauauaccugccuuuauuuucacucagcaaauauuuauugaacaccugcuguaugucaaggcugguuuuaggugcuagagauuuagagugagcuuacauuuuuauucuaagaccacaugcacacuucuuuuuuggcuaauaaguaaauaucuucauagaccuggcccaaaaaaaaaaaaaaaaaccucugcccuucuuucugguaacucauuuuguuaauuguuuuuauuuuuaggcccaugcaaaugcacgugcugcuguacuaaaagaacaacuagaacgaaagagaaaggaggcuuaugagagagaaaaaaaagugugggaagagcauguaagauuuagcucauauucuuaauccugguuguauuaacauuuuuauagcucuuccuggguaguacaucaguauuauaauuuucuugugcuuuuuuuuuucuguuuuuucauucucauucucucucucacccuuucucauuaccucucucuuucucagucucucugucucucucgcauuuaagaauaaucaauguggaaguuauuugggagauugauuugaagucagaacuaauuuaucuuauuuauuuauuauuauuauuuuuugagauggaguauugcucugucacccaggcugaagugcagugacacgaucucggcucacugaagugcagugacacgaucucggcuccaccuccuggguucaagcgauucuucugccucagccucccgaguagcugggacuacaggcacguaccaucacgccuggcuaauuuuuguauuuuuaguagagacaggguuucaccauguuggccaggcaggucucaaacuccugaccuugugaucugcccgccucagccucccaaagugcuaggauuacaggcaugagccaccacgcccggcccuuacuuuauuuuaaaauuuuuaauuuacuauuaccaaguagcuuaucaaaaucccagcauaauuuaaugacuacaucauccuucugucacugauuuauaaugcuacuuguaagauuuauuaaauucuuauauaaaacagugaaugaaucuauagcaaguauguaucaagcuauaucuuccuuugggcuuucuccuuugcucuguuacucugucuuuucugccaguaccucguuguauuaguaauuauuuacaauaugcuuuaauuucuaauagaauucuuuccgcauuuccccuuuacucuccuuuuuacacuuauuguucuuaguuauuugcucucuuuuucuuuaccagauacauuuuuaggguaauucuuguuucuuuuuuuuuuucaaucauauuguaauuuugauuaguauuauauuaaaccuacaaguuaagaagaauugacauaguuauaauaguuuuuauacagaaacaaguuaaauuucuacauuuacucauaguuucuuuuauaucucuuacacaaauuuugaucauuuucacacuuaucuguuguauuucuuauaaagguuauuucuagauaguuuauaauuccauuucaaucuuuaaagguuuuuuuuccuaacagaauauugcuaauauuugcagacauuuugaguuuuugcuuauccucuuauccagugaguuuuccuguucugccaauuuuaaguuaauuuucuggguuuuagccuacaacuagaucauuggcaaauagucgugauauacaucauaguaacaacaguuccuauaguuuauugcuuguuuuaugccaggcauauuauaaccacucuacuauugacccaugaacaacauggggguuggggcauuggccccuugcacagucaaaaauucacauacgacuuuugacuccccguagucuuuacuacugauauccuacuguugacuggaagccuugccaguaacauagaguaacauauauuuuauguuauguguauuauaugcuguauucuuacaacaaagcuaaaggaaaaauguuauuaagaaaaucauaaggaagagaaaauauauuuacuauuuuuaaauggaaguggaucaucauaaaggucuucaugcucaucuucagguggaguaggcugaggaaggaggaguaagaggguuggucuugcugucucggguggcagaggcagaaaaaaaaauuguguguaaguggauuugugcuggucaaaccuguguuguucaaggauuaacuguauauuuauuguuuuuuuuaauccuuacaacuuuacaaagcauauauagaaaggauaaaauaauuauauaaaauauuuccaacuaagggcagaacaaagauuugaaccuggaucugcccaauguugaagucuuuuucuuacgcuguuuccccuguuuucuguaaguugugccuuaaaaaaaauuuuuuuuuuacuuuuaauuuuuguagguacaugguagauguauauauuuaugggauacaugagauauuuuaauacaggcauaaaugcaaacuaaucacguuaggguaaauggguaucuaucaccucaugcauuuauccuuucuuugcauuucaaacaaucgaguuacacucuuuuaguuauuuuuaaagguacaauaaauuauuguugacuauauucacccuguugugcuaucaaauacugaaucuuauucauuuuaucuaauuuuuguacccauuaaccauucccacuuucaugcacuacccuuuccagcuuuugauaacaaucauguuccguuuccaugaauucaauuguuuuaauucuuuuaguuuccacaaauaagugaaaacgugcaaaacuugucuuucugugccgggcuuauuucaccuaacguaauagaacuccaguuccuuucauauuguugcaaaugacaggaucucauucuauuuuauggcugaauaguacuccauuguguuuaugucccacaguuuucuuuauccacucaucuguugauggacaauuagguugcuuccagauuuuggcuauugugacuaguccugcaauaaacaugggagugcggauaucucugauauacugauuuccuuucuuuuggguauauaccuagcagugggauugcuagauuguaugguaguucuauuuuuaguuuuuugaggaaccuccaaacuguucuccauaaguggcuguacuaguuuacauuccuaccaacaguguacgaguguaagaggguucccuuuucuccacauccucgccagcauuuguuauugcuaguccuuuugaugaaagcuguuuugacuggggugagauaacucauugucauuuugauuuguauuucucugaugaucagugauguugagcacuuuuucauguaccuguuugccauuuguaugucaucuuuuuagaaaugucuauuuagaucuuuugcccauuuuaaauuggauuaucagauuuuuccuguugagugguuugagguccuuauauauucugguuauuaaucccuugucagauggguaguuugcggauauuuucucccauucuguggguugucucuucacuguguugauaguuuccuuugcugugcagaagcuucuuaacuugaugugcaaucaaguccauuuguccauuuuuacuuagguugccugugguuaugggauauuacugaagaaaucuuugccuaggccaguguccuagagaguuuccccaguguuuucuuuuaguaguuucauaguuugaggccucagauuuaagucuuuaauacauuuugauuugauuuuuguauauggcaaaagauaggagucuaguuucauucuucugcauauggauauccaguuuucccagcaccauuuauugaagagauugucuuuucucaaacguagauuccuggaacauuugucaaagaugaauucacuauagauguauggauuuauuucuggguucucuauucuguuccacuguucuaugugccuguuuuuaugccagcaccaugcuguuuugguuacagcucuguaguauaauucgaggucagguaaugugauuccuccaguuuuguucuuuuugcucaggauaacuuuggcuauucugggucuuuugugguucuauaugaauuuuagguuuuuuuauuuuuuacaaaaaaauaacauugguaauuugauagaaauugaauugauucuguagauuacuucaggcaguauggacauuuuaaugauaccaagucuccuuccaugggcauuaaaugcacuuccauuuguuuaugucaucuaugauuuucuucaucaguguuuuguaguucuccuuguagagaucuuucaccuccuuggguaaauguauuccucaguauuuuugugugugaguggcuacuguaaaugagauugcauuacugauuucauucucagcuugaaugguauuggaguauagaaauacuacugauuuuuguaaaaugauuuuauguccugaaacuuuacugaagucacucaucaagucuaggagucaugguggaauuguuagaauuuuccagguacagaauuaaauuguccacaaagagauaauuugacuuucucuuuuccuauuuggaugucuuuuauuuuuuucucuagccugauugcucuggcugggacugccaguacuauguugaauaggauugcuaagaauggaauccuugucuuguucuaguucuuaggaggaauccuucuaacuuuuugcucauucagcaugauguuggcuguggguuugucauaggugguucuuaauauuuugagauaucuuccuuugaugccuaauuuguuaaguguuuuuuaucauaaagcaauguuggauuuuaucagaugcuuuuuauguguauauugaggugaucauauucuuuuuuaaaauucuguuuauguggggaaucacauuuauugguuuguguguguugaaccauccuugcaucccaggaauaaggcucacuugaucauacaaauuuucauuuuaaugugcuacuggauuuaguuugcuaauauuuuauagaggauuuuugugucuauuuucaucagcaacauuggccuguaguuuucuuuuuuuguugugcccuugccauauuuugauaucaugaugaaacuggucuuguagaaugaguuagggaggaaucucuccaucuuaauuuauuuucaauaauuucaguaggauuggcaucagccuucuuuguauaucuugugaaucuaucugguccaggacuuuuuuuuuugauugguaguuuuuuuuuuuuauuacuguuucaauuuuguacucauuauuggucuguucaagguuucaguuucuuccuaguucaaucuugggagauuguguguuuccaagaauuuguucauuuccuaauuuuauaguaugugcacauggggauguuuauaguagucucugaggaucuuuuguauuucugugggauccguuguaaugucaccuuuguuauuucugacuguguuuaugaaucuucucuuuuuuucauguguuaaucuuuccagaaguuuauuaaucuuguuuaucuuuuugaagaaccaacuuuucuuugaucuuuucuauggcuguuuggucucaauuuaauuuaauuccgcucugauuuuaguuauuucuuuucgucggcuagcuuuugauuuaguuucuuuuuguucuucuaguuccuguaggugcagcauuagguuguuaauuugagaucuuucuauuauuuuuguauaagcauuuaaugcuguaaacuuuccuuuuaacugcuuuuaccauaucucagagguuuugguauguaguguuucuacuuucauuuguuucaaaaauuuuuuuaaauaucugccuuaauuuuauuguuuuccaaaagucauucagaagcagguuguuuacuuuccauguauuuguguggcuuugagaguuccucuugguauugauuucuauuuuuauucuacuaugguccaagaagaugcuuaguaugauuucaguuuuuuaaaaaauuuauugagacuugcuuuaugacugaguauguggucagucuuagacuauguucugugugcagauaaaaagaauguauauucugugguuguuugguggaguguucuguagaugcuaauuaggaccaacuggucaaguguccaauuuaagucuagaauuuauuaguuuugggccuugaucaguuuaaugcuaucagugggguguuaaaguguccacuauuauuguaugauauuauugucugucccuuuucuuagaucuaguaguaauuguuuauaaaucaggguccucaaguguugggcauguacauauuuaggauaguuaaauccucuuguuuaauugaaccuuuuaucauuauguaguacuuuucuuucuccuuuuguacuguuguugauuuaaagucuguuuuaucugauacaagaguagcaagcccugaucuuuuuuguuuuaaauuugugugaucuuucuccaucccuuuacaucaaguccuuugggugucauuacaugugagaugggucucuugaagauagcagaugguugggucuuguuuuuucauccaauuugccauucuguguuuguagugaagcauuuaggccauuuauguucagcguuaauacugauacgugagguuuucuuccucucuuaguguuaacuauugcuuuguagucucaauuguauaguugcuuuauaguggcaguugcuuugaacuuacauguacuuuuguggcagcaaguaucauucuuuuauuuucauguuuagaacuccuuuaagcauuuuuguggggccuaucugcuggugacaaauucucuuagcaauugcuugucugggaaaaacuuuauuucuccuuuguuuaugaagcuuacuuagcuuggcaggcugugaaauucuuggcuggcauuucuuuucuuuaagaaggcuaaaaauaggccaccaaugucuucugguuuguaagauuucugcuaagaaauccauuguuggaggaggagccaagauggccgaauaggaacagcuccaguguacagcucccagcuugagcaacacagaagacaggugauuucugcauuuccaacugagguacuggguucgucucacuggggagugucagacagugggugcaggacagugggugcagcgcaccgagcaugaaccgaagcagggcgaggcaucaccuuacccgagaagugcaagaggucagggaauucccuuuccuagucaaagaaaggggugacagacggcaccuggaaaaucgggucacucccacccuaauacugcgauuuuccaacggucuuagcaaauggcacaccaggagauuauaucuggcgccuggcucagaggguccuaugcccacggagccucgcucauugcuagcacagcagucugagaucaaacugcaaggcggcagcgaggcugggggaggggugcccaccauugccaaggcuugaguagguaaacaaaguggccgggaagcucaaacuggguggagcccaccgcagcucauggaggccugccugccucuguagacuccaccucugggggcagggcauagccaaacaaaaggcagcagaauccucugcagacuuaaaugucccugucugacagcuuugaagagaguagugguugucccagcacgcagcugcagaucugagaacggacagacugccuccucaagugggucccugacccccgaguagccuaacugggaggcaccccccaguaggggcagacugacaccucacacagccugguacuccucugagacaaaacuuccagaggaaugaucaggcagcaacauuugcuguucaccaauauccacuguucugcagccuccgcugcugauacccaggcaaacggucuggaguggaucuccagcaaacuccaacagaccugcagcugaggguccugacuguuggggggaaaacuaacaaacagaaagaacacccacaccaaaaccccaucuguaugucaccaucaucaaagaccaaagguagauaaaaccacaaagauagggaaaaaacagagcagaaaaacuggaaacucuaaaaaucagagugccucuccuccuccaaaggaaugcagcuccucaccagcaacagaacaaagcuggacagagaaugacuuugacgaguugagagaagaaggcuucagaugaucaaacuacaccuugcuaaaggaggaaguucgaacccauggcaaagaaguuaaaaaccuugaaaaaaaaauuagaugaauggcuaacuagaauaaccaguguagagaaguccuuaaagaaccugauggagcugaaaaucauggcacaagaacuacgugacgaaugcacaagccucaguagccaauuugucaacuggaagaagggguaucagugauggaagaucaaaugaaugaaaugaagcgagaagaguuuagagaaaaaagaauaaaaagaaacaaacaaagccuccaagaauuaugggacuaugugaaaagaccaaaucuacgucugauugguguaccugaaagugauggggagaauggaaccaaguuggaaaacacucugcaguauauuauccaggagaacuuccccaaucuagcaagacaugccaacauucauauucaggaaauacagagaaugccacaaagauacuccucgagaagagcaacuccaagacacauaauugucagauucaccaaaguugaaaugaaggaaaaaauguuaagggcagccagagagaaagguuggguuaccuacaaacggaagcccaucagacuaacagcugaucucuaggcagaaacucuacaagccagaagagagugggggccauuauucaacauucuuaaagaaacgaauuuucaacucagaauuucauauccagccaaacuaagcuucauaagugaaggagaaauaaaauacuuuacagacaagcaaaugcugagagauuuugucaccaccaggccugcccuaaaagagcuccagaaggaagcacuaaacauggaaaggaacaaccaguaccagccacugaaaaaacaugccaaauuguaaagaccaucgaggcuaguaagaaacugcaucaacuaaugagcaaaauaaccagcuaacaucauaaugaagggaucaaauucacacauaacaauauuaaccuuaaauguaaaugggcuaaaugcuccaauuaaaagacacagacuggcaaauuggauaaagagucaagauccgucagugugcuguauucaggaaacccaucucaugugcagagacacacauaggcucaaaauaaagggauggaggaagagcuaccaagcaaauggaaaacaaaaaaaggcagggguugcaauccuagucucugauaaaagacuuuaaaccagcaaagaucaaaagagacaaagaaggccauuacauaauuguaaagggaucaauucaacaagaagagcuaacuauccuaaauauauaugcauccaauacaggagcacccagauucauaaagcaaguccuuagagaccuacaaagagacuuagacucccacacaauaauaaugggaagacuuuaacaccccauugucaacguuagacagaucaacaagacagaaaguuaacaaggauauccaggaauugaacucagcucugcaccaaggggaccugauagacaucuacagaacucuccaccccaaaucaacagaauauacauucuuuucagcaccacaccacaccuauuucaaaauugaccacauaguuggaaguaaagcacuccucagcaaauguaaaagaacagaaauuauaacaaacuaucucucagaccacagugcaaucagacuagaacucaggauuaagacacucacucaaaaccgcucaacuacguggaaacugaacaaccuguuccugaaugacuacuggguacauaaugaaaugaaggcagaaauaaagauauucuuugaaaccaaugagaacaaagacacaacauaccagaaucucugggacacacucaaagcagugcguagaaggaaauuuauagcacuaagugcccacaagagaaagcaggaaagaucuaaaauugacacccuaacaucacaauuaaaagaacuagaggagcaagagcaaacacauucaaaagcuagcagaaggcaagaaauaacuaagaucagagcagaacugaaggaaauagagacacaaaaaacccuccaaaaaaucagugaaucuaggagcugguuuuuugaaaagaucaacaaaauugauagaccgcuagcaagacuaauaaagaagaaaagagagaagaaucaaauagaugcaauaaaaaaugauaaaggggauaucaccaccaaucccacagaaauacaaacuaccaucagagaauacuauaaacaccucuacgcaaauaaacuagaaaaucuagaagaaauggauaaauuccucgacacauacacccucccaagacuaaaccaggaagaaguugaaucccugaauagaccaauaacaggcucugaaauugaggcaauaauuaauagcuuacccaccaaaagaaauccaggaccagauggauucacagccgaauucuaccagagguacaaggaggagcuguuaccauuccuucugaaacuauuccaaucaauagaaaaagagggaauccucccuaacgcauuuuaugaggccaacaucauccugauaccaaagccuggcagagacacaacaaaaaaagagaauuuuagaccaauaucccugaugaacaucgauguaaaaauccucaauaaaauacuggcaaaccgaauccagcagcacaucaaaaagcuuauccaccaugaucaagugggcuucaucccugggaugcaaggcugguucaacauacgcaaaucaauaaacguaauccagcauauaaacagaaccaaaggcaaaaaccacaugauuaucucaauagaugcagaaaaggccuuugacaaaauucaacagcccuucaugcuaaaaacucucaauaaauuauguauugaugggacguaucucaaaauaauaagagcuaucuaugacaaacccacagccaauaucacacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaaccccaucgucucagcccaaaaucuccuuaagcugauaggcaacuucagcaaagucucaggauacaaaaucaaugugcaaaaaucacaagcagucuuauacaccaauaacagacaaacagagagccaaaucaugagugaacucccauucacaauugcuucaaagaguauaaaauaccuagcaauccaacuuacaagggacgugaaggaccucuucaaggagaacuacaaaccacugcucaaugaaauaaaaggggauacaaacaaauggaagaauauuccaugcucaugggugggaagaaucaguaucgugaaaauggcccuacuucccaagguaauuuauagauucaaugccauccccaucaagcuaccaaugacuuucuucacagaauuggaaaaaacuacuuuaaaguucacauggaaccaaaaaagagcccgcauugccaagucaauccuaagccaaaagaacaaagcuggaggcaucacacuaccugacuucaaacuauacuacaaggcuacaguaaccaaaacagcaugguacugguaccaaagcagagguauagaccaauggaacagaacagagcccucagaaauaaugcugcauaucuacaacuaucugaucuuugacaaaccugacaaaaacgaaaaaugaggaaaggauucccuauuuaauaaauggugcugggaaaacuggcuagccauauguagaaagcugaaacuggaucccuucuuuacacuuuauacaaaaauuaauucaagauggauuaaagacuuaaaugggccgggcacgguggcucacgccuguaaucccagcacuuugggaggccgagacgggcggaucacgaggucaggagaucgagaccauccuggcuaacacggugaaaccccgucucuacuaaaaauacaaaaauuagcuggucaugguggcgcgcgccuguagucccagcuacacgggaggcugaggcaggagaauggcgugaacccgggagguggagcuugcagugagucgagaucgcgccacugcacuccagccugggcgacagagcgaaacuccgucucaaaaaaaaaaaaaaaaaaaaaagacuuaaauguuagaccuaaaaccauaaaaacccuagaagaaaaccuaggcaguaccauucaguacauagacaugggcaaggacuucaugucuaaaacaccaaaagcaauggcaacaaaagccaaaauugacaaaugggaucuaauuaaaauaaagagcuucugcacagcaaaagaaacuaccaucagagugaacaggcaaccuacagaaugggagaaaauuuuugcaaccuacucaucugacaaaggccuaauauccagaaucuacaaugaacucaaauuuacaagaaaagaacaacgccaucacaaagugggcgaaggauaugaacagacgcuucucaaaagaagacauuucugcagccaaaagacacaugaaaaaaugcucaucaucacuggccaucagagaaaugcaaaucaaaaccacaaugagauaccaucucacaccaguuagaauggcaaucacuaaaaagugaggaaacaacaggugcuggagaggauguggagaaauaggaacacuuuuacaguguuggugggacuguaaaguaguucaaccauuguggaagucaguguggcgauuccucagggaucuagaacuagaaauaccauuugacccagccaucccauuacuggguauguacccagaggauuauauaacaugcugcuauaaagacacaagcacacguauguuuauugcggcacuauucacaauagcaaagacuuggaaccaacccagauguccaacaaugauagacugaauuaagaauauguggcacauauacaccauggaauacuaugcagccaucaaaaaugacgaguucauguccuuuguaggggcauggaugaagcuggaaaccaucauucucagcaaacuaucacaaggacaaaaaccaaacacugcauguucucacucauaggugggaauugaacaaugagaacacauggacacaggaaggggaacaucacacaccagggccuguugugggguggggguaguggggagggauagcauuaggagauauaccuaagguaaaugacgaguuaaugggugcagcacacaaacauguuacauguauacauauguaacaaaccugcacguugugcacauguucccuaaaacuuaaaguauaaaaaaaaaaaaaagaaagaaauccguugugagucugaugggauucccuuuaaaagaggcaauuugguucuuuucucuagcugccuuuaagauuguuucuuucacauugacccuggauugucugaugacugugugccuuggugauggucaucuuauauaguaucucacugguguucucugaauuucuugugucugcauaucaaccucucuuggaagauuggggaaauuuuucagaaucauacccugaaauauguuuuccaguuuccuuacuuucuguuuuucucucucaggaaugccaguaauucauugguuugguugcuuuacauaaucuuauauuucuugaaggccuuguuugcuuuuuuaaauucuuucucuuuauuuuugucugacuggguuaauucaaaagaccagucuuugagcucugaaauucuucuucugcuuugucuaguuuguuguuaaggcuuccaacuguauuuugaaauucccauagugaguuuuuuaauuccaaaaguucuguuugguucuuuguuaauaucauuaugucaucuuucauguccuggaucauuuuucuggcuucuuuguauuggauuucaacuuccucucagaucuuguggaguuuccuugccaucaauauuccaaguucuuuauguaucauuuuagauauuucagucugcuuaggauccauggcuagggagcuagaacgauccuuuggagaugacaaagcaccuuggcuuuuuguacuuccagaguucuuucacugauuccuucucaucugagugagcugacaauucuuuuuuuggauuuguguuuauuuggaugggacuuauuuuuuuuccccuugaagguguaacugugauguauguuguguaugcucgauuggcuucuuuucugggugcuuuuagggggccaaagcuccauauggguuuuuugguugcagguagguuugugugguggcuuucucagaugcuguuuuuuguaguuuuugcuuggcgguguaauucaggcugcaguccaguagauggugccgaagaguaagauacagcagauuuauuuaggcucuguucacuuucaucgagccaccagagaagcccagaaagggccauugggccccaacagaaagaacugcugccauguccacaaucaugcacuuuggcgagaugagaaggugagagaugacccccuucuccacguuuguuccgaggcauuggcgcugcccccuucagugguuagugcugcacccacauuuccuguuucccauugguggcuuugacaggcugcucugucuccuccuugaggggcaguuugugccaaguguucaaucugugggagaccccaaacucccugagaaucugcuggugucauguacuugccaaagucagaguagguuguguaguaugucugcgggugguggugcaguggcucaagggcagaggaucuacaagcaaggggaguggcaccacagguacacaacugguaugacaacugccaucucaguuuggaucagaggugggugcagcauggcuaagucagcugcucacccaguucucuguuuucaggaaguccucuaaucgccaccgauaguguugcccuggcuugcaagggcugaggggcuccccagcuguuuagcagccaguguguugucagaggggugaggggagcagagacacacucccaccuacaguuucugcuggacucugaguuccucagcggucgcuaucaaccagacuuuugcugcuuucuuucucuccacccaaucuucuucacguggguacuccaacagguccuggcucuguucccucuguuuccuugucaaaacuugaugauuuaccaguaauuuugaucuuccuucugaggagaacgggcaugagauguccguagucacaaucuugaagcagcgucugaaucuuauuuuuccauccauucuaaaucuuuugauuggagagcuuaauuacauugaagauuguuauugauagguaagcacguacuacugcauuuguuauuguuuucugguuguuuuuugguccuuuguuccuuucuucuucucuuauugucuacucuugugauuuugugcuaugugcuaaguuuugauuccuuucucguucucauuuguguaucuacuguaguuuuuugcuuuguaguuaaucaugaggcuuacacaaagcaucuuauaguaauaauagacuauuuuaagcugauaacaauuuaacuuugucacaugaagauauucuagacuuuuacccuccucacaauuauuuuggcugucacaguuuauaccuuuuuacauuuuggacuucauaacaacuuaaugcaauuacaguuguuuuuuacuguuucaacauuuaaccuuuauaauagcaauuugagagauuuacacaccauuguugcaguaauggaauauucugaauuugaauauauauaaauaccucucuaccagugaguuuuauacuuugauauguucuugugguaguaguuauuguucuuuuguuucugguugaagaacucuuaagcauuucuuguaaaucaguucuagaggugaugaauucccuuagcuucugucuaucugggaaagacuuuacuucuauuuuauuucugaaaaacagcuuuucuaaguauaguauuguuggcuggcaggguuuuuuuaauuagcaccuugaguauauuaucccauucucuccugaccugcaagauuucugcugagaaaucugcugauagucuaauggcgagccccuuguauguugcuugaugcucuucucccucugcuuuuaaaauucuuugucuuuuacuuuuaauguuuuaaauuauaaagugccuuggugaggaccucuuugcauugaaccuguuuguuaguuuucaacuucuguagauauggaugaccauaucacucccaagacuugggaaguguucagcaaguacuucacuuaaaaagccuucugugccuuucuccaucucucuuuuuuuuuuuuuuuuuuuuuuuuuuugagauggagucuuccucuguugcuggagugcagugacguaaucuuggcucacugcagccuccaccuccuggguucaagcgauucuccugccucagccucccaaguagcugggacuacaggcgcaugccaccacaccuggcuaauuuuuuguauuuuuaguagagacagggcuucaccauguuagccaggauggucuugaucuccugaccucgugauccucccgccuuggccucccaaagugcugggauuacaggcgugagccaccaugcccggccucaucucuucucuuucuagagcucauacugugacauuuguuccuuucaugguguuccauaauuccuauaggcuuucuucacuuuuucucuaucugggcaacuucaaaagaccuaucuucaaauucacagauuguuuccucugcuugaucuagucugcuguugaagcucucaguuuuuaacaauuucauucauugaauucuucagccccaagauuucuguuugguucuuuuuguguuauguauaucuuuauugagcuugugauucauaucauggauuauuuugcugauuucauugaauugucuauccucuuguauaucccugaguuuccguaagaucauuacuuugauuucucuaucagguaauuuguaaauuuccauuucuuuggggucauuaucuggagaauuauuccuuugauggugucauguuuuccugcuuuuucauguuucuuguguccuugcauugauaacugcacaucuaguggaucagugaccucuuccaaaucuauagaguugcuuuuguaggggaugauuuuaccuauagaugauugcuagggggucaguugagcagggugcauuggcucugugggugguggugcaguggcucaagggcagagguucugccucugguuccagguaggcacgguaguguaguguccaugcagcuccuucaguuguaaucaauuugaguaauggcugcagguacuuuagccaugacuguaggagugugugacagcagugguagcagcauagguuauuaggauucucagugacaagggcuuuaguggggguccuccugcucuuguuuaucguaccguggggagacuuuguuggggaaauccuucuuguugucagauuuggcagagcucacaagcagccuacaguggugcuaggguccugggcccacugucuuccugaauuacuaugauacuugugacuugaguacaaguucacucucugagguauggguagaugaagcuguucuacaaagguggggacugacucuaaggcauuccccaguagcuugggcccagguagcagggauauagcugugacucugauccugagagucagggcacagcacuggcaugggucuggagaagaagagauguucuagaggcuuggacccuagggagcagggcauaacugcacuucaguuucuggagccaguagggcauaguggcaacuuggacaccaggagaggagguuccuuguaguggugacucuggcauggcaggacauagcaauggaccagacuuugugaggcuggguacagcagcaacaagggcccaugaaugguggggcacagcugugacuuaggcauuggggaagggaauagcacaacaaugacuccacccuucuguauauggccauacuuagccugugcuucacaggguuucugccacucccuugcuauucucugacauucuuaagucacucuggucaaaaugcaguuaucaauucauuguuuuuguccuuuuuuguggggcagaggguagagcauuaggcauuuguaauuugccauccugcugaugucaccacccuccuugccuggcugccuggcuaccuagcugccuccuucccucccucccuccgccccucuauaguuaguuucuauugccuucaaccaaagaaucuuaacugauuuaccacguaaaaugcucagcaugguaccuggugaauaguaacacaaauaaauucauugggaauucugugucucaugauauuccagagcugugcauaaggaaauguucaggaaacaucuguuuauuuaaugcacacugguauagugggaaaaaaaugagacugggaaucagaauaccugauuuuggucucagccuugccaauuaauuagcuuguuugaagauugacuuaauguuuguggccuuuauuuccucgucuagaugaagggcauauucucuaauguugcucuaucuaaauuguauagaaaaauaguauccauaauguaaguauuuagauccagcuuaauauacaaaaaaaaauugauuaaaguuauuuaacuauuauuucaauagaaagucuaauauagcauaaucuagauguuauauugggggguaguguucauauaucuaucuuuacucauugaccguuacucaggagugguuaacauggaauucagaauugaagcuagcauuauuaagcccccuaaaauauuaauguaaaguuuggcaguauguauguuggugcauuuucuucaguaaaaccacguauauuuccuuggauucucaaaaguauaauauuuucaaucuaacaaaggauaaaaaucacugcccuguaaccaaaccagcaugguacugguacaaaaauagacacauagaacaauggaagagaauagagaacucagaaauaaaccacauaccuacacggaacugaucuuugaaaaaccugacaaaaacaagcaauagggaaaggauuuccuauuuaauaaauggugcugggagaacuggcuagucauaugcagaaaauugaaacuggaucccccuuccuuaaacuuuauacaaaaguuaacgcaagauggauuaaagauguaaauguaaaacccaaaacuauagaaauccuagaagaaaaucuaggcaguaucguucaggacacaggcacaaauaaagauuucaugaugaaaugccaaaagcaauagcgacaaaagcaaaaauuggcaaaugggaucuaauuaacuaaagagcuuuugcacagcaaaagaaacugucaucagagugaacagacaaccuacagaaugggagaaaauuuuugcaaucuauccaucugacaaagagcuaauauccagagucuacaaggaacuuaaacaaauuuacaagaaaaaaacaaaaauguccauuuuuacgcauuaaaaaaugggcaaaggacauaaacagacacuucuuaaaaagaagacaugcaugcagccaacaaacaugaaaaaaagcucaacaucucugaucauuagagaaaugcaaaucagaaccacagagaaauaccauaucacaucagucagaauggcaauuauuaaaaaaucaagaaacaacagaugcuggcaaaguuacagagaaaaaggaaugcauuuacacuguuggugggaguguaaauuaguuuagccauuuuggaagacaguguggggauuccucaaagaucuagaagcagguacaccauuugacccagcaaucccauuacuggguauauaccccaaaauauauaaaucauucuguuauaaagauacaugcaugcguauguucauugcagcacuauucacgauagcaaagacauagaaucaacccagauuuccaucagugauagacuggauaaagaaaacacgguacauauacaccauggaauacuaugcagccacagaaaggaacaagaacauguccuuugcagggacauugauggagcuggaagcuguuauucucaacagacuaacacaggaacagaaaaccaaacaccucaugguaucacuuauaagugggagcugaacgaugagaauacaugaacacauuggugggaacaacacacauuggggcuuuugagggauguggaggaagggagagcaucaggaagaauagcuaacggaugcuggccuuaauaccugggugaugaguugaucugugcagcaaaccaccauggcacacauuuaccuauauaacaagccugcacauucugcacauguacccuggaacuuaaaagugaaggaaaaaaaaaucacugccuuaacuauugugauucuuuggcaguauauaccuaauuuuauaaaauuuucucuuugacauauuuaaugauaaaaauuguaguaccaauugggauuuagauauggagaacaauaugugaugauggguccuuuuuuugggagggccaaguaauauaguguuagguuuucagccaucacguaugcuauauugugaaugaaguauguaaggaagaucgauucaguuuuuuaaaaggguagcaauguuuuaagaauuaaaauucagugaaaaauagaauuagggagauucugucuugguuagguuggauaaaauauuuugaauguaaauucuuguguauuucuguuuccaucuuugucuuauuuuuagacuuuccaugcacgccuguaaggcuccccacaggguguacacacucauugcuucuggcuaccuuguucuuauucuuagauauucuuauaaaagcauuauggcaauacuaguuaagaaaauuuauucaaauacaaauacuuuuauacuauugguucuucaaagauaagguuuugagacauuaaauaugaauuugauaagauuuggccaugauauaucuuuaggcuguauaaaacugugugaaauuacucuauucaaaauaugaaacuaagucauuuaauacuuuccuagcauacauuaaauccuuacuaauaagucagcauaaagaugaaaauauguuuguuauugaucaagaguaggcagacaucaagaguaggcagacuggugguuucauguguuuguaagccucgccucacuauuuggugaaauuuugaguuucgucauuugguggcacugcugcuuaauuuuucagcacauggcaaaauugacacgugaaguagaaacaguuuuacagcgauaauugaaaaccuuuugugacaauaaaagcaauguugaaaagccuuaaauuuaugaaccuugugagaaaaauggcuaagaaaaaaaaagcuucuaaagcauuucuuuuaaaacugaauuaugaaacuuucaggucaauguuuuaucuuuuuuuuugcacauuuuuauauuuaaaacugugguuaaacuuugaaagacugugcuuuguuuguuuuguuuuguuuugaaacagggucuugcucugucacucaggcuggagugccguggugugaacauggcucucugcaauuucgaccugcugggcucaagggauccuccugccucagccugucuauagcugggacccuuagcacacgucaccauacauaagcuaauguucuuauuuguuguacaaauggagucucacuggucuggugagacuccauuucuacaagaaaaaagaaaauuaacugggucucaaacuccugggcucaagugcuccuccugccucagccuccugagugcugggauuauaggugugagccauugcacccagugaaaaaguauguuuagaaugaaauauauauuauagauuuagcugggugaucaauuguauaauaaaauugggucauucuuuguuccaaauuuuuauauuuuucucuuauaugaaacuuuauauuguuuuccuggcuuaguuaauuuuugugauaugucauauuugcucaacuuuccguauaaaaggcuuaguguaaugguuuaucuuucaauaauuagaaguacauuaucaucuuuuaucucaagauguaguuaauauugaaaagcuuuaagguucugauuauaaauaauacaccaugauauuuauacagaaggcccaauucaacuguacuaauaaguuacuuaaguguaugacauuagcuuauaaugauguugccacauuucaguagucauccugaaccacccauaaauuuucaguaacuuaguugucuucuuaaguuauuguaagaguuaguaaucugucuuuguucauuuauuuagauuccaugucugaauuugucuguuuagguucuucuaaucuguuugguuuaguugacucagaggagagaucaguaugcauuugauuauagaacauaagcauuuacugaaggcugcugaagaucauuauuauaaaagugccaauaaauuugucucucacaaugcucaaauuuuaauuucugaucaugguuaagauaggagguuuuuguuuuuagucugcauucuaaagaugagaaacuugcauucugaaacuuaauacauuucaucaggaacuaaaaccagacuuguaguguuuaagccaaauaaccuuauuuaauggaaaccaaauaaauaacaauugcuacuauuuauuagguacacagauguguacuuuacguaaauuaucucaugcaaucccuauagcagagaggcaaagaguacagcauuucuauuuuagagaaaaacugugagguucagagaggauaaaaacaaugaaaaaucacaggacuggugaguguuuugggauuugaauguacaacuguccuacuuuaucuguguuuuauggccuucccgaacaaugaauggcugaccauuggcugcucugcgaaggcuguucucacuggugccccucuuggcuuuacagaguuaguucuuucuauauuuuuuguuucauucuuccccagaucguuuaguacuuaucucuuuauuuuuuucucuguaacauacugauugauuuauguguucuuuuuucuuuucuaauuuacaguccccucagagaaaauauugugucuaauucauuuuggauaucauuaucuagaacugugcuuggccuuaauagguauuaauauguauuuuaauuuauugauaauuuuugucaaauauuguggauuugucuucucacagaaaucgugucagauugauguaucgaaauagcaggccaaacgcgguggcucacgccuguaaucccagcacucugggaggccaaggcaggcagaucacggggucaggaguucgagaccagccuggccaacaugugaaaucccauuucuacuaaaaauacaaaaaugugcugggcaugguggcacauaacuguaauccuaguaugugguagagaagugauuacugauuuaaauaaaaauagcagaauguguucauucaaaguauauuucuuuuaaguaaucaucuagagaaauaacauauuuguucuaaaaauacugcuacuauucagaacaacuuuggagcuuguuuuuauucucucaguguaugaaaccuuauuugaauuuauauacuauaguaauuaaaacaaacaaaguuucaaaauauuuagauauaaucuuucaaggugauaauacuguuaggugagcucuagauauuuuuaaaaguuauuuguaguaacuuuuuuuuuuuuuuuuuuugagacagagucucacucugucgcccaggcuggagugcaguggcacagucucggcucacugcaaccucugccucacggguucaagugauucuccugccucagccucccgaguacuugggacuacagguguacaccaccaugcccggccaauuuuuuguauuuuuaguagagagaggguuucaccaugauggccagacuggucucaaacucaugaccuugugauccacccgccuuggccucccaaagugcugggauuacaggugugagccacugcgcccggccuauuuguaguaacaucuuaaauaucaguauacuuuuucaauaauacugaacuaugggacuaaagcaauguuuccauccuuuuuugaacaaaauaaauacaggcauacuuuguuuuauugugcuucauaaauacugcauuuuuuacaaauugaagguuuguggcaacccugcaucaagcaagucuaucagugucauuuucccaacagcuuuugcucauuuugugucuuugugucacauuuuuguaauucuugccauauuucaaacuuuuucauuauugucauuauaucuuugauauuacuguuguaauuguucugaggcaccacagacuucacccauauaagaugggaaauuuaauugaugaauguguguguucuaauugcuccacugacugguaguuccccugucucacuccucagaucuuauucccuaagacaaaauaauauugaaauuaggccacuuaaugacuuacaguggccucuuaaguauucaaguaaaagaguugcaugucugucaccugaaaucaagauuaagcuuggugaugaaggcauauugaaagcugagauaggcacagaauuaagccucuugcgccaguuauccaaguugugaaugcaaaggaaaaguuccugaaggaaauuaaaagugcuaccccagaccaggugcaguggcucacgccuguaaucccagcauguugggaggccgaggcagguggaucaugagaucaggaguuugagaccagccuggcuaacauagugaaccccaucucuacuaaaaauacaaaaaauuagcugagcgugguggugugugccuguaaucccagcuacucaggaggcugaggcaggagaaucauguaaauccaggagggaggcggagguuucacugagccauugcaccccauugcacuccagccugggcgacaguacaagacuccaucucagaaaaaaaaaaaguucuacuccagugaacacacaugauaagaaagcgaaacagccaggugccuguagucucagcaacucgggagacugaggcacgagaauugcuugaggccagaaguuugagacuagcauggaugacauagugagaaccugucucuaaaaaaaaaaaaagaaagaaagaaagaaagaaaaauuagcuggaugugguggcacacaccuauagucccaaccacauugagaagcuaaggcagaaugaucauuugagccuaggauuucaagguugcagugagcuauuauugugccuggaucugcacuccagccugggugacagagcaagaccccaucucuuagaaaaaaaagaaagaaagaaagcaaaacagccuucuugcugauauggagaaagcuuuaguggucuagauagaagaucaaaccagccgcaacauucucuuuggccaaagccuaauccagagcaaggcccuaacucuccucaauuccgugaagacuaggagagauaaggaagcuacagaagaaaaauuguuggcuagcagagauugguucauaagguuuaaggaaagaagccaccuccauaacaugaaagugcaagguaaagcaguaagugcugauggagaaacugcaguacauuauccaggagauauagcuaagaucauugauaaaggugguaauacuaaacaacagauuuucaguguagauaaaacagccuucuauuggaagaagaugccaucuaggacucucauaacuaaagagaagucaauaccuggcuucaaagcuaaagagaagucaauagcuggcuucaaagcuucaaaagacuggcugacucucuuguugggagcuaaugcagcuggugacuuuaaguugaagccagugcucauuugccauucugaaacuccuaggacccuuaagaauuaugcuaaaucuauucuauuuguguucuauaaauggaacaauaaagccuggaugacugcacaucuguuaacagcacgguuugcuguaaauauuuuaagcccacuguugagaccuacugguuagaaaaaaaaaauuauuuccaaauauuacuacucauugacaaggcaccuaguuacccaagagcucugauggagauguauuauacaaagagauucauguuguuuucaugccugcuaacacgacauccauucugcagccaauguaucaagaagucauuuugacuuucaggucuucuuauuuaagaaauacauuuuuuuaaggcuguagccauagauaaugguuccucuaauggaucugggcaaaguaaauugaaagccuucuaaaaaguauucaucauucaucauucuagaugccauucagaacuuuuuugauucauggaguuaaugucauguuaauguuaaugucaacauuaacaggaguuuggaagaaguugacuccauucuucaagauuucaguggaggaagucaguguagaugugguagaaauagcaagagaaguagaauggcaaggggagccugaagauaugacugaauugcuacaaucucaugauaaacuugaauggaugaggaauugcuucuuauggaggagcaaauaaagugguuucuugagguggagucuacgaaggugaagcuguuuugaacauuguugaaaugauaagggauuuagaauauuuuguaaacuuagucgauaaagcaacagcaggguuugagaugacugacuccaguuuugaaagaaguucuacuguggguaaaaugcaacagcaucacaugcugcagauaaauauuuucaugggcugggcacaguggcuuacgcuuguaaucccagcacuuugggagacugagucaggacagucauugaagccagaaguucaagaccagccuaggcaauauaguggaccucaucuuuauuuaaauaauaaagaauuuuaaaaauauuuuuacaaaaucaaaagaauauuuucaugaaagagucaauggaugcagcaaacuucauuuuugucuuauuuuaagaaauugucauagccaccccaacauccaggagucaccacccugaucagucaguagccaucaguaucaaggcaagacccuccaccagcaaaauaauuacaauucauugaaggcucagaagaaucauuagcuuuuuuuuuuuuuuuuuuuuaggaaugagguguuuauuaagguguguacauuguuuuuuagacauaaugcuguugcacacuuaauaggcuacagaaucguguaaacauaaauuuuguaugcucugagaaaccccagaauuugugugacucacuuuauugcaauauuaccguuauugcaguggucuggaaccaagugcguaauaucucagagguaugccuguauuguuguaaagugaaggucuagaagccuaaauauuaagauuguauuauuacuguauuuuuagaagauacucaauaaauauuguguuugaaauguauacuccccagaaagucuuguuuccuagauugaggaagacuaggaauagggaguagggaguaaacuuccugcuguguuacuauugucauacccauaaaugucauuuccuuguauuaauucagguuucauaaucuuacuuuguuuagaguuuaaauggcaacauaaaaacaagcacauauguuaauacaacaugauguuuucagugaaguaaaucuuauuaccuggaucuguuucuccuuccauucucauuuauguuggcauuuuuaugagggcucuuauguugaguaauugauauuugaacuuugagaagauuguacccaaaccugcaggaauuacaaaagcauuucuuuuagaaguguaagauuaacaaaaucuuacacuugaaucuuuaaaagacaguuuuucaggaucauuucaugaaacauugauaaugcaaugaaagcggguuauuuaggacuaugugacaugacuauguguacaucugagaccagagauuuuuuucucuagucacugcuguauccccagcauguagcaucauaaugccuugcucaacagauaauucaggaaugaaaaaaacuacuuguggauagaguggauaaauagugaucugguagguaccauuuuauuucuucauacaaauauaaaaucccuaauguauuuaauaaaauccuuuuuuauaguugguggcuaaaggaguuaagaguucugauguuucuccaccuuugggacagcaugaaacagguggcucuccaucaaagcaacagaugagaucuguuauuucuguaacuucagcuuugaaagaaguuggcgugguaaguuuccuaagauucagaacuccucaaagucaaaagauuauuuaaaaggaaauuaaauuuaaugaaaucacauuaaucccuaaugucccuuucagguuuuucuaaggaaaaaaauuacuuuuuaagggauuuuaguuuacucagaauacuggagccucauuguuuauaaguuuuauaucuaggaccacgugguagaugaaaauauaucacaauaacucuuauauuacuuuaaaagaauauugaaaaaauaaaauauacagagaaauguacugaaaauaauacuauaaacauuuuucuacccaacccucaugauuaacaaauguucacuuuaaaaagaauaaugucucuuuggugcuaaaguagcucuagguauuagguccaacacauauuuacauuuauucaaauuuugugacauggcaaauguuagaggacucaguagaacuaguuaauucaucaguuauuccuuuuaccuucuacuucugaaucucugucaugcccuacagauaguaaaacaaagaaacauagacaaauaaaaagcuuaaacuuagaaguauauuucagguaucugucugaagugugaagacuguucagggguuaagagaagugggcucauaguguggagcugcggccuagaauucaacagacaggaggagaaaagucuacugaaucagauaacauaauaacuucauuuuccccuuuccugguaauggaugucugugcuuuuuauuuguuuaguuucaguaaauauuugcagacaaaauugguacacuagcuguuuuuuuuuauagccuuuggguugauuuugaaaauaaaacucaguaggaaaauauaaguuucuugaucauucucaagaacuucauguaagaaacuauuguucuucaaguaggcuuagucacuuuuucuuucugauaacgacuuugcgugugccacguuguuacuccaacuuuagauaccacuguguggucccuccuugguacccagucucacaucucaauagcuguucaucucucugguuguaggacugcuaauuccugacuacuuuacuggguaaaauguucuuugucucauugcuucauauauuacuuugaaacugaccaccaaauuuuuaauuuuuuuuaaguauuacaaaauucgagguaauccauauaacugaacgguuuucuuucuguguuguguugguaaaugucacuuacuuaaaacuuagaaaauuguucuuugaaucuucuacaugccuuugcuuucauagcuuucguaacugcuaauuucuucuuuucguauguuuuuuaauuuuagauagucuggauugcuuugacaaugcuaauuaggagauaacauuuaugucauuuguaguacaaaugacucagaacuaauuuuuguuacacucuuuguuuagggaggaaagccacuucucaauuacauuuaguacuauggcuuaacaaggauauauauacaugaaacauaaagacaguuuuagaauaacacagccuauuuugaauuacuucaucuaucaaaacuuuuucuaguuauaauuaagagaguauaugaauuuuccucuaauuucuacuuuuuccucuaauuucuacuuuuuccucuaauuuucugacuuaaauuaccaaaaaaucagguaccaaagaggaagaggauauaguuaauuaugugagcaguaaucuaaaaauaugacaaauaauugagaauuggccccugucuauguugucuaauuaauaauauuuaaagguuagucauugcugauaaugaaggaagcuuuguuaacauuuuauaggaauaaaaaauuuacaaggaacaaauuaaugaaaaccaaaaaguaacgaggauguaauauuuuuaaagguagauuuaaaaaaauaaaauuaucucuuccucuguaucuaucugcauuuaaaggacaguaguuuaacugauacccgggaaacuucagaagagaugcaaaagaccaacaaugcuauuucaguaaguaaaauuuucaaaguuuaucaaucauuuuacuuaaugauauacauauuaaaauauauaaugucgugacuuucagaguaagcgagaaauacuucguagauuaaaugaaaaucuuaaagcucaagaagaugaaaaaggaaagcagaaucucucugauacuuuugagauaaauguucaugaagaugccaaagagcaugaaaaagaaaaaucaguuucaucugaucgcaagaagugggaggcaggaggucaacuugugauuccucuggaugaguuaacacuagauacauccuucucuacaacugaaaguauguauaguaguauauuaauauccuauuuaggucuaguacauauguaaacuuauagacuaaccacucugaaaaaaaugaacacuuagaagaauugagagaagcugaaagaauucuauauauuuuccuuuugggcgaauagaagugccucccucucacagugaaaugugaagagcagagaaaacuaaucaaacuaaucagccuuaauagcaaggauuuuuauuacaaaaguguauagugugagagagggaacuaaugauacauauuuaaauugcauuacuuuaacucuguauaccauguuaaauuaaucuguuacuaugaauaauucuugaugagaaccaggguagugucucagaaacaucucuuaggcauuuagcgagaguauugagaaaaucugacuuaaugauuuauauauucggugauaauuacugagaaucuauauuucuuacauuguucuaggaauuggagauauaggaacaaaacagaaacauaugugcucuuguggagcuuacauucuagaagggcaagucugaccaucaacaaaucugauuuuaaguaauuuuuuucacagacuguuuuuguagaauuuuuucuugcauuggaaaaaagcccaaagacuugauagcauuuauuuugcuuauuuauucaacaguucuuuauuggguaccuaccauauguaauacacucuuaagcaaugggaauauaauaauguuuagaauguagucccuccccuuagggagcuuaaggucuaguggaaaggcaggcaaguaaagagauaauuguaguugauaaauacugugcuaggaauaaucauagacuacugcaggaauacauaagagaccauaaaucagccuuggaagagcccccaugauccagucaccucccucccucaacacaggguuauaauuugagaugagauuuggguggggacacuaucugucugcuuuuaugauuugucuuuaucacugguuuugagcaauaugauuguaaagugccuugguauaguuuucuucaugcuuccuguccuugggauucauugagcuucuugugucuuuggguuuaugguugucacauuuggaacacuuucagccaucauuucuucuaauauuuuuuccaugccuccuccuucuucuguccuuuagggacuccaguuuuacuuucugucucauaccucaguggugcucuuuuuacuuuaauuuuuuagauucuuguuguguuucauuguggauaguuucuauugcucuaucuuuaauagaugauagucuuuuuuuccugccauacccaaucugcuauuaauucuauucaauguacuuuucaucucagauauuguaguuuucaccuccagaaguuuaaggaguuguuuuucuaucugccaugucucuacuuaacuuuuuugaucauauggaauacaguugugaaaauuuuauuaaugucuuuacuuauucugacaucugugucaaauguuagaauuuuauuggguccauuuuauugauugccuuuucuccuuguuacagguuguauucuucugcuucuuugcaggcuugguuguuuuuaauuggaugucagacauuuugcauuuuaccuuguugggugcuagguauuuuuuuauuuuuguaauuauucuggagauuuauucuagaaugcaguuaaguuauaauacuuggacucaguuugauucauucaugucuuauuuuuaauauuugugaggugagaucagagccauguuuagucuaaugcuaauuauacccauuuaggagauaagaugcuucugagugcucuacggaaggaaugaugagguuuuccaguuuggcugguaggaauagacacuauuucaugucuuguguucucuguaaucuuuuugggugcuuuuuuuccuaacuuggguaguuuucucauauauuugcucugcucauacucagggcuaccaucugcaggucucuggaauucucuuucuaguugcuuuggucuuccaggaaucccagcucuaccuccugaacucagggagugugguagacccauuagcuauagccugaaaacucuaaaggcugggcaaucauagggaucaucucauuuguuuuuguuuuuguuuuuucccucucucagggacccauguucuuuauuaccuguuguacaaugucuugaaacugcugucucauauuuuguccaguuguuuugguuauuuagggagcagcauaacucuaauuacucuauaccaucuuaauaagaaguagauauccuugaaaccaguuuuuagaggcuauugcacuaaucuaggcagaaguuaaugaugaccuuaacuaaauuacugaaagguaauaaagaggagauauuuaaaagauacuaggagacagacuuauaggggcuuuaugugaaacuguucaaagaguucaucagaggaagaccuuugcaaagaaaaugaggaacagacagagauaaaauuaggagacuguaguauggguuccaaagaaagaagaaagcacuucaggaagagagguaacauauucaaggcuaaaaaauauacacuggauucgucagagaagaggcaaugugagcuugguaaaagcagugucauuagagugcuagagacagaaauagaauccaagaauuaggaagugaauaggagaggaaauuuaaaaagagaguuuagaaccuuuucaagaagcugaacugcgaagcagaacagagagguaagaugguauuacuugguggggauguagagucauuguaaccuuguguaaaaagagacuugaaaauauuuuaugcugauuagaaaaccaaaguauaucacaucacugucucauuuuaaaaccuaauugguuuucauugcaacuagaauaaaaguccaaaguucuuuuaaugauucaagucucuccucucucuugguuuaugcguugccugcucauuguauccauuuccuucuaacuaguucacuagaacuacuucucaccuuucacuucuuaaaacaugccaagcucuuucuuuuccaucguacucuuccccuucccucuuucccaaguccuuaauguggcugcuucucuuuuuuuuucugucccuguucuuuagcuaucaccccauuucuaaaaguccucuuuauaucagaauucuucaaaaguguucucuguuuacaauucuaguuccucuccuuuauucucccuuaaucuacuucaaccagacuuuuuccucuaccacuccauuacaauucuuuucauggucacuauagaccuucaugucgguaaguuuuaaaggcccuauuuuauguauuuacagcuucgacauccuggauuauuguccauacccacacgcacgugugcucacacauacacacucuucuugaagcacuuucuucacuuuucuccccucuauuaauaguagaccucucucucucucucuuucguauuuuuuggagagaugguguuuugcuauguugcccaggcuggucucaaacuccuggccucaagugacccacccacuuuggcuccccaaagugcugggauuacaggcaugagccaccaugccugacccuucucuuauuuucaaaucauugaauauuauuucuguacuuuaaauauuuauuuauuuaaaucuauuuuauuucuauagauucaggguguacaugugcagguuuguuacauguauauauugcauuauggugaggauuggguuucuaguguaccuaccacucaaaauagugaacaugguaccccaauagguaauugguauugguaccccaauagauaauuuuucaacccucaccccugcccagccucuccccuuuuggaguccccagugucuauuauuugccuccauguccauguuuacccauuguuuagcucccacuuagaauucuguaagaauaugcaguuuuuuuuuuuuuuuucaagacaggcuggaauacagugcugcagucauggcugacuguaucuuaaaauuucugggcucaaaugauccuccugccucagccuccagaguagcuggaacuacaggcacgugcugccaugcccggcuaauuuuuuuuuuuucuuuuuuguuagagaugguggacucacuauguuaaccaggcugcuuuugaacuccuggccucauacaauccuccucccuccaucucccaaagugcugggauuacaggugugagcuacugugcccggccaguauuugauuuuuuauuucugaguucuuuuauuuauuauuuuuaaagaacuaaucacauacuguaauuaucuucuucauuuguuuaaguauaauuugccuguguucuguuuuagaauauaaacauuuugauaaagcuugucuuauuuguacugcauguuuaugcuccgucauguagcauguaauuuauacaugaaaaguaguuauuaaauaaaugaaugugaggacaaaaacauaaauaaugaggagagacacugguguugugagaucucugagaugguggggcuggagaugauugagagcaccucugaggcaauagaccauugccauugugaaaggaugcauggaggcaaagguagaaagauacaaguaaguugggggaaagugucaggauggccaaauaagaacagcucuggucugcaguucccagugagaccaaugcagaaggcaggugauuucugcauuuccaacuaagguacccaguucaucucauugggacugguuagacagugggugcagcccacagagggagagcagaagcaggguggggcguugccucaccugggaagcgcaagggguugaggaacucccuccucuagccaaggcaagccaugaaggacugugccgugagggacggugcuaucugacccacauacuacgcuuuuccgaugguuuucacaacccacagaccaaaagauucccuugggugccuauacaaccagggcccuggguaucaagcauaaaacuggauggccguuuggggagacaccgagcuggcugcaggaguuuuuuguuuuuuuuuguuuuuuuuguuuuuuguaccucaguggcaccuggaaugccagcaagacagaacuguucacuccucuggaaagggagcugaagccagggacccgagugguauugcucagcggaucccacccccacggagccccacaagcuaagauccacuggcuugaaacucucgcugccugcacagcagucugaaguugaccugggaugcucaagcuugguguggggaggggcaucugccauuacugaggcuuuguaaacaaagcugacagaaaguuugaacugggugcagaacccaacacagcauggcaaagccgcuguagccagaaucuagagaggcaucucuagauuccuccucucugggcagggcaucucugaaagaaagguagcagccccagucaggagcuuauagaaaaaacucccaugucccugggacagagcaccugggggaaggggcagcugugggcacagcuucaacagacuuaaacuuuccugccugcuggcucugaagagaggaacagaucucucaccacagcgcucaagaucugcuaagggacagacugccucuuccaguggauucuugacccccgugccuccugacugggagacaccucccagcaggggacgacagacaccucaaacaggagaacuucagcuggcaucuggcgggugccucucugcgacgaagcuuccagaggaaggaucaggcagcaauauuugcuguucugcagccuccacuggagauacccaggcaaacagggucuggaauggaacuucaguaaauuccagcagaccugcagaagaggggccugacuguuagaaggaaaacuaacaaccagaaagcaauagcaucaacaucaacaaaaaggacacccaagcaaaaaccccauccaaaggucaccaacaucaaagaccaaagguagauaaauucacgaagaugaggaaaaaccaacgcaaaaaggcugaaaauucccaaaaccagaaugccucuucuccuccaaaguaucacaacuccuugccaguaagggaacaaaacuggacggagaaugaguuugaugaauugacagaaguaggcuucagaagguggguaauaacaaacucuccaagcuaaaggaguguguuuuaacccaaugcaaggaagcuaagaaccuugauaaaaaguuacaggaacuaucacuagaauaaccaguuaugagaacaacauaaauuaccugauggagcugaaaaacacagcaagagaacuuugugaagcauacacaaguaucaauagccaaaucaaucaaguggaauaaaggauaucagggauugaagaucaaccuaaugaaauaaagagugaagacaagauuagagaaaaaagaaugaaaaggaacaaacaacagacccuucgagaaauaugggacuaugugaaaagaccaaaucuauguuugauugguguaccugaaagugacggggagaauggaaccaaguuggaaaacacacuugaagguauuauccaggagaacuuccccaaccuagcaaggcagaccaacauucaaauucaggaaauacagagaacgccacaaagauacuccuugcgaagagcaaccccaagacacauaaucgucagauucccaagguugaaaugaaggaaaaaauguuaagggcagccaaagagaaagguuggauuacccccaaagggacgcccauugaacuaacagcagaucucucugcaaaaacccuacaagccagaauagagugggggccaauauucaacauucuuaaagaaaagaauuucaacccagaauuucauaugcagucaaacuaagcuucauaagugaaaaaauccuuuacagacaagcaaaugcuaagggauuuuguuaccaccaggccugccuuauaagagcucaugaaggaagcacuaaacuuggaaaggaaaaaccaguaccagccgcugcaaaagcauaccaaaauguaaagaccauugacacuaugaagaaacugcaucuaacuaaugggcagaguaaccagcuagcaucauaugacaggaucaaauucacacauaucaauauuaaccuuaaauguaaaugggcuaaaugccccaauuaaaagacccagacuggcaaauuggauaaagagucaagacucaucagugugcuguauuaaggagacccauuucauauucaaggacacacauaggcucaaaauaaagcgauggaggaauauuuaccaagcaaaugaaaagcaaaaaaaaaaaaaaaaagcagggguugcaauccuagucucugauaaaacagacuuuaaagcaacaaagaucaaaaaagacaaagaauggcauuacauaaugguaaagggaucaaugcaacgagaagcucuaacuauccuaaauauauaugcacccaauacaagagcacccagauucauaaagcaaguucuuagagaccuacaaggagacuuagacucccacauaauaauagugggagauuuaacaccccacugucaauauuagacauaucaacaagacagaaaauuaacaaggauauucaggacuugaacucagcucugcaccaagcagaccuaauagacaucuacagaacucuccaccccaaauuaacagaauguauauucuucucagcaccacauagcacuuauucuaaaauugaccacauaauuggaaguaaaacacuccucagcaaaugcaaaagaauggaaaucauaacaaacggucucucagaccacagugcaaucaaauuagaacugaggauuaagaaacucccucaaaaccucacaacuacauggaaacugaacaaccugcuccugaaugacuacuggguaaauaaugaaauuaaggcagaaauaaauaaguucuuugaaaccaaugagaauaaagacacacuguaccagaaucucugggacacagcuaaagcaguguuuagagggaaauuuauagcacuaaaugcccacaggagaaaaugggaaagaccuaaaauugacacccuaauaucacaauuaaaagaacuagagaagcaagagcaaacaaauucaaaagcuagcagaagacaagaaauaacuaagaucagagcagaacugaaagaagauagagacaugaaaagcccuucaaaaaaaaaucagugaauccaggagcugguuuuuugaaaagauuaacaaaauagauagacggcuagccagacuaauaaagaagaaaagaagaaucaaauagacacaauaaaaaaugauaaaggggauaucaccacugaucccacagaaauacagacuaccaucagagaauacuauaaacaccucuaugcaaauaaacuaguaaaucuagaagaaauagauacauuccuggacauauacacccucccaagacuaaacuaggaagaagucgaaucccugaaaauagaccaauaacaaguucugaaauucaggcaguaauuaauagccuaccaaccaaaaaaagcccaggaccagacagauucacagccgaauucuaccagagguacagaggagcugguaccauuccuucugaaacuauuccaaacaacagaaaaagagggacuccucccuaacuaauuuuaugagaccagcaucauccugauagcaaaaccaucaauugguuugucauuguuucaugcaauucagaguaaauugcagacauugguauaccuugcccuaaguauuucacagcauguaauuauuuauuagaguucaauguuuguuuuuucauuuauguuaaauuuacaugcaaugaaaugcacacauuacaaauauauauuuacugguuuuuaacaaaugcugggagcuacaaaauaagaacccccaucaagauacagaacauuaacaucaccccagaaaguuugccccugccuaaucguucucuguucuuauccucccaggggcaacuuuuucugaauuuuuuuucuaccuuagauuaaauguuccuguucuagaauaucauauaaacagacucuaaucguuuguauucuuuuaugucuggcuucuuucacucaagcauaaugauuauuuuucccuaaucucucaccucuggcugaaagcauaaugauuuuugagauucaucuguguuguaauuauuaauagcuuguucuuuuuaaaaaaaucuuugcuuuauuaaaaguuuucuuuguuugauauugauauagucacuccuacuuuguuuugcucaguguuaaccugguauaucuuuauccuuuuuuuuccucuuaaucuguaugugucuuuauauuuaacauggguuucuuaugggcagcauauuguuaaauucauuuuuaauccuuuaaaauaacuuuuaacugguauguuuagaucauuuacauuuaaugugauuauuaaugugauuggauuuaaauccagagcuccucaauuuacaaugggauugcagucuaauaaacccauuguaaaguugaaaaaucuuuaacugguaaaaaucauaaccuuuaacugguauguuuagaucauuuacauuuaaugugauuauuaaugugauuggauuuaaauccagaugcuccucaauuuacaaugggauuacagucuaauaaacccauuguaaaguugaaaaaucuuaaguugaaccaucauaagucagggacugucuguguaccauuuuucuauuuguuuuuuguuugccucaucuaugcuuucuuuccuuuuuccuccuguuuugcauuauuugggguuauuuuuuauuauuccauuuuaccucuguuguugaauuauuagcuauagcucauuguuauuucaguguuugcuucagaguuuauaguguauuauuguagcacaguguauuaacuuagcacagccuaucuucaauugaguuauacuucauauaugguauaagauuauuacaauaauauacaguugacccuugaauaauacggggguuggggguguugaaucccccguguagucaaaaaucuguguguaacucuuaacucccccaaaauuuaacuaguaauagccuacuguugaccagaagccuuaucaauaacauaaagccaauuaacacauauuuuacauguuauacguauuauauacuauauucucauaauaggaaucaagagaaaagaaaauguuacuaagagaaugauaagaaugagaaaauauauuuacuauuaaguggaaauggaucaucauaaaagccuucauccgcaucaucuucacauugaguaggcugaagaggaggaaguugggggguuggucuuggcgucugagggguggcauagguggaagaaaauuuguuuauaagugaacccuggcaucucagaacuuuguuugagggucaccuguacuuacauuuguucccucccaaccuuuggugcuauuuuuuuuuuaugcuauaaaucccauaauacagcagagucauuuauucuuuaaaaagauuuaaauaauaagagaaaaaacuauuuugugucuacccauguaguuuucauuucuuuuguguagaagauaucuauuuuguaucauuuuucuucugccugaaggacuuccuuuaagauuuuuuguaguacaguccugcuggugauucuuucaacauuuguaugucuguaaaaguuuuuauuuuaaagacauacaaauguuuguaaaaguuuuuauuuuuauuuuauuuagccuuccuuuugcaaagauauuuuuucugagacauagaauucuaaauugaaauuuuuuucuuuuaguacuuuaaugaugcugcuccacugucaucuuaugcacauuacuugugaugaggucuucuguuacccucauuuuuaguuuuauuccucugugucuuuuuucucugacuccuuuucagauuuuucccuguagccuugguuucagugaauuugauugugaugugccuugaugucacuuucgucauguuucuuuugcuuggguuuuguugagcaucuuggauuuaugaguuuauaguuuucaucaaacuugaaaaacucguggccauuauuuauucuauuuuuuuuucugucuucaguaugaauggacgaguucaauggacagguucauuuauaugaacuucauuaggacaaguucaguguggaucuuauuaauguuuucuuuaccucuaucacggucagucuucucucuagcuuguugaacauauggaauucaguuacaaugacaguuauaaauguccuugucuacuaguuacaucaucucugucauuauagaguuggauuggauucauugauuuuuuucuuccuuuuuuauaguuaauauucuguuucugugcaugcuugauaauuuuuuggggguguccaaauguugugaauuuuaauauuugugcuauguauuuuuguauuucuauaaauauucuugaccuuuauucuuggacacaauuuaguuaccugugcauagcuuggcucuuucaagucuugcuuuuaagcuuuguuaguuggaacaaagcagcaaucuauauuauuaguauuuauuaguauuacugugcauuagcguacugcuaaucuuuuaccuuuucugcaucaacaaccuuucugaauaaucugccuugugccuugugaauuauaaaucagucuuuuuuggcugaugggaauaggaacucuuucuggcacugugugaacucgaaguauuguuaccucugcuucuuuugaguggucuuuucucuaaacuuucucuaaaauuucuuuauacauuauguacugauaugcugaucaguacucaaguaaagacucaaaggggcuuuuuacaauuuuccugaguucucucucugugaaacguauuacuucaguacuccuaucuugcaaacacuagccacuuuggccucccuagacucccauuuccaccuccucagcucagagagaccauugacuccaccucuguuuucccucccugcauugaagggguuaaauuccaguggugggggggacaggaggguuucucuuaugaacauuuaguuaucccaguuuuguuuguuagaacuuuuuccccuuuugaauuucuuuggcauauuugucaaacaucaaaugacuguaaguuaugggucuauuucuggguucucuacucuauuuuaaccauccuuuaagaaauuccucuugguaaucauuuuggcuguaugaaacuaauuauuaucugcuaauuugcauguacuuucauggaacugguacauuaacuguaucaauauguauuagguuaccauugaaugucuauauaccuuaugccucauaauacauaauauuauauccuguauguuacuacuagguaccuguauacuucauauauuauuaccaaauauucuaaagacucaaacuucaguauauaauuuuuauauauugcuuugauaaauguuauuaaaaugguuuaccccaaauuauuauugucaauaaggaaguagcaguuauuugccuacuuaugauaaauaaagcaggacaaauuuucuuagaaauacuuuucucugcuuuuuaauccauauguauguuuauuuuaagauuuguuuucuauuuuuucuguuuaauauauagaaaugaaauacuaauuuguuucuucuauuuuuauauuccccccaauuguauuuacuuaucuuaguuuuuucuauuuuuucacauaaagauuuuauagaaacauaauacagguugagcauuucuaauccaaaaucugaaauccaaaaugccccaaaaucugaaacuuuugaguaccagugugacacccccacaucugaccccaugugaugugucaaagucaaagugaagguacacaacacaugguuuauucagcauccccaaggacaaaaagacccuccagccauuuuaaaaagcuaucugauagaauaccuucucaucccuucagaucccuuucugaucccucagcugcuucugauauuucuuuuugcccauaaaaugaaagacagcauagaguaaccuuuuaaucaaaauccaguuucguggguggagacugaaagccugcgguugcuuaacagcucucagguauucuggugauaauacugugcugcuuaguuaucuuaaacacauuuuuucacuguaaugguaugucucucuuuuuuuuuaacuacgaaguauuuuugugugaacaaguguaagaaaaugauugcuuauuagcagcauauaaacucacagucaggaaugauggugaugccaaacaaccauagagggcccacauggguggccaagacagugacacuauugcuuucugauaguucuauguauaugaacuucguuuuguucacaaaauuguuuaaaauauuauauaaaauuaccucaagucuauguguauaagauggauguaaaacauaaaugaggcccuuuguggugguucacaccuauaaucccagcacuuugggaagccaaggugggagggucacuugagcccaggaguccaagacuagccugggcaacauagugagacucuaucucuuaaaaaacaaacaaaugaauuucauguuuagacuuuggucccaucaacaagauucucguuauguauaugcacauauuucaaagucugaaaaaaauucaaaauccaaaacacuucuggccccaagcauuucagauaagagauacucagucuguauuaauuuaugguuuuuuccuauuuuuauauuccccaaaacuagaauuuaauucauauucuacaaggcaauuguagauauauuuuuauugcuaguuucauuugcuucuguucuugccauuauucaucauucuuucccugaaagucuuugugauauaaccuuuuuuucucaugaaccacucaauuggauaaaagacucaaaaucugccuuaccaugcaguauuauuauacuguuauugaaaauuguuucuuuguauauuuuucuuauaggacauacagugggagaaguuauuaaauuagguccuaauggaucuccaagaagagccugggggaaaaguccgacagauucuguucuaaagauacuuggagaagcugaacuacaacuucagacagaacuauuagaaaauacaacuauuagaagugguaaggagaaacugguaguuuuucuauacuagaaguaauauuauuaaaaaucuaauuauguauuuuaagauguuuccauuuuaagugaauuauuuuuaauuaucuuucucuuauaauaauuuuuuaauuagauugagaaugauuguguuuucuagggggauuguccaaaugguagucuugaguuuugaccugauagaccuggaugggaucuaaaaggaaaaugaaguguguauggguggaguuggaaaagucagaaugauguuuuacaugaaaacagauauaggagaaaugcacugagaugaauugugucuguuuugauauggauucaagaaugagauugacuaaaagguauuuuaguagguaugacagacauuauuaauucuaggacuggggaaggagaguugucaugaggcaggaggaaauauuccugauccauaaguuuuguggccuuugguauuacagcuaugcaucaagaagaguggcuauguaugaaacagguauuuucagauuaaacagcuuguuuaaaugaugaggaaguggaguguacuuuuccucuuuuuagaaguugugucuaggcaggaguguguguugcacuuuuguguucuuuuuccuucucuaucucucucacucuuuuucucugucuccccuuaaaaagcuucuagugacacucauauccagagcugguggaaaaauaaccuaggagaugacacugcugauauguucaauaauggaauuagccagugaaacgaaccuauacacauguuacugaaauggcaaaaguaggcugcuaauaauucuguuauuuucuuuaauauuaaagggagaaaacaauuugaauugagaaauacagucaucugcaaaaaaggcaaaaaguguauauguuuguaauuaauuuguucacauucucauauaaggaaauuuugcaguuguaugccaaauacuaauuaaaaauacuaguaacuuuuucaaaauguuccaggcuuuauucaagacaaaaaugccuucaggcucuaacauuuuuuuaaauaauaauaauaauuuuacucugcagugcaaaacucucuggaaaaaaaugagaaaaaaauucagauuuuuuuuguagucuaaaagcucuauaauaugcugaugcucauuaacacuauuacuuuuaaaauauuagauucugauuccuugaugucguuuuauuaauuaaauauaugcaauuugguguacaguaauacuuaaaccgcauaaaaauugggcuuucauucuucguauucaucauaauccauuugcacagaauuggaacugagaaauaacuuaugauuucucuucauucagucaccaacuauuuauugaacacuucuuaguuguguucacuauuauauguuagaugguaagcuauaaaggaaaaaaagaucauucuugcucucagaggacagacaaaaaugaaaacaaauaauaacauugcgugaaaaggacaagaauaaaaaguacccacaaaguucagaauuaaugcagagauauuuagguaauuaacuuuaucuuguauagucaagaaagacaucccagaccuguuaucuccccucuucuuuuucucccaaauacauuuacugggaagaauaugcucuguauugggauuuuaagccaaagaagugacaguuuuuaccaucaucgaaaucacauguggcaaaaucuguguuacagauguuuuuugugaaaugcucugcggccacagcugagguagcuuuacuuuaucaguacuauaugccuuuauuaaugauaacacauauggcccuuuuggguaagggagagccacaagacaauaagcaguuuugggaccacagaugagguggcuuuucuuuaucaguaccauacgguuuuauuaaugacaauauauauggcccuuuuagguaagggaaagccacagagaauaagcaauuuuuggguguaucaaagauuguuuuucaaauaacucauaagguagauaagggggagaaugaaauuccaggcaguaugcuauucuaguauaugcaaagacaaagguuuagcucauguguauguggagguagcuucaugugguagaaagagaaugggcuuugguuccaauccuggcuuuauuacuugcucagcaacaauggauaaguuccucugacuuuggcauucauuuccuccauguguagaauggaaacacuacuaucaaggcuuguuuuguguauuaaaugagaaacauaaaagauccuugguguucuuuauuuuagucuuccaauucuuaugucagugucuccuuagucauucugauugcuugaaacucuuuuuguaauagauuccuuaggaaggacuugugugaacacuacacucauagauuuuccauuuucauaacaguuugucuuaugacuuuauuugugagggucgauuuggcugcauguaaaauccuuggcuuacuuuuuuuuccuugacugucuuuaauauauaguuuaauuauauucuggcauaaaacauugcugcagaaagucugauggcaguuuuauuuucuuuaccuuauaagugauuuggucuuuuugcuuggaugcucagaguauaucuuucuuuuuacuuaaaguccaaucauuuucuuaaaauauauuuuggcauugaguuuauuuuucuaguacaguacauaguggguuuuuuuuguuuguuuaauagaccuuuucuuauaggaguuuuggauacauagugauaugguuuggcucuguguccccacccaaaucucaucuuauagcucccaugauucccacguguuaugagaggaaccuggugggagaugccugaauuaugggggcaggucuuucccaugauauucucguaauagugaauggaucucacgagaucugaugguuuuuaaaaaaugagaguuucucugcacaagcuuuuuuuuuuuuuaaccugccaccauccauguaagaugugacuugcuccuccuugccuucugccaugaucgugacgccuccccagccauguggaacugugaguucaguuguaccgcuuucuuuuaugaauuucccagccucaggcauguccuuaucagcagcaugaaaacggacuaauacacguagcaaaauugagugaaaaguacagaguuccuguauaugcccuucccccauacacacacagccucccccaccaucaauagcccacaccagagagguacguuuguuuuaaucaauagaccaauguugacacaucauuaucaccaaaguguauaguuuacauuaaaauuuacucuuggugcuuuaauugcccuggguuuugacaaauguauaaugcuauguaaccacuauuauuacacaagaauuugcugccccaagaauccccugugcucugcuuauauuaucccucccuuucuuccaaacccuggcaaccacugauuauuuuacuaucuccauaguuuugucuuuuccagaaugucauguaauuggacucauacaguauguacucuuuucagauuggaugguuucacuuaguaauauacacuuaagguuccucuguaaucuuuuugugucucaauagcucauuacuuuuuagcgcagaauauuacauuguauggaugugccacaguuuauuuauucacuuucaagauguacugaaagacaucgugauugcuuccaagugauagcaauuaugaauaaagaugauauaaacaucuaugagcagguuuuuguguggacuuaaguuuucaauucauuugggugaauacagaggaauacaguugcuggauugucuaguaagaguauguuuaguuuuguaagaaaccaccagucucccaaagugucuguaccauuuugcaguguaugaaugagaguuccuuuuacuccauguccucuccagcauuugguguugucaguguuuuggauuuugguuauuuuaguugcuguguagugguaucuuguuguuguuuuuauuugcaaucuccuaauaacauaugauguugaaccucuuuucauaugauucuuacuauaugcugcuuugccaccuguauaccuuagugaguugccuguugagaucuuucacccauuuuuaaauuggguacuuuauuuucuuauuguugaguuuaagaauucuuaguauauuuugguuaaugguccuuuaucaaauaugucuuuugcaaauacggauugaguaucucuuaucugaaaugcuugggaucagaaguguuuuggauuggguuuuuuuuuucagauuuuggacuguuugcauuauaccaguugaguaucucuaauccguaaauccaaaaucugaaaugcuccaaugaacauuccuuugggcauuauaacaauguuccaaaagguucauauuuuggagcauuuuggauuagagauagucaaccuguauuuucuccuagucuguggcuuuucuucauguucucuugacauugucuuuuuuuuuuuuuuuuugagauggggucucacuguguugcccaggcuggagugcaguguugcaacauggcucacugcagccucaaccucccugggcccaggugauccuuccaccuuaacuuccugaauagcuaggacaacagguaugcaccaccaugccuggcuaauuuuuguauuuuuaguagagagaggguuugcccaugugauccucccaccucaaaccccaaguagcugggaccaccagugugcaucauugugccuggcuaauuuuuguauguuuuguagagaugguguuucuccguguugcuuaggcuggucucaaacuucugaggucaagugaaccauccgcuucagccucccaaagugcugggauuacuggugugagccacugcacccggccuaguuuugcauuuuauauuuaguuaugugauuuauuuggaguaaauauuuuugaagaguuauaaggucugugucuagauacauuuuuuucguaaguagauguacaguguuuuuuuagcaccacuuauuguaaauacuauuccuucuucgaugaauuaacuuugcuccuuugccaaagaucaguugacuauaucuguauggggccauuucugaacucuguauccauuccauucaacuuuuuuccuguucuuuugccaguaccccaguauccugauuacuguagcuuuauaguauuucuugaagucacauagugucagucccccaacuuuguucuccuucaauuauguauuggcuauucugggucuuuuguauauccauauaaacuuuagaguuauuaugucuguauccacaaaagagcuugcuggguuggcugggauuauguuaaauccaaagaucaaguuggaaaaaaacugacaucuuaaugauauugaagcuuccuguccauaaguuugagauaucucuuuauuguucuuuaauuuuuucaucaguuuuguagucuucaucauaguauaucuuuuuaauauguagcuuccggucuuuuuuuccccugucaguuuuaggagucuuuuuuuauccucucaauuuuaggacaguacucuugaauuauugccugucuucuucccuccccuccccuccccuccucuccuuucuccuccucuucccucccucuccccuccuucuccccuccccccuucuuucucuccuuccuuccuuccuuccuucucucccccugccccgcacuuucucucuuucucccuuucuccuuuucuccuuuucucccuuucuuucuuuuuucuaacagcaauggagucuugcuauguuucccaggcuggucuugaacucauggccucaagugauccgccugccucagccuccaaagggcugggauuauaggcaugugccaccauaccgggcaucuaguauucuguuuuuuuuucuccagucuuugggaauuuccacuuuguauauuuugggucaucuuugccuuuccucucagucaauugcucuuuuuucuuaaugucuuauuaacuauuguggguacauaguagguguauauauuuauuggguacaugagguauuuugauacagauaugcaaugcauaguaaucacaugaggguaaaugggucacauaaagcauuuauccuuucuuuguauuacaaacaguccaauucuacuauuuuaguuauuuuuaaaugcacaauauauuauucuugacuuaacucuagucaccuaguugugcuaucaaauacuggaucauauacauucugucuaacuguauuuuuguacucauuaaccaucccccaccacccaccaccaccacccuuccuagccucuaguaacuaccauucugcucucuuuaucaccaugaguucaguuauuuuaauuguuaacucccacaaauaagugagaacaugugagauuugucuuucugugccugucuuauaucacuuaauauaaugaccuccaguuccauacaugaaacugacaggaucucauucuuuuuuuguggcugaauaguacuccauuguguauaugucccacauuuucuuuauccauucaacuguugauggacauuuagguugcuucuaaaucuucgcuguuguaaauagugcugcaauaaacauggaacugcagauaucuguuugauauacugauuuccuuucuuuuggauauauacccagcagugggauugcuggaucauaugguagcuauauuuuuaguuucuggaggaaccuccaaacaguuauauaugucuagaaauuuauccauuucuucuaaguuuuccaaucuauugaaauacagcugcucauaguagcuucuaaagauccuuuuaauuucugcaguaucaguuguauuauaauuccuccuuuuucaucucugauuuuguuugcuugggucuucucucuuuuucuuagucuggauaaagguuuguugauuuuguucaucuuuucaaaaagccaacuuuugauuucauuuaucuuuuguauucuuuguuucuauuuuauuuauuucugcacucaucuuuauuauuucuuuucuucuacuacuuuugggcuuacuuugcucuugcuuuuguaguucuuuaagauggaucauuagauugucuacuugaaguuuuuccucuuuuuugguguagggaccgauagcuauaaacuuccgucuuaguacugcuuuugcuguaucccagagguauugguauauuguguuuccauuaucauuuguuucaaaauuuuuuucaauuuccuucuuaauuucuucauugacccacuguuuauucagaagcauauuguuuaauuuccauguguuuguauaguuuccaaaaauuccucuuguuauugaugucuaguuuucuuccauuguggucagagaagaaacuugguauaauuucagguuuuuugaauguuuuaagacuuguuuugugaucuaacauauguucuauccuugagaaugauucauguacugaggagaagaagccguauucugcagcuguuagaugaaauguucuguagauaucgauuagguccauuuggucuacaauacagaugaagucugauguuucuuuucuuuuuuuuauuuuucuuuugcugcuccuugcagagcugugaugaccccuaggcagugcuacuagacuagagucagcuaagucugauguuucuaugucgauuuucugccuggaugaucuguucaaugcugagaguauaguguuaaagucuccagguauuauuguauugggggcuaucucucacuuugacucuaauaauauuuccuguacauauauggguacuccaguauuggaugcauauauauuuauaacuguuauauccucuugcugaauugaccauuuuauaauuauauaaugacguuauuuguaucuuuuuauaguucuugucuugaaaucuauuuugucucauguaaguauaguuacuucugcccuuuuuugguuucuauuggcauagaauaucuuuauucaucccuuuauuuuuggucugugugugucuuuauaggugaagucuguuucuuguaggcaacuguucauugagucuucuuuuuuuuuuuugauuaugcuucaaguucuaggguacaugugcacaacgugcagguuugauacauagguauacaugugccauguugguuugcugcaccaaucaacucaucauuuacauuagguauuucuuguaaugcuaucccucugccaggccccaaccccccaacaugccccagugugugauguucccugcccugugucaaaguaaucucauuguucaguucccaccuaugagugagaacaugugguguuugguuuucuguccuugugauaguuugcugagaaugaugguuuccagcuucauccaugucccugcaaaggacaugaacucauccuuucuuauggcugcguaguauuccaugguguauaugugccacauuuucuuaauccagucuaucauugauggcauuuggguugguuccaagucuuugcuguugugaauagugccaccauaaacauacaugugcaugugucuuaaaggagcaugauuuauaauccuuuggguguauacccaguaaugggauuucugggucaaaugguaauuauaguucuagauccuugaggaauugccacacugucuuccacaaugguugaaccaauuuacacucccaccaacaguguaaaagcguuccuauuucuccacauccucuccagcaccuguuguuucuucacuuuuuaaugauugccauucuaacuggugugaaaugguaucucauuguggcuuugauuugcauuucucuaaugaucagugaugaugagcauuuuuucauauguuuguuggccacauaaaugucuucuuuugagaaguuucuguucauauccuuuuccccaccuuuugaugggguuguuuuuuucuuguaacuuugcuuaaguucuuuguagauucuggauauuagcccuuugucagauggguagauugcagaaguuuucucccauucuguagguugacuguugacuaugaugguaguuucuuuugccaugcagaagcucuuuaguuuaauuagaucccauuugucuauucuggcuuuuguugccauugcuuuugguguuuuagucaugaaguccuugcccaugccuauguccugaaugguauugccuaggguuuucuucuaggguuucuaugguuuuaggucuaacauuuaagucuuuaauccaucuugaauuaauuuuuguauaagguguaaggaagggauccaguuuuagcuuucuauauauggcuagccaguuuucccagcaccauuuauuaaauagggaauccuuuccccauuucucguuuuugucagguuuguuaaagaucagaugguuguagauguguggcauuauuucugaagccucuguucuguucuauuggucuauguaucuguuuugguaccaguaccaugcuguuuugguuacuguagccuuuuagugcugagaccaucuuggucagggagacccuaacccagccgcacuagaggaauuaaagacacacacaggaauauagaggugugaagugggaaaucaggggucucacagcuuucagagcugagagccccgaacagagauuuaccuacguauuuauuaacaguaagccagucauuagcauuguuucuauagauauuaaauuaacuaaaaauaucccuuaugggaaaugaaggaaugggccgaauuaaaggaauagguugggcuaguuaacugcagcaggagcauguccuuaaagcacagaucgcucaugcuauuguuuguggcuuaagaaugccuuugaacaguuuucugcccugggcgggccagguguuccuugcccucauuccaguaaacccacaaccuuccagcaugggcguuauggccaucaugaacaugucacagugcugcagagauuuugauuauagccaguuuuggggccaguuuauggccagauuuuggggggcuuguacccaacauuguaguauaguuugaagucagguagcaugaugccuccagguuuguucuuuuggcuuaggauugucuuggcaaugugggcucuuuuuugguuccauaugaacuuuaaaguaguuuuuuccaauucugugaagaaagucauugguagcuugaugggaauggcauugaaucuauaaauuacuuugggcaguguguccauuuucacgauauugauucuuccuauccaugagcauggaauauucuuccauuuguuuguguccucuuuuauuucguugagcagugguuuguaguucuucuugaagauguccuucacaucccuuguaaguugaauuccuagguauuuuauucucuuuguagcuauugugaaugggaguucacucaugauuuggcucugugugugucuguuaaugguguauaggaaugcuugugauuuuugcacauugauuuuguauccugagacuuugcugaaguugcuuaucagcuuaaggaaauuuggggcugagacgauaggguuuuaaauauacaaucaugucaucugcaaacagggacaauuugacuuccucuuuuccuaacugaauacucuuuauuucuuucucuugccucauugcccuggccagaacuuccaacacuauguugaauaggaguggugagagagggcauccuugucuugugccaguuuucaaagggaaugcuuccaguuuuugcccauucaguaugauacuggcuguggguuugucauaaauaguucuuauuauuuugagauauguucugucaauaccuaguguauugagaguuuuuagcaugaagggcuguugaauuuuguugaaggccuucucugcaucuauugagauaaucaugugguuuuuguuguugguucuguuuaugugauggauuacguuuauugauuuguguacguugaaccagacuugcaucccagggaugaagccaacuugaucaugguggauaagcuuuuugauaugcugcuggauucaguuugccaguauuuuacugaggauuuucgcaucgacguucaucagggauauuggucuaaaauuaucugguugugucucugccagucuuugguaucaggaugauguuggccucauaaaaugcguuagggaggauucccucuuuuucuauugauuggaauaguuucagaaggaaugguaccagcuccucuuuguaccucugguagaauucagcugugaauccaucugguccuggacuucuuuugguugguaagcuauuaauuauugccucaauuucagagccuguuauuggucuauucagggauucaacuucuuccugguuuagucuugggagaguauauuguuaaagucuccagguaguaauuauguaaguacguguccaggaauguaugcauuucuucuguauuuucuaguuuaucugcauagagguguuuauaguauucucugaagguaguuuguauuucugugggauugguggugauauccccuuuaucauuuuuuauggcaucuauuugauucuucugucuuuucuucuuuauuagucuugcuaguggucuaucaauuuuguugaucuuuucaaaaaaccaucuccuggauucauugauuuuuugaaggguuuuugugucuaucuccuucaguucugcucugaucuuaguuauuucucaccuucugcuagcuuuugaauuuguuugcucuugcuucucuaguucuuuuaauugugauguuagggugucaauuuuagaucuuuccugcuuucucuugugggcauuuagugcuauaaauuucccucuacacacugcuuuaaaugugucccagggauucugguauguugugucuuuguucucauugguuucaaagaacaucuuuauuucugccuucauuuuuuuauuuacccaguagucauucaggagcaaguuguucaguuucuauguaguugugcgguuuugagugaguuucuuaauccugaguucuaauuugauugcacuguggucugagagacaguuuguugugauuucuguuauuuuacauuugcugaggagugcuuuacuuccaauuauguggucaauuuuagaauaagggcuauguggugcugagaagaauguauauucuguugauuugggguggagaguucuguagaugucuauuaggucugcuuauugcagagcugaguucagguccuggauauccuuguuaaccuuuuuucucguugaucugucuaauauugacaguuggguguuaaagucucccauuauuauugugugggagucuaagucucuuuguagguaucuaagaacuugcuuuaugaaucuggguccuccuguauugggugcauauauauuuaagauaguuagcucuucuuguugcauugaucccuuuaccauuauguaauggccuucuuugucucuuuugaucuuuguugcuuuaaagucuguuuuaucagagacuaggauggcaacccccgcuuuuuuuugcuuuccauuugcuugguagaucuuccuccauuccuuuauuuugagccuaugugcaucuuugcacgugagaugggucuccuaaauacagcacaccaauuugccagucugugucuuuuaauuggggcauuuagcccauuuauauuuaagguuaauauuguuaugugugaauuugauccugucauuaugauguucacuguuuauuuugcccauuaauugaugcaguuucuucauagcaucaguggucuuuauaauuuggccuguuuuugcaguggcugguaccaguuuuuccuuuccauguuuagugcuuccuucaggagcucuuguaaucccucagcauuuucuugucuguaaaggauuuuauuucugcuucacuuaugaaacuuaguuuggcuggauaucaaauucuggguugaaaauucuuuccuugaagaauguugaauaauggcccccacugucuucuggcuuguaggauuucugccgagagaucugcuguuagucugaugggcuucccuuuguggguaacucgaccuuucucucuggcugcccuuaauacuuuuuccuucauuucaaccuuggugaaucugacaauuaugugucuugggguugcucuucuagaggaguaucuuugugguguucucuguauuuccugaauuugaauguuggccugccuugccagguuggggaaguucuccuggauaauauccuggagaguguuuuccaacuugguuccauucuccccaucacuuucagguacaccaaucagacguagauuuggucuuuucacauagugucauauuucuuggaggccuuguucguuucuuuuuacucuuuuuucucuaaacuucucuucucgcuuuauuucauucauuugaucuucaaucacugauacccuuucuuccacuugaucgaaucagcuauuuaagcucaugcaugugucacgaaguucucaugccaugguuuucagcuccaucaggucauugaaguucuucucuacacuguuuauuauaguuagccauucuucuaaucuuucuucaagguuuuuagcuuccuugcuaugaguucaaacauccuccuucagcuaggagaaguuuguuauuaccgaccuucugaagccuacuucugucaacuugucaaagucauucucuguccagcuuuguucuguugcuggcaaggagcugugauucuuuggaggagaggaggugcucugauuuuuagaauauucagcuuuucugcuuugguuucuccccaucuuugugguuuuaucuaccuuuagucuuugauguuggugaccuccaggugggguuuugguguagauuaccuuuuuguugauguugaugcuauuccuuacuguuaguuuuccuuuaauagucaggucccucagcugcagaucuguuagaguuugcuggaguuccacuccagacccuguuugccuggguaccaccaguggaggcugcagaacagcaaauauugaagaacagcaaauauugcugccugauccuuccucuggaagcuuugucccagaguggcagccaccuauaugaggugucagucagccccuacugggagaugucucccaguuaggcugcgugggggucagggacccaguugaggaggcagucuaucuuuucucagagcucaagcaccaugcugggagaaccacugcucucuucagagcuguuagacagggucguuuaagucugcagaaauugucugcugccuuuuguucagcuaugcccugcccacagagguggagacuacugaggcgguaggccuuguugagcugcggugggcuccgcccauuuugaacuucugggcagcuuuguuuaccuacucaagccucagcaauggcggaugccccuccccgagucaggcugcugccuggcagauccaucucagacugcugggcuagcagugagcaaggcucugugggcgugggaccugccgagccaggcacaggagagaaucaccuagucugccgguugcuaagaccuugggaaaagcacaguauuuggguggggagugucccguguuuccagguagucugucacggcuucccuuggcuaggaaagggaaaucccccgacucauugcgcuucccaggugaggugaugccccacccugcuucggcucacccuccgugggcugcacccacuguccaaccagucccauugagaugaaccagguaccucaguuggaaaugcagaaaucacccaucuucuccaucaagcacgcuggaagcuguagacuggagcuguuccuauuccgccaucuuggaacuccuguugagucuucuuuuuuaaucuauucagccacucucugucuuuugauuggagaguuuauuccauuuacauucaaugggauuauuacaaguaaagacuuaauucugccauuuuguuauuuguuuucugguuguuuuguggacuucucuuccuuccuuccuucauaucuucauuuuagagaaggugauuucuuuagugguauguuuuaauuucuugcuuuuuauuuuuuugcguaucuguuguaugauuuuuuauuuuugaggguacuaugagguauaaauacuaucuuauaacccacuauuuuaaacugaugacaacagugauugcaaaaacagauaccaaacaagcaaauaaaaaacuaauaaagacucuaacuuugucccucacuuuucaacuuuuuguuucuauuuguaucuuacuguauugucucucaaaaaguuguaauuuuuuuuuucuugagacagggacucacucugucacccaggcuggagggcaguggcacaaucucagcuuacuacaacuuccaccuucuggcucaggugaucucacaucagccucccaagcagcugggacuacaagcaugucccacugcuuguagccaccacacauggcuaaauuuuuuuguauuuuuuuuuuguagagaaaggguuuugccuguugcccaggcugguuucauguugcauguugcccaggcugguuucaaauuccuggguuccagcaauccucccaccucagccuuccaaaguucuaggauuacaggcauaagccaucacaccucacauaauguuuauuuauuuuauuucauuuuauuuuuugagacagagucucacuccguugcccgggcuggagugcaguggcacgaucucggcucacugcagccuccaccucccggguucaagugauucuccugccucagccucccgacuagucuggaucacaggugugugccaccacaccuggcuaauuuuuuuguauuuuuaauagagaugggauuuuagcauguuggccaggcuggucucaaacuucucaccucaagugauccacccgccuucaccucccaaaaugcugggauuacaggcgugaauaauuuuuauuuucaaucaguucaucuuuuagucuuucuacucaagauaugaguagcuuacacaccacaauuacaguguucuaauauucuguguuuuucuguauacuuacuauuacuggugaauuuuacaccuucagaugauuucuuauuacucauuauuguccuauucuuucauauuaaagaacuccuuuuagcauuucuuaugggacaggucuuguguugaugaaaucccucagcuuuuguuugucugguagucuuuauuucuucauuauguuugaaggauauuuucucuggauauacuauuuuaggauaaaaguuuuuuuccuucaguacuuuaaauauguccugucacucucuccuggccaguaagauuuuugcugaaaagucugcugccagacacaaagucugcugcugcuuuucuccuuuguuugucuuugaccuuuuggaguuugauuaguaaaugucuugagguagucuuccuuggauuacaucugcuugguguucuauaaccuucuuguaguugaauauugguaucuuuuucuagguucaggaaguucucugacauuaucccuuugaauaaacuuuguaccccggucucucuacuuccucguuacaacgaaucacucuuagauuugcccuucugagucuguuuuuuagaucuuguagguauuccuuauucuuuuuccuuuguuuuuugucuccucugacuauguauuuucaauuguuuuuugucuccucucacuauguauuuucaagcagccugucuucaagcucgcuaauucuuucuucuuuugauguguucugcuauuaaaggacucuuaugcauucaucaguaugccaguugcauuucucagcuccagaauuucugcuugauucuuuuuaauuauuucaaucuuuuuguuaaauguaucugguaagauucugaauuuuuucuguuauuuugaauuucauugaguuuccuuaaaacagcuauuuugaauuuucugucugaaaggucauauaucucugucuuucugggauuggugucugguaccuuauuuaguuauuuggugaggucauauuuuccuggguggucuugauguuauggguguucaucggugucuggguguugaagaauuugauauuuauuguaguuauuuugggagguugucugugugcaggaauuugucuauuaccucuagguuuuccaauuuguuaacauauaguuguucauaauaguuucacaugguacuuugcauuucuguaguauuuguuguaauggcucuuuguuuuuuauuuucuuuauuugggucuucacucuuuuucucuuagucucguuagugguuuuucaauuuuguuuaucuuuucaaaacgccaacuuuuguugauuuuuuuagugucuguuugauuuuguucugcuugauuauuauuucuucuacuaguuuugcuuuuuuucauuaacuguagucauccuacuguacuauuuuaaacacuagaauuuuauucuauuuaacuguauuuuguaugcauuaaccagccacacuuuccagcuucugauaagcaccauucugcucucuacuuccaugagaucaauuuuuuuagcucccaccuauaagucagaaacaugcaauguguauuucucuauauggauaaugaccuccaguucuauccaucuuacugcaaaaaaauaagauuucauucuuuuuauggcugaauaaugguccauuuugugcauguguguguguguguguguguauauauauauauauauguauauaguuguuuuguuuuaaguuuagugggugcaugugcauguuuguuacauggguauaucgcauaaugcugagauuugggcuucuguugaacccaucacucaaauagugaugauaguaccugauaguuuuguuuuguuuuuuuuugccuucuccccacucccuccuuccuuccuuuuggaguccucaucaucuuauuauuuucaccuuuguguccauguguaccaauuauuuagguuccacuuauaagugagaacauguaguacuugauuuucuguuucugaguuaguucacuuaggauaauggccuccagcuccauccauguugcugcuuuuacuaauuuuggauuugaccuuuuuuugcuuuucuaguuccuugaaauacaucauuacauuauuuauuugaaaucugucucuuuuuuuuauaaacagggucucacucugucgcccauguuggaguacaguagugcaguuguagcuugcuauaaccuuaaacuccugggcucaagcaauccucucaccuuagccuccugaggaacuaguacuacaggcagccaccaugaccagcuauuuuuuguuuuuguuuuuguuucaguagugacagggucucacuuuguugcccaggccgaucucuaacuccuggccucaaggauucuccuacaucagccucccaaaauauugaaauuacagccaugagcuucuggcccuuuugugauauggguguuuauugcuauaaacucucagcacugcuuuugcuguuucccauagauuuugguuuguuguguuucuguccccauuuguuucaugaaauccauuuauuuccuucuuaauuucuucguugacucaauguuugcucaggagcauguugcuuaaauuccauguauauguacaguuuccaaaguuccucucgugauugauuucuaguuuucuucaguuguggucugagaagguacuugauaugaaguaguuacguuuuaauuuguugagauuuguuuuguagccuaccauguggccuguccuggagaauguugcaugugcugaugagaagaauguauauucugcugcuguuggauguguucuguagaugucuguuacguccauuuggucuaaagugcaguuuaaaucaaauguuucuuuguuaauuuucagucuagauuaucuguccagugcuguccauggggcguugaaguccacaacucuuauuauauuggagucuaucucucccuguaguugcuuuauauaucuagggguucugcuguugagugcacaucuauuuauaauuguuagaucugcucauuuaauuuuucccuucaucauuauguaaugaccuucuuugucuuuuuuuacagcuuuuggguuaaaauaugucuuaucugauauaaguguaugccuucucccacucuuuuuuuguuuccauuugcauggaauaucuuuuucuguuucuucauuuucagucuauauauguaaugaguuuauuguaggcagcauguaguuuggucauuuuuuuuuaaccauucagccaaccuguaucuucuaaaugauuaauuuauuucauuuauauuagagguuauuauugauaggugaggacuuaacucuagucauuuuguuaauugguuuuuggauguuuuguauauuuguuguucuuuucuuucucuuuuauuguuucauugcaguuugguuauuuucuauaacauuugacuccuuuuucucuuuuguuugugaaugugcucugucagguuuuauacuuuaaugugcuugcaugguguuagauacuguccuuuuauuuccacauguagugcucucuuaagcauuucuuauaggaucagucugcuguugaauucucccaguuuuugcuucuuugggaaagacuuuauuucuccuucauuuuugaaggauagcuuugguggguauaguauucuuggcugacaguuuguuguugguuuguuuuugguuuuguuuuuguuuucucagcacuuugaauauaucaucccguuuucuccuaucuuauaaguuuucugcugagaaagccauuguuagucuguugggggugcccuuauauguaauuugaugcucuuuucuuucuguuuuuagaauucucuuugacuuuuaacugucugauuguaaugugccuugggaagaucuuuuuggguugaauauuuuugugucuuuaaguuuccuguaucugaaugucuauaucucuuacaaggcuugggaaauuuucagcuguuauuucguuagagaaauuuucuauguccuugcccaucucuuuuuuuuucugaaacacccaaaauuugaauauuugggcacuuuacaauuucucuuaugucacauagacuuccauucuuuuuuuuucuuuuauccuuuucuuuauuuucugaguggauuauuucgaaagaacuguuuucauucagaaacucuuuuuucuguuuagucuauuguugaagcucucaguuguaauuuuauuuaauucauugaauuuugugguggguggggggguuugggguuuuauuuguuaguuaauuuguuuguuuuugagacagggcucugucacccaggcuggagugcaguggcagugcugugaucacagcuuacugcagccuugaccuccuggguucaagggauccucccaucucagccucccaaguagaugggacuacaggcuuuugacaccaugcuuggcuaauuuuguuuauuuuguguagagacagaguuuugccauguugcccaggcuggucucaaauuaugagauagauagauagauagauagauagauagauagauagauagauagauagauaaaauauuuuuacuugguuagagacaggcugucugccauccaggcuagaguacauuggugcaaucauagcucacuacagccucaaauccuggacucaggagauccuuccaccuuaucuuccagacuagcuauggcuauaggcacaugccaccacaccugacuuacuuuuuaaagaauuuccuguagagacaguaucucacuguguugcccaggcuggucuccaacuccuggcugcaagcgguccuucugccuuccuuuucuaaaacacuaggauuacauuugugagucauagcaucuggcccuguuugguuaucuuuaaugauaucuauguugaauuucucauugagaccaugaauuguuuuucugauuucuuuguauuauuuaucuguguucuccuauaccucacuuagcuuuaauuuuacuuugaauuguuuuaggcauuuuguagauuuauuuuuguuggaaucuuguuggagaauuaccguguucuuuuggagguaucauguuuccuuacuuuucauguuucuuguguccuuauauugauaucugugcaucuauuguaauaaucacuucuuccgauuuuacggauugacuuucguaggcaaagacuuuuucccguauauguauccauaguguugguugaguaggguguuuuggcuuugauucugggugggcagaguagugcagucuucauaugauuucuuuggcuguaaucagugucagugguaucugugaauuccugugugucuuagguuaugauuguuaguggagacucugguaaggauuuaccguggacagggagccaguugagccaguccucaggccccagucuuggcagcaugcugagaaugcagguacuuggccccccagaugguguucaggcacuggugauaguggguccagguaauccuugggccuccacauggcuuacuugggugccagcaguagcaguggugggccaggugggcagggcuagucccuggguccaucaucagcacucaugggcaccagcaguggugguggugaacugagagggcuagucuccaggccuuuagugcagguggaugguggcaguggcugcagguugggucucagggcccucuggaagguauguuugggugucugugguggcggacagagguggguagaucuccagaccucuggacaauacacauagcacuauugggggcaucgccagguagagcaggccuauacuugggccccuguguggugcaugugcaggcaguuuauguugggcaggacugguugaucucuagacccuagaugaugugugugggugcuggcaggcugggugggcccuuucccaagccccuggaaagcuuauacaggcacuagcagcaauaggcauggcaaauugaucccugugccccuggaugaugcucacaggccuuugccaaggcaguagcagggcagggugggucugucuucaagcccugugauggugcugucaggcacagguugugcuuagcacaguaggucuacccccaggaccccagacugcacacucagaaaucaguggugguggugguaggcaggagggccuguccucaggcccccugacugugugugcaggcaccugcaucagcaggcaugguggguugaucuccaguccuggaugacaugcuugcuagugccagcucugaugcauggggcagaucgaucucccagcuaccagguagcauucucaggugguggcaucagugagugggccaggccugaccucaggcucuaggauggcacccaagcaugccuaucuccuugcuccugaaggugcacacaagugcacauucacccaggugcuaggggaggcaggguugcugucaguaccagcaacuccaggaaggcagcucccaggcucuggggagcacaugcuucagcucccuuuuucccaggggcagccuuccuaaugugcugcaccacccauuuccugugguguaggacuguaugugggcuagaggacuagggaccuggcugcacaguugaguccagcucaugucacaagguugcaaaucuauagguggacauggaguaaaugucaguagggcuccagggguguggagauucagggccuguugagcccuggggcagguuguuaucugguagggauuggguucucaaaguggcaccauguugcagcugcuugggucucaggaugcugugugagauccagcacaaacuuccucucuagaauaaugcaucacuuugacuccaggcagcuuccucuacuagucucagggcgcuugagggcugaggagccauggcuaggcuugcaggaguccauggugagaacauggagcacuggggaucucucuuaccauuuuccugcauucaggcaggucaaucugugguguuucuccuggcuucuagccaguccuagccaggccaacuguuucgcuucccucuccuuccaugccucagagguuccccaucccuuugcggcugaauuccuguguucucuuucagaugcucuauucaauguguuauuaucuacuugcuguuuuguacuucuuuguggaacagacaagugccaggugucuguggucagccaugcugaagcucucuccaaacccauuuuccaaaucaauuaauauaauaguauaauuucucuuuuauuauauuaauguugcaaauugcauugauugauuuuuaaauaucaaacagccugaaagguaauaucccuuuaaaaaaauuuuuuaccauuuuugugugguauauauuucauugguuuuauuuuuccuuuucugauugugagugaauuucauuauguugcauucuauugacuauuuugauuugcugcuuugaaaauugccuguuuauauucucugcccuuuuuuauauuucauugcuuuuugcuauguuuuaagaauuuuuaucuaguauagcuauccagccgggugugguagcucaugccuguaaucccagcacuuugggaggcugaggcaggucauuucaggucaggaguuugaggccagccuagccaacauggcgaaaugcugucucuacuaaaaauauaaaaaauuagccaggcauagugccgugcgccuguaaucccagcuacuagggaggcugaggcaggagaauugcuugaacccgggagguggagguugcagugagcugagaucacgccaccgcacugggugacagagcaaaacucaggucucuaacaaaaaaaaaaaaaaaaaaaaagauacccuaaccuccuccucuuccuuccccuauuucuuucuauauauagauagaaaauuuuauaucuggacgcuguacugauuauuuuuacuaaaucuauuaagcuuucuuccuugagauauuagauguuccaaaugugcagauuuaucaucagugacaagaaauagauuuuuauccuauauuuugauuauuuccuauucuucuguuagaacccacuaaagcaaucuuuaauaauaauaauaaugcgauaugguauccugauuccugguguuaauagacaugauuuuauugcagaaugguagggcugaaggaggaaaaacacagaugugaucucugcuacagucaguuuguuuuggcaagcaguuuguugaaguacagugcagggaaaugauucugaaacauuugcaacacuauaguuuuguucucuguugacuagaaagaaguaaagaguaaaacaacuuauaaauacuugaugaacaacuuuuuugcucuggaaauuaacugagcuaaggacaguuccugcuagcccaguguuauaaaaggacugcagccaacacaaagggccuacuuggcuuuagaaacaaugaauuuaaauugagaccaaugagcaaggauuucuguuuuucuucaaccauuuuaacccuguguaugcagauauaguaggcagagaauugaauuuaugcaaaauugggguuuugccacuugaauacaauaaguugaggaugcacaagagaaugacuauauuauggaauuucugugaauuuuaauggagaugacagaaaauguagcagaaucagugcauuguagguacuuucaggguaaaauuuuuuuagaguuggaguuguagaggcggagaaguggaaaaugaguguuagagauuagaggguggaauacuuaacacuggaaauuuaaagaggcuauaauuaaugacaaguucucuaagauaugaccauuggagugcuggagauaggaugaagacugagguagagugaagugcaacaaaccaagaggccuaccuuuuggaaggauuauugauacaaauauagaaaucaccuaaauuaguuaugacagaguuaguguuggggagcuuguaaccuggaaaguaaaaucuucaacggauuaauaggagugagaaggugguaaauaacugcauuaagcuauucugagguaguuuuuuuuucuuuuuauucuuuuuugaaccugucucaggauguucugagguaaaccuccucucuccuuaguguggagaauuucagagcaauuagaaguaacuaggaguuacuucauauaaacagaaucaacuaguuaauaauuuaaaaaauaguauucuaauacacauauuaauuuuaccaaaagcagaaagaagguaaaccauuuugaccaccauagaaauuauuauguacaauugaaaugaaauuugacuuucauauacuguagucacuuauuaacuucuaauauguaacagagcuuaacuaguaauugccuguugcaguaaugcagcuuuuugaacuuugcccccaaugccauuacagauaaaaugcaucauuuugagaacuagcaugauuuuuuauuuuuuguuuucacagagauuucucccgaaggggaaaaguacaaacccuuaauuacuggagaaaaaaaaguacaauguauuucacaugaaauaaacccaucagcuauuguugauucuccuguugagacaaaaagucccgaguucagugaggcaucuccacagaugucauugaaacuggaaggaaauuuagaagguauguucuaaugagucaaaaugagcuauauuugauuuaguaaaaacuuaaauuucacaagcuuuauaaacagauuaucaaaauuuguauauguuuggguaauuaucucaaauuagguucaguauuuuuauauuuuuagcuauuggucuuuuuuuuaugacugccuaacaagucaccccaaaacuuaguguugaaacaccaaccguuucauaccaugauuuuaugugccaggaauugagucaagacuugucuaaugugauuuuuccuaauucgugugccuuuaucucagagaucaguaaguguuggucagccggcagcuaggcuggucugaagggucccaaaaagcuucacugcuaucuuggcaaguacagcuuagcugggccccucucccucuuuaugugguuucagggcuauucuauguacucuuucuggcaggauagucugacuucuuaugugauggcccggggcucacagaugcuaaggugaaagcagcuuguacucuuaaaagcugaucucagaacuagcacaguaucacuucugccguauucuauuagucaaagcagucacagcccaaccuggauucaaagggagggcaaacagaacccaccucucaaugggaagggcgucaaagaauuugcaucuguccuaaaucugccauagucugcccucugaccaaaaauuaucuucauuccucccauaugcaaaauacacucacaccuucugaaagccucaucucauuaugacauuagcucagaguuuaauaugauaacaaagucaggccgugcagauggguuuucucaucuacaggucuuugaguacaguuauucucaaucugaagaccuaugaguaaaaaaaaaaauuaguuauuuguuuuccauaugugcaaaauacaauggugaaacaaccuuugggacaccuuuucgaaaacaaggaagaugggaagcagauagcagucauuggucccuagaaauucuaaaauccaaccaggaauagcauugucagccugcuuccuugcaccaaagcuuggugugcucaagggcucuucucuuuugcacuauguuuguccccuucagucugagcuuacacagugcuuccaaaagcagaauuucuaaauaauuuuguggguuuaugugaauauuauugauacucacugugguuaacaaaagccacucauguuucugagacagacucuucucuaccuucaguuaucuaugaggauacuguaagacagugcuguugaguucuuagaaauucuuucucuaucaaagagggucugcaagacaugccuuuaaaucuuucugugcuguaacagaucuuaugugcacaaccuugacuucaucuuugcccugaggccacacccuacuguccuaaauuuagucuuugucuugaggccaugucuuccuuugagaagcauuuguugccuagaaggaaucauccugggcucucuguaucucuucuaaauucugcucauaagcuaaacuuuuuucuucaauuaaucucuaguuucuuguucuuuaucagaaguuauuagaagcagcugucacuuugaauguucugcuuugauaauuccuuagcuagaccacuggauccauaaaguacaguuacuaucuuccacauuauugcaguuaccaaauuuucagccaccguagagcaagaauccccuuuucuucagccuccaguaacuguuuuucacuugccagucucucaccaacaaugucauugaagcccuuccaauuucugccugcuccgcagucccaaagccagugcacauaggcuuuuacaucagcuccuugcuuccggauauguaauucugcuucaauuaucuauugcugcaaaacaaauuacuccuaaaacuuaguagcuuaaaauaacaauuuuaggccaggcucaguggcucacaccuguaaucccggcacuuugggaagccaaggcuggcauaucgcuugagcccaggaguucaagaccagccugggcaacauggcaauaccccuucucuacugaaaauaugaaaauuagucacaugugguggugcaugccuguaaucccagcugcuagggaggcugaggugggagaaucacuugagcccaagaguuugaggcugcagugagccaugagcaugccagccugggugacagagugagaacuugucuccaaaauaaaaaacaauuuuuauuuuuauuuuauguuaucucacaauuuuuugagucaggaauuuggagguucuucugcuccauguagcaucaacugguauugcucagugguauucagccaucagcugggcuuuuuuggaagacgcaaaaugacgucacucccaugccuggcauauuggcagggcuuauucgggucccucuccuucauuuuagucucauggcauugcaauguggucuuuaagaauaaacuauuuucaugauggcuugggcuuccagauaucaaauagaaguucccaguucucuuaaaggcucagccuggaacuggcauagcaucacuuucacugucuuccauuacucaagggaaucaccaugccagcugaaauuaaagaggaggagaaacagagcucccucuaguugagaggaaaaccagaaacccugcaaaaugugaccauccuuaauucaccacaguaacuuaaauaaucuuauucauuagaacauaguuacuaguaucauuauggaacgaaaguuuguuccccucccuaccccccaaaaaaaucauauguugaaaucuaaucccugauguaaugguauuggaaguggagucuuugcaaaguaauuagguuaugagaguggcgcccucauuaaugggauuggugcccuuauaagaauaggccagagagcuuucugcuuucuaccacauacggauacaaggaggaaaagguuaucugcaaaacaggaagagggcccucuagaaccaaccgugcuggcacccugacauuggauccuucagccuccagaacucugagaaauaaguuucuauuauuuacaccacccagucuaugauacucuguuauaguagccugaacuaaaacaguaucuuaugccuuuucuuuaaaaaagaaaagaaaauaguguuaggcauacuauggaagcuguauagccuagugcaggaguugauagaccagagaauaaauauucuaggcuuugcagguaaugcagucauaagucaaguuuauagaauaaguugauaaugauacagcuuaaaguacuaggaaacagaauuauucauuaaaaaauaaaaaaggauuuugcccccaagugcuuaccuugaaugaaugaccaaaauaaucauuugaauaaaagauaaaaacuuaaagauuaguacaauaucaguugucuuuccaaauaagacagauaauuggaagcuuuaaaaauggagaaguaugucuguauuccaggggaaguaagagggauaguguuggcuuaaacaggauauuauugauaaucuuaauuggaaaggaaaaagagaaguuaacaaauacucuccucaucgcuguucacuuuuggaaaauauuagccaggugaaaaaugagccacugccagaaaacagagguaacaucuugauguuaauugagggucaggccaggcgugguggcucacgccuguaaucccagcacauugagaggcugaggcagguggaucacuugaggucgggaguuucagaccagccuggccaacauggugaagccccaucucuacuaaaaauacaaaaauuagccuggugugguagugugugccuauaguuccagcuacucaggaggcugaggcaggaggaucacuugagcccgggagguguagguuguagugagugagccaagagcacaccacugcacuccagccugggcgaugggagugaaacccugucucaaaaaaaaaaaaaaaaaaaaaaacuauuugagugucuaagaaaauagauuuuuagugccauucaauuauguucucaauaucauugugaaaguccugguaauaguuuuucuuuuuugacuauuaaaagauagauuuugaagauugaaauuuuauuuuagucacuaaucaguaauaucacagucuauucuuccauauuucuaaccacaaauaucuuuauucuuuaaacuguuuuuauaccuucccuaaaugaauuuacauauuacuaaaauuuuaauugaagagaaaauuuuacauaauggugaaaaauauagaguauaccauauuaccuuugagcauuuuuauuacaguaaaaggcaaaagaaguagucugucguuucagaaauaacugaacuaaagacuucacaauaagaguuaaacccuauagagagaauacuuaauuuuucuguuuuaaugaauauauuacccuaaaacuagguagcaauaauuuauagcaaguuuauucaauauucucuugacaaauuuugcuuugagaugucucucguuacguuuauccuuugcagaaccugaugauuuggaaacagaaauucuacaagagccaaguggaacaaacaaagaugagagcuugccaugcacuauuacugauguguggauuagugaggaaaaagaaacaaaggaaacucaguauguacaucuuuuccugacauuuuaaaacccaggucccuuuuguaauaacuuuuaagaaaauacuauaauaagcuaauauugcaacauaauauccuaauauuguaauaccuuauaaaaggaacuuaauuugaauagauauucauaugguucagaaauaaacaaguauauaaaauauuugaagaggccgggcacaguggcucacaccuguaaucccagcaauuugggagacugaggcgggcagaucacuugagggcaggaguucaagaccagccuggccaacauggcaaaacucugucucuacuaaaaauacaaaaauuagccaggcaugguggcacgugccuauagucccagcugcuugagagacugaggcacaagaauugcuugaauccaggaggcagagauugcagugagccaagaucaugccacugcacuccagccugggcuacagagcaagacugucucacaaaaaauaaagugggccaggcacggugguucacaccuguauucccaguacuuugggaggccgaggaggacggaucaccugaggacaggagcucgagaccaaccuggccaacauggcaaaaccccaucucuacaaaaauuagccaggcauggcggcgggugccuauaaucccagguacucaggaggcugaggcaggagaaucacuugaaccugggagguggagguugcagugagcugagauggcaccacugcaugccagccugggcaacagacucuccaacucaaauuaauuaauuaauuaauuaauuaaaguaugaugauaugcaguaaaaagucuugcuuacaucuguccccauccacucuugucuucuuucauauauuucuaguauaugcuuaagcaaaaauaaauauauugucuuccuccuuacaguuaacuacauuuguuaguauaguguacacagauuuuuccaccuuguuuauuuuuggucaauaauaaaucugggaaauuuuuuaaauaauaauacaugaagggcuuucuuuuuuucuuauuuuauagcuaguuaguauuccauuauguagaauaccacaacucaacaaguuuccuaccugcuggacauugauugacauuacaaaugaugcugcaaugaauaacuuuuuauauaaagugacuuucguauguguauauaucuguaauaaguauaauugcuuggucaacugcauuuuuauaaguugcauuuguaauuugguuauuguucuccuggagguuguacugguuuacacuuucagaaagaaugucugaaccccauuuucuccacagccuugcuaaacuuuucucaucaaacuuuuugaguuuuuccaaucuaacaagguaaaaaauaguauaucuguuugggcuguuaguuugucuagcucuuaugauagguaaagguaagcacaucuuuucaaauguaaguuucauuugaacuuccuugucugugaauuuucucuuuauaucuuuggucccccccuuuuuuuuuuaauuuagucguuggucuuuuauaaauuaguaaaaacucuuaaaagugagagauauuugcccuggugguuacaugaauugcaacuauuuuuucucugcuggucauuuauguuuugugugugugugugugugugguuuugccaugcugaaguauauaguuuauuuuuguuuaucuuuuauuguuaucauauuuaucugagcuuugauaguuacucagaacagccuuguucuuucuaagauuaccaaauuuuuuuucaguuuuucuaguauuuuuuuucuuucuuuuuuuuuuauuuugguggagacggagucuaauuuuggugcccagguugaucucaaacuccuggccugaaacaauccucccgccuuggccucccaaagagcugggauuacugacaugagacugugccuggccagcauucuaggacuuuuauuugaugcuuuauacauuuaaauauuugauuuuuuuacauguaaaucuguggaauuuaucaugguuuauagauuugagucuguuuguauacauuuuuuccuauuagucugucuacaguaagcuaguacauacuuuuaauuaauaaauuauaaaauauuuuggcauuguuauguaucgguuaucagguuuuuuauuuagguuuucuauauacuuaacaauuuuuauucacuucauugaaaugagugaaggcuucuuccuacuaauguguuuccauuuauuucauuuuauauuucaagugauuuuuaucuaaugaauguugcuccuaaguuauuuggugcauagauauucacaaguauaauacucuugugguaaauuacacauuauagcauuauaaaauaucauuguuuuagucuugcuuaauauuuuugacuaaguuuuaucuuuuuauuuauauuuucccaaucugcauuggcucauccuucuguuuucagcuuuucugaauuauuuuauuauguuucugauaucguucgugauucaaucugaaauuuuuguauuuaaauaucuaguuaauuuacagaaguaugcuauaucuuugauaugauauaauaguugaauuuuguugucauuuuuauuuuauuuguauauucuuuuuagucuuuugcuguauuggcuguauugguuuuuuuaacuaauagauuucuguaagcaauuuuaguuuacaaaaaaaugagcaaaaauuauagacuuauuagauaccucucacuccccacccccaacaauuuuuuuuuucuuauuccugacaagugauauuuuuaacaucuugcauuaauguauuucauuuguuacaacugaugagccaauauugacacauuacuauuaacuuaaaguuuauaguuuacauuaggguucacuauuugguacauucuacaaguuuugacaaauguguaaugacauggauucacauuacacuauuauuccuaugauacuguacaauccucugugcuucaccuguuuauccugucuucuuugcaccccacaaucccuggcagccacugaccuuuuuauugucuccauaguuuugccuuuuccagaaugucaucuaguuauauaguaugaagucuuuagauuggccccuuuugcuuagcaguaugugcccaguggcuuacaccuguaaucccagcacuuugagaggcugagguaggcagaucucuugaggccaggaguucgagaccaguguggccaacauggcgaaacccuguuccuacuaaaaauacaaauaaauuagccaggugugguugugugcacaccugucauuccagcuaccuguguggcugaggcaugagaaucacuugaaccaaugguagagguugcggugagccaagauugcgccacuguacuccagccuaggugacagagugagacucugucaaaaauaaaacaaaaacaaaaacaaaaaaagcuccuuaaaggcagagagaguguuuucuauuuuuuaaaucauuuuuacauauuauaggaauaauagaaaaccgguguuugauauguguguggaaauuuaauaaaugguaaagauuucuaaucaacauaaaaagauaaccuauuuaauaccugcuuuugggacaaauaaaucacaauuuggaagaaauaaaauaaucauuuccauuucugaaaucauucaacaaaacaauaccagauugauuaaagaccuaaauaaaaaauuuuuaaaggaggcagccuaacauaaaaauuaauauccagaauuuauaaagaauguguauaaauuaauaagaaaaagacagaaguccaagggaaaaauggggaaaggugaugaauaggcuauucaugaaggaagaaauccagauaguaaauacaacaguaugauacuuuaggaguuacagggcaucgauaaaaugacagaugguaaguguuugagagacuaacuuaguggagaacuaggguccugugaaugucacugcuagucagauacuuacuccuccucaaagaagagugaguaaaaggcagggcaagaguccuuuuccacaucaguggaaaagauguauuuuccacugauuguuuuuccauaaaauaacaugaagcaauggggaagagaaaugacauaucaaauguaugugagggauugggacuaugguucuuugauggacugcaaauacauauaugaaaugguagagccaguuuagagauccauuugacaguuuuuuuaacguuuuaaaugugcacauccuauaauauaccucuuuuacuuuugguaucuacucuucagauccuucauacaugagcacaaagaagcaaaugcaggaauauucauuccaggagagucacagccaauaauuugcaacagucuaaauaagcauuaauaaggagauagcuaaaaauacugcuguguuucuguauacagccauccuuuaguauauuugagggauugguuccaguauccuucguauaccaaaaucuacauauacucaagucccacaguggguucuguggaauccauauauaugaaaagccagcccucuguguacacggguuugcaucccacgaauacaguauuuucaauccacauuugguugaaaaaaaaauugcaucuaaguagaugcaugaaguucagacccauguuguucaagggucaacucuaaagcauuaauggaauauaauacagcaccuaaaagaauaaaggggacucuuuauuaauauggaaagaugucuaaaacauugauuaauggaauaaaauaauauugaaugaaaaaaccaucuccauagauuagauuagcauguaaauuuaaaggaaaaaucucguaaggugugcaccaaacuaauaauaggaaaggcaacuggaauucgaguaguuaggaguccugaaaggaacuuaacuuuuuuauuggaauaaaauucacauaacguaaaauucaccauuuaaaauuguacaagucaauuacauuuagaaauucacagugguguacaaccaucaccacuauauaguuccagaacauuuucaucacccaccucucuaucuguuaagcaaucaucccccguuuuuucccuccccaccaaccucuggcagccacuaaucugcuuucugucucuguggauuuagcaauacuggauuuuucuuacagaaucauauaguauauagccuuuuguuucuggcuucuuuuacuuaacauacuguuuuuaguuuuucauccauguuguaggauaugccacuucuucauuucuuuuuauggcugaauaauauuccauuauauauauauauauauauaucccauauauuuuuauaauucaucaguugaugggcacguagguuguuuccaccaucuggcuauuggaagagugcugcaaagaacauugacacacaguaucuguuugagucuuugcuuucaguuccuuuggguauauaccuuggaguggaauuguggcaucauaugguaguucaguuuaccuuuuugaggaaccaagggacauuauauuuugaaugaauaaauauguugcuugacuggggaaaguggcucaugccuguaaucccagcacuuugggaagccaaggugggagaguuauuugaggucaggaguuugauaccagccugggcaacauagcaagaccccaccucuacagaaaaaaaaaaaagccaggcaugguugcaugugccuguaaucccagcuacuugggagacugaggugggaggaucacaugagcacaggagaucaaggcugcagugaggugagccaugauuauuccacugcacuccagacugggcaacagagcaagacccugucucuuaaaauaaauauauauauaagcuuaaaaaauaaaaaacagaggcuggacaugguggcuuaugccuguaauuccagcacuuugggaggccgaggcggguggaucaccugaggucaggaguuugagaccaaccuggccaacauggcaaaaccccaucucuacugaaaaauacaaaaauuagcugggugcaguggcaugugccugucacccuaccuacuugggaggcuaagucauaagaauugcuugaaccugggaggaggaggcggcagugagccaagauugugccacugcacuccagccuggguggcagagugagacucucucaaaaauaaauaaaauaaaauaaaauaaaagcagaaaaugguugaaaaucugaaaaugagaaaguagaaaauuauuuaaaauuugaaacaggccgggcgcaguggcucaugccuguaaucccagcacuuugggaggccgaggcgggcggaucucaaggucaggagaucgagaccauccuggcuaacacgaugaaacucugucucuacuaaaaauauaaaaaauuagccgggcaugguggcgggcuccuguagucccagcuacucgggaggcugaggcaggagaauggagugaacccaggaggcagagguugcagugagccgagaucgugccacugcacuccagccugggcaacacagugagacuccaucucaaaauaaauaaauaaauuuaaaagauaaaauaaaauuugaaaccaauuuaaaaguauuuagaaaauaaaaacuuaccuauaagcuaacucccagagauaaauuacugguacuuuuggaauauauucuuccagucuuuaaauuuuuguuuaaaaaaaaugcaugaauuuaauucccaggcauauagagauaaaaauugugaguucuuuuuuauuuuuuuuuccucaaucuuaauccccucccuuugaggguuaaaauauuuuugugaaucuuauucuauuuuucugugcuacaaaccauuuuuucaaaaccuaacaccauuuaauacaaauuggucugugaaucacuuuguuuacuuaacaguauaucuugccuauucuaaucaguuuauauagaucucugcuucauuuuuuaacagcugcaugauauuccaugguauuaauauauuguaauuguuuuauauucuccacucuuaaggggcauucccauucuuuaaaguagugguucucaaacauuagcauguauuagaaugacuucgggacuuuucccaacuaauugcugggcguuaucccccaaaguuucugauucacaggucaagggugaggcugagaauuuguauuucuaaccaguuucuuuacuaugccguuguuuggggacuguacuuugagaaccauuguuauaaaacauggugagccugguugcugugaaugauuacuauuuggugaggauuugaacagggugaaaaauacauuguacuuaugugagaaaguauauaugaaagugagaaaaauacuuggaagagggaucaaagaaugcuagugaacuuguguuccauuuccuguauuuuagagcacuuuuauuucugguaaacuaaguguguguguuuuuaauugguguacccaucuguggcaggucggcagauaggaucaccauucaggaaaaugaaguuucugaagauggagucucgaguacuguggaccaacuuagugacauucauauagguaagcaucauugcauuagucuaauuacuuucuggaagauguuaaugauuauuaacaucaaccuguuuuauuuggguaauauauaaauaagaaagcauuccuuaucagucaucucaaucauuuaaaaaauauaauaggcauagcacacuggacuacauuaauaagccuggauuguauggcaacauggcagugaaaguuuuuggucaguuauuuuuauugaauauuaaaaaugaaaagaauuacuugccaaagcuaagccaguguacuaaggacauuaaauaaauuguuuucuuuuuaaaauaguauuaguuaaaauguaagaaagguaggcuggguguaauggcuuacaccuguaaucccagcacuuugggaggcugaggugggaggaucacuugaggccagaaguuugagaccagccuggacaacauagcgcuacuccaucucuacaaaaaauuuuuuaaauuagccaggcaugguggcaugccuguagucucaucuacucaggagacugaggugagaggauugcuugaggccaagacugcacuccagccugggcaauagaccaagaccuauuucuuaaaaagaaaagaaaaaauaauuguuuucaucuaaccuauaggaacaaagauaaacuggagcuaaauauguaucuaaauaguguauuuuuucaccuuucuuuggauuuaugucuuuuuuuuuuuuucauuuuguuuguuuuucuugagagacagggucucacucuguugcccaggcuggagugcaguggcgcgaugauaacucacugcagccucgaacuccugggcucaaacaacccucaccucauccuccagaguagcugggacuauaggcaugcgcuacuacacccagcuaauuuuauuuuuuguggagacguagucucacuuaguugcucaggcugguuucaaacuccuggccucaagcaauccuccaccuuggcuaauuuuauuuuauuuuuuguggagagagagucucacuuaguugcucaggcugguuucaaacuccuggccucaagcaauccucccacuuuggccuccugaggggcugggauuacaggcauuagccaccaugcccacccuugugucuguauuguagaacuuucaauauaaugaaaguacauaacaaauuaaaucaacucucugaagauagaacauuguauccuauuaaagauuauucagaagguaauauacugacacacauauuuugauuuuauuuuccugauauguggguuuuuugcuagaauuuguguuacauacugugccuuaucaauaucauuuagaacuuuaaguacuguauagacuuaccacauaaucucuccuuucuaccacagagccuggaaccaaugauucucagcacucuaaaugugauguagauaagucugugcaaccggaaccauuuuuccauaaggugguucauucugaacacuugaacuuagucccucaaguucaaucaguucaguguucaccagaagaauccuuugcauuucgaucucacucgcauuuaccaccaaaaaauaaaaacaagaauuccuugcugauuggacuuucaacuggucuguuugaugcaaacaacccaaaggcaaguaugguccucaaguggaaaauauuauccauucgauaacauguauuauuguuuuucuuuuauaaaccauaauauugaguuuuaaucucuuaacacagacacaaacacacauccaacaaaaaccuccaucuucugagcaaauaaauugcaauugagaguacaacuaggauaaagacuauuucauuggcuuccuguucaggauuuuuuuuauagagucuuuuacuugagcaaaaagucccuuuauauacccucaugcacuauugcucuuucccacuacccaaccugacuuccauuuuuaguaucacacuaaguuuaagcaauauaucuuaaauagacagaggugcuauauugccuaauuuguauauaaaaacauuaagagauauucauaugcacuuucugguagaaguuuuucggaccucuuuuucucacuugcuauuuuugaauauauguaaccaauuuuuucuuauaaaaaauaucucuacagaaaauguugaaacgcagguaaaaauaagaaauaaucauuuguuauauuacucuuuauauaaccuuugcauauacauaacuuuuuaccaaaauaagauuuuauguauacucuuuauaaccuuuucuauucaauauauauuacgacauuauugcaaaugccauuauuacaauacugugaugaaaauagcacuuugucauugucacauauucucuuuauaucaucauaaauaacuacauauuccauugagcugcuuaucauaaucuuuuuacaaaucuuuuucuauugucaugccuuuccgcuguaauuuuuguuguuguaaucacaccucuuaucuuuguacauaucuacaauuauuucccuaaaauaaauuucuauaaguggaauucaaaagguuauauuguauacugccugauuuccaaauaguuuauagugcugucaauaguaugugaaaguacauccauuucucuguguguuaaauaccacccacuauuauuauuuacuuaaaaauugucuauuuaucaaaugaguaauguuauugauuuguauacauuuauguuucuguguuuuacaaaugagauugggcauuuuuuuuuauuuuagccuguaaaagaaucaacugccugaauucuuuaguccuuaacuauuuuuuaaauaugucauuuuggccaggcaugcuggcucauaccuagaaucccagcacuuugggaagcuggggugggcggaucauuugagcucaggagcucgagaccagccuggccaacauggcaaaaccccaucucuacuaaaaauacaaaaauuagcugggcguggucgugugggccuguaaucccagcuauuugggaggcugaggcaagagaaucacuugaacccgggagguggagguugcagugagccaagauugcaauauugcacuccagccugggugacagagugagucucugucucaaauaaauaauaaauagucacuuugauuuucaauuuaauuuuccaacuggguauacuuucauuuuguggaguauuuucuuaugcuuaucuuaaauuuagagauuauuaaauuuccucauguaucuaauaucagucuuuugaaaggugugaacuaccaaaaccaauuuaugaucuucagaguuagagagaaaggccuauagauaaggacuaucauacaauucauguacuuuucuuguaguaaagauguauagccaucuuuagcucagagcuucuuaauaccuauugccaucuauaaaguuaauauucuuugcauaauacauuugauuguuugauuuucuuuuaugaccuuaagaguucuauagaagaacuuacucuggaaguaaccacagcaaauuagaagcagcaaugcagauuucauguagaggaguaugaggaaaagaggcaagaaaaaacacuagaaaaucaaagcagucuguagccauuuaggaaaagaacacaaaaccaucccugcccguucuauaaauauuuauauaaucuguuuacuaaggugggauaauuuaaccuuuuauaagcauguuuaaaacucuuuuuugcaaauguuaaguuauacuacuggugggauuuuuuucuugauugaggaaauuccccuugugcuuuggaucccaccuccucacucuucaaggaacugacuccauuaauuuugccacucuaacccgugucaucaacuuuuucuauaguggaucauuuacucaacauauauguucuaauaaaucucaucaaaaauagcaaacuucuuuugagcacaguauccuucuuuaccuacgaccccauuucucuauccccuuuugcaaccaagcaucuugacuauguugcagucucauugcaguuuccacauacauucacuucccaauacauuccagcauggcuuuuagccugcucguccacugaagcggcucuguucagauagucaguuaccaguauguugccaaauucucugcaccguuuucucuuucaccuuucuuagcuuuucagaguucauauaugcuguacuuuuaaauucacuuuaucuguuggcucccuuuauauuguacuuuccuaguuuuucucugaacucaguagucacucuucugucuccacugcugguggauccuacucuaacaaauuucuuaaaaauaauguguguuuuucuacugugaaauaugcuaugaaugucuauaaagucaaauugguugauaguguucaagucuucugcaucuuuacugauuuuuuaaucuauuugaacuauaaauugcugagagaagauugaaauucuuaacuacgcuuguguagaguugauuuucacacugcuuucaagaaguaccugagacugaguaauuuaugaagaaaauagauuuaauugacuuacaguuccgcauggcuggggaggcuucaggaaacuuaaccaucaugguccuagaaggugaaggggaagcaaggcauaucuuacauggcagcaggagacagagagagggagagagcgugggcacgaagggggaagugccacacacuuuuaaauugucagaucucaugagaacucacucaccaucacaagaauagcaugggggaaaucugcccucaugauccagucaccucccaccaggucccuucacugacucuuggggauuacaauuccagaugagauuuggguggggacauagccaaaccauaucaacuuguauagauaacuauuucuucuuucaguuaugucaguuuuuauuuuauguauuuugaaguucuguuuuggggcaaauaaaaauuuagcauucuuaugucuccuggaugaauugauaaguuuauguuuaugaaguauccuuuuuguuugaucacguuguucaguauccuuacugauuuucuuucuacuuaucaauuacugaaaaggaguguugaaauuuccacucaguugcauuugaacuaagaaucaauaugucuucuuaaugaaucaaccccuuugucaccaugaaaugaauccuuuuaucacuggucauaucaccuugucugaaacauuuucucugguuuuauuauagccauuccagcucucuuaugcuuaaucuuuauaugguauauauacauucuuuacugcucuuaaccaaacauuuuauauuuaaaguggauuucuuacaguuagcauguuagucaagucuuguuuuuaacaagucuaacaaucucuuuuaauugauuagacaauuuacauuuaauguaauuauuaauaucacaaccauaugauuggguuuaaaccuaccauuuugcuauuuguuuucuauuugaucacuuuuuuguucccuuuuuacuuuuauucuuccuuccuuuggauuuaguauuuuuagcaccuuauuuuaucucuacuguuuguuuucaagguacaucuuuagcuuagcauaaucucccuucaaauaauauuauaccacuucacauaugucauaaaaaccuuacaacuauaggcagucaugcaucacauaaugacauuucagugaauuacagaccccauauacagcaguggucccauaagauuauaauagaccgaaaaauuccucucaccaccuaaugacaucguagugucacaguguagugcauuacucacauguuuguggugaugcugauguaaacaaaccuaccacacugcuaguccuauaaaaguuuaggacauacaauuauguacaguaccuaaugcuugacaacaauaauaauugacugcaugccugguuuguguauuuuuaauacuuuacuuuuuaucauuauuuuggaguguucuacguauuaaaagaaagugaacuguaaaacggccucaggcagguccuucaggagguauuucaguguauaguguauaguuaucacaggagaugacagcuucauucguguuauugcccuugaagacuuucuagauuggagguggaagacagugauguugaugauccugacccucuguaggcauaggcugacguguguguuugugucuucaaguuuauaaagugaaaagguuacaguaagauaagguuaauuuauugaagacagaaaauuuuuaaauacauuuaguguagucuauguauacaauguuuauaaaguccacaguaguguacgcuaaugucccaggccuucacauuucacucaccacucacucacuggcuuacccagggcaacuuccaguuccacaagcuccauucaugguaaguaccuauacaggugcaccauuuuuaaucuuuuauaugguauuuugacuauaccuuaguguuuagauagacaaauauuuaccauuguauuacaaucuucuauaauauugaguguaguaacaugcuauacagguuuuguagccuaggaacaauaggcuguaccacauauccuagauauguaguaggcuaauaccaucuagguuuguguaauuacacucuaugauguucacacaaugacaaaauugccuaacaacacuuuucucguaacguaucuuuguuaagcaaagcaugacuguacuuccauucccguccugccuguccuucgugguauuguugucggguauuuuuucuaccacguuauaaauuccacaauacauuuuuauuauuuuugcuuaaacauucauuuaucuuuuacagaagucagaaauuggaaaguauuuuauauuuacauguuuacuauuucugacauuuuuuguuccuuugugcagaauucaaguuucuaucugguauucuuuuucuuccacuuuaagaacuuccauuaacacuucuuacacagcccuguugaugaugauuuuuuuuuucagauuuuguuuguaugaaaguguuuucauuucaccuucauuuugaguggauauuuucacuagauauagaauuauauugucuucuggguugcauuguuucuaagaaauaugugagcuuucuuaucuucauguauauagaguaucuuucucucuggcuucuuuuacaguuuccuuuuuaucacugguuucuagcauuuugauuauuaaaugcuuugguaaggguuuuggggaguaagguuuuuggaguaagguuuuauaggacuagcagugugguagguuuguuuauaucagcaucaccacaaacaugaguaauucauuaaacuaugacacuacaaugccauuagguggugagaggaauuuuucagcuuuauuauaaucuuaugggaccaaugcuguauauggggucuguaauguguguguguuuauccuguuuugggguucauugaucuucuuggacccuuagguuuauacuuuucauuaaauuuggaaaaguuuuggcuauuauuucaauuaaauauuuuuucucucucucuacuaccuuuucugugacuccaguuacauauguuagacucuuugauaccauuccacgggucacuaagauuauguucauuuuguuuucagucuuuuuuucucucuguacuuccuuguggauaaauucuauuaguauguauucauguuuacuuaucuuuuuucugcaauaauauacuauuaaucccacucagugaaccuuuuauuucgauauuguguguuuuaucuuuagaaguuguuuuugugucuuucauuucucuccacauuauguucguguuuauccuuuaauacuccauuaaaauagcuggcuuaauauccuuaugugcgaguuccaucaucucuguaucuucuucuguugacuuauuuuucuacugguuauggaucauauuguccuacuucuggguguguuuuauaauucuuuauuugaagguggaccuugugaauauuauauuccuaggucucugauuuuuuuguuauuacuaucuuccuguaaagaguauuggguuuaaguuagucaaguuacuuguggaucuauuuuacacuuuuaaacuuuguuuuuaagcuuugcuaggacaaguguaaaguugucuucauucuagagcuaguuaacuuauuuccaaggcaugacccucuagggccuccacuguacaucacaggugaucuugaggaaacaccucccucccggucaguuugaucaucuccuaccugcaugagcucugagcauuguucagcuuacaacuccccagcuguuuuggccuagcuuugugaaguuucauucugcauauucauggccugugcucaucaaagacucaagaaaacuaccuugcaaaguuuugaaguuuuuuuuguuuuauuuuaaugaaucucucuuuucuaguucuaccucccuggacuuugaucuuugucucaucagucuagcaaggcugcacccaaaguccagauauuuucuccaggcagaaagccaguuuagugguaggguuuacuucauucauuucccuucucacagggaucacagucuugugcugcuuauuguuuaauaucuaaacacaaugucauguauuuuguccaguuuucuaguuguuuccuguggaaguuaagucuggccauuauuacucucucauggccagagcuggaagucuccagaagauaaaugugauauuuuaaggcuauguccugggccuucucuguuugcauuugcuucccaaguaaucugaccccaaggcuuuaaauauaauuuauaugcugaugauacucaacuuuauuacucuaguucuuuccuacagauuauucaucuauuucaucaaucuacuagucauaucaaccaauuguuuccuaacuucucuuccuaauucuguggcugccugugugaaauccauuguccaaauagaaaccagaagucuuuuuuaguauuauaaauuaugucaaaucacagccaugcuuaagacuucaguggcuuucugcugcuuaacuaauauucagacucuuuaccauggucuacaagguuucauauggcauugacugccucucugucugaccucaaaacauuuuucucuagcucauucuaacauuuuccuuugauacaccagucccuuuccugcaguagaguuugcacuugcuguuacccuggccugaaaugagcuucucuuuguucuuuucaacugugacucauuauagucuuucaaguggggccuuggcuucauuuccauuucuaguaauugccaucccaacuaaugucagacaucaucaucuuggccaucagguuggaaaauuacaguuauaggacaugcuacuauagcacauacaggaaacucuaauauaguaguuguuagcuuuucagcuucacuuauuacugugauuuuauuuaaaguauauucaugaaugcacuuaaucuuuuuuuaauauuagagacagggucuugcucugucucccagaauggagugcaguggugcaaucacggcucacugcagccucaaccuccugggcucaagcaaucuucccgccucagccuccugaauagcugggacuacaggcaugcuucaccauaucuggcuaauuuuuaaauuuuuuguagagacaaggucucguuauguugcccagacuggucuggaacuccugggcuuaagcaauccucccaccuugaccucucaauagugcuggaauuacaggcgugagccaccaugcccagccacaugugcuuaaucuuaaucuuugaguaccucugauaacaucuagacauuuauguaucugugauaccuaaugugaggauuguuaaccaguacaccaaagaucugucuuaaauaagauguacauuaauauaucuuuaugcugucaguuuacuuuggugaguaguauaagaaauucucuagaagacuuuuguauuuaccuugaggaugcuguuguaaaucuuaucuaccacacgguuugagaaggaacaaauaagugaaaacacuuguaaugcauuaugauaauuccuguaauggagagaugaaugugggauagugggaccacuaaagaggaaaugauuaagucuguccuagaacaaagaaagauuucugaaaaaguucgcaugguggauaagacaugagaacauuuaaagcaaaauuaacugucaugaacaugagauagcacaguguguuugagacauuacaacuaguucuuaguaacucagaugugaaggagguaagauuccagucauucuuguccuuaagcagauguccuuaguuuucgaaucugugggaucuuuuccccguuuucuagaaaaagucucucuuuuuucugaauaaaggaauacaaugucuuaaagagauaaaaguggagcuguucuuguggcccaaguccucccuuguccucuugcuccuaccccgcccuccaccucacaagcaguuccuuagccacguguuuagagcccuagaauucugggaauaugcucuggaucaugauacuaaggcauuccuuuaauguacuuuaaagggcucuuuuugcagaaacuaagauguaaugacaguaaacugaauuacauguuuaagcauccauacagauaguaguuaguggcuuaguugaucacuguaagacuggcagucagaguaaugcuuugauugccaccauucaucagcagggauaggccuggaauaagcaguuauuccagaagacugcccuuccuuuuauacuacauauuuguuuauacccugcuucagaccagaagaauugaucacauccaaauauauagauuguacuagagaauaugcauuacaaaucaagccauuagcaacuauuuuacauaguuauuaauauugaguauaagauuuguuuaaaugauagucaaaaugaaaagagaauuauaaacuaugccauauuccccagaggagagaaauauauaaauuguucaggggaauaaaugcuuuccuugcuucuucccucuguaagggauuucucuacuggaguuuucuguaacagccaauaaauucuguaaccuaugauaacuucaguacuacuucuacuguaaauacaguagaugauuuuauaagguagcuauaaagugacuuacuaaaaugagguaucacacuuggagaucacugaagguuaguuugugaaaggucaaaauuaaauagucuaaaauuguuguuuucucaugcuuuuguuuacauaaggacagauucuagauuaccaaaugaauuagcuguuugucuuugaaagagucacauuuugcaauauagcuuuuaauagauuauucaguggauggcacugcaaaggcaugccaugcagugcucuauguuguugguugauaacuuugaaauccaaugaggcggugauacaauugauaaccuauaauggaaaaugacuguaacucagacucuaguuugguuagguggccagcuauuuuuguuaaaguagguuacagagcaauuuuuaaucaaaacuagaacuucuucaugaaaacuuuuuuguucauucaccauuuuguucauucaccauugauuaaugaucaguuuguuuuaaaccauauagccuuaacucuagaauuuuaauguggguaccgugaagaauguuugucuaaaauacagauucuuacaccucacagcuaaagguauuuguuuuaauauaucuggagcagaggucaggaauaugcauuuuuggcacacaccguaaguaauucugcugcuggugguccacauuccccacuugagaaauacugccacagaucacaguugaccuaauugcagccuggaaaguguuuaaaguauguuauaugucaacccuccuugaccacuaaaaauauuaauaaugcuucaaaggaaugucuaauuuugagugcugugccuuucugaugaauuacaauuaugaacacuuugucaaauacauucauaaauauuaaacaaguuaauuuucuauauaggguuauuggauaacaaccaauaaaauuuuggaaagagauuacuaauaugagguuuacuucuuggugguaauaaaaaagaaguaccaaauuuaagaccauauuaucagaguaauacagauuauacugaccuuucuguuguuacuaguaggauguaugacuguaacucauuaaaauuuaagcaaauagauucuagaucagaaaacagccuugcauuguucacaauuauuaauauuuuuugucuugggaaguagcuaugaacuaccaucuaauaaaaguauacuaauuauuaguguaauaguagcuggcuaauaguaugaauaguauucuauauacuguucuagcugcuugacauauaguuacuucucacagugacccuaugugacaaauacuguuuuuguucagacugagucucacccugucacccaggcugcagugcaguggcacaaucuuggcucacugcaaccucugcccucuggguucaggugauucuucugccucagccucccaagcagcugggauuacaggcacccaccaccaugcccagcuaauuuuuguauuuuuaguggagacggaguuucaccguguagcccaggcucaucuugaacuccugaccucaagcgaucugcccaccucggcuucccaaaguucuaggauuacaggcgugagccaucgcaccuggccauuaauacuguugucuccauuuuacggaugaggaaauuacaaugcagagaggugaaguacaugguggaucaguauagauuuugaaggacguauuagugacaugaggugacugaucuaguuucucacacagagacaaagacugauuaaaggucauuuaaauuuguacuuuaucacuuauuuauucauaaaauaacuguugccuguggugaaguacuuccugcauugccaucuuauaugaaaacuugccuggaaaacuuuggaauuuguuguagaggaauguggcauaaaauuuagguguauuugggaggccgaggcaggaggaucacuugaacccaggaguuugagagcagccugagcaacauaguuagcccccaccucuacaaaaacauuuuaaaauuagccaagcaugguggcacacacccaccucuagucccagcugcuucggaggcagagaugggaggaucgcuugagcccaggaagucaaggcugcaguaagccguguucaugccgucacgcuccagccuggaugacagagcgugacccugucucaaaaaaaaaaaaaauuagcuguacuauuuaaauauuaauaacuauaguuugaaggaguaaagaguugcuuuaaaaaaaaagugacauaaacuaaauuaacaccacacaccuaugauguuaagugaacagaagguagaguuuauagcccacaaaucagaacagucugaaaaguuuggguccuuauauuuguucauuaagugaacuccaucaaagagacauucaaucucaaucucccuugccucucuccuugccucccucuuucccucucuuucuuccucucucuuccucccucccuccccccaccaccccucucagucuuauuccagcagagaccuauggcuccugaaacguagauaagccuuucuccuuucuguugccacaacuguucucuagucuuguggugauaacuuuucuauguucagaauucccagagucaggauauuuuucuucccuaaaaguaucauaaggcaaagacuggaucuauuuucaaucaccauuauauccucagcaucuaauacaugguuaaugcccaauaaauucuaucaguggauagaauguauucaucaguuagggacuuuuuacaugugguugcuuuguaccuuaccaaaucuagcuuuguuuugauaaagguauaggcaggccaaagaaguccaauaguagaagauaauggugaagcaugguuuaaaguucauucucuaccauaaagcuuuccuuuucuuuguccuguuagggagaauucaucagugauggguuuugauuaaaagccuuuuacaaggaggcuuuuaaaaguagaaaucagucuagggaaacacuguuccaccuucagaagaaacaaagguaggacaggugauaagcaguuuaaagccagugauacagucuuguauucuucucuaaagaacaacuguuucuuuaaaaguacaaacugguuaagccuguuugguuguccucacaaguggauacaggaugaauuuguggaguugcccacaaauucucacucugagucaagcuauuguaaggcagauucauuuagucaacaaauauuuauuaaauaucugcuaugugccagguaccacucuaaaugcuagaguuaacaguagugaggaaaacagacaaaaauccucugcucauggagccauucuaauuggagaauauaaaugauaaaauacaugaucauaaauaauuggaaaaauugaagcaaggcuagugaagaaaguuuguguacaugagccccauuucuccuccuuaucuggagccugcuagucagguaugaagguauuccucagagguuacuccuggcugggauacaugccuucauaaugcagugaauggucuguaggccaacauagguuuguaaagauucaaaucaaaacuuugcauuuguugugauuuuauaaagggaaauuaucaauauauuuuuccaauggaauuuuuaaaaauaguaacauuuucaagauuugauuaauuuauaaucccaugaaaucugaaguagguugagauagagaauuaccugcuaacuccacuucauuugcagccaguuaaaaugacauaaaagucagucauggcggugugcagugacucacgccuguaaucucagcacugugggaggccgaggcagguggaacaccugaggucaggaguuugagaccagccuggccaacauggugaaaccccaucucuacuaaaaauacaaaauuagccagguguggcggcacaugccuguaaucccagcuacucuggaggcugaggcccgaaagucgcuugaacccaggaggcagaggcugcagugagccgagauugcaucauugcacuccagccugggcagcaagagcgagacaccaucucaaaaauaaaauauaagucagucagucaugaccacugagacuaaaaaaaaaaaaaaaauagagucagauaaagaucauaauaucaguuuuauuuuugauaaagcucuacuggaaaauguggccuuagguuuggcuuaaaaucaugccucucaauauuuuccuccugugacuaguccuuggaaucugaagaacaaacuuucuuaacccacaauaagagcuuuauauccaucaagcuccaguagcaggaagacugagagugagaccuaucuugucccuagaaagcaggcguaggccugagcuauuugugcucaccacaaggcaacagaagggaaacaggauacgcacgcacacacucuguggcaggcagaucugagaaagagaacaggaaggacacacacuuuacugucagugcccucuugcaaauuugccuucagucagcucguguuucuucacuuuaggggauagugaauaagggauggagagagaccagauguguucuguggauagggagugggacaaaaaaaugaucugcuuuaugaaaacuugagaauuucuuguuaaagcaaaugcaaaguggcaaaaaaugaugaauguauaauucacauaaauagcacauguaccuuagaugucuuuugauuuguuaaaguauuccauuauuagauaauguccguaauuuuugucuuugggaaguguuccuaaguuuuaaauuaauguuuuaaauccauuuugagccugauguaucgguugaaguaagcagauauucacagugguuauucuuagagagcagcagcagcauuuaauugcaguaaacagaggcuaaaagaauguguccaucauaagacauuugguaguguaacuagaauacuacuacuuccugauuuuauaugaaaaauacuggagcucaaagaguguauuagaauuacuaugaguagaauuuuuuaguugaaguucuguuaaugcaaguaauacugaauucauucacuauguuauauguuucucuacaucuuugaaaaaaaauagaacuaaccagcaauaaaaacugaaggaaacauuuuaagguuuccuaaaauuugguacuccuguuugaacuuauaaugguaccaaaugcuagauguguaaauuaucauguaacaaucuugaaaaaaaaaauacuguacaugaagaucucagccaguguguuauagaugagcuguuauuuucagaaagaguucuuuuuguggauauuaaaacuauagaauauuguuuaaacaacauagaaauaguagaaucagaauuauagaacugaaaguguucuuuuauaaaauucucuugaccaaagaugaauaaccuguuucaaacuuaccagucuacuauucagaaucuaccaggaacucaaacaaauaagaaaaaaacaaucccaucaaaaagugagcaaagggcauuaauagacauuucugaaaagaauauaaacaagaaacauaugaaaaacugcucaacaucacuaaucaucagggaaaugcauauuaaagccacaaugagauaccaccuuacaccugcaagaacggccguaauuuuuucuuuucuuuucuuuauuuuuugagacaaagucucgcucugucgcccaggcuggagugcaguggugugaucucggcucacuacaaccuccgccuccuagguuuaagcaauucuccugccucagccucccaaguagcugggauuacaggcgcaugccaccacacuggcagauuuuuguguuuuuaauagagacagaguuucaccauguuagccaggguagucucaaacuccugaccucaagugauccaucugccucggccucccaaagugcugggauugcaggugugagugagccacugcacccggccaagaauggccauaauuaagaaguccaaaaacagguaaguggccgggcgcgguggcucacgccuguaaucccagcacuuugggaggccaagacgggcagaucaugaggucaggagaucgagaccauccuggcuaacauggugaaaccccgucucuacuaaaaauacaaaaaauuagcugggcgugguguagggcgccuguagucccagcuacucaggaggcugaggcaagagaauggcgugaacccgggaggcggagcuugcagugagccgagaucgcgccacugcacuccagccuggggacagagcaagacucugucucaaaaaaaagaaaaacaauaaguaaaacaauagauguuggcuuggauguggugaaaagggaacacuuuuacacugcuagugggaauguaaauuaguacaaccacuauggaacacaguauggaguuuccuuaaagagcuaaagguagaacuaccauucgauccagcaaucccaccacuggguaucuacccaaaggaaaagaagucauuauaugaaaaagacacacacacacccauguuuauagcagcacaauuugcaauugcaaagauauggaaacgaccuaacugcccaucaaccaacgagugaauaaagaaaacguggaauauacguaccuuggaagacuacucagccauaaaaaggaaugaaauaaugucuuuugcagcaacuuggauggagcuggaggccauuauucuaagugaaguaacucagaaauagaaaaccaaauagcguauguucucauugauaagugggagcuaagcugugaagacccaaaggcauaagagugauguaauggacuucggcgacucaaggggggaagggugagagguagaugagggauaaaagacugcacguuggguacaguguacacugcucggguguugcgugcaccaauaucagaaaucaccacugaagaacguauccauguaaccaaaaaucaccuuuaccucaaaaacuauugaaauaaaaaaaaucauuuguauuguuuaaaauaugaaaaggaaaaaugagaauaaauaaaucuauagggaaaaaagccuccaaagccaugggggaguagguggggggacuuacuagucuaucaaggaguacugugaacaugaagggcuuauccaguugauagcugucagauuaguggguugguauaaaccuguuccaggagguaaguugucaaauuacaugaccacuugaaauuuauuuugguuaacaaaaggaguaaacuagaauugaguuuauuuuaccagggccagaauuuaucucagccuaaaaaauauugcauuauuuuauguaguaaccccaaauuuaauuauauaaugcauaugugcuguuuauugauuagcagguaccuaaggaaaccauuucugguacauauugcuaguuuauaauauacaugguccaaaccauuaaaauaauaaacaaggaaagugugaauucuacagacagugggaaauucagcaaaagaaauacuuccaguaccaucacuaagugauuuaacaagcaguguacuuuuaccaacuuguaguucauaacgauuuuucccuugagugugagaacauuuaaauuauguucaaauaauggaaaucuuuuucauuauucucaaaaacagauuguaccaauaaaauuggccaaguauauaaguuuucauuaauaugcuaaacauuguguuuuccucacaggcucccaucuggugaagaguucuuaucagugccuuaguagucauguuucaaaucucacagauuccuuuaggguuaacccagcugugagaguuauguauguaguuaguuguuucauagccuugucuaucuaucacauucuaauuguugaaagguuguuggacagaggcuauuucuauuaucccuuauccaguacggauucacauuuucaacaccucagcugugcuuuuuuucuuuccucaacucaguuggcugaguuucuucuuacuguuccugcaaauuaugcucagcauugacaucaaagugcuuguccuuccugccuucuguucuagugagaaagguuccacucacagucccauggucagggaagcacugauaggcuucucucugcacugauuugaggccccucauuucaccaguauguggcuaaucagcaguuccuacaauugagugauacaaggggcugucaguuaugugugguggugcuuagccaaacuucagacuaacaugcugcagcauuugggcaagacuguguggggcaaguugaccauaggaagaugagaggaacacuuagcagaaacaccgugaaagcggaacaaaugggucgugagugagaaggagaaaacagauaguuucuagcacugccugauuccugacagauuuccaaguccauuccauguuuauaccuaaauaaacacuucucccaguuuucaaaggugguaucagggaauuccugugcuaaaacccaaacauaacucacaaguuuaguuuccugugaaaaaagacugagcugaaauucaagagaauuagguucuagcuuuaugcaagucaccuuuggauccucuagcucuaaaaauauauauauauauuuuuuauauguuacauauauauguuacauauauaaaaaaacuuuuuauauguuacauuuuacacauauguaacaaaauugugauuaguucuaguuuucucucauuuuuauguuuuaauuaucuuucuccuaauaagaaauuuguugauuuuuauuuuagauguuaaggacauguucacuuccagaucucucaaagcuguucagaacccuuauggauguucccaccguaggagauguucgucaagacaaucuugaaauagaugaaauugaagaugaaaacauuaaagaaggaccuucugauucugaagacauguaaguauaaugucauuaguaaacagcauuaaaagauuuucugaauuuauauguaaaaaagaggggauaacuuaccuagcucuuuuuuuuaacucauuaaccucugcuuuuaugucuucuguauauuauuuuuaucuauuuuaagagacagggucucacucugucaccuagcuggaauacaggcuggacacaguggcuauaaugucauuaguaaacagcauuaaaagaguuucugaauuuauauguaaaaaagaggggauaacuuaccuagcucuuuuuuuuaaucauuaaccucugcuuuuaugucuucuguauauuauuuuuaucuauuuuaagagacagggugucacucuaucaccuagcuggaguguggguuggacacaguggcucacaccuacaaucccaccacauugggaggccaaggcaggaggaaugugagaccagccugggcaacauagugagacaccaucucuacaaaaaaaaauuuauuuuuucuuuugagguggacucuugcucugucacccaggcuggagugcaguggcaugaucuuggcucacggcgaccucugccucccaaguucaagcgauucuccuccucagccuccugaguagcugagauuacuugccaccacgccuggcuaauuuuuguauuuuugguagagaugggguuucagcauguuggucaggcuggucucaaacuccugaccucaagcgaucugcccaccuugggcucccaaagugcuaggauuacgggcaugagcuaccacaccuagccaaaaaaaauuuuuuuaauagccagguuuguuuccacaugccuuguagguagucucagcuacucaggaggcugagguggaaaaaucauuugagcccaagaguuugaggcagcagugagccaugaucaugccacugcacuccagccugagcaacagagugagacccugucucaaaaaugaaaaauaaauaagcuggagugcacuggcaugaugauagcucacugcagccuccaacuccuggacucaagcaaucuuuccacuucacucucccaaauagcuaggauuacaggugugagccacugggacuggccaaguuaauuuauuauugcagaaaaauaaauugauaaauuuaguguagccuaagcauauacuguguuuauaagucuauaguaguguauaguaauguccuaugauaaguacccuauaaaguuuaccauuuuuuaucuuuuauacaguguuuucacuguaccuuuucuauguuuagauauauuuagaauagacagauagcauuguguuacaguugcuuccaguacugaguacagucauaugcuguacagguuuguagcuuaggaguaaacaggcucuacuuuguagccuagguauguaguuagcuauacugacuagguuuguguaagcacauucuaugauguuagcacaacaaugaaauuggcuauaacaaugcauuucucagaaugcuuccuguuguuaagcaauucaugacugugcucuacaguuucccaggagaaugaccagaaagcuccacaucuaccucuugccauauaugauuucaaagccaugccaauggggaguuagcaggucgaccaguuuuguucaugugugugugugcacaugugucagugcacacauguuuucugcauguaauuggauuguuuucacaaaauugcuuucuuugugauucauggggaauccugaaucuaggagggaaauuuaacaagcaauaccucugagagcuguaaggagugauaaccccuuagauugugcacauguacccuaaaacuuaaaguaaaauuaaaaaaaaaauuuuuuuccauaaaaaaacaaaaagaaccuuccuuuaccuuguucaguguuggucagcccucucaacugucuuagacaaauguuacacacuuuuugguguaauaaaaccagaguuuccuagaguaaggugagaagguacaguguguucaaaucaccuggauaaaaaguuauaaaauauuagaauuuuuauaauuuauuuuguaauuucuuugaacuuguuucugcuuuuuacuuuuaccuuuggaaagaacuuguauuuugaucugauugaaaguauuauaucacucucauaauguuuucuucuguauugaguuacguaggaucgaugccgcuggcacauuuuauuuucugguuuuugguucuuuuuuaagccuugcccuugcuucuuaaguuucuggugaaacuucauuuuuaaaagauugccuuuuucauuuuuccuagaguucuguagauuuuugcuaaugaccuuacaaucuagaagaaaaguuaccuuuuuacuuuuguuucuucuacuugacuguagucauuaaacacugaaauauuguguuuuuauuaauccuauuggagaacauaacaacauucaggauuuuuauuguugacaaacugcuaacuaaaauuuuuuucccaaaaauuuuaugaaaucauuuauuuuuaucugaaugaacuacagcuuauuuguggcuuguguucuuuuauuuuuucuuucuuccaagcugcuaaguuuguguuaugcauguguucuuuuaaugaacaauugaugacagaauuuuauuuuaaaacuuaaguuagaagccuuuaguauuaauugaaaaauucgaaaaccaaguuguuuuuaaaguacguuauuucauauuguuauagggauauuucacuugauguuugucuuuggaaaauuauuauuauuuuuuuuugucuaaacuuuagucaagauuuuauaagauagccaacuaaaaacugaauucaagaccaaauuuuuuuaaguaccuuaaaguuuuuuggugcucauuuaguaaaagaucuuaaucuucucauacuuucuuacaguggcaagcuuagcugccucaauugaauaccaucugcagaggguacuaauuccucuaggccagccacuagaugauuuuaugaacaggucaauauuuacucauuguaguaaugguacauagcaggugugcauacuucguugaucuuuuuuuaauaauaaaauuuuuugggggagauagggucucacucugucacccuggcuauaguacagugcugcaaucauaguucacagcagccuuggacuccugggcucaagcaguccuccugccucagacucccuaguagcuaggaauacaggcucgugccaccacgccuagcuaaguuuuuugcaauuuuuuuucuagaggggucucgcuauguugcccaggcuugucucaaacuccuggccucaagcaauccucuugucucagccucccaaagggcuaggauuacaggcaugagccacuguacccagccuaaauuagucuuguaauuauauauuaaguuaaaugcuacuaguaggaugauucaagagauuagacacuauuuucucauucuaauuagaugcuuugcuuuucuauagcuccuacaagucaaauuguaggcguuuguacauauaaguacaaaauaaagauauuucuacauaaaaagauuauuuacucuauuaauggaaauuauauugacagucuuacacaauaguguuuauauuuuaguucuucaguaaauauuugauuggagucuaaacuuuuagaaaggccuuaauuagcccuuguguccuguuaagcauugccuuccugauagaugaaaucccggcuuagguacauaaucucuuuuagaagucuucagacaucuaaaacaucaguuaacuccuuuagucuacaaacuuuuccauuuacauuccauguuaggauaaagaagcaaaucauaagaggaaaaaaauuuuucugaguauguuucucagauauuacagaaguggucaaagacuagauuucagugcucugucauuuacugacuauguggccuugaccaagucauuuaaacauuuugguucauaguuuucaugucucuaaagugauuuuuuguggauaaaauuugaguaguaggauaaaaauguuuaaaaaacaaaaguucuauauaaauguaagguauuauuuguauaaguuauuucauuccagcaucuauaaucccaugaaaauagaaugaauauucuuaccaauacuuuggaaacaaaauucuccagugaagaauuaugaugguugguauaggcuaguuacacagaaaaucuauuauguauuuuagaacauuuuuaagaauaagcaucuaaagauaagauuucuggugaccauuuuauucacugggucauccuauuaacaugaauauaaaauuuccuaaguauuucuauuucuaaaaguucaaaugcccaaugggcauguauauggaaagccuuuuguauagugucuagcuauuagccacauggauauuuugaaaauuacaaaauuccauaaaagagaaaauaauuuacuauuauuuguuuuagaaaaacuucuauagucuggccuguuaaaauaucaaaacauuguuucagaauuuaagcaaugaguaacaucgauaguuaugugauucucuuuggcaaguugggaucauuuuaaacaaaucaucuucuggcuuauauauuccagaauauguguugugugauauauuuaucaguuguauucauccucaauuuaccggugaaaaacaauguaggcuuuuuccagauuuuuuguuaucuacuauuaggauuuuuuaagaagugccuacguauugaguagaaguaaaauuucaguaugagguaguuuuaguuguuuaacuugguaaauuucaguauguuugaaacuuuuaguuauacuuuuuaaauuucaguguguuugaagaaacugacacagauuuacaagagcugcaggccucgauggaacaguuacuuagggaacaaccuggugaagaauacagugaagaagaagagucagucuugaagaacagugauguggagccaacugcaaaugggacagauguggcagaugaagaugacaaucccagcagugaaagugcccugaacgaagaauggcacucaggugcaugaucagaguuuuggaccuuuuucuuuuucaguuuacaaauauuucaaguagaguguauuuuucuaaucucugcugugaaccauuuccaacuuuaaauacaacugaagcaugccucugggucucuccccuuuuuucauucuuuuucuuuucauacaaaugugugauuuuccauuuuuuauuaaaguuuuuauuucuuuccuauuaugucaaugcuuuuuugaagcauuuuuauucuaaucuccauuuauugacugauuuuuccaguaauaaagauaauaacauuguuuucuuggcauucuauauuuuagaaagagcuucugcauauauuaaccagcagaguuaacacugaaagcaguuuuuaaaguacuaaaaacucuuuucguaaauuuguaaacuuucucuuucauaauauuaccccuaagaugcauagaaagugugucuguuucaauaacuauaugauauuaauuuaggaagaaaagcuaaugugaaaagacuaaguaauuuuuuucaaaguaugucgagcacguacaugacaaaacauauuggccauuuauacuuucuaggugcuuuccugaaauguaaugauguaugucuuagguugucuaccuuuugcaggcuuuuccaugguguuucccguguuuauuaccaacuuuugaaaauacuaguuaggguuagcugcuucaaagcaaaacauggaggugugcuuuuuccacuuuuuuuuuuuuauuuaaguaacaucucuaggaguguuuugauuccaaccugauuuauuuuuuauaucuauacaugaaaaguaacauucuuguuuagacagauuuauacauuuuuuuugccaaauaaaggacaaauauuaaaaugacaaaaacuguuuauaaugaaaguagaaguagucuauuucaauggcauuauucauuugucauagaauuuuagucuauuaggguaugaguuauucagucuuuuuaaaucaaaucucuauuuuaauuuuguuuuuuagauaacagugauggugaaauugcuagugaaugugaaugcgauagugucuuuaaccauuuagaggaacugagacuucaucuggagcaggaaaugggcuuugaaaaauucuuugagguuuaugagaaaauaaagguaagugaaaagucaauuaaaacacuuaaaaugugcuauguuugaagguugaagaaauguugauaaucuguauuggucauuagauuuauuauaaauaaaaagugaagucugcaauuacagaaaguuauucaaauauuaauuuauauuugggaauuugguauaggcuauucaugaagaugaagaugaaaauauugaaauuuguucaaaaauaguucaaaauauuuugggaaaugaacaucagcaucuuuaugccaagauucuucauuuagucauggcagauggagccuaccaagaagguaagauuuccucacaugucuguauaauuuucaguaaaugugagaaaaacaagaugauacauguauaugaaucagcuuacaucacauccauuuugugaaaucuacuugggaacuauauaacuuuuaagcaauaauaaaauuaacuuugucauguacuuuuacugaucugucauauacuuuuacugacuuaaguccuuuaaguccauauuuuuaauuuaauuuacaaguaaccuuugaaugagguuuuuaaaaaucuuacuagauagauuuuuggacagcucuagcaauuagaauaauccuagccgggugccgugguuuaugcuugugauuccagcuacuugggaggcuuaagugggaggauggcuugaggccaggaguuugagaccagccuggacaacauagugaaacccuaucucuacacacaaaaaaauuuuuaauuagcuaggcauaguggugggcaccucuagucccagcuacucaggggacugaggugggaggauugcuugagcccaggaguuugaagcugcagugagcugugauugugcuacugcacucagccuuggugacaaagccagacccugucucaaaaaaguaaauaaauaaaaauaaagaagauuauaacuuagaauaauucauuuuuuuuuguuuuuuuugagacagagucuuauugcccaggcuggagugcagugucgugaucucggcucauugcaaccuccacccccugggcucaagugauucuccugccucagccucccaaauagcugggauuauaggcgugcgccaccacaccugacuacuuuuuguauuuuuaguagagacaggguuucaccauguuggccaggcuggucuugaacuccugaucucagaugauccacacaccucagccucccaaagugcugggauuacaaaugugagccacugcgccuggcccuagaauaguucuuaucaaggaugugguauuaaacguuuuuugugugugugagauggagucuugcucuguuguccaggcuagagugcaguggcacagucucagcucacugcaaccucugccuccuggguucaagugauucuccugccucagccuccugaguagcuuggccuacaggugcuaccaugccuggccaauuuuuguauuuuuaguagagauggggucucaccauguuggccaggcuggccucgaacuccugaccucaaaugauucaccccuccuuggccucccaaagugcugggauuacaggugugagccacugcaccuggcaaaacuuguagacacaaaaagcaauauguaaaauuuugaacaagaauuuauuucuagauuauuugcccaaacauuaauuuuauuacuuuaaauguuaaauucauagacuaaaauugaggguuuuaaauguugaugcuuaauuuuagcaauaaaaauguuuauaaaauguauuuguauuccauacaaaauguguuugcauauucauacaaaaaagucuaagauugcauugaaauauauauauguauauaguaagagagaaaauuaaguuuuaaaaaaaaguuuggggaagucaacaaauuggacaaaugagcacaagcaguauaacaugaagccaggaaugaagaauacaaacuucauguucaaaagguuuccacauuuucuaaaaacaggaaacaaauuuggugcuggucuuucucacaaagcagaaaaccuaauuaauuacaugagucacaguauucaugagacaaaacauuuuaguugcucagaggacagcuauuuuugguauugaaaccaaaggaacaauuuucccaugaucuuuaaaaagagggcacuaucauacaguguuccucaaacuugaauaacauguggaucccuuuaaggagcaaaaaguauuuuuuucaggcaugagaauccaagggucuauaaaccccaguaaaaaaaaaaaaacucaagucuuagugguagaaaauuucuguuaguugugaauuauuacuguaaaacauguuguauuuuucuaaauauuaaaaaauuuuaucaaaaugaaaauauaaaagguaaacauuuucugguacuuguggauuucuuauuuuauugagaccuuggacuucauuuuacaaaacagugcuauaauggaaugaaaaguauccucaguaauuuuuacaauauuuagauuucaugaggcuguuucucauaugucaugcuguaaguuaauggcacgaagccagaggaugauuccauuucaguaauucuguagaguguaucaaaccaauucuauucauauucagacuauuccaccuccaggcgguucuccuuaaguauuguuucaauagagcuuuucauaaguaaucagcaacaaugugcuugggguucaguuuugcucaacaaguaucuggagagcuuuuaguuugccuugccccuuaaguggagagcuguaacaaucaacuuauucacaagguagaauugacacccucuuuugacaacugaguggcuucaaaaggauauaagccuacacagaaggccauuuccccugcaaaggaccaagaaucaggcuagguuaauacaccacucaggaagcaauaucagauuuucucuaguacacaaauggaaagggaaagagaaccccagaguucuguaucauaaagccugacaguaauuccuucacccuagaaaaaauguaaagcaauugaagaugccuacccuggcaaucuuuucuaaaacucuuaguacauaccauuacagcagguguagcuuaaaaaaaaauugaguacagcccauaaaauauuguaacuugcuacuauagcuacuaaagaaacugguuauaaaauggauauugaauuauguggaugacuugcuguuuuguauuguuaaucaugagaguuaaaugaaaugacuagauauagauuucauauucauugauucagaauaaccguuuugcacuccuucuuauuggaagucaguagagcccauauauagcuguucuuuuugauuuggggaguuuuuuguugggauuuuuuuuuuucuauggagacagggccuugcucugucacccagguuggagugcaguggcaugaucucaacucacugcaaccuccgccuccugggcucaagcaguccucccacuucagccuccugaguaacugguacuacuggcgugagcuaccaugccugacucauuuuuguauuuuuuuggcagagauggcauuucgccauguugaucucaaacuccuggccugaagcuguccucccaccucagcuucccaaaguguuaggauuacaggugugacccaccgcacccagccuaccugucuuagagauaguuguccagacagcuaucuuuuaggccacaucuaggagaugguaaagccaugucaucuacauaugguacuuacacacuuuuauuuucuguguuggggaaaagggagaguaaagaagggaagggguaagcaaaauuuuaucucgcucacccgaaagugacaucaagucauuaagauacaaguuaaaaagaagauugucaaaaacacauuucuguuuuauuucacuggaaauuauauaaguccugaaaagacagccucagcuauuuaacucuccugauacuguuauggugcagguuugguaagcgucaauaucuucagccguugauaaaguuaaugcuuuuuuuuccauagcuagauacuauccagagucagaagucaaauagagcuaauaaaauguguaagcgauuugauaguauuccuaauaaauucuuccacaaggagaggaguauaacagcuguggccaguggcaaccuggcagaggcuaccauguucucacauugaguauuagcauuagcggcccaaguuuauagauucuucuuuuuuuuuuuuuuuuuuuuuuuuuuuuuuugagauggagucuugcucugucgcccaggcuggaguacagugacaugaucucggcucacugcaaccucugccucccagguucaagcaauucuccugucucacccucccaaguagcuggcauuacaggcaugugccaccacacccagcuaauuuuuguauuuuuaguagagacaggguuucaccauguuggccaggcuggucucaaacuccugaccucaggugaucugucugccucggucucccaaagugcugggauuacaggcaugagccacuaugccuggccauuauagacucuuaagaaagagacacauaccuucucuucauauucauuuuagguggaauauugggcugcguuuauguaaugaaauuguauacaucggcuaaaaugaaugaauuaaauuccgacugucaauauggauaagccccacaaacaugaugaguugaauaaguagaauauuacaccauuuauguaguguuucuaaacaauuuuauuuagaugugcauguacguaauaaaaauaaaagcaaaaaccaugagcgggaagaauacacaucaauuucagaguacugaaaaugccccuggggaagaaaggaaggcaguaagauugagaaaggguacucugcaucuguaauaugguuuuacuuaaauaauccaaaccacuauggccaaaaguuagcuuuuguuaauucuacauauuauggauauguguguucauuacuuuccugauuauuugaaaaguaaguaaauuauaguccagugauaaguguuaccuuggaagcaauaaaauguauguaaguuauaaaguaaugauccaacuacauugauggugacaggauaggucuuccuaggggagaggacaucaaaguuggauucugaaagacaaaugggaauuuaaugcaaauaaguacucauacauggaaguaugcaaaauguaguagggaaacuauaagcaauucaguguuccuaaagcauaaauuauaggggcaguuaaggaagguggggaaugaaauuugguaagaugagaaauauuuaaaaggccagaucaugaagggcuuuguaauccacguuaaggagcguggauuccauuuugaggcagcagggagcuaacaaauguuuuaagcagugcagugauuugacaugacccuuggauuuuaaugaaagaucacuuuugcuagaauguggaagauagugcuugcauauaagauuaaguuaaccagucuguuuaauucacuugauuauaaucuuuagaauuaaaaaaauugaaaauaacaaaaaugucuauaaauaguaaugguuaguuaugucauauccauuaaacagaauacucugcagacauugaagucaacauagaauauauccaugauuuauucuuuaacauuuuauugucaaauuuuuaucauauugaaaaucugaaagaacuuuacagugaucacccaugcacccaccaccuagauucuaacauuagcauuuucuaaucuuacauuaucacuuauguauccaccuuuccauucacuaggguguuuucaguggaaaaccuauguuucaaaacugcauuuuaguguaauuuuuaaaagauauuuguguaugcauaggaaagcauugugggaggauuuauauaaaguuaacauugguugucuuucacuuacagaugauuuuugcuucccauuuuauucuucauuguauugucugaauauuuuacaaggaaugugugauaaaauaauuuuaaaaguauguuuaaaacuacauuaaagcucuucuccuuuagcaugaacaagaauggguuuuuuuuaaaguagauacagcuugauuugaaaugaagucaauuuuuuucuuuuuucuacagauaaugaugaauaauccucaaaauguuuuuuaauccucaacuauaugaaagcauuugaauuuggcuuaucagaauaacaagcuucagugggaaauacagcaauuauuuauuuaaaaaaucagauuuaagauggacuuucuuauugcaugaaaaagauggagaaacaugccauuuuucagugaagauucuaauauuuuaucuauuuuguucauugaauuccaugguuaaaucucauaaaauauauacuuuauuaaaucauccaaccaaagcauaggaaacauugacccagaaccugacuuaaugguuuugaagauuuacuaugcaauaggguaacuuugaguuucagcaaaugucuuuagguugaaggaauuaccuaugucaugaaggaccugucugugguuuuucaauggagucuuuaagcaugaucuuuuuucugucuaguacuuguuuucauucuggccagcaguucuacauuaaaucaccuugucaagggcucuguuuacaucuauacauuuugaagaugaaauuuuuagccuuaaaguuuauauucucaaguccuuuuacaaucagugugucuccugaacuagcacacaggcuguagaaacagucuuagaaaucauugaaagauuugauuaugaaagaauagcaaaauuauauuucuugacauauaaaaaguugguuuaaugccuuuauuucucuuuaaggaccagaaccaggaauacuauaucgaaaaauuagucuguggauuuaacacugacuuagcauauagcuuaaaguugcucuuuugguuuuuaacuuccuccauacauaagcuucaaggacaauaagauguuaaaaaggaggaaauaauuauuuuuauuuugacacugugacaguuuugguaacuaggauccuagggagggaaauguuugccuguugaacuucuuucuguuaugagaggauuuaguuaggucauuaagauguugaucacacagcuucaaucacaauaugccaaguauaaccugguuucguuagaggugucuacaguccagauguucuucguaauaaaagcaaaguuuuugaaccucugaguccaaagcaggcugguuggcauaauauguaauuugaaaaauaaaaucuuaucuugcagcacuaucaguauguugaauuuauuauguauauuauuucuaauauccgaaacuaaauacuugauuuuuuaauauguguguuuauuuuaugauauugcuauuaaauuuuuauuaucuaccugaagua

SEQ ID NO: 191872 - RNA, 102517 nt, Homo sapiens
aggaaaccgaaacucccgccggaugcauaaaagacuggcugcgguggcucagagcgccgaguccuaggccaggucugggguaaccuggaacuuccaccugggcucugcgcuaggucucuguuucacucccuccccgcggggcgcgcagcucgcgggucuuuggacaccaccgguccugaguccgcggugaggagccggggaugucccuugggaagagccuggggcggagcugucuagcgggaguucuaggucuucuucaacggaccggacagggagguggcccaggagugcugggcucggggcgcgggaaucuggggaaccuccugggaucgcaaggccguggcgcacgggcccccugcuggcccggaaggccgggcguggggaggggcggaggaaagggacaaccgcgaaaggccugaagucugagacagagaggagugcuuaguuaggcauuuaaggaguccccgucaaaggugggagcuggguaauggagguugaggagaaauuaagggacaucauaucuaagcacagccaguaaaaccuguacauugacagcagcaagaagcuuccaccuucaaucccugcuccagacuuguagaaucagaaucugcguuuauuaauaagauucccccagguaauuucugugcacccuuaaauuucaguggcuuaagacaauagaaauuuauuuccuacuccaguaacuuaauuuauuccuggucaaggggcagguauaguggcuuaaaacauuacaaguuuauuauuuuacaauugcuguggaucagaagcccaggcauggguaaagugaguucucuguucagcaucucaucgagcugaaaucaaggugucagagcuguggccucaugggacaccauggaugcucauucagguuguuggaagaauucaguuucuugcagcuaaaggacugagguuaccugcuuucuugcuggcuguuggcuggggguucccaugucuuuagauuucacccugagaucuuagcuacaguggccuucucacaacaagguggcuuauaccguuaaagaagguauaggguaccuuuaaagaagguauaagccucuuugggggaaucucccgagucuacuaugaugaagucuuacauaauauaaccgaaucauuaaagagacuaugccauuaaauucacagguccuguccacacucaaggggagaggguuauaccggguacuggaagccauuuuaacccaccagcucuucuccaggcaggguuucaggagcuugaugccuuucaucaaguagcuccaccauucuguuccaauacagaauccaugauuuccuuucccuucccuugcccccauuuuuuuccucuuuaccuccccuuugcgccuuuccucuucccuccuuuuuucucuuuuccauuucucuuccucccuucuucuuuucuucuuccuuuuuaagauuguuugaaucagaauaugguucugacacuacugugauuggaggauaagccuuauaagguucuugcaauuucuuucauccccuuuuaauuuauucguuuguaagauuuguggucuuaugauuguuuguuuuuguauguguguguccuguuggguguguguuuauguguguguguguguauguguccuaaucccuguggugucauuuaacauauuuugcuggccucuaaauuucuuguaaauuaaucauuacuacuagcguuuugaucagauucagguuuucuuuuuuuucuucuucuucuuuuuuuuuuuuuuuuuuugagacggagucuugcucuuuugcccaggcuggaaugcaguggcuugaucucaguucacugcaaccucugccucccagguucaagcgauucuucuaccucagccucccaaguagcugggauuacaggugacugucaccaugcccagcuaauguuugcauuuuuaguagagaugggguuucaccauguuggccagucuggucucgaacucccgaccucaggugaucugcccgccuuggccucccaaguuuuggguuucuuuuuuuuuuggcugggagaacuacaauacuucacugaugguguggacacuugccucuauuuuuguugugcuaucguuuaaaaauaccaagaucuguuaauucauuaggaguuguaaaauggugauauucuaauucuaucauuccuucuguguuuauuagcugcauuauuucuagaaaugaaucacucuuguaucuacucuuugguaaugcgauggugcaguacuuagaagaaaagcaggauaauuucuugauuccauaaaccauuauuuuuuuucauauauugucuucagaugcuauugcuggacauccugcugugaaagaugaagaauuuagcauucauauuuauuuuucuuucauucaucccuuugugaacugccaaguugguuaauuauauuauuauuuucauacugucaagguuuaucauauuuuacagcaguuugugacuuugauucuugugauuuguuuguauguugagucaacaguaaaaaagaaguaaacagcagugacaaaauuaugaguauguacacauuacucaguguagaagcaaucuaggaauugcuaggcuaagacauguaguucuauguuguuaaaauuacuguuugaaauagacuuuuguaaauucgaaguaccauggguucucuuguuuuucuuuauagcuuccuuuaacuuuucuaaaucacacaaaguuucaugguuuuuugauugucuucauucuugauggguuuuccccaauuuucuguauuaucucuuuaaauaaaauuaucauuuaagauauauaguuggcauuuuggaagacagcguggccauuccucaaggaucuagaaccagaaauacuauucgacccagcaaucccauuacuggguauauacccaaaggauuauaaaucauucuacuguaaagacacaugcacauguauguugauugcagcacuauuuacaauagcaaagacuuggaaccaacccaaauacccauuaaugauaggcuggauaaagaaaauguggcacauauaccccauggaacacuaugcagccauaaaaaagaaugaguucguguccuuugcagggacaugaauaaagcuggaagccaucauucucagcaaacuaacacaggaacagaaaaccaaacaccacauguucucacucauaagugggaguggaacaaugagagcacauggacacagggaggggaaccucacacacuggggcuugucggaggguugggggcaaagggagggagagcauuaggucaaauaccuaaugcaugaggugcuuaaaaccuggaugacggguugauaggugcagcaaaccaccauggcacauguauaucuauguaacaaaccugcauguucugcacauguauuucagaacuuaaaauaaaaaaaggauauaugguuggugaaauuuaugacuucuuagaagucuaauuacaucuuuuugccuccuccaugaauugaaucacuauuuagaugcagaauucuaaguucaaauuauuuucccuuuagaaaucugaaagugcuuuauuuuaucaaaacauccaggaauguugcuuauuuuaauuaauucugugugccagguauuauuuuaaucaauucguauccaucaguucauacauuuaaguagcuugaaaacacaaucagaggugaguaauauuauuguuccaauuuuauagauaaguaaauugaaacucagagaugguaaauaccuugucuaagcuuauagaacuauaguauauuucagaaccaagauuaaaaugcaaguagucggccaacaguguucauuucuuaaaccaguucucauauggccugacuuccauuucuuuguaccuuuucugucuuucucuuuauucuuggagcucugcaauuuuaacaaguugugccuaggcguaguuuucucuuuugucauuauuucuacucaguaguuagagaaacauuucaaucuaaacacauuauguuguucuuuaguucuagucuaauauuaguauauuaguuuaaguauauaucuuugauuauuuuuauccccacucauuuuggaaucuuaguuaucuccuacuagaaauauuaguagggggagaaagagcuuauugacuuauuccuggauauuuuaguauuuuuagaauuuuuucaucucuuugucuuuuacuuuuauccuuuacaaaauuuccuggacuuuaacccuacagaucacugacuaaaaauuccagcaugcucauuuuauuguucugcaaugacuuucuuccuuguaaaauuauguuuuaaauguguacgaauacuugcaugcuuucuuuuucucuuucucucucucuagcagccuguuacuauuuuaugagaaauauuuuuaauucuuugaaagcaguaauuagaaaauuuugaaggucuuuucugucucugcaucaugcuuauucaucugguuucuuauuuuugcuuuuuuugugugccucaaaugucuauugguacuaauuugugugugugugugugugugugaguguucaaucauuaguuacuacagguggcuggaucucuagcaugucucucccuuaaaugacagagaaguggggauaaugacugugaauucuguuuagguguuagggcgugcauguguuggggcagagguuaauaggguagcucuaguauaggguauauaagaggaaagccuaggguguguaagccuacuuuaguauagggcauguaagaggaaagccuauuaggcuuuacacgcauugucuugcauacccuguccuaugucaugcagagcaaccuguaggaucucaaacuucccauaggcaggcuacggaaucccuugauugucaaauuaaggagggauugcccauuaacgcaguuuuauuuugucaccauagcuauugcugaaaguuucacaguguuuaacgggcacucacgucucagucauaguuauauuucauuauaaaaacuauauuauuccuuuuaaucuauguauauuauuucuuaaaacaauuucuaaguugucaggacauaaauaguuauuaauuuguuuguaucuaacuacuuaauaaaugaaacgguuagcuauugauuuuguccuaggaguggcauaaaaaaauuccugagacucuaagagcaucgugaacaucugggaaccuguaaauuaacuuauuucaucuuguagaaucugaugcuauccuuucugaaguuuucuguaauauacuugggguuaauucucucuugccuguucaguucucacugacccauuuuuuuccauuugagcuugguacaauuuggagaguugaagaaagauaguauggccaaugcacaguuagugagguggaggauugcaugaaaugggugacagagaguuuuuugaaaauaccuaaucuccugaccugggcacaagacccauuauagucugguucuaaccuaccuuuccaaugucaucuccaaugagucacccuguccuaugccauguagaacaacccauaggaucucaaacuugucauguaguuucacaacuuuaugcauuaaacugaugcugauuuugcuaccugaaaaguaauucucuauaucucucacuuuccccaacaugcuuucauaagucuucaucaucuuuucaaccuguucuugaaaccucagaacacaggacccugaucccuucauucugauuuaggaacucccucucaauucucuaauggcuuccugugccauuucugcuagaacacagcaaauuagauguagugugucacuuaguuaucuuucaacuuacacuggguuguacaaggagagaaucaugcuucaugcauauuugcauauguuucagcaaguacaauguuuuguaaaguguagauacucuauaaucuuugaaauaagauaguaacugagugagugagagaccauacuuacgcucgugucuccauuaagggucccuaaacuccccagcccacaguaauuccauuuuucuuuaaacuuauuugucauuacagucauauacuuccuugcauuauuauuguaauauuuaauaucagcaugugcaucaccauuauauguuccuuacuaucauggaauaggaaucucucucucucuaucauaucuaucuaucuaucuaucuguguauccaucaucuauaucuaucuauaucaaucaaucuaucuacuaucuauccauaaaucauguguguaucuaccuaucuguuucauagcccuaacauauugaauggcaagugucucaauauuuaguguccaugacaaaaugcucaagugcauuuucaucuaccucuuuaguauuuucuucucuauuaccuuuguggauucuuccuccucucuugauauauuaaguauuaguaucuucaaauguggguuuuuaguacucuucucccaugaugcugucucucccuguccaagcaagcucaucuacaccaauggccucauuuaccguuaauacucagaugacuuaccucuucaaaucuaguccagacuuuguauuuguccucuagacuuguauauuuuacuacuuacauaucauggcuuauggggaaucuugaaagcaagucaaauucaggugguucacaaaugccgccauaaucuuuuccugacacguagccuuguucuaaaauucccagcccagggaauggccuagucauccauccuguuacuugagcuagaaacuugugucauccuugacaacccccuuuccucucuuguccauccacauccaguccaguuccaaauuaugucaagcucaucuccuaaauguccuucaagugaguccacaucucuccagcuuuauuaucucagcuaccaucaaacuauauuacaucaaauuaucaucauuacucuccugcacaguaacuuucuuucugcucuacuaagaagcuuacucccauccuguuuauucucuauauuguagcuggacuaaucuuuucaaagugcaaagccaaucacaauaccaccugcuuaaaauccaucaguggcuaacuuuucauucuaggacgaaaagaaaauucuauaacaugacuucaaaggcucugcauguccuucuauuucucuuguccucucuagucuuuucuuugauggucuccacuccagcccuacuggcuucuuucuggaaucaaugucacccacaacccuucacgccacugagcuuuuacacaugguauucugguauuuccucugccagaaaugcuacuuuuucucuuuuugccuaauuaauuauuguuuauuucuuagaacucagcucaagcauuauuucuuuagggaaacuuccucugaccucuugacuuugucguuuuugcaauguuccauuguuucuaugauuaucugauuaauaauuaucuuuaagcucugugagaacugucagcaauguugauuuguucauucuuguauuccuugugucuaauauuuugcuuuacauauaguagucauucaauacauguuuguugaauaaagacucauuuucuuuucuuuuuuugcaggacugccauuuucauuaagaacugccacuuagagguaccaaaauaaaggguauuugcuaccuuuaauacuugccaguucagguuggaggcacaggcagcagcaagaauggguaauuuuccacuuaaaauauuuauagauuauaaaacaauguuacccuguaaacuacauagauuuaauggaauuaaaauaaccacauuacuguuuuacuuucuugaauaauaacuaaaugauagcuccuguaaaaaggaccaauugaaaaauaacccauucucuuucucucuuuuuuuuuaaauuuagaaagaaauguucuuacaacauuuucacaggaaaugucccaguuaauuuugaaugaaaugccaaaagcugagugaguauuauuauaguaauaaagacgggaaaucauagcucauguucccuguaugucuauuuggccuuaugcugauuuauagacaguugaccauugaacaauguaggggcuaagggcacugaacaacuaugcaguugagaauccauguuuaacuuuuuaaaaauuauuguuaauuaauuuuuauauauuuuuucuaaauucaugccagccggauaaugagauaacuuuguaacaaggauugaguagggcacauccaacacauacacaugaaaacccaaucaucacauuuaugaacuacaaaaggaugguguuuaacuuuuuacuccuccaaaacuuaacugcaauagcuuucucucugcucuaccaagaaguuugcacccauccuaucuauugucuaucuuguagcuggacuagucuuuuccaaaugcaaagcccaucguaaugccaccugcuuaaaauucuucaauggcuaauauuugauucugggaugaagagaaaaucccaaaacaugccuucaaaggcuugccugcccucuuguuucucuggucuuaguauagaaaauuaagaaaaucauaaggaagcaaaaauguauuuauuaagugggaguggaucauaacaauagugacaucuucaauggugccauccccccagacuuccaugauguucugucuaucaggguucucuuccauagcauugacaauucuuuccauagauuacuguguguaaugagccuuaaagguucuuaugacacucugaucuaaaggcugaauuaaagacauuuuguuugggggcgaguagaccacuucagcaucguuguguugaacucauggaguucuagguggccagggacauuguccaauaucaaaaguacuuugaaaagcagucucccucacuggcaagguacuuccugauuucagggacaaaguaucaauuuaacuaauucggaaaauguguccucauuguccaggacuuuuuguuguacaucugagagacuggcagcugguguuuaucuuuucccuucgagucucaggaguuggcagcuuuacagauaaagacaggccugaagauaaaaccaacagccuuuacacaauacaguagaguuagcuuaucccuuccugcucuaaauccuggugcucacuuuuguuuuguacuaauaaauauuauuugugacuuuuuuuccagaauaauuucauuugcauuaaaaaccuauucaagcagauauucuuuccccucaaugauuuucuucugucucuuagcuggcugaaacugcuucucuuguuaucuugacauuuuuaaagccaaacuucuuuccaaaauuaucaaaccauauugugcuggcauuagauuuuccaguuuuagauauuucgucuuccuuuugcuuugucauauacuuugcuuuuucuugaaucauauuagagucuauaaauuugccuuuuuagauaaucccacacccacauaaaagcucuauuuucaaugugagauuaaaaaaaaagccuuucacaaaaaaugcaagauuuuuaugacugcugcaacaaugccuucacucauuucuuuaaaaaaauuuuuuuacaaugguccuuacguuagguuuauuuaucuggaaguggugggcaacuauagcugcaagcaucaaucuaugacacacaucaggcaauucaacuuuuucuuguaaugucaugacuuucucugcuuuuugggaacacuucuggcaucacuaauggcacuucauauggguuccaugguuuuauuuaggguuuaugauauugcaauaaacaugauggaaaaauacgcaagaaccaugagagaucacuuuuuauuguguuuggagagcaguuuacuggagaggaacugcuaacuuaccaccauacaacaagaaguggcuacaaaguuauuacaguaguacaguauguacuagaguuaauuuuaugcaguuaugauuuaauagugcagcauaacauuuguuuacacuucucucaacucugaaagcugccauguguagucuauaagugcgugcauaaguuuagauaauuuuuaacuuuuacaauagaucuguguauauuuuauggcaguaaaugcuaaaauagacuacauauacuuuaugcauucgugacauagguaacuuaaaauuuuuuucauauuuguaggcugcacgguuugagaguuuuuucaaauagucacaaauuuucacaaauuuuucuaauauauuuauugaauauauaguauacauuuaucaguauauaucuauguaucaguauuuauauugguguguaucuauguauaauauauauacauauauaauauauaucuauauauaguauagaauauuauauauaacaguauauagaacuauguacacuauuauauauauguauauaugauuguucaacacagcacuuuuagagcuauaugacagugaauggaaacaguuuccucuugcuuaauuugucaauagccaucagugaauccacuuguaaggggcugagguugauuaagcauaaaauauauauaauuuagguuuauaugcaggguacaaguacuauauucaugguccuaucaggcugugccacauggcuuuggauacuuugcucucugagccuaagaugugaauaaucccgccuuccuccugugaaggauaguugugaauguagauauguuugaaaagccuuaguguagacacugccaugagacaacucagcaaauuuagcuauugaugauaaugauaaugagcuaauaagaacgaugccuuuuuggaacaugauuuaaugcauaugugauuuuuguuuuaacuguuuuucauuuuagauauuccaguuuauucaaugauuuuguugaaucugaauuuuuuuugauugauggggauucauuacuuaucacauguaucugugagauaucauuuaagccugggcagaaccuccauuucuucuaucugguugaacgcuaucuuguggaucuuauuagcaaaggaggacaauucaccauaguuuucuucaagguaacaugauaguugaguucuuuuuuauaauaugagaacuaaaacuaaaauuuccuaaauuauuauauauauauuuuucuuauuacaaaguagauuauaucuauaaaaguucagaaaauugaaaggaaagaagagaaaaaauuacccacaaucccaguauucagaaaucaccacacuugagauuauguuuuauuugaaugaagagaacuuuauuguaaggacacacaggaucaugagagaggaugagaaagcuccucaauagcggcccaguugaacucuggauuccaguucuccugcucugagaacuauuucuguuuucaaaacucagcaggcaauuuauaugagcccagaggaaaauauaucugagccuagggacagucauuaauaaugcuuuguuggcugggcacgguggugcaugccuguaaucccagcacuucgggaggcugaggugggaggauuacuugagcccaggaguuugacacugcagugagccaugaucacgccacugcacuucagccugggugacauagugagacccagucucuaacaauaauaaucaauguuuuaugaugguuuguuugagguauuuccaaaauaauacuauuuuugguuugcuuuuuuauuaugaauauaauuaauauaauuuuuaacaauuucaaauaaagauaugcauaaccacuaccacccuuccuaauccuauaccuaaagguaaagagcuuuggugugagucuuuucagucauuuugcagucucaauuauuguuacauuucugaacauggcugaaugcuugccagccauguuuuguguaaagagcuaggcuuccgaucuaauguuuacaaucuaguugguugccccaauuuuguuaugccgagacaaucucaguugcuuaaggaggguugcaguaaccuggagcaauccucuaaaacacaaugguucaccucagcuuucugaugcagaugauuuauaucuaccacuugcuuucuguucuuuuucuuucugaaaugagauuggagaggaaaagaauuagaaaaugggaaggguaagcaugauaagcuccaaguauuaagugccugcuuaaaggagacacaugcauuuaaauccaaacugugauuuuuuucagcaaauaucuguaagaugguaguaaaguuuaggggucuauuccccgaccaucagacagaacaaaacuguuggauuuuauuccuucagugccuuuaaugauguguuagccaacuaaaugauuaaaugauaauuuugaaauaaaauguacuucaccuccuccuccacaggaugccgaguaugcguauuucaacuucccugaacuucuuucuuugagaacugcuuuaauucuucaucuucagaagaauaccaccauugauguucgaacaacauuuucgagaugcuuaucaaaagaguggggaaguuucuuggaagagaguuacccauauuuccugauaguugcagacgaaggccugaacgaucuacaaacacagcuuuucaacuuuuuaaucauucauucuugggcaaggaaggucaacguuguacuuuccucagggcaagaaucugauguucuuugccuuuaugcauaccuucuuccaagcauguacagacaccagauuuuuuccuggaagguaauucacauccaaaagacaauuucuucuagaaauuuucaaaauguucuaaguuacuugacucaguuuuuucuccuccuccucuaggaaauuaucagaggcuuaacagauagguauaacaauuaauaauauuaaguaaauaaugauaaugcaaaugcagucauuuaucaaacacuuauuguuauaaaauugugcuugguauuucucaugaauaauuuuuauuuaaccuuaaaaccaaucuuauaagguagguguuaaguauugucuguauuuuacagugaugaaauagauacuagaaucaguaaucugcucaccaaacacaccaaaugaauaguagaacauggauuugaaaagacacaguuggacucaagccccuguguccuuaacugcugcauaauauguugaccucaagguauugaaggccagaaaugcauggaauuaggcaaaaauuacgccccuguugcugagacauauugacaaaaugcuauuaauaugguagccuuuaauaagaaaacaauggagaaggucaauaaagaaggaaaauaacugaaauaagcuuauuucuuauuauuaaguaaucaauaggagaauuuucaaaguucuuagaguucgaauuccaugauguuauuauuuugauacauuaguauauuugacaauuauuguauugaaauuuugggaguaaauaugcauacggauauauuuauaaauuacuauauguauaaaauaaaugauagcuauaauaauauaauauauaauagaaauuauaauaaauuuauuuacauaauaaauuauaaauaagacaauacgguaccauauaguaaauuaauaaaauuaguacauuaaauaauauagcuauuuauaaauuacuaaauuuauuuauaaaauuauaaauacauccaguuucugcuuauuuuucacuacugauggugaauugugaauaugagggccauucuuuaauucaucaaaaucauuuuugagacaauuaacauuugucacuguuugagaauuaugucauacuccucauguauuuggaaauauccacaugguugccauaaaauaagcuaguuuguauugcuuuaguuaguacagucaugcaucacauggauacauuccaagaaaugcaucauuagacgauuucacuguuguguaaacaucguuaguguacagacacaaagcuagaugguauagccuaugacacccuuaggcuaucugauguagccuacuguuccuaggcuaaaccuauacagcauguuacuguauugaguacucuagguaauuguaacacaaugauaauuauuuguguaucuaagcauaucuaaacauagaaaagguacauuugaaaaugguauaaaagauuaaaaaugauacacuuguauaggguacuuaccaugaauggagcuugcaggaccagaaguugcccugggugagucagugagugacugacgagugaaugugaaggcuuaggacauuacuguacaccacuguagauguuauuaauauauacaguauucacuuuggcuacauuaaauuuauuuaaaaauacuuuuuuauuuaauaccuuaacauuagcuuacuguaauuuuuuauuuugugaauuuuaauuuucaaaauuuuuuugacagcuguacaaacacauuauacaacuguacaaaaauauuuuccuucuuuauuuuucuugagacagugucuucacucugucacucaggcuggagugcagugaugugaucacagcucacugcagcuuccacgucucgggcucaagugauccugccgccucagccugucgaguggcugggauuacaggugcgcaccaccaugccuagcuaauuuuuguauuuuuuguagagacaagguuuugccauguugcccaggcuggucucaagcucuggggcucaaccaaucugacugccucagccucccaaaaugcugagauuacaagugugaaucacugugccuggccuuucuuucuuuuuaucauuauucugucagcuuuuuuucuguuaaaauauguacuuuuuaagcuuuuuucuuaaaagaaaaaaagaugcaaacacacacauuagccuaggcauacacagggucaggaucaucaacaucaacugucuuccaccuccagaucuugucccacuggaaagucuucaggggcaguaacacacauggagcugucaucuucuaugauaacaaugccuucuucuggaauagcuccuuaagggccuccugaggcuguuuggcagcuguuuuaaaaauacaagugaaaagaguauacucugaaauaauaauaaaaaauucgcauaguacaguaagucauaagucaguagcagucauuuuuaucaugaucaaguauuauauacuguacauaauuguauaugcuguacuuuuuuuauuguuguuuuuuuggagacagagccuugcucuguugcccaggcuggagugcuguggugcgaucucagcucaccacaaccucugccuccuggguuugagcgauucuccugccucagccucccaaguagcugagacuacaggcaugcaccaccaugcugggccaauuuuuguguuuuuaguagagacgggguuucacuauguuggccagucuggucucgaacuccugaccucaugaucugcccgucuuggccucccaaagugcugggauuacagacgugagccaccacgcccagccuaugcuguacuuuuauaugccuggcagcacaguaaguguguuuacaccagccucaugaacacuugaguagugcauugcacugugguguuaugacaucacuaugacaucacuaggcaguagaaauuuuucagcuccauuauaaucuuaugggaucaccaacauauaaguggucuguggcugaaagaaacauuguuauguggcucuugacuauuauuaaacuauuuucaauucugguugccuacucugagcaggaauagcccugggauucauuuuuauauuggaaggaaguacuguuauuaauuuucucauuuuacucuguuagagcaauuucuaaaucugaguuuuaacaguaccuacacacugucgaaucuuuccuuaagaguauuuuuuuuuuuuuuuggagacagagucucgcucugucgcccaggcuggagugcaguggugugaucucagcucacugcaagcuccgccucccggguucucgccauucuccuaccucagccuccugagcagcugggacuacaggcaccugccaccaugcccggcuaauuuuuugcauuuuuaguagagaugggguuucaccguguuagccaggauggucucgaucuccugaccucgugaucugccugccucugccucccaaagugcuaggauuacaggugugagccaccgagcccggcugaauaauuuuuuuaaugaaggauuuuauuuuuguuaaaaucuauuuccuaauuuguugaauauucaccuuaaagaaguuauguuauuagucaauuugaggauuaugugaaauacaauugaaaauacaaugcauauuuaaaauggcugcugcugggugauagguaccugaaagggggguuaugcuaucuuucauucauguguauguuugaaauuuguuaaaauauauggcauuaaauggggaugacgguguuuuggagggugcuggaaguguucuaaaauuagauugugauauugguuccaaaguugauaaauuuacuaacagccauugaauuguaacaaaaugaaggaauuuuauguuauguuaauuauacuuuuaugaagcuguuaaaaaacaaaauacgcuauauuccuaggcaaaaauuaacuuucaaagacaaaauagugauguucaaugggguuuaaaacuuacaauuacauuggcauauuuuuuuccuuagaaauauaucguaacauaauuauaucuaaaauauguaauuuucuauaguuggaaaauaauuacauauuuuauuuauaacaacuuuucugauuuuucuuuauuuuacagaauaagcagaacauuaaagaugcuuauacaacccugcuuaaccaguuggaaagauuuaagcuuucagcauuagcaccucuuuuuggaaguuuaaaauggaauaauauuacggaagagguaacaaaacauuuuaaaaagcuuuguauuugaacuaaguuuuuaguuauagaaaaguugcaaaaaucauacagaguucucauguacuucucauccagcuucuccuaauguuaacaucuuaaauaaccacggaacauuuaugaaaaccaggaaauuaacauugugucaauccuauuaacuaaacuuuagaccuuauuccaauuacacugacuuuuccacucaugucucuuugcuauuucaggauccaguccaggauaccacauccauucaguugucagucacacuuuugagugucccccagucuguaacaguuucucagucuuuucuugucuuucaugaccuugacauuuuugaagacugcgaaucaguaaugagguuauacaucuuuggccagaaugucacugaauuaaucuuggguccucaguacauccuaacaauaugucugagcauuaguuaaguuggugccugacaguuuucucuacugugaaguuacuaucuucccuuuguaguuaauaaaucuugaaggacaugcuuugugacuaugcagauccuguuucuucucaaacuuuaguugauucacuuuaauguccacaguggaucuugucugcaacaauaauuauugauguuuuugccuaauggugacuuuuauuucacucuuuccuuggaauuccaccguaagggacagcuguccuagugcugccauuuauuuguuuauuuaugucaguauggauaaauauauuuauuuuauauuacagguuaaaauccaacauuauaauuaucuuggagcucaaaauguuccagguuugaacauuagaagccccuuuagguuggcgcuuguguucuuuuacaagcccucaucuuucuguacuuucuaacuuucugaaaucacaagaugguccagucucaucuuguauuuucccugccccaccccugaaauuaacuacuuugccaaggaagaaggcauuuagaaguucagaucugaaaacuuuguuggugaacugcuacuggggugucauugcuacuagggcuuuucagcaaauugaacuaggauccaaauccauaaugguuuauuuuaccccuccccuuucuuuauuuuuaauuucucucuucaaucaugagaaauccagcuuucguuaucuacaauauauucacuuuuuuguucaauuuuuauauacacagaaaguuauuuuauuuuauuuauuuugauuuuuauagauucagggaauacauaugcagguuuguuacaugaauauguugcauaauguugaaguuugguuuucuaguguacccaucacccaauguuguacucagcagguaacucuucaaccaucacucccccugacucacccuguuuuggagcccccgugacuauuauuucccuccguauaguaauuuuguaauugcuaaccauaccugugagaaaaagucaaugagauuauaagauuuaugugcaguucuuuuuuaacuguagccauagaauauguuaauauacuguuuccaaaguuauucaggcuagugacuuucucacccaccuccuuuggugugguuauguuauccuuuauuauguaauacaguuacagucauugguuaguguuuguauuucaucuuggucccucccaccuauuuccugguuguuuuuaauuacguucauuuugaaagguaugugaaagguauaggaaacacuuccacuacacacacacacacacacacacacacacauucugguguuaaacacauagaucguagcuucuuuuuuuuuugagacagagucucaauucgucccccagguuggagugcaguggcaugaucucggcucauugcaacauccaccucccagguucaagcacuucuucugccucagccucccaaguaacuggaacuacaggugcccgccaccaugcccggcuaauuucuguauuuuuaguagagacaggguuucaccauguuggccaggcuggucuugaacuacugaacucgugaucugcccaccucgaccucccaaaguguugggauuacaggugugagccaccgcacccagccguagcuucuauuugcuugaguguuuuuaucaugaaugcaugaauguuuacuaaaauuauggauauaauuacacaauuuuuccuccucaguuuuauuaguauuguauuaaugauuuucccuguauugaagcaacucuauauuacuggaauaaauccaacuuagucauaguuuauuacuucuuaauaugguguuggauucuguuuacuaacauuuuguuuagaauuuuugcaucaguaugcaugaaugauauuucuguaauuuuguuucuuugaauugccuuuaucugguuagaugucagugugguauguucuucauaaaaaagauuagaaugucuucuccucuuuuucaauauugugaaauaauguguagaucauugggauuaucuagucuuugaagauuugauagaaaucuccugugaagccauauaguccuggugcuuuuuugugagguaguuucuuaauuuucuguauuucuuccauggcaauugacuucuuugggcuuguuaacucuaauggggucaaauuuaguaauuuauucuucugugaaaauuaucuauuucacuuaaguuuucaagucuauuugcauagaacuuugugaaguaggcuuuugugauuuaauuuaucuuguuucauuaauuacuuucccuuuuaguuuuuauuuuguguauuugugaauucucuugguuuuuuuuuaugaucagguuagcuagugguuugucuguuuuuaaguuauuuaaaaccaagaauuuugauuuauuaaugagaucuguugauuuuuuaauuuauuuugugcuuucuuucaucuuacuuuuuugguuuuuauguuguuguuucuuuuagauuuuugggggggcugggaacuuacucauuuuuaaaauucguuuauuuuuauuguuaaacauauuuagugaaauaaacuuuccucugaaucacugcuuuaaauauagcccauagauuaugcuguaaauuuuuugucauuaaaaaaauaaauucuguaauuuuaguuuguauuuccuuucacccaaguuugaccgaauagaaauguuuuuaaguuccagauuaaagcacguuugugauuuuuuuuuuuuuuuuuuuuuuuuuuugagacagucucgcucugucgccaggccagagugcaguggcacaaucucgguucacugcauccuccaccuccuggguucaagcaauucuccugccucagccuuccgaguagcugggacuacaggcucaugccaccaagcccagcuaauuuuuguauuuuuaguagagacgggauuucaccaaguuggccaggaugguuucaaucucuugaccucaugaucugcccuccuuggccucccaacgugcugggauuacaggcaugagccaccgugcccggcuacguucaugauuuuuaaaauuucuuuuuuuuuuccacuaccuuuauuguauuaugaagauguuaacauauaguuaauuuuuauggaugugcuggggacauuuaagacaaaugaagauucccuaucaccacaauguaguuugauucauaaggucuacucuguugauuauggugguuugucuuuuaucccuuaacuuauuuuuuuguccagcugucucucuuguguuuuaaaauuuguuacuauaggugaguuucucuauagaguuucuuuuaucuuuugucauuuuuguuucacaaaguugguugccaugcauauguuggauaauuuuucauaaggauuaucuuuucauuauagauuguggcuuuuagaauaaaagacugcuuuucuuuuucacauguaaugcuuuugaguuugaauucuacuuagcccaauauaaagauacuaacuucugcucucuuuuaguuuccauuuaccugauagaauuauguccauuccuuuauuuuuaguauuucugaaucacuuuguuuuaguugugugucuuauauauggaauguggugcaaguugaaauuauuuuuucuuuuauagguaagucucacauuuacuguuaugacugauacguuuggucuugauucuauaauauauuauaggcauuuguauucugguguguuuguuaaguuucuuuacgauauguguauucuuuguuauuuuauuuaaacaauuuuaaacuuugggcuguuuuacauguuucguuaugguaauuacguuuguaauuaccaugcuguaccauuuuuauaaaaagaauaaucucaauucucuguuuccuuauuuuaccuuucacuauuugguuucugaaguuuuaauuuuucucaguauccauuagcacucauuuauuguguauaguggguuuucuaggauuauuauuuuaaaaauauuaauuuuauuauuaaauuaucauuauuacuauuauuuuauuauuuauuauuuuucauugagacagagucuuguucuauugcccaagcuagagugcagugacacgaucacagcaaccuccuugccucccugauucaagcaauucuucccccucagccucccaaguagcuggaacuacaggccugugccaccacaccuggcuaauuuuuauuagaaaugagcuuuugucauguuuucuaggcuggucucgaacuccuggccccagccucccaaagugcugggauuauaggcaugagccaccgcaccuggcccaguuuuguuuuugauaagaugugcaaugauacaaauauuuuucugucuuucauuuccacuauuauuuuucugaccuuuuuugguuuuuauuuuaugucauuugguuguuuuccuaccugucuucauuaaauuuuauugagauuauucuccuuugggcaucuuguaacuuauucuuuauuucugcauagcuuugcauuuuucuaugauuauuuugcggaauuaauuauuuauugucuuucuuucuuucuuucuuucucuuucuuucuuucuuucuuucuuucuuucuuucuuucuuucuuucuuucuuucuuucuuucuuucuuucuuucuuucuuucuuucgucucucucucucuuucuuucuuucuuuuucuuucuuucuuuccagcccuguuuuugguuuaucaguugcugaauaaagaucauuuuuuggcugggcgugguggcuuaugccuguaaucccagcacuuugggaggccaagguaggugaaucacaaggucaagagauugagaccauucucaccaucauggugaaaccccgucucuacuaaaaauacaagaauuagccgggcaugguggugcaugccuguagucccagcuacucgggaggcugaggcaggagaaucgcgugaaccuggagauggcaguugcagugagcugagauugccgaacccaggagguggagguuccugugggcccagaucaugccacuguacugcagccuggugacagagugagacuccgccucaaaaaaaaaaaaaaaaagaucacuuuuuguauguucgaaugcuuguuugaguauauccauauuuagaauguagacuuagagauuucuucugcuuuauaauugcugauauuauuacuacuuuuggagauaaugaugagauuuuucacacaauuugugugaauuuuuuuuccugcuauuauuuuuuguaauagcucucuauguacuuucuuuucauuuuaaugauaccgagguuuguuacaagauacuuuaauucgauuuaauccaauccaauuaauuuaauauaauuuaauuuaauguuaucuuuuucugccagcuugucagaauccaggcauguuagugggguuuuuguuaguuuguuuauuuauuuguuugguagugggugagugguuuugggucuucaaauuaccugcuuuucuucugacuugcagagcccucaaauucuucuuugucuucuuuuacucuuucgccacuuaauugccaaaggauacuucuuccuuuuuuaaagcuuccuuuucuuucccaaaccuguuuucagaaaauuguccccuuagguaguuccuuuuaaauaguuucuauucuuuuuaaaaauuuuaaauuaaaaaaauauuuuugauugacacaucauaacuauauauuuaugaaguacaacguuuuguuuugauauauguauacaacgugacaugauuacauggagcuaauuaacauauccaucaccuugcuuaccuaucauuuuuuauugugagacauuugaaauuuaugcacuuauuuugaaauauaugacauuauuauugguuguagucauccugcuguauaauagaucucaaaacccauuccucuuuuuuaucugaaaguuuguacccuugggucagcaagucuccguuucuccccucacccucugaagagaagaguuucucuucucuauuucuaugaguucaacuucguuagauucuacauauaagugagaucauuugguauuugucucuuugucuuggcuuauuucaccuagcauaauauccuccagauucauucauguuguugaaaaugacaggauuuccccccguuuuaaaugcucaauaguauuccauuguguauauauaccucauuuucacuguccguucaucuguugauaaacacuuagguugauccacgucuugauuguugugaacaaugugucaaugaacaugggagugcagauauaccuucgaaauacuguuaaaagaaaaacuucagcugaauuaaauuuaaaggaguuuaauugagcaaugaacgauucacauaucaggcagccuccagaaucacagcagauucagagagacuccaggggugccucauggucugaacaaacuuauagacaaaaaauguaaagugacauacaggaaucggaagugagguacagaauagcuggauuggguacaacucugcauuugccuuauuugaacacaguuugaacgcucagcaguguaugagugauugaaguaagggauuggccaagacagcgacuguuacaagaacauacuccuaaacuagguuuucaaucuugucuaccuauuaaguuacauugcaauucauccagaaggauucaaauauagaaguacgaaguccuucuccagccauauuuaguuugcuuuaaccauacuaauuucgguuccuuuggauacauacccagacaugggauuacuggguccuaugauaguucuaauuguaguuuuuugaggaagcuucauaucguuuuacauaaugccuguacugauuuacauuccuaccaacaauguauuagaguucucuuuucucugcuuccucucugacacuuguuaucuuucaucuuuuugauaaaagcccuucugacagaugugaggugauaucucauuguaguuuuaauuugcauuugccuaauuauugguauaauuauuaacgcugagcauaucuuucauguaccuauuggccguuggguuuuuuguuuguuuguguguuuuuaguaaugacuguccaggucguuugucuauuuuuaaaugggauuauuuguuuucuuacuauugaguuugaguuguuucuauacuuuagaucuuaacuccuuauuaaauguauaguuuggcugggcgcgguggcucauaccuguaaucccagcacuuugggaggccuagguggguggaucauuugaggugauuaguuugagaccagccuggccaacauggugaaaucccaucucuacuaaaaauacaaaaauuagccuggcaguaguggcacaugccuguaauccuagcuacuugggaggcugaggcaagagaaucgcuugagccugggaggcagagauugcaaugagcugagauugggccacugcacuccagucugggugauagagugagacccugucucuaaauaaauaaauaaauaaauaaauaaauaaauaaauguaucguuugcaaaaucuguggacugccucuuucauuugcugugcagaagauguuuacuuugaugccaucccauuuggcuauuuuugcuuuuguugccugugcuuuuguggccguauccaaaauaucauugcccagaccaauguuguggagcuuuccuccuauguuuucuucuaguaguuuuacacuuucaagucuuguauguaagucuuuaauccauuuugaguugcuuuuugcauauggugugaggaucuaauuucauuucauuguuucucuuguuauacagugagcucuuuuauucuauguacacagguuuccuuucgucucagaaaaauuuuauuauuucauuuuuuuaacuuuaaguucagggguauauguguagguuuuuuauggagguaaacuugugucacggggguuuguuguacagauuauuuugucacacauguauuaagccuaguaguacccacuaguaagaucacuuacaaauaaaaauauuuuucuaaauagcaugacacauuacaauuuuuuucuuugacaggcacacaagacuguaucucugcuuacacaagucuggccagaaggaucugacauucggcgugucuuuuguguuacuucaugcucauuaucuuugagaauguaccaucgcuuuuuaggaaacagagagcccuccucuggucaggaaacugagauccaacaggugugguuuuuauaacuuuacugagaaauacuauuucucuccacauuugaaauuuuguugauuuguaucuuucauuuccucuauuugguacuucauguuuuucucuuauuuauauaaacuucagaaaauaaaacugaaauuugugucuaucaggaaacacuuauugugccauuaaaugauuuaauguuuuacuaugugcauguuucacuuaguauauauuuagucuaaaucauccaaaagaaaaugaaacaagacaggauauuagcacuugguggaggccuaauaugcuaguauguuuugggcuuuuuguaugcauugugcccuuaaauccucacaacagcauugugagaaaggcauuaguauucccauuucaccuaugagaacacugaaguucaaauaguccagguaacauuuuucaaaccaaacguacuaaauagcaagguggauugaacuccgguccaucuugugcaaguuccacaauaucaaagugucuuuugaaagaaccuuccugcuguagugucuuggcgucauccuagcuggagagauacuaaaguuuuuaacuuucuuuauggccaguaggguccauuaagaaucuguuggccagucuguuuuccuucccccaauauacaguugucucuaaguauaugugcuuaugggugugcguguuuacacauacacacacacacuuacacacucagacgcauguguauacauacuauucuguauacaaucuaccuacugggggauucuuggcugaagguuucuauuaaagagaaaugaaguuucugaacauuucagaaauauucagggcucauuaucuuuuacuuagcauccuuauaauuguuuuuccaauuaucagauugaauauauuuuuagugaaacauuucuucauaacuagacauaguauuuuaaaucauucucacaaaaaugauacuaagucaaaucugccucucuggaauuucuaaugauuagacucuauuuggccuucuggaggugcccugaugaaaucuuacacuugcuuuguugauagcccugcaaauguuugaagauagcuaugacguucuugucccaugauaucagauguguccacuucuuuacccguguucucacagggcagguuuuucagauauauuaccauccugguguccucgcccugguaauuuucaauauuauuuaaaaauaugaugccuuggaugggauagagcauuuaauguguggcuccaucagcguagaguccugugaaauuacgacuuuauuaguugcucgaucagcucauguagaguuuggcuuaacuaaaaauccugaaaaauguuuuauuuuaaaugcgauuaagccagcagcuucccauuccacuuaccucacaucuguauaaaugcaguagaguuuauguuauaaagaaaaggaaagucuuaaaaaauguagaaugaaaaauguaauaauucagcugggcauggugucucacacgaguaauccuagcacuuugggaggccgaggcagguggguuaccugaggucaggaguucgagaccagccuggccauggugaaacagugccucuacuaaaaauacaaaaauuagcugggcaugguggcagguaucuauaaucccagcuacucgggaggcugaggcaggagaaucacuugaaccuuggguuggagguugcugugagcugagauugggccacuucacuccagccugggugaaagagcaaaacucugucucaaaaaaaaaaaaaaaaagaaagaaagaaagaaagaaagaaaggaauaauucaugauuccugaacagcaaagguagcugucagcuuuugugguccuagaugcuuauuaugcaaugucacacccugcuguucucuggcuuauaccuucuuuauuuuauucaggugaacaguaauugcuuaacccugcaggagauggaagauuuguguaaacugcauugucucacugugguuuuucuacuccaucugccucuuucucaaagagcuugugcuagagucaucacuucccauugggcugaggacaugaagccuuuauuacaaaugguaaauguacucuuuauuaguuuacuauuuuuguguuuugaauguuugauagaaacuacaauaacuuucaaaauucucuuaugugggacuacuauuagccccuugggggcuauaaaaguuuaaugggcuacaucagucacuuuccaauuucagcaucuauguuuaggagaacuaacaaauagcaugauauauaucuaaccuaaggaaaaagccucucuauuuuuccuuuguuaaaucucugccaaggucagguuuuuguguuaucaacuguaguugaugguuggugaucacuguggucugcucuuaagaggaacugaagaaaucaguuuuguaguuuauuacuuucaacucuuauagagaauauuuagagacaauuuggauacuuuagagaaauagaagcaaaaacagaagaaaaacuuccccggaggucuaccauuuuaaucaauagggauaacuguuaacauuuugguuuauucuuuuuauuuuaaaugcauagauuuuucugauguuuuauuguuucuuauauuggaacucuauauauacauauauuuuuucauguuuuucuauuuccuuucacaauauuaguaucauuuuuaauggcuacuaguuaucuuuuaguaccaugguuuacuuacccauuucucuauuauggaauauuaagaagacuuugaugguuguauuauagauguuguuauucucuuuguguauaagccuuuuccuuuaauuugggguuauugauuuuggcuugagagcuagaaaugggauuaaaggaucaauuggcaugaacuuuuuuuaaggaucauuauacauacagugaaaauguucaaggaaaguauuuuaugaccaauuaacuaggaagccaguccacaaacauuuaguacauugugguaaucacugggauagagugagaaaaauaaaaacauauuuacccuucccacuccaaccccuucauagaccuacauuuuccacagaagacagauauuaaauuuuaaaaguaauuaugaagacggaaucauagaaugcuuuauaaucugauaauaaaaagauccaacguagucugaaaacgaugguguuucuuaagaaaugaagacaggccggccgcgguggcucacaccuguaaucccagaacuuucggaggccaaggcagguggaucaugaggucaggaggaucaugaggucaggagaucaagaccauccuggcuaacauggugaaaccccgucucuacuaaaaauauaccaaaaaaaauaaaaaguagccaggcauggugguaggcaccuguagucccagcugcucgggaggcugcggcgggagaauggugugaacccaggaggcggagcuugcagugagccgagaucgcaccacuguacuccagccugggugacagagcgaggcuccgucucaaaaaaaaaaaaaaaaaagaaaagaaaagaaaacagaaagaaaugaagagaagugaagugacccaaguccuggaggaauagaaggaguuagcaggaugcagagaggaugaaacuggauuguagggcgugaagcagcaugugugauuaucccgaggauggcauaaccaaggaacugagauacaucuaucacagcagggguagcaaaaauaugggaaagugaugaagcugaagaggcgggcaagagacaagucacguaggauucuguaggcccuguuaagaaaauacagauguaacuugauagaagcccaaugaggauucacugagugguuucaaauggaugaguggcacuugcauuugcagaaacuuucccuggcuugcaaugcagagagugcauuguagaggcaaaacaggggggacuuggggaaauuagguggcuauuaccucagucauguaaguguugauggugccagggaccagugagagguaaguagggaugaauagcacugggcaauuuuaagaguuauuuaaggugaagaaugacaaguuuagugauugaauauggguaacgagggaaaggaaggagucaaauaguuccuagaccccuggcuugagcauuuguggggaugccgucauuguaugaagggcacguuaguggggaaggaucaaugguuucuuuuuuggaaauacugaguuuugagugccaaugcaauguccacauggagauaucuaguaaacaauuugaaauaauguuuuggacuuagaaggguggaaugggcuggagauaaaaguuuaggaauuguuacccuguggauguuaauugaugcuaugcuaagagaugaaauuauuuuggaagagagauaugguaagagagcugaggacagggaguucaaauauuccaauauuaaacacuuaaguauggguugagacaguggcaaaagauacugagaaggaacuacuuagauagaugggaauaaaaucaaggagaauggguuguccugaaggucaaaggaacugggcaguucaaaauguggaugugguuaauaguaucagcugcuauagaggauuguaauagguugaggacugaaaauacauugguuuuaaugaaacggagcucacuguugaucauaauuaagagacuaaggucuagguuguacuuuaccuaauagaaaaccuuagucuuuaauuagacauaacaacgauccucuuauguccucauuuugcaaaggaaaaacuuggacucagcuaugugguccaugagcacagcuaaugaaugaucaaguugagaucugacuucacucuguccagcuuccaaauauaugcccuauggaguaacagcugaucagcccauagucagccaaccuuccugccuuucccauacuccaugccugauauuugguaacacucuguagcuugaaguguaauuucagguagccccuaauauuuucaaaauaaaagaaauuuuugacauuucuugaggccucuugagaaagcaacuaagcaaaucguagaagggaucauuccaugagguuuacucugaaucuugaagcauggagaccagccagguagguggaugggaaucuuaagaguuugaaggauucagcaucuucuaggucccugaacacucaaacacauuuuuuuaaaugcucuuuugaccugaagguugaaucugaacauauuaaaaucuaaauaaagaacagaggcacauuucaaagcagaaguauuucuguagcuuuggaauucuaucuguggguaacagugugagaaaaacacuauuuuaagagucaaaugcagauuuccuugauucgggauaaagaacuauacagaaugcauuuuuggaucaguuuuuauuuuauuuuaugcuuuaauuccuuaagguguaaagcauucaccauuacccagccugaaugggcuugccuaaacaaggauuggaaugauccugcccacugccuuucaguucagaagcauaugaacccuauaguuuauugcuaauaugaauauugccaauaacuugguuuucuuuucaauuuucagaaaaaguggugugaauauuucaucuuaagaaauauacauacuuuugaauuuuggaaucugaauuuaauucaccuuucugacuuaaaugaugagcuuuuguugaagaauauugcuuuuuacuaugaaaaugaaaauguaaaagguaccaucucaguauauuauaaucauacuuccauccacagauaaacuuuauaaggaauuuaaaacuacaaaauaauuuuucuguacuuccaacauauaacauagcaauuauuuucaucuuuguucacauuuguauguaauauuuuaguugcaauuagagggaaugcuguauuuuaaaauauguuuuucacuuaauauuacauuaaaaguauuucaggagaaaauauauguuugcguguccagcauuuucaguuaauuucaaaaguugaacuuuucauuuaaaugcaugcauaauauuucuucauaaaguuuaauuaauuuaauuauuucacuacuauugagauauuuagaaaauuuauuuuuuuccaaaagauaaggcuaauuuauauauuuuuauauguaauuuguuuuucuuucuuuaaaaucuuuucuuaggguaagauuucugauguuuccuaauaguaaaaccgaacaaaacaaaacaaaaacauauuuggacagaacucuaacugauugaacauuauugaagcuuugaccacagugaugugguuccuucauguuguaaucauuguaaugaauuagcugcauauaaacuuaacaauccuuuaccaauuuucucaucucucaaaaacuaaaguuuuuauucuguuuuguuuguuguaaaguuauguguggcauaacauuuuuauuaccuuaaagaguaguuaaauguucacgaugcguuuguggguuaaugugcuuacaaauuuaauacuuaguuauuaacaauaaaaacaagauaaacuuuacaaucuguaucucauagucaacacuagugaccauuuucauuuauguccaguguggaacucacuaaaaauuucacuauguggaaaguauuucagaauuccaugaauuuacucaaaaugugacuaaugauucuuuaugugggaguggauggcuucuaguauuuaguguuuuuaauuguuauguaggccuacauuugaauuugggagauaccauuaugaaagauuaugaauaucucuggaauaccguaucaaaguuggucagagacuuugagguuggacagccauuuccucugagaacaacaaaaguuuguuuucuugaaaagaaaccaucaccaaucaaagguaauaaauuucuaaauuaaucugaaaugaaagcauuauuccucugaaaguguuuaggaaacaccacuaauucagugcugcaaguauaaauaauuuucuggcacuugaauuuuaauaauaaaaauaaauuaccuuuauucuuauauccuuggagugguaugcugugacuauaauuaugaagauuuacauuuugcuuauaauuaauauuguuucaauuaaaaaacacagccagauauauaugacuuccauuuccagcaauauggcaguuauagguccacagaaaaaucucuuuguguaaagcacuugagaugcugaauaagagacaccaaacaucuuuuuauaacauuauagcuaagcucaaaacauccuaggggcugaaaaauuuagggaaggccacaugggcucuccaccucuuuuaggcagcaaguugcaggggcuuaaauaagaaaggaucccgacaaacgcaggcacagggagcacuaggaggaucccaggcagagcaauggugguuaaccuggaaucaugaaccagacauucaauagaauaaaaagucauucauuugucuauuaucauaauauacuugauauguaauaucuaucuaucuaucuaucuaucuaucuaucucgugugguguguguguguguguguguguguguguauaaaaucaaggaggacucaagagaauacuguaaucauaucaaauaauuucauuaccaucuguauuuuucccuacuucuuuuuuauuucauuuucaugaaagucuuuguauauguguauguauauguauauagauauauaaucucugaggcuuccaucgucaaaaucuuugucuuauaauaagggauaauaaaaggaauucacauuugaaaauaaaaggcauagguauuuuucuuuaucuuccuuccuuucuuccuuccuuccuuccuucuuuccuuccuuccucccucccucccucccugugugcuugcuugcuugcuuuucuuucuuucuuucuuuuucuuuuuucuuuccuuccuuccucccuccauccuuccuucccucccuccuuucuuucuuucuuucuuucuuucuuucuuucauucuuuccuuucccucccucccuuccucccuuccuuccuuccuuccuuccuuccuuccuuccuuccuuccuuucuucccuccuuccuuucuucuucccaucuaccuaccuaucugauuuauccaucugucaucugucuacuuacccauccauccauccacccauccaugcauacauccauccacccauccaugcauccauucacccacccaucccccaugcauauccacccacccaucccccaugcauauccacauauaugccaaaaugcugucugauucuuuauacucuacuguguuccaaaguguuuuacugugggaaauagcuuuaugagaagggcugaacuugauauauguaaauaagauuaauauaaaauguuuuuaauaugaaguuuuagaaaauaauauguaauauuccugucugaaagcuuuacauuugaccuugucucaauuuuuuuuuguuuguuuacagacagcuccaaugaaauggugcccaauuuggguuuuauuccaacgucaucuuuugugguugauaaauuugcuggagauauuuugaaagauuugccuuuucuaaagagguauaaggccaaaaacugugccucaauaaauacuuguguggaauacaugaguuacucaacgaggauuauuugaaaugcagacgauuagaguacauuacauguaguauguguuuguaauacauaaugaauuuaaaaucaaaauuuucaaugccuuuuggccauuacuauguaaaaaucuguauaguuuuuaaucuuagaauaaaucacuacagcugcauauuuuaaauuaaugaauuaaugaaugccuauuaguugauauugaugggacuguuagagacauggaguagauuuugauuuauuaaaccucuaauaaacugcuguuuggagucuaccacccacaucauauugcagaaagaagaaggggaacuaugauuuucaaaaacauuauaaaauaaaaucugugcuguguuauauuuggaagugugcaauuuaaaauaugccuuuuuuugucucacagugaugauccuauuguuacuucacugguuaaacaaaaggaauuugaugaacuugugcacuggcauucucauaaaccccugagugaugauuaugacagguccaggugucaguuugaugguaagcucugugacuccagugauauaaauuuaaaucuacuuuacucucugccucuuauuuuauaguggaaaauuaucauaagacacaaauuaaauuuuuuugaaugaaaauagucuacaagauauuuagaugugcauugggaaagaugguaaugaaaaauucucucucucuuuauugacagucguacguauguagauauguauguguuuuaggaggaagugcuagaaguuguuucaaggaaagaugguuuguaguuuaagcaauguauguauuccuuggagucauauauauugagaccauagucuuucaagcaauuuuaacuguuugauaacacccgauuggcugcauguaacaagcaccagcauucuaucugccuucaugcucagggugguugaaacuacagaaggaggcccaugaaaccacuaacaguggaucaacagagacugaauuugggaucuugucuucaucucaacuuucuguaucccuaugcuuacccccagccccguuagaguugacaaaacuuacucugagaauaaccuaggaguaggcauagcaaguaugcuccugugaaguaccuggguauguaaauaaugaccaagguguggggggauacuuuagaugaaccauuaacaugcuucggaguggucuggugugauauguguaguuacagacauagaaaaauuaaucagcuuaguuauuucauuacugugaguauuacaguuuuuauggagauaagggaguaaggcauaucuugacuuugggggcaucuuauguuauuaaauuuuaccauuuuagcugccaugcucugggcucuggcucuauggcuaugguccggaguaaggauuuuuucuauccagugauacaagaagucagaauaucuuagaugguugucuucuucacucugccucuaccuucuucuuaaacuaauucacagggcacaggacauagguaaugaauggaauccgucauuuuuuuuguugcaccugauaccuaauuuaggagguagaccaugaaaguguguuuugucacuuccaucuuuuaaauaagaaaaggaauuauuaacuugauuuuacguucucucuuuaagaaagauaaugagauuaaauuacuuuuccacuaauuuaacuacuggauguggaauaauaugaagaauugaugagaaugcuauugaaaaacuacaauaaaguuacauuuuaagucuuuucuuuuucagaaaaaucuagagacccucguguucuuagaucugugcaaaaguaucauguuuuccaacgguuuuaugggaauucauuagaaacagucucuucgaaaaucaucgugacucaaacuauuaagucaaagaaggauuuuagugggcccaagagcaaaaaggcacacguagguucuauaaauucuauccaauuaaaaaaauuuuccuuuucuuuuaucagguugauauguguuaucccuuuggugguuucuuuuuauauaaugccuuuucuugauauuuauaugcauauauuuuuguauaugauuacuuauucuuuuaccucuugcugaaaaagccuaaccuucauaaaaaaguuguaaugauauucuauacauaauaacauauguaucucuuugaagaauaauuaagugacuaaaguuuugaguuuagaaauuuuaaacuaacguuaaaaauauaguuguucauuaaugacagugaaaaucuuuuucauauagguaguaaaaauggauaugaaauguuuaucuacuuuuuuucuaaauuauaaagaguguuuacacuuuuccaaaguauuuaaaugauugauuaauccaacacauuuuuugaguggaagguuagaacucuccauucccucuuucuguguggcuuguacuccugcaaacuuaccuuuuuccuucuugggaugucauuuuucuacucuuuuccugggagacguaacuggggauggaauacaaggaguaaauaaggaaaguuccaaucuauuucuggaauaauaauacuaauaguuuaugaucuaaaauuaucaguugauaauuccugaaacauuaaugucuaaguacagauauuuuuauuuuaaaacugaauuuucugauuaucugacuuuagaggcaggucauaaaugguuuccaucuuaaacaaauggaaaacucaucaggcuuuaguaucuuucuguggccucaaaguugggguuuuggaaauggcauuaauuuucacaaaaaaguuucucucaagaugaaagguuuuaguauauuagagaaaguaccaacuuaacaaaaccaaucacaaauaaagguauuugucacauauccaccuuaacaaauugaaauaaacguggugaaguuaucaggaauggaacauauaaagaccucaaaaaauauuuuuauuuucacuucugaauaauuacuuuugcgaaaauuuuggcaagaucaggaaaaugugcaucucuuugucaagccuucaguggacauuuucagaacuccgagagacagauaguucaucaguucaaggacuuaucaaaaaaguucuuguauuuucuacucaggauaacuucaaaaaauaaucacaaauuacucuaaaagguucucacauguucugugaagccucuauucuugaacugcuucaaaaguuuaagcaguugggcugucccaucuuuuguuuuaagagccaaagagaagccucucugagcccaacugugugaucguuguuucucuccuccuuuucauuuuuauagccaauuguauugucagugagacuacuuaauuaaacauuuacuuuuuuauuaugggugacaaaaggcuacugcuuuucaguuuuuuuguuguuguuguuuugagagauguuaugaaaugguaaauuugcagaaauucuuguuacauaauacaauguaugaaaauagaaaaaucuacauggcaaagggucaaagguaacccuuguacuauugaaacagaaccaugcuaaauuggcccaacacagcaaauuaggaagacuaaacacugggaaaacucaaauauuauugauuagaauuauuuguuucuaauuuagagagugaugacaacuaaacuugacuucauuauaggcaggcauuuacauauuaauuucgugacuaaccagaaguguggaaaauguguuggaauccucuugcuaauacaacaauucucuaauuugucuuuguagauuaaugagucagguugguaaaagcauaguaaaaguggguccauacuauguuuaaguuaauuggaagugcuuauugaggaagagcaaaucaguuguauuuguguuguuccucuuaucuacuccucuucuuccucuuuccuuauucacucaucaaacauuauggacuaaaugcuuugugcuugagacauacagacaacaaaggcacauuccugucucaaggaucucaaucaagagaggaggaauggcaaaugaaauuacaacuacaguuuauguuaaugagugcuucaauaggugucugagcagaggaagaauacaugacuucgacuugggagagucagggaaagcuucauggaggaaauaucauaaacaaguagagaacagggaggugaugugggaagaauggaagaggacaggcgauuccagagagagcagcagauaucauagcauggagaaaugaaaagagaggcagucuguugucucugauuuugugacauuaacuuuucuucuucuuuuuuauuuuucugagacagaguccugcuccaucgcccaggcuggagugcaguggcccaaucucggcucacugcaaccucugccucccagguucaagggauucucaugccucagccucccaaguagcugggacuacaggagcgugccaccaugcccagcuaauuuuuguauuuuuaguagguaagagguuucaccaugugggccaggcuggucugaaacuccuggcuucagaugauccuccagccucagccucccaaagugcugggauuacaggugucauucaccacgcccagcaacauuuacuguuuuauuuauaaaccacaccacucagaaaucuagaaaauuaucuacagagagccuuuacacucccuaaauuaaauugucuuaaguuauaaauuaacagaggcuuaauuuccaaaagaaaaaaagaaauuuuucacaucuacucaaaaugggaugauggucaaagucuucaauacacccauaauauugucucacucaugaccuguuaucuuggaauauuuucaacuugucuuaagagauguuuuuuccuuuggggcaggagaccaaggcugaaauaauugcuagagagaauaagaaaagguuauuugccagggaagaacaaaaggaagagcaaaaguggaaugcuuugucauuuucuauugaagagcaauugaaagaaaauuuacacucuggaauaaagagccuggaagauuuuuugaaauccuguaaaaguagcugugugaaacuucagguugaaauggugggguuaacugcuugcuugaaagccuggaaagaacauugccgaagugaagaagguauguaauucuguuuuguuauuucggugaguuggagaauuaauacaaauguaaugaugauaguugccauuuguuaacuggaaauuugcauuagaagacuuacaugcccuaucuuacuuuauacauuauuaccuuuacaauaguuucccgcuaccugccggggguauguucuaagacccacaaugguugccugaaacuguggauaguaccaaaugccauguauauuguuuuuuccuaugcauacauaccuaugauaaaguuuaauuucuuugaacuccugcucuugaacuccugacuuugugauccaccugccacggccucccaaagugcugggauuacggacgugagccauugcgcccagccacuguugucacuuuuuaacucaucaaagugucucugugaagguugccauucuuuugugauuauaugggugacuuuaaugcuguguuccaucugagaauuguauuccauauuuuuucuuuuaauauccauguaauuugaaacacuucagcaaauucagguucugcuucagguucuucaucuuccucccuagaugacucaauaaguucuuccauuuccucauuuguuaacauuuccuaaugaacuucaauauguuguuucacuucuuuaucaaacacguuggcaaaucucucucuaucaaucagucuugcugcaugaauuauuuuccuaacuucuccauugauccccaggaagucucgaauaucacucaggacuuuacuccauaaauucuuccagcaggcauuuauaguuuuuggguuuaauuaauccauugcaucuuuggugaguguuauugcaucagcaauagugaauaauuuccagcaccuuaucauguccagauuagggucugcaucaauugcugauugaauguaaucaaacaccaggcagguguauguggcuuuggcaaacugaaugaugccauagucaaggcgcugaagcagugaguuuguauuuggagguaaaaauacaaucucaauguuuucauuuucaacaaaaacagauuugggauggcuaggugcauugucuaguauuccaagcuuuccucuuucaaguauuuuuucacuucugggaagaagcauugguagaaccauuccauaaaaauguuggcugucauucacacuuucugauuauguugccagaacacaagaagauaauuuuugcuuuuguuuuugagaguguaugucuucuucagucuguaugcuaugccugucuuuauuauaugcacugcagcauugccaccuaguaccaggguuacucuguccuuccauguuuuaugucuuggugccuccuuuggacuuuuaugaauguguagguucuauugggcaucuucuuccagaagagccugguuucaucacaauuaaaaccuugcuuuggaugguauccuuucuuucuaaccaacuucuucaacucugccagaaauguggcagcagcuucuucauuggcagauggagccucuucagucaguaguuuuuuuguuuuguucuguuuuugagauggagccucgcucugucaccagacuggagugcaguggugugaucuugcucacugcaaccuccgccuccuggguucaagcuauucugcugccucagccuccugaguaucugggacugcaugcacacaccaccaugcccagcuaauuuuuguauuuuuacuagagaugggauuucaccauguuggcauguuggccaggaucaucgaucucuugaccucaugaucugcccaccuuagcuuuucaaauugcugggauuacaggcgugagccacugagcccggcccgcuucaguauuuuuuauauuuuucaguccaaaccuauuccugaauuuguguaaccauccuauauuugaagaaaaugggucauugucacucauuucagaggaugccuuguugaagucuucauacagauucaaugcuuucaggugcaacauguuuccaucaccuggaaaauauuuucuauucaugucuuccaccuucuaucuuaacuaagcacuuaucaaacacuguguccaaaacuuuugccauuugaggugcaacagcaaaacuagcacggauuucuuuuuucuucuucacaacuucauggauaaaagauuguuucugacuguagaucuuagcaaccucagcauaugaguuuuucuucacuuauuaagucaagaacuuucauguuuucacuuaaagaaagcacuuuauggcuucuuuuuggcauaucugaauugccaacaucacuuauuuuacaguuuggggccacuauuaaguaaaagaaggguuauuugaacaccaacacugaggcaucaaugcagucaaucugaucaucaagguggcuacuaaguaacuaaugggaagguggugucuacagugugaacaugggggacaaaggaaggauucauguccugagcaggaugaagugagauggugcgagauuucaucacacgacucaaaauggugugcaauuuaaaaacauaugauuuauguauuucuggaauuuucuuuuuuuuuuuuuucuuuuuuuuuuuuugagauggagucucgcucuuucgcucaggcugcagugcaguggcacuaucucggcucacugcaagcucugccuccuggguucacgccauucuccucccucagccuccugaguagcugggacuacaggcgcccaccaccgcauccggcuaauucaccauguuagccaggauggucuccaucuccugacguugugaucugcccgccucggccucccaaagugcugggauuacgggugugagccacugcgcccggccuggaauuuucauuuaauaguuuugaaccacaguuuagcucagaucccugacaccaccaauaaaaggacaauuuuguauuuuaucaaugagcaaugaaaucucagagagggucccaagggcaaauauauagcacauccauaagcaccuucaaagacgggugcaaaaagaacaacuuauaagguugugggcgugguuaagggaaccaacaaaaacgaugaggcacccaggaagaaucugucauucaccuuugagaccaaugaguaaacauuucuuuuuuggguaacacuguauucaugcuucccuggcacgcugaguucuuccaaagcugcuguggauaccaugugcucuacuuuauaauuuccauagcagguaguaaaaaagaaaagaagaggcagaaagaggaagauacaggugaaauaggaucacaucaagauguguaaacucacggcaagugaaaugaucuuguuccauaauaccuccaaacugacaguucuucugagcaaaccuaguugaucugucaguuuugagcaucuccacacuuugauccauuuaacacaugaccuccauguucucuccaacacccugaccuauuguuucucuccagcaaccuccuauuguuucugcugcuuaauugggaaugaucaaguguuaugcauuguuuuucuaagugaacugcucaccuagaaaaacagugcauaacaaucaguaugaacuguauuacauuuccuuuguagccucuuacuguauucaguagguguuaguuaauauuguuaaauaggugaaauauaggugauugauuagaagaaacccugacauaauaaguaugaaauaauuagcagagcagaggaacaaaaaggguauguaugaauauaaagcaauggagagagauuagcaacaucuagaaugugacaguuggaagagguggauugaauugaagggcuccaaugaguacaccaaauacuuaucuguggucaaccauaggacucaauaaauguugcuaagguuuuaaccagauauuucaaguaauaaagauauuuuucuuugaacauaguagagcacauaugaaaauaaaagauggagaaaauauuuguuauucuuccuaaacuuuuacaaacuugagcuuuuuugaucuuauuucuauuaugaacuacaauuuuuuucccaacacugauauagcuacaucucaacaauccacagagaugaugaaguguggauaguggaacuucaauuuuacuuuauuugguccuuucuacuccaaaaccuccacuaaugccaagugagauagugaggccaucuagaugauuaaucuuggguaaucaaaugaauuauuuuugauggucuuuauaacaauuuuauuguuuauuguuuaucaagguaaaaccacgaaagauuuaaguauagcuguucaggugaugaaaaggauccacuccuugauggaaaaauacucagaacuuuuacaagaagaugaucggcaacucauagccagaugccuuaaguauuuaggauuugaugaguuggcaaguucuuuacauccagcccagguaauauuaucagaauagcucaauuucaacaggguaauuauuagguauacauaaaguguuuugcaaagauagucaucucuuccagauuuuuuuuuuuuuuuuacugaaaauacuauuauuaguaguaacccaacugcccaaucuugaaguaauacauaaugagaaaauuuguacaaaugcuuaccuggacaaacagauuaaaugccagauaaucucugcagauccuuuaaaacuaacccugcacuuaauucuagcaaaacaucucaaaacuagugugauuauucaauugucuuuaaauauaucagguuguagccacaaauaucaugacguauauuugaaaaucuugaugucuacuaauuuuaccuaguuaagacaaugauuuaaaaaauuuaaauuuaaaaggugguaaaaugcuuuucacauagaaagugcucaguaauaaauguuuuacuuauuuaaaugauauucuaauucaaugucauuuucaaaauggacuuuuaaaauaaugcaggaugcagaaaaugauguaaaagugaagaaaaggaauaaauauucaguuggcauugggccagcucgguuccaacugcaauacaugggccauuauuugauacgagaugagagaaaagacccagaucccaggguccaggauuuuauucccgacacauggcagguaauacugcaaaugaaacaaaaauuacuguauuuucuuauuauaugugaucucagagguuucucauuauuguggcuguacauguuauauuugauguucaugucauuuaaagauacuuuguuauugaaaaugucaaauguggacuauuuuuuccccauuuaaagaaagugagauuuucuuuuauuauauagaccauuuccuuggagguacauuaauggagucauauguuuagcucugauguuaucucagugucauccagcuguaucaucauggagcagccuccagguuuuccgugugucaauaggauuucauauguaaauauauaaagugcauagagaaauuuggauaguuuaaauaguagggacaauuguuuagauauuuacacauugcaucugucaccauaguagcuauucuaaaaauguauauaaaauuaauauugagggauauaaaauuuagaagaaaaggaugcauuucuacauacauugaaccauaccaacuugcugauaaauugaacauguuugccuacagaaaugcaguuuuauagcuucagucuaauagacugcccccuucagaaucuuucuuaugauggugggguagguuaaaaaaugcauggugccuuuucaugaauaggaagaccgguuccuugcuucagugcaggacuagaggcacuaaugcucuccauuaauuucauucacauuguaacucuucugaugcccaauucacgcugagguguggccgggaguggaccgguugggguuuugaguuguuuucccaccuucuaccuauuacauagacuuauuaucauucuucggcuagucaacauucuucggcugaagggauggagcucucucauccuggcauucuucuauguagaaaguagaauaucaguaguaaaauuaagaauguuugauguuucuucuccucagcuauuuucuucaccaucaguaauauacauauugucucuuucuuagaacuuaguuucucaaccgcacuuaguaaauagcaaauaauuacaagauguuuucucaauaauaagauauuuuguucagacauccucuccauuugucacacauaaaacccaccuuacagauguucaaaagcauaaaaaugaucucuucugagagaaugacaugagaccuucagauguaccuacagauccuuugagguucagaaaaucguauuggaagucuauaaauacugucuuuguuuugguaacauacgguucaguuucuugacaugaaugguacucugcacccugcagcgagagcuccuugauguuguggauaagaaugagucagcagugauuguugccccaacguccucaggcaaaaccuaugccuccuacuacuguauggagaaagugcugaaggagagcgacgacgggguggucguguacguugcacccacaaagguagugcucaagugacuauaauauucucuuucauuccugaaccuacuauuuaaaaauaaugaacauggucacaugguagaucuaguucacuuuauuuuuuaaccugcauuuucuuguuucagugucugaagcuaaaauaauauacauauacauauacacauacauacacacacacacaaacauguacauaaaauaacauauacauauucaaacuuuagacaucagaggaaagucaccaaauauaggagacacaauuuuuuuucugauauauaggcaacauuuucuguuuuuccuucugaugaauacuuuuuaaauuccauuuuacuuuagguugagguuuaucaaugagauuugugugcugagucaacuaucucaaagagaauauguuaguguguuuagaguaguggguugaugaaagggguuaguaagcuuucugcacugaaagcaggacacacuuuuagacaguucuuguuguccucugauauuucaccucucucuauuaugugacuaauggaucuuuuucuuugucaaucaggcccuuguuaaucaaguggcagcaacuguucagaaucguuuuacgaaaaaucugccaaguggugaaguucucugugguguuuucaccagggaguaucgucaugaugccuuaaacugucagguaggguauuuuaauuaauaaguguguuaucaaauuauauaacuguacuuguaugucucuuugacuagaaauucaacaucuucacaaggcuugugaaaauaauuuauuugaauuuaugaaagacaaaauacuuuuagaaaaaauguaauauuguuacauuucaaagagugagaacuagaacucaucuuucucuaaggacacugaccuuuggauuucugauuucauuaauauuuuauugcauugucuugguuuguaaagggauucagaaugaucugaagaaugcuauguuauagaaaauuaacaaaucucaauuuuaaaucaauuacuuuuucuucauaaguaucuauuaaggauacucaugauuuagaaaauguuguauuauggaucguauaccugguguuaaaucauagacaguuuucacccuuaugaacucacagaucaacaauuaagacuaaauaagaaugaacacaugauuauagaagauugcaugguagacauggagauguucuacccagauugccuuucaaagaaggacuugauguggggagugugguuaagauagaugccagccaucagcucccccaguucugccuccacagucucuacccugcaacugagcuaaguagaaguauaagcagcgggcugcuguggcuugauguggaacaacucugacagcaguccuuacuccagaacugcgagcuagguuggcugaggcuccaucaggccugccuugcaguuaggcuucccccucugcucauuccugcuucccugcucuuuucacacuagcugauucuuaauaaacaucuuucaaucuaaacucuaugucagugucagguuuuaaagaaugaaacuugugacaaugaauaauuucuauuuuuaaacccugaauguucauaaacaaggauguaaacuucaaaucugauuuucuaccauuuuuggccuaacaaaauuucaguuucauaugguuccaaugaauauagcacaguuuugaugaaacccugaauucucagaagcaauguuauaugccaauuaucagcagguacauucaggacucauaagucuaucuuacauauuccuguaaauaugucaacacauaguaagugcucaaaauguuacuucacacaauauuauucuuuguagguacuuauuacagugccugccugcuuugaaauucugcugcuugcuccucaucgccaaaacugggugaaaaagaucagauauguuauauuugaugagguagguuugguguucuuucuuugcuuaauucccuagugcacacuugcauagcaaugaagauauuugguguuucaggacaucuauccccuuggauggaguucagauugagaaggccuccguuuuuuuuuccugagugauuuuucaggaaaaaucacuuuuuuggcucccuuuuccuguugugacucaauaggguaaaaugaugcacccugcagaguucuguaugggaguggaaucuuucauugacaacuguuucaggggaaauagaauucaaccauccugguacaaguuucccuggacagagauuucaauccaaucuuugaccucuaaaguaaauaauuuuuggcucuaacaaugaugucaauuacauaaguuuuaucagucaugaucccaacagauaauuaaaugacacucuugaaaugcaauaauucaagaaguguauuuuucaaagguguaugugagggaauccacaaggguuagugcaguaauauagagcuaguaguuugccccuuggcuuaaaggggcagggcguggaagcauuuauggaaacucaaaaggagauuccaauugaguuggccauauugugaggaacauagcugauucaagguagcuuugcaggaaaggagccaauggaaaaaugaccucagccucagucuccccacuucuucugaucuauggccaagacccuucauaggccaaacgcaguggaaccagaaaucauaagaguccuuuugacgaagugucuaugggucagcuucccugggaagagagagcagaauaaaaaacaauguagauuuguagcgauuuauuggggcaaauggaagauacuuagcaaagcuauauugcagcauuauuuggaauauuuauuggucaggugcgguggcucacaccucuaaucccaggacugugggaagcugaggugggcagauugccugaggucaggaguuugaggccagccuggccaacguggugaaaccccaucucuacuaaaaauacaaaaauuagcugggugugguggcaggugccuguaaucucagcuacucaggaggcugaggcaggagaaccacuugaacccaggagguggagguugcagugagccaagaucguaccacugcacuccagccuggguaccagagcgaaacuccaucuccaaaaaaaaaaaaaaaaaaagaaagaaagaaaaaaaagggggaauauuuauuaaaagagauuuaaaacaugauagaaagauauauucuuugacucuguggaauuuuacauucaaaggggaaaaguuuaacaaaucucuguaacuuaccuuuuccuugcuguaaacuuggagcuaccaaauaggcugugcuuuggauuuguuugauacugauuuauuauauuuauuuuugguuaaucucauauugcaucaugaaggucuugaauauuauaguuuucaaaaauccaacaacuuugucugugcaaucuagaacuuugaauuaaaaucugaucucaaaacucugaagugcuaugacgauaugacuuuggcuauuucaguuuuucaaauuuuguguaagggauaaaaccaaaagguuuuaaaggcuaaugucuauucuggcagaaucagggaacagugcuaucuagugcaaagcauaaggucaauauuugauggagugguauuuuaucucaccaguacaagcccagaugggcaguggguaugcauauucuaauagguauauaauuugacuuugauaguaagucuuuuucaguugcuugcuaggugucauacuuuaaucucuuaaaugaagaccacauuugagacucuuuucugaaucuaguuugauuugcucauccguucauuuacucagcagauauuuaaggagugccuccucagugcuaggcuuugugucaguggcuaggaauagaauauucaggucuaagguuacaguuuacuuaaugccuuaucuauuagacacuggagcugacagcaguuuaaucaagaaagaggaaauaaacaagugagcucacaaaugaugaugccagcccacguugguacaaacugugaagggagagaccaggcugucaugacugcaguccuggcagagugucaggaggaggcaacucuggaauagguggucagaaaagucuuuuuuauggaguggcauugagcugaacucuaccauuugaauaauagaggguaagaguauuuuaagcagagggaauaauauacgugaaagcucuuggguagaaagggugaguucaaggaacaaagaaaaggucauucuuucuggaccauaguaaagguggagacaguggauugagauaaagccagagaggcagcagcggccaaaugaugccagacauuauacaucccauuaaggaguuuauauuuuauuucacaugcaaagggaagauauuaaagcaauuuauuuagugacaugacuugauauaguuuaucuuuuuaaacuuuuuuuuuuugagauggagucucgcucuguugcccaggcuggaacccaguggcgcgaucucagcucacugcaagcucugccuuccggguucacgccauucuccugccucagccuccgaaguagcugggacuacaggcacccaccaccacgcccggcuaauuuuuuuuuguuuucuuaguggagacgggguuucacuguguuagccaggauggccucgaucuccugaccucgugauccgcccuccucggccucccaaagugcugggauuacaggcgugagccaccgugcccggccaacauuuuuauuuuggcugugaugugaagaauuuaagggcagauagggaggcuaaguacaguagucaaguggguauugugguaacgcugcugagauaugagaguagcuagguuggcaguagacaugaagagaaaugcauugaguugaaggaaauuuuugaaaguaaaguaaagcagaacuguuggugcauugguugugaggauuuuuaauauuucuuuaaacuuggcauggucacuuaaaggcgaugggaaggcaugcaugacaauuucaagauuccaugucuuaacuuucauuugcuauuuuuaaaucaacuuuucaguugagauuuuuuuuuuuuuguuuaauagguucauugucuugguggagaaauuggagcagaaaucugggaacaucuccuugucaugauccgaugucccuuuuuggcucuuucagcuaccauaaguaauccugaacaucucaccgaguaggcauuaaguuucaauuuggacagaguguuuaucuauuuugaauauuugaauuucauaauuucucuguggauucugaggaguuucauaauuuucuagugaauuuaauaguuuauuucugaaucuucaagaaacugcaucucucuacaccuccuggccguaguugaggaaagccacccuguauaaauuaaggacuuccccaccuagaucuacaauugaguaggaaauuucccccaucccaaaaaugauucaucagaaaagauauauuuuuguuucuuuuuuuguccuucaccaagaaauaaaaaauaaaaugauauaacaacacacucagccauggguccugugguccauuuucccacuuuacagagauguuuagaaagauagcaaauucuuauuagaugaaaaccccauuuuaucuugucauugggcuugauuuuugccuacuacuaauaauuuuuuuacuuuauaauaauaguuauuuauuuacuaauaacaauccuauaauaccuccuaugugcccaguacuguucuaagugcuuuacauguauuaauuuauuuuaaaugcccagcaacccuuaugauuuaagcuuacuuccauuacuacuauuaaauagucacaguuccaauaugaauaccauauuuccauuuuaaaauguggaaaacuagguacagaaagaugaaguuauucaaccaagagacacagcuauuacuaagaagguugggauuuaauuucagguagucuggcuucugagucuauuccccuaaguacacuuuauaaggaagaugaaauugucuuuacuuaaacuacuuaauuucacaggaaguaguuccauguucugccuaaauaauauguacauuuauuuuuuaagguggcuacaaucgguaaaaugguacuggaaacaagaagacaaaauaauugaaaauaauaccgcuucuaaaagacaugugggucgucaggccggcuuucccaaagacuacuugcaaguaaaacaaucguauaaaguuagacuugguauguuugauauauuuauauaaagcuugccuuuuauuuuauuauuuuuaaaaaaucugccauugccuugaucuugaugccguuuacuuuaaauuuguuucagugauuacauuuccauugauguggaaauucuuguucuucauuuuuagugcucuauggagagagguauaaugaucuagagaagcauguauguucaauaaaacauggugacauucauuuugaucauuuucacccaugugcugcacuaacaacagaucauguagguaauauuuuagccauauuuguucuaaguaauauaaaauauuuguauauauuauaaauaaaugcugccuaauugauauguaucagaauuauagaauagaauuacagaauuacagaaacugauacuuuaaccuuaauuuaaaaaauaacaagaguauucuuucuaauucucauugguucuucaacaaugccugaauacacaaagauuaaaaaccacuacaaauuuaaccugaauuuuuagcuaauuuuauuuauucucggauguuuucuuuggcaauuuuucuuccucucagcucccaugucugucugucuaccccucugacacuaauucuucucauagugcagccauacaauuauauguagacaaucccuaguacauagaaaaaucagguaaaagacauucucacuaauguagcaaucacgacaugauuuuuuugguggugagccaguaagguggaggucuuaggaagauuucagcugggacaccggggugugaguggggaaagauuacuuacuuuuucuugcauaguucucuuccucucucauccuagucccauacauggcccauuuaaacuuccuuuggcuuucaaagugaugauuagucaauaguuuugucuuccuucuaaaaccuuaaauauauuccaaauucuguuauguuaaacauaauaagacauccaucauaagauuguugugaugauuaaaggagguaaaauauguaaaauuuuuagagcacaaaagucaacauaauuugacacgaauauaauuaaauguaacucucagcuuucuuugaagauaauuuugaucuuuccaagucucuuuugacuuucuuuuggaaaaagcuaaaugcauaccuccuuagcuugacaaccaaggucaucuaugaccuggccccaaucuccuuuccauucauucacuggggauaucuuaccuggcagcccucaugcuauauauugcucuuagaauauuucaaaccggaugccaaauaccagucauucagauacuguucaucuuccauaauucuucaaaugugaaaccuuuucugaauucuucucugacuuucuuagcuagauguaaucuuucuucucucaauaauaccuugucuguguuucuaauacgacaccagccaugaugagcuuacugcuuaaguuguuuacaugcauauagucuuuacuuacuagaauaacucuuugaagacaaauuuuguguccuucauuuccuaacaaauugcuauguauauaaaagguacuaaguguauguuaaauaagaacagcuaaccuaaauugagcacuuacuucauguucuaaaaauucuacguuuuuaaaccucuuuuaaccauuacaacaaucuuaugauagaugucuuaauacuauucccacuuuacaaugaggaaagugaggcauagagaacuuaacuaacucaguguugcaucauuaaguaaaugguggggccaggauacaaucucaaacaaguuggcuucuaaaagcaagcuggcugaugguaauuuucuaauaggauuuuguuaugggaacuuaucucuugugugacaauggcccaauccaaauucuaaauaaaccuaaauauggacaaaauucuugugacuuaacucauaccccaaaucuagaauauggaugauaacccacauauaagaauaaaaggcacuuuauucucucauuuuucuuucucccuucccuucccuucccuucccuucccuucccuucccuucccuucccuucccuucccuuccuucccuccuucccuccuucccucccuucuuuccuuuaugauauccaggaguuaucugacauuuucaucauuauguggcauuuuaaaaacaguauaguuuuuaaaaauuauucuguguaggaugguucaaggcagauuaucuuuaagcagcaaugaauauagugguuuggaguacuugcugaaauugucauuuugguccaagugccuuuccucuauuuucaguagcuauuaauggaguaacuggaaagcaauagaacugcuacagugugcugugaccccagaugacuucugcaaaggucaugcuguuguaugagucuucuuaagaugucuagacuuuuguggcaggaaugcagaaugaacauaaagacuuagguauuaguaaguccguuuugacagcugcaugguauagcauguguuuauauaggacauauccuaaagaagcagugauaaaaaccaaagagaccuuucaacugaguaaauaauuccuggucuuguguaguccauuuuucagauuaauaugaaaaaauggaguggcaagaaaaaaacauaauaaacuauggcaacauaagaacggccauccaccuggguccuuuccucuauaguuguaguauaaaaaugauuucaggagugggggcaggaccagugagcugaucugaauccaaccauggugagggaucgccuucaauccauacauggcuuguuucuggcuaaggacagugucuuuggcuuuuggcccaauuuucaugccacacaggaacagcugcugacuccuggagagcuaucagccccaggaaguccuugaaagaacugcuaucuaucuguuucugcucagcauagaucaaugccuaccgucaccuaugacauuagggacaaugugguuuacaaaaauagcaucaugguauaauacuauuguguuuauaaauaaagaaugguacaaaucugugaccuuuuauuucucuucauuuucugccuagacucacucaacuuuugcaggaucauuagucacuguguaguggagaacaacugaauuggauccccaguauuuaggcauaggacuguuaaacugauuuaaaagauuaagaacuauaagggauaauuagucaaucauauugauggcuguggcauuaaucauaugccaggcauuuuacuaagucuguuacauauguuaucuaauauaauucucauaagaaaucuaugucacaggcagaauuauccuccauuuuagaaaugaggaagcucagaccucucuaaaaggcuaagagacuuaagaaaucauaagcauucuagcuagcaaccaaaaacagaagauuuauauuuuaaaauuauaauaaaucuuggauuuauuguauguuuuuauuuuagauaggucgaauaaguaaccacuuucaaguaauaccuaacaagagagcaagaugccaacauuacaaaauaauagguguuuuguuuuauuuaguauguugauauaauauaguccuuagcauuuagcuaucuuucaguacuccaacugagauguuaaacgaugauuccaggaauuguuuuacguucuauaguuuuaaagguuugaagaacauauguugauuuugucugcucucacugcagucuuuaggguggaaguaaaaauauuguauuuucauuccuauauuauggaugaggaacuagcauuuacaggugcaauuagaaccagaucuucugauucauacucuccuguacuuuccauucuaccaaacaucaucuccaguuuuuuucaacuguguuguguuuggaguggcuuuuuuagccccgaaauuugaagccugaauuuuaaaacauauuaauagcuauuuacgaaagcaagugcccuauugucaaauuauuuuggauaaauuugcaugcuauauuuacuucuuugagguuuaacauuuccagugagaaaucccaaagaauccuauuugauacaauauauaucauuucucucucuuuuuucuuuuuugaagaauacucucuuagcccauucaacaggcuucuguaacaaaaauaucacaaauugagaggcuuuagaaacaaagauuuauuuuucagaauucuggaggcugggaaguccaaggucaaggcccugggagauuuggugucuugugggggccugcuuucugguucauagauaagcugucuucuugcugugcccucacauggcagaagggacaggggagaucucuguggucucuuuuauaacagcauuaaucccauucaugaggguucuuccuucaugaccuaaucaucucccagaggauuugccuccagauaccaucacauuggggauucgguuucaauauguaaguuuugggggaagacaaacauucagucuauacuacauuccuauuaacaucucagagaguauguuucuacaugcaaaugauuuguagcaguagugauugaaaccaguagaaaauacuacagugaaacuuuuugagaacaggaauuuuuuauuuccacuuaaaaauauuuguggaaaaaaugaauggcauacauuauuaagaagacuuaaagcagaccugucagugaccuuugggagaaauuucuuggagucuugaaggugguuuaagagccuuuaucuugaaguugacccaguucuuaucuugaaacuuaagcaaauaagauuuucccauuuuagccuggcuugguacacauaaaaguaaagaaucacauucuuaauuacaucaguuuugguguuagcuguaagauagaaguuauguauugucuaaacugaguccacaaaucuuucagcuucccaucgcucugauuucaauuaugaagucaguucauagaaaauuagcacaaugaaaaggucuugggaaguaauauuaaaauuuuuuggugggcuuuuggcuuuuuucccucuuuugugauucagggaacuguguugauagaauuugguagcauuuagcaccuaucagcauuugaacauuuuaguuuauugccuuucagugucuuuggguuaugauagugacuaagaggcaaaggauacgacauaaaauaaaauaaagaguaaaaauuuuaauuuuauuuuaaacagauugaaagguauggauucccuccugaucuuacccuuucaccucgagaaagcauccagcuguaugaugccauguuucaaauuuggaaaaguuggccucgggcccagguaaauaauaaugauguaauuaauccuauuauagaggaugauaauauugacaaacucucacccuuucuaaucacuggcaucuaaucuuuuaaaauuauuaguugacucuuccuacaauaagagugccucuucucauauuucuaacauuaucuguuuguuuuuuaauggguuuuaauuuguauuuuauuuaauuccugagaauauuucuucuuuuuuuuuuuugaaaucuuuucaacuucugcaacuucuagaacacuauuauauuucagucuucuuacaccuuagauucauauuucuuuuuauuacacuugcuucccuucuaagucccaauugcuguuuguuuucaucuucuacuuuguuuugcuuuguauccucucuuuugaagagcucauccauccuaguaacguuaugcauuagaagccauguggagauaaaaaguuuaaccaucucugugcucaagaaacuuguaaggcuguuaaugaggcauauaauugagaaauacuuuuggauuuucuugcaugauugugccuaauuuuguaauauuuguuuucaaggaacugugcccagaaaacuucauucauuuuaacaauaaauuagucauuaaaaagauggaugcuaggaaauaugaagagagucuaaaggcagaauuaacaaguuggauuaaaaauggcaacguagagcagguaauuuucauacgcuuuuuggccaaacuuuauuuuuguuguuuucuugaguuauaucauucaguuaauaccauuuucugauuuuuuuuaauccucaauuuuuauuuuagaaauuuaaguugaacuugaagucuaguaauucugagauagaauaaaaagagaaaguaaacuggucuuugucuuauccucagugucuucugaaccaugugccagaggcuacugguugcuucuaaauggcauagcagauaagaacagaagguucacuauccauagagaugauauuguugauacuuuggcaguagagaaacugaacucacaguaacagucucugagaagauuguuuuacuccucugucuuuuuugacuugcaguuuauuguccuuuucuucuucuuauuucaaguuguaggaacuauuuguguauuaaaacuuuaccuggaauuauauaaguuacagauauuuguuuuaauaaguugauggucuucauauuuugaaauuugauuuauuggcacagauugaggaaugacauauauuagacuuuucucauuggauuuuuuuuuguuguaauaccuuaaucuacucccauucaaaaacauaauauaauugaguuacauuuucuucuagcuauucugucauuuacagaccuugaaaauauauuuggaugugauuuuuugacauaauguagaaacugauucacacuugcccuccugucauagugaaaccagcaucauuugcugaaaaauccuucuauuccugauuuguauugucuuaaaaauugcagguuaaauugcauauguguguauauauuacugccaaauuuuuguucucuaguguauggguuuguauguuucuuugaugguucuuugccucguuuuauaauguacuuucauaggacuauuuuaaaaaaacccaaaaacauauauuagacaacuaugaaaauauuuuagcaaaaaguaguaauuucuuucuuucucaugcagaacuuaaaauuguuuuguauucaccacuacaggccagaaugguacuucagaaucuuaguccugaagcagauuugaguccagaaaacaugaucaccauguuuccacuucuaguugaaaaacuaaggaaaauggagaaguuaccugcacuauuuuuuuuguaaguuauuuaauuuaauuugguuuugcuuguaauuguauuagacucauuccuuuaaggcagagguccccaaccuccaggccacagaccaucacuggcccagcccauggucuguuaggaauugugccacagagcaggaggugaguggugggccagcgagcauugcugccugagcuccacuuccugucagaucaacccuauugugaacugcacaugugagagaucuagguugcaugcuccuuaugagaaucuaacgaaugucuggugaucugagguggggcaguuucauccugaaaccaucccccucgauccuugugcaccacuuccccaccgccacccacugccaaguugucuuccaugaaaccaguccccggugccacaaagguuggggacugcugcuuuaaggugagggguguuauacaaaguucccuaucguagugcgguguucauuacuauuucugggacccauugguuauuugaauacauacguuuuguuuaaaaaccgcauguucucacucauaggugggaauugaacaaugagaacacuuggacacaggaaggggaacaucacacaccggggccuguugugggguggugggagaggggagggauagcauuaggagauauaccuaauguaaauggugaguuaaugggugcagcacaccaacauggcacauguauacauguguaacaaaccugcacauugugcacauguacccuagaacuuaaaguauaauuuuaaaaaaagaaauuaaagacgacauagaaaaaaauacaacuuucuaguucaauucuuauauuuguauuugugcuauuaugaauuaccuucuuuauuuaguuugcuacucuauuuuuuguuuucuuucuacuguaaacuauuauuuuuuauuuagccuuguuaauuuuuaauacauaaagguucuuugcaaaacaaauugaauauauaugcacacaaguaucccacauaaaauuaaaguaucuucacaauauacuacuuauugacaguguauuuuauuauauuuaauuuauaguaaugagaacucugauccagauacacugauaucuugcuaaauuuuauauauuauaguaucaaauagcuuaaaauugaacaaaauagugcaauuucguuggacaucaaaguauaauuuauuaaauggauaacauacuagauccuggauuaacuuugguaacauaguuugggacuagaacacaauacucuauuuacuuugggcaauuucaagcuacacuuaagccauggaagcugaaguaaauaaauccagagucuuuguuagguggaaaaguuuaaugaaacuugcucacauguaaacagacauauagggaugaaucauugaugauauauuucugaaauaacgaugaugggugaauguaagauuguguuugcaaauuugggggauugcaauaauauuacuccuuuuaucuuuguuguugggauaaggaaaauacauuucugcacugccaaggauuuacaaagcucacccauuucacuuucaaguguggcuauagacuguaauuagaaacaaaaguaauucuguaccucugggauauuucugaaagccucacugcaaaacagaaacugaaaaauaucuguuuauuauucauaccuucauacaaauauaggggaggcaaaauuuuacuucuaccaccuuaggcuuuuuuaccugggccucagaauuagacugauauaagacaaaucaauagaaaagcaugcacauguauguaguauguuuuauauggugcagaaggcuccauaaggaguugaaaacccaacgaugcaguuagaguuggacacuuacauagugaauuggacaaagagugguaaauugugaaaaaugugacaaaguaaagggguguaggcuaggguaacuugggugaagaugugacuaggaagguaagaguuaguuuaacaagguuuuuuaguauagauuucccuugucuucaaguucccaucuuugaagauaggaguguuacuguccuucggguaugaaaacauauuuuugugggcauuuaaucugcuacuuuuaagaaaaagaaagaagaucagagugaucuucuugacccugcuguuuuuucuagugcuuucaacucaaaauaguuaauaugccagagugguauauuuugggaguagcauguuccaaaauccuucacauacuuaaaauauuuuaaaacuaaaauauuucagaaaacaucaaaaguuuaauuauacuugaagaauugaagcuuggcauguuuauaugacucuugaauucucuacaaaauaaacugugaacauccuugguauuacacaauuugaucccagaucaucaagagaucugaggauuuuucugggcucaaguuuuaccucuaggagcuuuucaaauaguaguguacccuuaagccuuuugcagucugaucucuuaaaaaaaaaauacauggagcauauucaguguuugauggcaauggcagugugugcuuaagggcacacacuucauggccagacccaaacuuggaucccaccucugcccccaugaauuguguuauuucuggacagcuacuuaaugacuuuaagccuuaauuuacuuauuugcaaaaugagaugaucagaauaauaguacaaaggauuggagugagaauuaaauaaacauaaguuaugaaagcacuuaguacagugcuacaaaaauguuauugaauaaggucuaaucucuaggucgcauucauucuuguauaccaggaugaucccuuuuugucagauccaaacagacuggagcugagagagcaugaaggcggguuguucaugcuugcauggcugagauaaacugucucaaggacuuucuaaaauaaucccacaggcaguucuuuauuuacugcugaagcaauucagauaagaugcccuugaaagaacacccacccaguaauggcaucuccaccgauaaauugaugccagcucugguuuugcgucuccaaaaccaaagaacuguguuucuaagcagcuuaugugaacuuccccuuuugccaguacaagcuuccuuuuaucuuccucccuucagauacauauguggcuugccauagcugugcaucuuggguuauaauucucauuucuaauuccaaauauagucaacauauuuggagauauuuuuucuuugguuuuguuuugguugacauaaaauguagguuaucagagagauuuaagaggcaacauuauuucuaagugaucuuugaacaagaguuuuuuaaaaaugaagugcuaugaugaaagugacacuauuuuaaaaaguaauauauuccuaggccccaguaacuugcauuaauguaaaaagagaagcaacauaugucaguuaaaaacaggauuugagaacaggggccugcaggccagacucugccacauauaaacugugggcucuugggcaggucacugaaucuggcaauaaggauauuaauagaaauauuaauauuaauagugccuucuucauaggauuguugugaguacuaaaugaguuaacauacugaagucacugagaauaaugccugacaacuguguauaauuuuuuuuuuuugaagggcgauggaguuuuacucugucgcccaggcuggaguucaguggugcaaucucagcucacugcaaccuccaccucccagguucaagcaauucuccugccucagucucccaagcugggauuacaggcaugugccaccacgcccagcucauuuuugaauucugugucacuguguuguccaggcuggucucgaacuccugacuucaggugaucugcccaccucggccucccaaagugcugagauuacaggcaugagccaccaugcccggccaacuguguauaacuugaauuuuacuauuaccauuauuuuauugucuacuauaugaaauuucuugccauguggcauagacucucaguuuuaaaauucuuacuucaccagugugccaguuuauuuacuguuuaguagcuaaacacauuuccuuuugauguuagcucuauaaaaacuuuagaaaggcccuuugcuucacaacauagauuuaaaaagcuuuauuauacaaaccaaaucuaugacuugcuauaauaagcuaugguuaauauaguggcaauagcuacuggcuacuugcagccacagcauuuugccaccaagaugcaguggagaaauaagaccucccugggcuuuucagugcuccuguaaaaagcccuagcuucuugacacagggaaaugcaugugaaauaaacauaggaaauguuugccuuuacuuccucuagaaacauuuuacuuuucauguaucaggagaauuugaucugcagccauuugucuauaaaugucuagcaauuuguagcuaauugcucagaucugagaaagccaaccuagaccagguugcuagguugagccccagggugccaggaaguauggaucacuauauuccuagguauuuacauuucaagaaguauaaagcccagaccuuggagacauuucugcauugcaaaguccagcaacaacuaggguuuauucuuugggaaagaaucauagguucucaccuucuaccaaaagaacaauuuuuuguugauuaaucuuuuuuuucucauuuuuagagaagggugguguuggggauagcuaucugucuucugcauauaaauggagauaaacggagaaaaaccauuguucucuguuccuugcuuauggaauauuugacuacucuuagaggaaaaauuuccacgaguucugauugcauugucccagggguaaugucuggguggcgggguggggugggggggaguggggagggagaaggggaggguaggcaacauuauuuacuauaagguaguuaauaaggagucugcugauucagaacaccuggugugcacauucuggguaacauuuauaaagguggguauuaaaaacccaacaggcagaugucgggaugauaguaguagauggaaauaugguuuugaauuguauuuaugauguuauuuucaaggcgcacauucuuuuuauuuccagauucaaguuaggagcuguagaaaacgcagcugaaagugugagcacuuuccuaaagaaaaagcaggagacaaaaaggccucccaaagcugauaaagaagcccaugucauggcuaacaaacuucgaaaaguuaaaaaauccauagagaaacaaaagaucauguaaguaguuaacuaaacaaauugauaaguagaggguuaaaauacuccccaaguccuaguaggaaacguaaauugaauauguucuauaaauaaguucuaguugucgcuuggacuuauuucuaaauugaguacauuugggugagagaaugggauaaagaugagugaccauaauuguacauucauuccuuaauugcaucaaucagccucauuuaggacuugggagagguagaaccacagccugucagccuagguagauuuuauaaccugacauaaucauccuacacaauaagcacaucuuugauacauauaugaacucuggcuaucacuuaguucucagaagguuuaaauauagacuacacacuuugucuuuggucaugacaaagaagucucacuaauauaacaucacaguuuugugagugaucauaaaaagaacuugagaauggauggaaaugcugauuugaugccuggaaagacuuagcuaauauaacaucucuuccuugcucucaaugucuaauucugucaacucuagggccaaaauguuuauccccucucuaugauccucuccaucuuaaguaacuuccuggcuuagaagcucaucauaucuugccuggaugaucacagagguguuuuuuuuggacuugagagccuugagguucaccacucuccaauccagucaacaaaugaucuugcacacauuugaauugauuaaauuaucccaugcucaauguucuuccuuugcccucgcuuagcugaugaagucuaagcuucuuuaccauuaugccaaaauguuuugguauuugccuuaacucgaucagucucacuuccuaccacucuccucuaccaauacucaauauuuaugauucuccucacaugacuuacuuuucuaccucuuccuuuccaugaacugacccaucugccuugagugcccuccuuccugauugcucccuuuuugguaucucaucucugaaucuuuccuugauuccugcaguuagaauuucuacccucucuccuauguucuucuacacuuucaauagcuaguagaucaauuauuguaauguauuguuguuuauauguauuucuuuuuccuaaauuuuaaguuccuuuucaacaggaaccguguauuuuucuucuugugucuuuagugcuuagcacauuaccuggcagguaauauuauuccauaaauauauuugaaugaaugaaagauauuucucuccaaguugaaacagcuuuuagagcauuucugauuuagguuuuccaaauucuagagcaaacuagaauuugcugcugauccuucugcuuauauuuccucuaccuauuuuucuguuuccuuagaagcaugggagguaaaaacccagggacagcauaggagguguaagccuucuuagugacuucaaguuauaaaaauaaagugagggugaggggacccuuuagauagucccacucuggccucuuccaucugcauccauucccauaaagcaaggggccaguggagcuaaggagacaugcccacccggagcucauucucacccuugaauuccagguuauuauggagcuauauuugucaagguagguggauagaauuuauuuuauuugacgguuuauuaccuugacuaaaaacuuacagugaggcaauaauauguggagcuuugccacaugcucugcaaauuuuagggccaggcccuuccauagucagagcguucuccccugaguuaaagguaacguuacuuaacacguaaugaugacauacaagugagcacaucuucucauauuuagaauugucuuccgugcacagcuaagagaaaaauuuaaaaaaucaaauaagugauaagugacuugggugcauguuacauugaggggugauggauggacaacacaguaugaugauacaauagucuaagccaggguuuacggaggagucuucuagguagauuccuaguagcauacacugagaugaggauaucuguggaagggauuuauugaaggugugugcucaugagggaccuaugagaaaaugaacgaagcaagaaagggaaggugaagaaaagcaagaauguggcuucugcuagaauauagccugauucuaacccuacugggaaugccaggacaccagagaauugccccaccuugagucaagggggcugauuuuuauacuucaugucacucagacauugggugugggcuauuucccauccccaggagaggucguaaccacccaggcaucuccaagaggccucugucaguuuagggcaauuguccagggaauggugcagcugagagccuuagcaacccaacucaaagcagcuguagcauccacuacaaggagggaaggagaaugacuagaauuggcaauguggagcaaggagaaugccuaccuuacauccaagcccagggucaugaaggccgaggaagagaaaaugaucaucacuuuaacaaggagaaacagaguuaucuugggagaacuggguuuggcaagacuacagccagaaggaaaaggaacaucccagaaaauaucaauaugugauagaauuuucucaugauggaucauaacauccagaggcugaaaaggaagggcauuagaggaagacugaguuauuaaagaugcacagcaggccgggcacgguggcucaugccuguaaucccagcacuuugggaggccgaggcagguggaccacgaggucaggaguucaagacaagccuggccaacauggugaaaccccgucucuacugaagauacaaaauuuagccaggugcggugguggacaccuguaaucccagcuacucgggaggcugaggcaggagaauugcuugaacccaggaaguggagguugcagugagcugagaucacgccauuacacuccagccugggugacagagaaagacuccaucuugaaaauaaaauaaaauaaaauaaaauaauaaagaugcacagccguggaagucugggugagaagacugacuugggaagucuugggcauccucugguggccaaaucaaauuaauuacuucauucauuauuuacaauuucauuaauuaaaauuuuauuuuuaugaacagagaugaaaagagccagaaaaaaaccagaaauguggaucaaagccuaauacaugaagcugaacaugauaaucuagugaagugucuagagaagaaccuggaaaucccacaggacugcacauaugcugaucaaaaagcaguggacacugaggucagcacuuacaaccugaucguucuccaaacuauuucauuugucagccauagcuuguuaguuguagauaaugcuuaauaagauauaugcauaauauaauacauaauuaauacaaucccuaccaaaagagaacucuccuuuagcuacauaucacucuugaaugcucugcagugcauaucuaaaaaggacauaauagucuaagccaggguucauggaggagucuccuaggucaaauucccuaguagcacacacugagauaccugugcaacagauuuagcaauuguagauuauuucuugccuguuaacaguucaccucugaaaauguuugccguuucguuauuuguuucuauuacauuguuuccacagccugaauucuagacuucaauuucacaugcugcauuugaaaauuugggugcaugugguccaauacacuuuaaguaauauucacagaauuucucaaaaucaggggcuuuuuacauuauagcuaaaacaccaaagaggcauuggaauagcuaaaacugguaugcagaaaccuuuuaaaaugcaaauuacucaugcuuauaguagacaaauuugaagauauaaauauaguaauaauaaaaucaaugucaucacucauaguacucacugcccuuccagaccaaccuuuuaucucauuuuccugugacuauacacauacaaacuuacauacauuuugcguauguguguacacauauauguaucauucuauugugcaccuucuuuuguaagcuucauggugucuuauuuuuuauaaccauguauuucgaucaucauuuuaaugaauacuugauauucuguugugugagugaauacauaauugaaguaaccacuaaccagccuuuugcuuuuggaagcguuuuuuugucgcucuuccuucauaagcaguguucaucuuuguccauguaucucuggacacaaccguauuucuucuuuaagaccuggauauuuuuaaguccauuugugcucaguuucaaugggaaguaggcauucccggaccacauaggguaaggaaccuccucugccuucuuggagaauucucccuguuggggaaaacuccugaggcuccaauagccaacugauaucccucaggcaagagcagucaugcacucaccaccacuugguguuuuaucugcuacuuugucaaaauuuucugccccagaaguggaguaagacaguuuaagauggucuguccaaagaagugggaagauuuuucuuguaguuacuguugcugccauaauguucuuuguauucauguagagucaguuucaaauaguugccuguuuagccaaauuauuacauaguaugcauguuauuuucauuuagacauuuuuaauuauaauuaaaauuaaaucauaaucccuaaaugucuugcuucuuuuagacuuugcagaagguauuuggucgaguaaaauuugaaagaaaaggugaagaauugaaagccuuggcagaaagggguauuggauaucaucacagugcuaugaguuucaaagaaaaacaauuaguugaaauccucuuuagaaaaggauaucuuaggguaggugaauuuucuucauucuaaaaauugaaauugugacuguuucaagcugaauguucaggaaaaguaaagaauacaaccaccauuuuucuuuuuuucucauguaauugucuuuuaaaaaaauaaguuggccgggcgugaugggucauaccuauaauaccagcacuuugggaggccgagauggacggaucaccuaggucagaaguucgagaccagccuggccaacauggugaaacucugccucuacuaaaaauacaaaaauuagccgggcgugguggcaggugccuguaaucccagcuauucaggaaguugaggcagaagaaucgcuugaacccgggagguggagguugcagugagccgagaucaugccaucacacucuagccugggggacaagagcaagacuuugucucaaaaaaaaaaaaaaaaagucaugauauccucugucuuauuuaauugaaaaggggauugaaauguacuacucaguuuaucucuuuuuguuuguuuguuguugaaccuccugaguagcugggauuacaggcaugugccaccaugcccagcuaauuuuguauuuuuaguagagaugggguuucuccaugcuggucaggcuggucucgaacuccugaccuuaggugauccgccugccucagccucccaaagugcugggauuauagguguuagccacugcacaaggccuaguuuaucucuuuuucaugagaauaaaaauauuuccuaaauaaauacuuuggcaaauuuuucuaccaugaaauauaucuauguucucucuccuaucagugauaaugaacaaaaggaauacuaaaauaacuuucaaacugaagucuugcuauguuuuguguagugugucccaugacagugcgcagggauuuucuggauaaauucaugaaggagcuuuauaugguuugcuuguaaauuuggaucuuuaguaauauucaaaaauagacugacuuuuaaaaauuauucacauugaauuuuguaugacauauauuacauucacaaaagagagagaggaagaaagacaaagagauugagauuguuucugcuacucuagguagcaucuuuuaaacuaaauguugaggaaaaucugacaucauaguuaaaaauccuauucccugaaaaaaaaaauaagauguagcauuugcaacuuugcuaugcuuuucucuuaacuaauaacaaauuauguaucucuuuuaaaggcuaauaaccacguacaauauuuucuacaugcuuaugaauugauagaagagagaaacaccuauuuugaucaggguauucuguguuuaaaauaguaccuguuaaauaguaguugcucaauuacuaauagguuaaugagaucacuccacaaaagguacuaugaaaauagugacagcuuugcuauagagaacauuuuuuaaaaagguauuuauucuaguuauuuucuaaauguauuauuauuuucuacauuuuuguucuuaucaaaaaacuugagaaaaacagguaauaaaugauguguugcauuuucgcagauauauagauuucaguuacagaauaauuacagaaaaucacuccguauacuuaaacauuaauacuaaccauuggcauguaugacaaucaauauaaaaagaaagagaagaugauuagaaauacccagcauuauaugaaaagaggauuaucuaaguaaacuuuuaaguuuguccugcuccuuuucugcucaguuaugacaauuuaggggggaaagacaacuuuuuaaaauuacugagguaugcuuuuuccauaggcauaaucucaacaaauuuuaguagacaaaauagguaauuguccaaaaguggauuuguaaaaguauuauugcccuaucauaaaaaauuuucuuucuaguuauucauuuaaaaauauuuacugggccuggcgcaguggcucacgccuguaaucccagcauuuugggagggcaaaguggguggaucagcugaggucgggaguucaagaccagccuagccaacauggugaaacucugucucuacuaaaaauacaaaaauuagccgaauguaguggugggugccuguaaucccagcuacuugggagguugaggcaggagaaucgacugaaccugggagguggagguugcagugagccgagaucgugccauugcacuccagcuugggcgacaagagcgaaacuccgucucaaaaaaaaaaaaaaauuacugaacaccuaucaguugucagguacucuuacggaugcuguggauacaauaaugaaucuugcuuggagucugguauaagacaagugaacaaacaaguaauauuauugagguagucauuaaugcuaugaagauaaaucaugugagacagagauagauaaugaugguaggggugguuauuuuggauguggugagcuacagauuccucugugacauuugaguagacagcugaagaagccagagaaacgaauauuuggggaagaauauucugugcaaagcaaacagcgcauuugggaauguacuugugguguuugugaaauagcaagaguaccaaugugucuaguuucucuagcuuucccauuguggcuuaauugaagcucaaagaguuuuucagcaacuuuaugacaggaaauacuugcauucuauuaaaaugcuauuuuaugaaguaauuguuuuauucucuuucaagguggugacagcuacuggaacacuugcuuuaggugucaacaugccuuguaaaucugugguuuuugcucaaaacucagucuaucuggaugcguugaauuauagacagguauugcaaaaugcauaaacuugcuuauuguauugcugaaauauggccauagcguaguaaaacaugugaaccuuuaguuuacaaacaugccacaauucacaguagcauaacuggacauucauccuugccuggcuuucaguuuuaguugugguauaguugaaagcaccugcauuugggauugugugauuaaccagaugugugaccucggaugagauaucugaacugccugauucucauuuucuaucuccaaaauauggguaauaauuacucucccacggcauuugcaagaauuaaauaagugauuuguauggaagauagacaucaaaggugcuugauaagcauuuacucauucauuugcugugcacaagauuuugcacucuagaauuaucuuuaaugcugaccucaucuuuacuccugacaccaaaucuguuaccaagcccacuucauuacugucccauagagguauuugauuuuugccuugcaauuucuguauccaccaucuuucaucguacguucuuagccuuguauuauuaguacaauuccccugauucuccauucuccuuauucuaccacguccugcagacaacgugguuuaucuucauacgaccucccugcucagagacauuugauaauuauuucugcucgcagaaucaaauuuagauaugucacccacaugcagguuuuuaucaacgcgcuucccucccuuuaucucuaaacacuuuuuguucuccuuauaggccuuguuccuacccaauauaacauucuuauaucauuucccagcauguuaacaaccccugcuuuuuauuucuauugcugcugccauacucugaaucaauucuucugacucauuuuugggaaucuucuccuuugggcucuugagcuaggguguuugauaugugggaugacggacuugggaauugaaaugucaggguuugaguucuagaucuuccacucugugguuguuucaguauggguacgucucuuacauucccagugccuuaccauagucuaagcacuuaauaaauaagaguuaacauaagcucuguaaagaguuuauucauaacuugcuuuuucacaaguagcauuucugaauuuuauuucacucauguauuuauucuguuugugcccauauuuuauuuugugauuuguaacucaacacacuugugugugagagaggguagaaaagggaugagagauggggaagaugggccgggagagaaaauugguauauuagaguucagcuguaagugauuuugacaucacugcuuugccaguguucuuuguuucuucaauagaucauuauuucuuugauauauauuacacaaaugccuacugcaauuaauggcaugaaauacguacguaaugaugacagaugucucaguuuuuagaucuaucucagucauggcaaauuuccuaagcacuauguaguugcauguuaguguccguuccuuaaugguuagacauaugcacaauuuccaugcuccaaaccagaguaaagggcucauucuuacacuauggcaguagaagcauuuagggaaguuuuacauuguaauucuauucucuuuucagaugucuggccgugcuggaagaagaggucaagaccugaugggagauguauauuucuuugauauuccauuccccaaaauaggaaaacucauaaaauccaauguuccugagcugagaggacacuucccucucagcauaacccugguccugcgacucaugcugcuggcuuccaagggagaugacccagaggaugccaaggcaaagguaccgugcuggacacugccugagguucagucuucaucacuggccugacuuuagucaggucugcuguucuuuuagaagucuguagcaaucacccuugaguuucaucagucuuuuaauguuuuguaaugucuugaaucguauagaauuggggguagcuagggagaauaacaguuuuguuuguuuccaccaucagacauggaauuuguggcuggaugggcacugaaaauuacccaggauuacuauuuucaggugugaaaugcaguguccuauaauaguuaagugcuggcuauggauuuaaaaagcucuaggugacuaauagacuccuuucuaccauuuagaaagaaaaaaauauuuauuuuuaugauuuuguaacaaaaagguuuaaguguuucauaaaaaaaguaacucaaacuuaggaguaugugggaaauguagaacguugaaauaaggaaaaagugccccuguuccacuccccaaagacauucacauuaucauuuuuuuuuucagccaguuuucuaggcaugggugugcauuugauuuuuaaacacugauaucguuguauguaacugaacuucaaaauaugguuguaaauguguccugauguguguugcccagauaaaaauuuuguauccaaucccucaaugacagacuuacaauucauaauuacauaauuugauucucaucuuuauggagaugcauuguuaaugauaccuguucuuucuguuuuuguauagugauuaacaugcccaguuaaaucagauacuguuuucugaaggggggauucuucuaggauucuuuugaugaguuggcugauccuacagagcagucauacaucauuuuuaagaccaaaauuuccccauucuugaguucuucauuuuuaccucucuauaaagaggaguacaucuucuaauaagguuucuuauuuuuuuaaaugguuaucagggugguucauuuucuuugcuuugcauauuugggaagacccacauguaaacuucucacauaugggacucuuaaaagugggcauaacauucuuagaauauuauuaucuucauucaucaaaucaaacuaagauuguuuccguugccuucuggcauuuaauguuuuacauagaggagccauggcaguuucuguuuucuugcaguuaacuugauauuuuuuucuguuuaugcaauuauaugaaucuuuuucuuuauucuauuucaaauguuuuauuuccuaugauuuucuauuuuauggauccuuuaaaaauugauguuuuaguuauuauaugagaccuuucaaucuucaugcucagguuuuuauuuauugcggugaaaugcauauaaaauuuaccaucuuaaccauuuuaaguguacaguucaguaguguuaaguacauucauauugcuaugcaaugcucagguauuuuuuaaaugaagaagagauccuugaauuguaucuuuguuauuugcuucuguuaauuguucuguuguuuuuucaggaaaaguuauaauuuuuaaauugaaacccacuuuucuguuuuucauugcuauuuuuuuuuaugagaaaacauaaaacuuaccuuccauaucacugauggucuuaagugucaguuauggcucuucauaaugcaaauguggauuuuaguucugcuacuacuggacuuuuguuuuccugaaauucuuuuuuuuucuuucuuuuuucuuuucuuuuuugagauagagucuugcucuauagcccaggcuggagugcgguggcaugaucucagcucacugcaaccuccgccucccagguucaagcaauuccccugccucagcuuccugaguagcugggacuacagguaugcgccaccacaccuggcuaauuuuuuguauuuuaguagagacaggguuugaccauguugaccaggauggucucgaucuccugaccuugugauccacccaccuuagccucccaaaguacugggauuacaggcgugagccacugcaccuggccccugaaauucuuuacuacuccauccaucacucuuuuauaucauaauaauguacuuuuuaaaugucaauuuauauugucucuauaccauaggcuguagugccagugccuugucucaaagaagucauaucauuuggcacccauuaaguaugacaaauaauuuuuucuuuuuuuccaucuucuuauauuauuuuauuuuaaguucugaggcacaugugcaggaugugcagguuuguuauguaaacaugugccauggugguuugcugcaccuaucaacccaucaccaaaguguuaagcguagcaugcauuaguuauuuuuccugaugcucuuccucucccugccccaacaggcccugguauguguuguuccccucccuggguccauguguucucauaguucaccucccacuuauaagugagaacaugugguguuuuguuuucuguuucugcauuuguuuucugaggaugauggcuuccagcuccauccaugucccaacaaagcacaugaucucauuccuuuuuauagcugcauaguauuccaugguguauauguaccacacuuucuuuauccagucuauuguuaaugggcauuuggagugauuccauguuuugcuauugugaauaguguugcagugaacauacacaugcauauaucuuuauaauggaaugauuuauauuucuuuaggcauauacccagcaauggaauugcugggucaagugguauuucuaccucuaguucuuugaggaaucuccacacucucuuccacaaugcgguuggacugauuuacacucccagcaacaguguaaaagcauuccuguuucucugcaaccucaccagcaucuguuguuucuugacuuuuuaauaauugccauucugauuagugcgagaugguaucucauugugguuuugauuugaauuucucuaaugaguggugauguugaguuuuuuucauauguuggcugcauguaugucuuuuuuugagaaguguccuuucauguccuuugcccacuauuuaauggguuguuuguuuuuuucuuauaaauuuguuuaaguuccuuguagacucuggauauuagacauuuguuggauggauaauuuucucccauucuguagguuguuuguuuucucugaugaucauuucuuuugcugugcagaagcucuuuaguuuaauuagaucccauuuaucaguguuugcuuuuguugcaauugcuuugggcauuuucaucauuguauuauuccauguucaugcugcugauaaagacauacccaagacugggcaauuuacaaaagaaagagguuuaauggacuuacaguuccacaugguuggggaggccucacaaucauggcagaaggcaaggaggagcaagucauguuuuacaauggauggcagcaggcaaagagagagagagcuugugcaagggaacuccucuuuuuaaaagcaucagaucucauaauacuuauucguuaucaugagaacagcaugggaaagacccgcccccauguuucaauuaccucacaccaguuuccucucacaacccaugggaauugugggaguuacaauucaagaugggauuuggguggggacacagccaaaucauauaauuccacuccuggucccucccaaaucucauauccucacauuucaaaaccaaucaugccuuucuaacagucucccagagucuuaacucauuucagcauuaacucaaaacuccacaguccaaagucucaucugagacaaggcaagucccuuuuaccuaugagcuaguaaaaucaaaagcaaguuaguuacuuccuagauauaguggggguacaggcauuggguacauacagccauuccaaaugggagaaauuugccaaaucaaaggcaccacaggccccaugcaaguccaaaauccagugggaaagucaaaucuuaaagcucaaaaaugauauccuuugacuccaugucucacauccaggucacacugaugcaagaggugggcucccauggccuugggcagcuucacuucaauggcuuugcaggguauagugccccuccuggcugccuucauaggcuggcauugagugucuguggcuuuuccgggcacacagcgcaagcugucaguggaugugucauucuggggucuggaggguggggguccucuucucacagcuccaauaggcagugccccaggagggacucugugcagguucuccaaccccauauuuucccuuugcacugcccuagcagagguucuccaugagggccccaucucugcagcaaacuucugccuggacauccgggaaguuucauacauccucugaaauugaggcagagguucccauaccucaguucuugacuucugugcacugucaugcucaacaccacguguaagcugccaaggcuuggggcuuccacccucugaaacaauagccugagcuguaccuuguccccuuuuagucauagcgggagcagcugggaugcaaggcaccagguuccuagacuuuacacagcagacgaacccugggccuggcccaggaaaccaguuuuuuuuccuaaaucucugggccugugaugaaaggggcugccacaaaggucucugacaugcccuggagacaucccauugucuuggugauuaauguuuggcucccuauuaccuaugcaaauuuaugcagccagcuugaauuucuccucagaaaaugggauuuucauuucuaucccauugucagccugcaaauuuucugaacuuuuaugcucugcuucccuuauaaaacggaaugccuuuaacagcacccauggcaccucuugaaugcuuugcugcuuagaaauuucuucugcaagauacccuaaaucaucucucucaaguucgaaguuccauaaaucucucaggcagaggcaaaaugcugcccgucuuuuugcuaaaacauaacgaaagucaccuuugcuccaguucccaacaaguuccucaucuccaucugagaccaccucagccugaauuucauuguccauaucauuaucagcauuuuggucaaagccauucaagaagucuuuagggaguuccaaacuuucccacauguuccugucugcuucugagcccuccaaacuguuccaauuucugccuaguacccaauuccaaagucacuuccacauuuucagguaucuuuucagcagcaccccacucuacugguaccaacuuacuguauuagucuguuuucaugcugcugauaaagacauacccaagagugggaaauuuacaaaagaaagaguuuuaauggacuuacaguuccacauggcugaggaggucucauaaucauggcagaaugcaaggaggagcaagucaugucuuacaauggauggcagcaggcaaagagagaacaagcuugugcaggggaauuccucuuuuuaaaaccaucagauuucauaagacauauucacuauuaggagaacugcaugggcaagaucugcccccaugauucaauuaccucccacuggguuccuucuaugacaugcgggaauugugagaguuucaauucaagaugagauuuggguggguacacagccaaaccacaucaauuaugaaauauugcccaugccgauguccugaauaguauugccuagguuaucuucuagaauuuuuauaauuuugggguguaccuuaagucuuuaauccaccuugaguuaauuuuuguauaagguguaaggauaggauccaguuccauuuucugcacauggcuauccaggucuucuauuaccauuuauuaaauaggaaacccuuuccccauugcuuguuuuuguugaagaucagaugguuguaaauguauagucuuguuucugaguucucuauucuguuccaauggucugugugucuguuuugguuacuguagccuuguguuaaagguagaaguuggguagcaugaugccuccagcuuguucuuuuugcuuaggauugucuuggcuguaugggcucuuuuuugguuccacuaugaauuuuaaaauaguuuuuuucuaaaucuguguagaaagucacugguaguuuaaugggaauagcacugaaucuauaaauuacucugggcaguauggccauuuucacaauauugauucuuucuguccaugagcaugaaauguuuuuucauuuguuuguguccucucugauauccuugagcagugguuuguaguucuccuugaaaagguccuucacuucccuuauuagcuguauuccuagguauuauauucucuuuguagcaauugugaaggggaguucauuugugauuuggcucuccgcuugucuguuguugguuuguaguaaaaugccugugauuuuugcacauugauuuuguaugcugagauuuugcugaaguugcuucucagaagcuuuuggguugagaugaugggguuuucuagauauaggaucaugucaucugcaaacaaagacaauuugaguuccucucuuccucuuugaauauccuuuauuucuuuuucuugccugauugcccuggccagaacuuucaauacuguauugaauaagaguggugagagagggcauauaaguauuuuuucaaaacaacuuuuuuuuuuugcugcauauagaaaacaauuuucauaggucagaucuuuucuuuagaggaaaagauguccuugucacagucuaugagauccuguagaauaugauaucuuaccagcuuguaaaacucacuucuuccucuuucccauauggccugcuaccugcuucaugaacaccccaggcacauuccagucugaggaccauggcucuugcuguuucuucuccuucuaagaucgucccugagacauauacauggccucacucucuuaccacauuaaauucuuugcucuaacauuacauagugaagccuacccucaccaugccuucuaaauuguaaauguuucccugucugcugcauugacaauguuccuuauucaguuaaauagaguucucaucaguuccuauauagcaucaaaucuaucuauguaucuaucuacauugaucuaucuuucuuuaugucuaucaucuauauuucuauccaucuaccuaccucuaucuaucuaucuaucuaucuaucuaucuaucuaucuuccuucuaucaucucucugcuaucugcuaucuaccuaccuuucuaucauguaucauucuaucauuuaucuuucuauccaucuaucuacaucuaucaaucaucuaucuaccuaucaucuaucuuucuaucuuccuaucucuaucauguuuuuauauauuuucucuauauuuuccacuagaauguaagcacuccaaggccaauaauguuuguuugucugauuuucugauguagacauucaguaaauauuuacagcaucaccauaauuuuaggaagaugaucaauuuuucuuaagaagauuugaucuauuguguguuuuucuauuuuaucacuuuggauacaucuauccaaaucugaugguuugccaagcaauaggauguaugaaauuucuucuggcuucacucuauccaccuaaaugcuaaucaaauacccuuucagagcugagcuggaugaauaguuuuuggcccaaauaucaguguuuagcagaucuucaucuauguaguuuucuggacugaaaggucgcguucuacuucugcuagucuuauuacacauugauuaucuggaugacauuaaucacaauaaacuauaguaugcaaugcuaucaggauucuuauaaucuuaguaugacuuuaauaugaggucuguaccucugugguuauagugaaccaccaugaaacccucacccuuuacuaugcuguuuucugacuauugccaucucugacuauauguggcauaugagagcgaagagguugcaaaaaaggccagauauggugcccucaaaaauaucaucccacaguaaggagauggaaagugcacucccuucuucuacgcuuccacucuuucuuccuuucucucuucuuccuuuucucucucuucccuuccucuuccuuucuccccuucccuucccuucccuucccuucccuucccuucccuucccuucccuucccuucccuucccuccccucuccuccccuccccucccuuucccuucccuuccuuauuuuuuuccuucccuuccuccuccuaguccauuaaccuuauaguaaguagagauucuuucuagguucuauaaacccucaggccuaaagacagguuaaguuucaauuuuggugaugcuggguuuuuuuuuuuuuuuuuuuuuuuggaauuucauagacauuuuaaugggaaguugaaagauacauguacuuuaaugcaguuuuacucuggaaaacaagcaauauuuuuauaacauuggugaaaucaaccuaguuacauuauuuuuguaauaauacugcagaacaugggauaauauaucuuuuuacuccuagaacaacuuaaaagcuauaaacucuugaacuggaauggcuuuaauaaucagacuguuuggcaauacguuucauuucugacaauucaguuuaugugcucuauuuuguuaaagaaguugccauguaacacuauaaaauaauaugaaaucaaauuuuuucugauacauuucugauaucuuugugguauaauagauauugaucuaucauuuauuaucauuuucaaacguauuucguaacacuuaacauugugugucuaaaaauacucuuuucuuuaaaggugcuaucagugcuaaagcauucauugcuguccuucaagcaacccagagucauggacauguuaaaacuuuacuuccuguuuucuuugcaguuccuggugaaagagguaugcauuacugcacuuuuguuuugggaaauagcauuacuacuaucuagauuucuuaucaugcugaacaaauuguagcuuuuagaagguucuauccaaugauugauauuauuuauaaaugguauaauuauaaaaguugggcccaguaauaguuauaaauauuucuuauauuggcauuaaauacuauuuuaaacugguacuuaauaaguuacuuauuauguggugacuugagucaaacuaauaaauuguuuuuuguucuuuagggcuauuuagaucaagaagguaauccuaugggguuugcuggacuuguaucacauuugcauuaucaugaaccuucuaaucuuguuuuugucaguuuucuuguaaauggacucuuccaugaucucugucagccaaccaggaaagguaagcuugagauuuuauauauauauguagagagagaguccaaaaauagcaacagauuuguagaaaaacaacacuucaggaauauuuuuaauaaagaaaauacaauuaauauguagauaauuuauagaucuucaauugauaaaguaaauaccuacuaauauauauuaaaugauagucagccauguuuuaugacauguauuuacaaugucaacaccuccaaaauauuaacuucagugauuccuugccuccaggauuaauaacauauuaaauaauauacacuuuuuagaaaauauuuucuucuaauuaaauauaauauauauucaucauagaaaaaggauauaguaaagcauuaaguuaaaaauaaaaaauuacucauaauuacacuauccacagauaaucacuauuaauguuugugaauauuuucuuccaaucauauuuucuuugaauauuauuguauaguauaccuaaauagcuaauaguauauuaauaguguaauuuagaaucauauuuuccccuaaaaauagcacaauuuuauccauauugaguaaauuuuuaaauacauuuuauuuaauacauuuuugauuaaaauccuuugauuuuuacauuuaaacacuaaaucuauaugguaguucuuaaaaucacuaagauagacuaaagggaggaaaaucuagguaaggaaauaaggcaauuugugugggaucauuaggaucuaaauuaggguauagguagcaaggaugaaaaagaaggcacagauaaaaacuauuagcggauauaugguaauucuucaauugcuauguuugucauaaauuuuuaguuuccaugaaauuaaauguaauaugacauuccauuuaaacaugaaaaaauagaauuauacccuuucauauuuacaagaagacacuuuguuuuauauaggcucaaaacauuuuucucaagacguuauggaaaagcuaguauuaguauuggcacaucucuuuggaagaagauauuuuccaccaaaguuccaagaugcacacuucgaguuuuaucaaucaaagguaaacugugugauucugauaaaauuuaguaauguaaaaccacuaaauagaucuuaccuaaaaugacuuagcagcuguagaauuuuaauucaaagggcaguucauuuguuuuauagaauaauuuguucuuuuuguaaucagugugauauuuaaucuguaauugaugucucccucuguaaaucuaccaaaaaguuaaagucuuugugaaaaaaaagaggauaaacauuuuauucauguuuuucauuugauuguaucaaauuauaauaucaggugacuaaagaaaagauaugcuaauuauacauuaagugaaacaucuagcuguaucaccgaauauacuguucuuuuaggauccuuuuaccuuaagguagaacuauggaagggaaguauauguugugaauuauaaugucuucacugagaaaauaucagaauagucaucuaagaaaucauuacuugacucacagagaccaaaaucagagaaacacuuuuucgauuuuauuuguaacaugcaacauuuucuuugguuaugauucucuaccaucaagucaacaucaaauacuauuacuauuauacuucccuagaauaaaaugggauaugcugguuuauacaagauaaccuuagugaaaaguugcuauggaacaaacaaaaagaauuaguauauauuuucuaaucccacaaugcuggauuaaaaaucugugcucucacagaaugcccucuagagcagugaacacaauuuuagucauugaccuaucaucuuuacacuuuucaccacucaugcauuuuugaaacaauuauuuaauuguucuguuuauauaaauuuauauuuaacauagaaaauucacuaucucuauuuugaaaaaagaagcucaugauaaaaauacacuuuacugcauaacagacagaucugcgugaaauguugggguacuacaccaaaaagcuuuaaaaaauaggccagacauggugacucaagccuguaaucccacuacuuugggaggcagaggugggaggauugcuugagcccaggaguuugagaccagccuggggaacagagagagaccccaucucuaagaaaaagaaaaaauuagauaauaauuccuaaagucccauuauauuaaauaaaaacucacuagagaaaaggaucugggucugccuucauagguaggcuuguaucccccucaagacauuuucgaagccaucuaggacuggaaaauuuaacagcagguuaggaagugcuauaggaaaaagguggaucuuuagcagucuuuuagauuugagaagacgaagacuaacuagccuuauucucaaaaucuuaagaaauccaugaccuagaaagagagacaaagcauaaaugaggcuuacuaaaacuguaaaacaauacccacugcagucuguacuuguacugaggugaucauacuuucacucucuuggccaaacacgaaaaugggggcauucgcucuugugaaagauaacaucuaaagccguaaaguccuuugaaaacaguuucuggugcaaaaccaauaccaaaacaaaaccuaaaauggugaguaagcaugaacauaugaccaauaagcaggaagaaaagaggucgguaauuguagauccauaaaucauccagacauuagcauuaacauauaaggauuauaagugugauuaauauguucaagaaaauaggaagagagacaaaauugauaaaaagauggauauuuuuacuagauaauuagaauguauaaaacuaaauuggacauuuuagaacugaaaauacaauaucugaccauuagaauaugcauuucagaagucaugaucaguaaguugacagcauaauagaaagcauccaagguauagcacagagauuaaaaaaaauuaaaaaaucagacagcguaacaaacaugaaucacauggaaaaaguuuaauguauauauaaugggagucccagaaaaaaaaaugguggagaaaaauggcugaagaguauucaaaaagauaauagcugggaauuuuccaaagcugauuaaagauaacacaccauaguuuuaaaaccguagucaacuucagggaggauaaauguagaaaaacauuaagcuaaacugcugaaaagcacaaagagaaaaucauaaaucaccuaggacagaaauaaagugacacauuuccuucuaagaagcaaugagaaugcuagauuucuuuuuaaucaaaauaauggaagcuaguggacaauggaacaauauuuuguuguugauucagauauuuuacaggcaaauacaugcaaucauugauauauacauauauaaacucuugguguuacauaacuagaaucauauuagacaugcuauugcuuuuuuauacuuauaucaaagauacuuuuccggaugaccacauaugaauuuuuuugguauuuuuuuuuauuucaguagguuuuggagaaacaguugguguuugguuacauguauaaguucuuuaguagugauuucugagauuuuggugcacccaucaccuaagcaguguacacugcacccaauguguagucuuuuauuccucaccccucacaccuuuuccuauggguccccaaaguccauuguaccauuuuuaugacuuuguguccucauagcuuagcucucacuuaugagugggaagauuugauuuuugguuuucaauuccugaguuauuucacuuagaauaauggucuccaacuccauccagguugcuugugaaugcucuuauuucauuucuauuuauggcugaguaguauuccauaauacauauguaccacauuuucuuuauccacucauugacugaugggcauuuaggcugguuccauauuuuuguaauugcaaauugugcugcuguaaacaugcauguccaaguaucuuuuuuguguaaagacuucuuuuccucuggguagguaccaaguagugggauugcuggaucaaaugguagaucuacuuuuaguuuguuaaggaaucuccauacuguuuucccuggugguuguacuaguuuacauuuccaccagcuuuguaaaaguguucccuuuucacuacauccacgcuaacaucuauuauuuuugauuuuuugauuauggccauccuuacaggaguaagguggcguugcacugugguuuugauuugcauuucccugauaauuaguaauguuaagcauuuuuuucauauguuuguuggccauuuauauauuuucuuuugagaauugucuauucauguccuuagcucacuuuuugaagggauuguuuguuuuuuuguugcugcuuuguuugaguucuuuguagauucugaauauugaguccuuuguuggauggauaguuugugauuuucucccacucugugggcugucuguuuacucugcugauuauuucuuuugcugugcagaagcuuuuaguuuaauuaagucccaucuauuuaucuuuguuuuuguugcauuugcuuuuggguucuuggucgugaagccuuugucuaagccaaugucuagaaggguuuuuauaauauugucuuccagaauuuuuaugcuuucaggucuuagaauuaagucuuugauccaucuuguauugauuuuuguauaaggugagagauaaggauucaguuucauucugcuacguguggcuugccaauuaucccagcaccacguguugaauaggguguccuuuccccauuuuauguuuucauuugguuugucaaagaucaguuggcuguaaauauuugccuuuauuucuguucuuuauucuguuccauuggucuaugugucuauauuuaugccaggaccuugugguuuuggugacuauaaccguauaguauaguuugaagucagguaguaugaugcuuccagauuuguucuuuuugcuuaguuuuccuuugacuauaugggcuuuucuuugguuccauaugaauuuuaagauuguuuuuucuaguucugugaagaaugauguugguauuuugaugggaauugaauuuguagauugcuuuuggcagccucaugauuuucacagaauuuauucuacucauacaugagcaugauauguguuucaaucugcuugugauaucuauuauuucuuucagcaguguguuguaguuuuccuugcagaggucuuucaccuccugguuaggcauauuucuaaguauuuuauuuuacuauuugcagcuauuguaaaaggggcugaguucuugauuugauucucagcuugguugcuguugguguauggcagagcuacugauuuguguacauuaauuuuguauccugaaacuuuacugaauucauuuaucaguucuaggagcuuuuuagacgagucuuuaggcuuuucuagguguucagucauaucauugggaaauggugacaguuugacuuccuuuuuacugauauggauguccuuuauuuauuucuuuuguuugauugcucugguuaggacuucuaguacuauguugaguaagaguggugaaaaugggcauccuuuucuuauuccaguucucagggagaaugcuuucuacuuuucccuguaaaguauaacguugacugugggauugucuuagauggcuuuuauuaccuuaagcuauguccuuucuaugccaauuuugcugaggguuuuaauccuaaagggaugcuggauuuugucaaaugcuuuuucugcaucuauuuagaugaucagugauuuuuguuuuuaaaucuguuuauguaguauauuacauuuauucacuugcauaugauaaaccaucccagcaucccuaguaugaaacucacuugaucaugguagauuaucuuuuugaucugcuguuggauucuguuugcuaguauuuuguugaggguuuuugcguuuauguucaucagagauauuggucuguaguuuucuuucuuuuuuuuuuuguuaugucauuuccugguuuugacauuaagaugauauuggcuucauagaacaauuuagggaggauucccucuuucucuaucuuuugaaauagugucaguaggcuuggucccaaaucuucuuugaaugccugauagaauucagucgugaauccauauaguuuuggacuuuuuuuguugacauuuaaaaaauauauaccauuucaaucucacugcuuguuauuggucuguucagaguuucuauuucuucuugguuuaaucuaggagauuuguauauuuccaggaauuuacccaucuccucuaaguuuuccaguuugugugcguaaagguguucauaguagccuugaauaauuuuuuuuuucguacuucugugguauugguuguaauaucuucuguuucauuucuuuggaugaaacuuauuuggaucucucuucuuuucuuggcuaaucucacuaauggucuauuuaucaauguuguuuauuuuuucaaagaaccagcuuuuaguuucauuuaucuuuuguauugguuuuguuuguuuguuucaauuucauuuaguucugcucugaucuuugcuauuucuuuucuucugcuggguuuggguuugguuuguuauuguuucucuaguuccuugaggggugaccuuagauugucuauuuuugcucuuucagacuuuuugauguaggcauuuaaugcuaugaacuuuucucuuagcaucacuuuugcucugucccagagguuuuaaaucaguugugucacuaauacuguucaauucaaagacuuuuuaaguuucuauccugauuucauuguugacccaauaaucauucaggagcagguuauuuaauuuccauguauuugcaugguuuugaggauuucuuuuggaguugauuuccaauuuuauuccacugugaucugagaucacuuauugaggcuuguuuuguugccuaucauauggucuuucuuggagaauguuccaugugcugaugaauagaauguauauucuucaauuguuggguagaauguucuguaaauaucuguuaaguccauuuguccuaggguguagucuaaguccauuauuuguugacuuucugucuuuaugaccugucuagugccgucaugggguauugaagucccccacuauuauuguguugcuaucuuucucauuucuuagguauauuaguaauuguuuuauaaauuugagagcuccaguauuagguguauauauauuuaggauugugaaguguuccuguuggaguaguccuuuuaucauuauauaguguccaucugucuuuuuaaacuauuuuugcuuuaaaucuguuuugucugauauaaaaauagcuacuccugcuugcuuuugguguccauuuccauggaauauguuucuccaccccuuucccuuaaauuuaugugaguccuuauguguuaggugagucucuugaagacagcagauacuugguuggugaauucuuauccauuuugcuauuccaaaucuucuaaguggagcauuuaggccauuuacauucaauuuuaguuuugaaaugugagguacuauucuauuuaucaugcuaguuguugcccaaauaccuuguuuuuucuuuuuccauugugcuauuauuuuauaggucuugugagauuuaugcuuuaaggagguucuauuuuggugucuuucagggauuuguuucaagaguuagagcuccuuucagcaguucuuguaguacugucccccacuccccaauagcgcugaauuuauuuccaggcaaucugugagcagggcugaaaacuuuccccaggcuacaagccuccccacugagaaagcaagcagggcucuuggguuucacaccuccccacuugcugcagccucugugcuuguaucugcacucccuguuuaccccccugccccagguucuguccaggaaacuuuguguuugguugaaauuguuacagaguucagcuggaaguuuccuucuccauguggucuuuccccaauuccauuggcagccuucccaaggaccccugugagacaaagucagaaacggcuuuucuggggaccgaaagugcccagagugcuuaucccacugcuuccucuacaccuauauuucacuuggcucucuaaauuugucucaauuccagauccuucucccaugaucuggaacuucaguuuccccauugaugauauguguuaagggguggauguucccccuuucacacuuuggacauucacaguuuuucagcuugccugaagaggcaaguuacuucuuugaaagggucuguggauucucuuggcuuuccugguguguuccuuugguaguucuuggagcaaaaguucauggugugagucuccacaugcugaucugucugucugagugggagcugcaaguuaguucugccucuugucugccauuuuuuauuuuuauuuuuauuuuggcucuccagacaauggaacaauauuuuuaaugugcucaauuaaaauaacuccuaucccugaauucuacacuuguaggaaauauucgucaaaauaaagauaaaauuaagauguuuucagaugugaaaucugagguuauucauugcuaucaagucugcaguaaaauaaauauauacuuuagguacauagaaaaaauccaaaauuuggaaacaugaaaaugcaggaaggaaugaaucacaauagaaaggguuaugugugauuacauauaaaggaauacacauugugucaaaaaauaauuguaacauauaaaauuugaaauaauacauagaacugaaguuuaugaaaauuauaauguaagaguucagaagguuaauacauuuaaauguuuuaaaauuuuggaagauuaagaaauauaaaauuaaagcuauaucuuauaaucucugggguaacagcuaaaagacuaguaaaauagugugcacauacauguuaacaaaaggaaaaacugguaaaaacaagaagggaagagaaaaaauauauaaugagugguucaaauucagacagaaaacaaauggcaagguagaaaauagcuauaucaauaguuauauuaaauguaaauguacuaaauacacuaaguaaaauacaaagauuuucaggcuauaucuuaaaauauagacaacuauagacaugugccacacaaugacauuuugauccacaacagacugcauacaugaugguugcauaaauauaauauuguauuuuuacuguaccuuuccuucauucagguauaucuggauacacaaaauacuuaccauuguguuacagcugccuaaaguguucaauucaguaacaugcuguacagguuuguagccuaggaccaauaggcuguaccauaaagccuagguaaugugaucuagguuuguuuaaguacacuuugugauguuugcacaaugacaauaucaccuaaugccacauuucuuagaauauaucccugccauuaagugacaucagacuauauaugcuauuuauacaagucacacuuuagguauaaaaacugagaaagcuugaaaguaagaugauuaaaaauauaugccagguaaacacuaaccagaagaaucagaaguaucucaauugcgugaaaaguuaaaaaauuaauuuauaaauacacaaaggauaaaaaagacauaaaauggacauuuaaaaauauuuuacauuaaauaaaaauaaagcaaacauaagaaugcuuauaaguuggaauuuauucagugcuuacagaggaauuugcagccuuaaaaccauaaauuagaaaaaaauacaggcugaaaagucaaugaauuaaacuuuagcuuaagaaaauaacaaaacgaacaagaagaucuaaccuacaguaaguagaaggaaagaaauaauaaaaugagaacagauauaaaguaaauuaacaauaauugugugaacaagaaaucaacaaagccucuaaguugguucuuuguaaagaauaauaaaauugauuaaugucuagcaaaacucauuaagaauaagggaguaaaagcacaaguaucagaaaagaaaauggggcaguacuacaggcucuauuuuagacaucgcaaagagcaaaggaagauuuugugaaugacuuuauagcaacguauuugacuauuuagacaaaugggcaaauuccuagaaaauacaacuuuccaaaacugagcaaggaagauauaauuaaucugguucugauaucuaguaaagaaauuuaaucuauuauuuaaaaaaaaaaaaacauucccacaaagaaaacccaaggcucagauggcuucacuggugaauucuuccaaacuuuguaaggauaacaucacuauauauguauauuaaaacaccaguuuguauaucuuaaauaugcaugauuuuuaucguaaagagaauaacaccaacuuuuuacaaauuuuauuuuagucuguuugggcugcuauaauguagcaaugauuggcuggcuaauaaacaacagaaauuuacuugucacaguuucggaggcugagaagagaccagucuuucuagcuauuuuuugguacccauuaaacauucacuucuccgucccccagcuacccuucccagccucugauaaccauccuucuacucuaucugcauaaguucaauuguuuuaacuuuuagguccuacaaaguagugagaacgugugaagugugucuuuuugugccuggcugauuucacuuaacauaaugaccuccaauucuuuacauguuguugcaaaugacaggaucucauucuuuuuuauggcugaauaacuaaaagaauagaauuguauuguuuguaacacaaaggauaaaugcuugaagugauggauaccccauuuacccugaugugauuauuaugcauuacaugccugcaucgaaauaucucauauaauccaugaauauacacaccugcuauggacccacaaaaauaaaaaauuaauaauuaaaaggaaguucuaaaucaaggugucuggugggggcugcuuuuugguucauagaugguugucuuuaugcuguguucucacaugguggaaggggcaagggagcucucuggcgucuuuuuuuaugggcacuaauuccaguuaugaggacuccacccucaugaccuaaucaucucccaaaggcccugcguccuaaucccaucacauuaaguguucauauuuuaacauauaaauuuugagaaaauaugaaacauucaguccacuacacucuucuggauaauacaaaaagagggaauauuuacucuuucuaagggcaaaaguuagcuuuaauaccaaaaccugacuagaacauaaugaaaaggaaaauuagagauacuucucuuucaugaauguaagugaaaaaauaguuaacuaaauauuagcaaaaugaauccagugagguuuaaaaaacccucaaaacaaaacgagauuuacucuaggcaugcaaauguacuuugucucauugcuugcuauucaaaugugucacuagagucuuugaaauuuucacaagucuaauguuauuugagggcaugcuucuauuuaaaagugguuuugauucaguaugucaaaauacauuuuuaaggguaaugaguaagguauuuguuuucauaauugcaaauagaaacaaaacaugaaguuaccugaacuucaccagugaaaaaaugaaacagugacauuauugaauaaauauuaauagauaacuauagaauuauauugcaauguucuuuaccuuucuucuuccaacgauucaguuuugaaggaagguaaauagaucuaucucuaugaaaauuauucggcuucuagguguuccuugaugaucucccugaggauuuuagugaugcuuuagaugaauauaacaugaaaauuauggaggacuuuaccacuuuccuacgaauuguuuccaaacuggcugauaugaaucaggaauaucaacucccauugucaaaaaucaguaaguauauuuuaccuccauuguggaacaauuugaagaauaaauaaucuugccuaagaauaguuuauucuggaagaagaguggaaccccagaaaguuuauuuugcccucaagugaggagauuccuuuuccuuucuaaagaaaaaaauuuugcuuauuagacauuaaaagggcaaaagagacaaacuaaguagggcaauuuauaaccaucuuguuaaaugcugcuucagggucaagccuggaaaacugaguaagggcaucuaugagaugaagagaaacuagagacgaauucugucacucucucuugagaggaaauacgcuuaguuuucauaaacacagauucugagcauauuuucuggguccaaacucugguucugcuacuuauuagcugugagaucuugagcaagagacuccauacucaugccuuaguuuucugaacagauauaugagaaagggaauagcauuaucuacguaguuuugaugaguuuuaaaugauuaaguuaacauauaugaaaaucuuaaaauaguguuuuguacaugguuaacacucuuagcauuugcacuuuuuuucaugagcuaauagauggaagcuuucuaagggaaaauagauacaaaaaggugaccaucacagguggggugagauuggagucugugaauauuaugccucaauuacaaauuagagcccaguuugaaugucugaucuggguuuuauaagaauauaaauggaaaauauauuuauucucaugcacuacuuccaaacuuacuaauugaggcugcaugguuucaggaaagauucugaaggcaauucugaguucaguaagaaaaaguacaaagguaauaacaauaauucucugauaagaguauauaauuuaaauuuagucuuucauuucuuauugauuaaggcaacuaaaauauaauacacauuuuuauaauagugauacuaacauuaauagccaacuuucauugaauguauucugugccaagcugugcuacuaaccuuaugcgauauaacuuacgaaacauuucagucuucauuacaugaagcugaauggcuccccuuguaacauggucuagagaaaguaucugagguuugacaauuugacugaguucaaaacacuaaucuaucccuaacuauuauugucagaauucacagguaaagaaugugaagacucucaacucguaucucauuugaugagcugcaaggaaggaagaguagcaauuucaccauuuguuugucugucugggaacuuugaugaugauuugcuucgacuagaaacuccaaaccauguaagugaagagugggguuuauuaauaaaagcuguuuaagaaagaauggauuuauauugcuaggcagcuuagaaagaacuucgaauuucccagcuuaaaaaggaaaaaaaaaaucuggguguaucaacagauauauucaggaauuggugcucuugaagucaauaugauuucuguuucucagaguuggccugaggacccugcucagagaguuuccaggcaccacuacuuuucuucaaucuuugaaggcucuacugauauugacacagguuuucuguggaaguagcacauaaaacugucuucagacuuucucaguacugcuauaaaugcuguaaauacuacuuacagucugcaucauugaugccuaaaauggaaugcaaagaacuagacacauuuggaagauccuggcuaauucauuugaauguugacacuuggugaaauuuaauuuauaucuuaauacaaacuuugagaaaaaguguuuuauuacauuugauauuauggauugacauuggugucucaacucuauuuuauuccaaaaucauagucauguaucacuuaaaauaauuuugaaaacuauauacaucuugugcauuuuaaaugaacacauacauuuuuauccuaaauuuaaauacuuucuaaaaauacaguuuuuaguuucaaauaaauguugguguguuaaaaccaaugcaucauucuuuuaauuguauaaaauggaauaucaacaagaaaguguuuucauacccauagucaguaaguuaagaacaagucaggaaaacuuuuuauaaggauuuauaaauuugcaguucuuuuccucuugaacucacauuuucuuuccauauucccucacauuuaccuuacccaacucacuuuauacaaauuuacuuuacuagaguaaguuauaaccucuuaaaauuguuuugcuuuuauuguuuauuuuaauuaauaaaauuaguuuuacauuuuaauauaaugcuaagcguacauacaaauauaucuuuuauagcauauagauaaguucuaaagcaucgaacuaaaugaacaccauguacuaaggaucuguguacuccucccacguuucauuuucuugucucccguuuucccccaggccaucaaccuuucuaaacuuuguguuuuucacuuuucuuuuuaaaaacuacauauuacaaaaucccuuuuuauauuaauuugcuuuugaauuuuaugaaaagugaaggaauaguuacugcagucaccugaaagucacuuuuauuuacauucagugcuaugccuuaagguucaucccugcuguaacgucgaacucucuuuuauuuuuaguacuuaauaauauuuuguagugugaauaucaaacagccuguuaaucuguucuccuguuucgaauaguuguguuuguuucuugucuuugcuauuacacacaguguugcuauggaugucucgugcguaugugcaauaguuucucuuagguauugauuuucuggguuaaaauaauuuucugagucauauagaauaagaauauucaaauauuaaacuuuucaagcuacuaccaacucauuuaaaaaguagcugugccaaacaagucucagcaggagugaacgcaguugauaucugucacucgaaugguuaccugcaaauuauuaaauuuuaauaauagagucuuguuuagauauugcugcaguuuauaauuugcaucacugaucugcauauaguacauggagucaacucuuauuauucauagauauuuauguaugaauuuucuuaguuguuaaaauuuauuuguaacuaccaaaaaaaaauagcugugccaauuuacacucauaauaacaguaugcuagaguucuauugauccucuacaguacaguuugcaaaaaaugagcagacaugggaaaacuauucaccgccuucuuuuuacuuuucuucuuuuuguuuuccuucuuccuccuuuuuauucagguaauuggguucccaagauuguuagaguuguucaauugaauuccuuucuugugauguauaauccucuagcucauuaauauucuguuuacaaguaaauuccuuucaccaauaaggagaaugaaaugguguuagguuuucuuuccuagugaguguuucuauauucuaguggauggaugguugaaagugccauugguauuuuguggaggcaauaaucuucaugggguggagcugagccacucuccacucuugcuuaggauggugcuaccacaauguguggcuaaggcacccucuuacuucacagugaagagugggcuuuaaaaaugguaacuaaaggauguaucuacaaagcaccacauaagaaauuaucaacuuucuuuauacauaaauaauacauuaagaauaaucguauuuuuucagguuacucuaggcacaaucggugucaaucgcucucaggcuccagugcuguugucacagaaauuugauaaccgaggaaggaaaaugucgcuuaaugccuaugcacuggauuucuacaaacaugguuccuugauaggauuaguccaggauaacagguauguccucucugucugucucuguuucucuguccucccaucuccaucucuaaugaauuaauuuaaugaauuuuaaggaagaaaccucauuacaguuucaagugcagguuaaaucauacuaaacauacuagauugauuuuuuuuagagacuaauggcaagagagaauaacaauucgguauuauuuuucuuugugguuuuccaacaaaaucuuggcacuuagcccagcucacaugacaucaugcugugcucuaacgauauaaauauuugcacaugcucauagauauauuuguauuuauuacucuccuguuuauucauuauuagauauuuuaaaacugaauaacaaauaauggcaugcucuccaguauuugagaagaguagauagaggacugaguacaugacaauuguuuuaguucuguggcaggaaaaacauuuucaaaaauaguagccagggguaaacacuguuggauuuauccaggaugaagaaauugacuugggcacugagcacauagauuuggggaggggcauucugucacaucaaagcaggaaaccaauuuuguuuuuuacauaaaauguugagcaguccuuauagaaugaagguauuaaaauaucugacacucuucaaagauguugagcacuguuuugaaaaaaagugacucauugugaauaaagcagcugugacauuaguaaaugauacaacuguuucuucccuuuugagucucuaguuccaauuuacccuccugagcuuuauuuuccuguuuugguuaucuccugagauggccagccuccuauuuuuauugcuuauauaugauugugaaauuucaacucuugaauucauaaucaccauugccauagguuagaucaauaucuaggagucuguggcagaaauaauuuuuggaaagagaucuugacagacaaaagcaaccucuuacugauaaauucagcauuuaaauauaaaauaggauguucuuuaauguuuuguauuauuaauuuucaaaauguuguuuucuuuaggaugaaugaaggagaugcuuauuauuuguugaaggauuuugcacucaccauuaaaucuaucagguguguuauauauuuaaauauugauuuuagauuuuuuaauaauuuauuuauaauuugaaaaauguugagcuguuacuauaagccagguacaugaaggugccauuaagcuucuucugugcuaugcauuucaacuccccaaaggcucugcagaaugucuguucaacacguguuguauuauuucuauaacagaauuaauuccaaugucuaguugagaugaaguuucauccagacuagagucucagccccaggcaucaugcacugacaggcagcaauauucaaaagcuucauugacuccucgauccugguauucucaauugccacaagcaguguaugucaaagacaugggacacgauauuucagagggcuccuuaggguuccauccggucucuaguuuauauucacuuacauacuuugaauuuuguguuuucucugauguuuucuccaggcuccgucugacucugaucuuucauauuggccuccuauuuucaccuuuaacaaaaccuaguggggucccaagcaacaccaaacuuuauguggguaccccauucuuaggcuucauugaccaucuacuguugcuuaguugcauguccaucuuucuuuuucuuuucuuuuuuuuuugagacagaauuuugcccuuguugcccaggcuggagugcaaugguaugaucucggcucaccacaaccucugccuccuggguucaagcaguucuccugccucaaucuccugaguagcugggauuacaggcaugugucaccaugcccggcuaauauuguauuuuuaguagcgaggggguuucuccauguugguuaguguggucucgaacuccugaccucaggugaucugccugccuugcccucccaaagugcugcgguuacaggcauuagcugccgcuccuggccuaaauguccaucuuucuaaagccuucaaucugcaugcaacucaauacuuuauagguguugcuucguccuaucccuuuuuauauauuuaauuugccacaacucucuccauuauuagguucuugcuaaucaagucucuuuuuauaucuuggaucugagcagaaucggccuguuuggacuuuuuauaacagaguaaaacuuuugggagcagaaggaaacugcuuuguccacuuggaauaucucuagauaggguauuccuugaguggcucauaguuacugaaguuauuaucuccagagcagcccaagaaacuccacagacuuggaagcugucucaaaaacuugggcaaggaaaucaaucaaucaaucauucacacauucauccaagaaguauugaagcauuguugguaugagacacacuuccuaagcauuugagcuauaaagguucauaauuuuuuuuuuuuuuuggagacggagagucacgcucugucacccaggcuggagugaaguguugcgaucucggcucacugcaaccucaccucccagguucaagcaauucuccugccuaagccucccagguagcugggacuacagguguauaccaccaugccuggcuaauuuuuuuuuuuuuuugguauuuuaguacagaugggauuucaccaugcugcccaggcuggucucaaaauuccugagcucaggcaauccacccgccuuggccucccaaagugcuaggauuacaggcaagaaccacugcgccuggccaaaggaucauuaaauugauauaccugcuuuaaaaaaauucuuacauguguagugaaagaagcugacuuauagaccuuacaaacauggucagagcuaugauggcagauaagggaaugacuaaugugacuugcauucaaagaaagagucucaaaugagguaauuuuuugacuaagccuuaaauuauggggaagaagaaauaguauuuucaaaguacagaaaugagaaagggccugaugugucagggauagacuccaagcucacuaugucaacauggagauuaugggcauuugacagagaugggggaagaugcuggguuguuguaagagacuuuaaauggaauuuggaucuauaucaggaaaggucuuuauguuaacauuaagaaguuugggcuucaucuuuugagcaacguguagacagugcauaagccugaggggagcaugagcaugcggauuauauauguggcagaaauauguaggugcaaaggcuguaacagucaugcaggugaaaaugagugaaggucugaauuaagggaauugaaauaugaugcagaagagugaucagaaaaauauuuacgagguaaaauucaagaaauugguaaaaaaauuuaugcaguugguaaagaugaccaaaguuccuauuuuuguuaaggauguauaggaaacaaggaugagcaugacauuuggggaugagaaugaaaaauagugagcuagaauuuauacacaucacauuauaucugggagauaucaaucaggaggaaauguucaguagucacaaugauaagucuguaacucagaaggaaauuugguguuguagagacagaacugaucaauuuuugugguaggucagugaugacacucgaaaauaacuggaacucuaguggaaacaagguaggggcaaauaauaaaaggcugauaagaugucagaucaugacaguuuucagcccuugaucaguccagcuguacuguucauucuuggauuucuucucuccuuuuuuguuaccuguacauuaguuucuuaaugcugcugcaacaaauuaccacaaaccuaguggcuuaaaccaacacaaauuuauuauuuuacaauucuggaggucagaaguccaaaaugugucuucuugggcucaauccaguugucagcagggcugcauuucuuuguaaaggcucuuaagggacaaucuacuuuuauugccuuuuccaacuuuuagaggcugccggcauuccuuggcuuguggcucccuuucaucuccaaagccagcaaugguucguagacucacacugcaucauucugacucucuccugccucacucuuccacuuacagggaccuuugagaucacacugaaccugcccagauaauccaggauuauuuuccuaucucaaggucagcugauucgcaacuuuaauucgcacugcagccauaauucauuccccuuugccauguaaccugaccuauucaucgguuucuggggaauauaugauauggacaucuuugcagggccauuauucugcuuaccauaucuuguuguccuuaucuuuuuacacaucuagguaaagaaagcaauauuuuccucuucguagauguagcugccuguggguuucaguauacacuggacacuagcauaaauaacacaaaaugacuccacaagagauauguagaggaaagaaaaggaauuugcguugcacuuuugaagggagaagggaucaaguuauguggaauuugauggcuuuucagacucucuugguaauagucauggagaagaauugcaugggguuguuuuguuaucuuuucuuaaauuuuuuauacaagauuuuuuaggagaaauauguuucuuaucauuauuccucauauuuugcuaacauaauuucaucaucugaugggauuuccuuacuucugccuaaccaaggaaagccuuucuuauaauauucaaucucacuaaaguggauccuauauuuuuuuccccauuuccaguguuuccuugcgugagcuaugugaaaaugaagacgacaacguugucuuagccuuugaacaacugaguacaacuuuuugggaaaaguuaaacaaagucuaaaaacaaagucuaugcaaaccacuuaaaaauaauuccauaguaguuuuucaggucacguuuuugauucuuaugcuucuugccagaaauacauuaugauaaaguggaaauacauuacgaugaaguggaaagagcaaacacuuuggaaucaaacagaguugcaaucaaaccugccauguucugucaugaauacucacaaauuauuuaguauaccugaaucuugguuucuuuuuauaacugaguaauaaugguuacaucucagguaguuugaggauugacuaaaaaaaugcgagaauguuguaugugacugaauaacaauuuuuacucugcgaagccaaaguaaauauaauauuaucaguaacuuuauccccagugucaguauuuauaaaauguuuauuaaggcuagaaaaaaugaauacaauauccugaaggugaaauauauucucuucaauuagcauaaauaugauuuacauaaguuagcuauacagcuauugagauaguacuuucuaguaaacuuaaacuacuuuuuaaacauacauuuugugaugauuuaacaaaaauauagagaaugauuugcuuuauuguaauuguauauaagugacuggaaaagcacaaagaaauaaaguggguucgaucuguuuacca

SEQ ID NO: 191873 - RNA, 113138 nt, Homo sapiens
ugaaacaaauaauauacaaacuuuuauucaaaguuaauucaagaaagacauguuuuggucauuuuuaaagugagauuaauugaagaucucagaaaaacuguaucugaucaacacacauggcuacucacagaaaguucucucuucuguuaauagcagcuaaauuuauacacacagaaaaaauuccgaagaccaugcaaauucaauugaauuccauacauucauuauauucaucaaaaaccugcaguaauguucaugccaaaguguuaauuuaagaaaaaaauuaaaaauacacaccaaaacaugaccaagauuaaacuaaagaaaauaauaaauaagcauaauuuauauuguauuuuaaaaaguuuggcaucacacauauucaaguguguuacaccagguccauuccucagaaguggcauuuaaaguguuaagcauuguuaaauaucaaaaaauacaacucuguuuuacaauguaguacuggcauaauucaaaguacugugccaauuauaaauaguauaaucaaguuucaaacaucuuuucaaacauauuuaaaggaaagcauauagacacacauuuauaugcacauaauuuauuauauucauguaaucaaaguuauuuuauaaaagcaaacaguguaucccucaacuaguuuguauacuuacguagauuuuaauaucuguucaaagauuuucaguuccugguauacagauuuuuagaagaaauaaagauaaaauuuaauuuuacaagaacacacauuacuucauccuccuucacaaaauaaucuguagucauucaagguugauaagaacuagucuuuaugaaagcaacuguugucuaaagacuacagauuaaguccugcaguccaaguuucuuaugaaaauucagucagcugcugcucauugcagaaaaagccuacacggugcuucuaccaaaaauaaucuucaguaucugaggccuauaaaggcagacgaucguaucuucugcugagacuuaaagugcagcuacaaguggagaagugcuagauucucagucacuucacaaauacuuguugaaggcuguuucucauguauaaauaugcugaaaauguccuucaggcucauaaugguuuaucaauaacugugaccccugagcaaagaaaugaagagagaaaaaagaagucacaggcagcacucuguaucucugagaaaacacucaauucuucauuauaauacgaaggcaggaggaacuguacaaaucauguuucagaaucucuuucuuaaacuuuaguaguauuaucauuugaaucuaaaugacagugaaaacucuguuuaguuaugggcuaguuaaauauaagacuauuuaauccagaacuagucuuuuccucuuuguaguuacaauuuggaaaauauacucaaaagggaacacagaaacuuuugagcaugauggauauguucauuaucuugauuguggugaugguuucauggguauauacucugucaaaaguaauaaaauuauauaguuuaaauauacaguugacccuugaaccgacaugggggucaggggugcugacccuccacgcagucaaaaacccauguauaauuuuuuacucccgcauaauuuaauuacuaauagcuuacaguugaccaaacgccuuacugauacagucaauuaacacauauuuuacauguaauauauguuauguaugucauaacauguuauguguuauauauuguauucuuaaaguaagcuacagaaaaggaaauguuauuuaaaaagucauaaggaagaggaacuauauuuacuauucauuaaggggaaguggaucaucaucaaggucuucauccuugucucuucacauugagcaggcugaggaggaggagaaagaggagagguuggucuuguuguuucagggguggcagaggcagaagagguggaggagguggaagggaaggcaggggaaacaggagaggcagacacacuuggugcaacuuuaaggaaauacacuguuaauuccugucugacuuuuuuguuuuuuucauuucucuaaaaauguuuccacauaauaccaaucgucuuuccacuacuuucuucaguuacagugcacauaucauagaagggcccauuucauaaaguaagucauaaacagucuugaauaaccaaacccuuuugccagacugucuaaugucaauuuguuuucugacauugcuucuacaucuucuucauugucuggcagugguuaagaagcacucaucuccgucgagucauguucuguuaauuucucugguuugguaucuauuagcucuugaauuucuccaagauccauaccuugaaacccuucaccaucaaccuuuauagccacauccaugaucucuuucaugauuucuuugacuggcucugucauaacuccugugaagucauacacaacaucugaacacaguuuuuuuccagcaggaauuuauuguuuuggguuugaugacuuucauagcuuuuucuauaacaaugauauauucaaugguguaauccauccagacuuucauguuuucucuguugagauucucuuccauagcacuggcaauuuuuuccauagagugccauguauaaugaaacuuuaagguuccuauggucacugaucuagaggcugaauuagauacauuguguuuaggggcaaguagaccacuucuaugccuuugguguugaacucaugggguucuggguggccaagggcacuguccaauaucaaaauaaaaagcagucccuuacuggcaugguacuuccugaaccugaagcauagauggaaccaguccgggaaaagauuucuugucuaggccuucuuguuauacagucaaaagacuggcagcugguauuuauauuuucccuucaaggauuggggguuagcaacuuuuuagauaagagcaguccaaaucauaaacccaacugcauuugcacaaaauaguagaguuagcuuaucccuuucugccuuaaauucuggugcuugcuuaucuuccuaauaaaugucccugguggcacauuugucugcauuaaaaacuuguucaggcagauauccauucuccucaacaacuuucuucauggcaucugggagcucaucugcuggccccuugguugacagaaguguucuccuguuaucuugacauuuuuugagccaaaccccuuuccaaaauuaucaagucauccuuugcuugaguaggcugaggaaauucuccagcuuuagauccuucaccuuccuuuugcuucagguugucacauaaugacuuuccuuuuucucaaaucauauuagaguugacagguaugccuuucuuacagcaauccugcacccaccaaaaaccaaaaccaaaaagucaaaaauaauaaaaauaauaaaaauuuaaaaauuagccaggugugguggcacaucccuguaaucccagcuacucaggaagcugaggcaugagaaucguuugaaucugggaggcggagguugcagugaucugagaucacgcuguugcacuccagccugggcgacaagagugagauucugucucaaaaacaaaaauccugcacccacauaaaagcugcauguucaacacaagauaaaaagggauuucacaaaaagugugaaguuuucaaaacugcugggauggcugcagggacggcuucaugaauuuccuuuuuccuuuuuacaaugaucccuacccuggauucauuuauuuugaaauggugggcaagugcagcagcagaccucaauccaugguauaucucaagcaauucagcuuuuucuuguaaugucaugacucuucucugcuucguugaagcacuuccuagcaccaucaccgguggcacuuuguaugggucccaugguauuauucaagguuuaugauauugcaguaaacaugaugaaaaauaaggcagaaccaugagagagaacuuuuuacugagauacgcaucgcugaagagacaaacugcucuuucaaagguaauuagccccccacagcuuuuuaaguggauacucacaacagcugagcucaccaauacagcaacaggagacggcuauaaaauuauuauaguaguacaguaacauacuacaguuaauuucaugcaguuaugauuuaauauuguaucuuugugguuuguucacauuucucuggacugugaaugacaccaucuaugguuuguggguguuuguucccauaagaguuugugugcauauguuuugauaaauuuuaacuuuuuguaacagauuuguagauauuuuguaguaaaugauaaaacagacuaguaucuacguauauuuuauguguucauaaucuuaaacuuaauuuuuucaauauuucuagguuaugcagugcaucugaguuuuuucaaacuguuaccaaucuccaaaaaaauuuuuccaacauaauuauugaaaaaaauccacauguaaguggacauacacaguucaaaccuguguuguccaagggucaacuguacgcuauguauucugucaguuuauaccucaaugaaguuguuuuaaaaauucaucuaauauucacccauguuauacuggaauucuacuguacauaguucuucucaguacuguuuugaaugauacauaagcaacagugaugguuaaugagcuuaaacauuuucuuccuccacuauuggaucaauuuuguuacagaaacauuauacuauuaaaagcaagauaaauauaauugaaauaaauaacauaaagacucaccauaauauuuauuaaaauuaacauuuaucuuacuaagagaauggaccaaaaaaucacauuuuauaacucaaccaguacuaugcuuaagaaagaaaaauuauuccacagccucacuauaauacuaucucauggagccacaccauggggagauguaggaauccuauccuauuucuuggacaucucaggaauuaaagccuugccacauaugaauucuucuccucugcauacagauuuuagcuacauuaaauuuuauuauaugauuuuguauaucaaagauuugggauuuugaauacaaaugacuguagaaugacaaaaguauacuggugcuuuauuucagaauauacacagccaauguuaaucaucuuaagaauaagauauaaacuauaccuugagaaaagacuuuauucuuauaacagaaaaacuucguuaauauaacauucauaaugaggucaucuuuuuguacggaaauugacuuuagagacaacuguuaccugcauaacuucucccugugcucauacacgaugacacaacuguccauuuaucgguuguuggguuauaauauucuacugacgccaaguuacaggaaccaucauccccuccaacaacauauaacagaccauuaacugcacaaacuccuuuaaaaaauuacagagagaaaacaauuauuuaaaaaauugggaugaauaugaguaucacuguacauguuuagugagguaauccagagacacuaauuucuuugaaaggaggcaagaagagaaaauagugagcaugaaaagaauucguuuuauauuaggauagccaggcaccauggcucacgccuguaaucccagcacuuuggaaggccaaggugggcagaucacuugaagucaggaguucgagaugagccugggcaacauggcaaaaccccaucucuacuaaaaauacaaaaaucagccaggcaugggggagugugccuguggucccagcuacuccaagaggcugaagccggagaaucacuugaacccagggaggcagaggcuacagagagccaagaccacaccacugcucuccagccugggcaacagagugagacucugucuccaaaaaaaaaaaaaagaauucuuucuauauuaggagaccauaauaccacuucuaagcuccuacugagugucauuuaugcaguaguuacuuuauauaugcauuauucuaccuaauuuucacaacauuauagguuagaaacuauuuugacccucauuuuuuuuuuuuuaauaaaaagucaaagucagcuacuuagggaaucuuaaggaagaaaauauauguuaguagaagguaaaaauauucuuaauuuuaauuaucacacugaaugguuagcuauuuuaucucccuuuaaagagaacaauauuauuuaucuauuaaaauaacucuuuucuuugcaaaaauucaaaacaucuagaaaaguauuauaagaaaaaaagaugaccuccaaccuuaugucucuuagaauaaugaccauuaaaauuuugaucucuacucuggcuaacuuuucuccaugcauauauacucagacacuuucuuuuuuaaccccaaaguagcucacacuacacaugcuacuuuauuaaauaacuuacccacccuggccaaccaaccuaccuuggacauuuccucaaguuaauaaauauaaauguaauuuuuauguaugacaguuuauuuaaucauuuuuuuacugauggauauuuaaguaauuuugauuuuuuugcuguuaccaaugauguugcaaugaacaaagauccccugaacaguguuuugaauacuugagcaauuuuucuuaauauaaauuauuagaaggaaaacugcugagucuaaugguaaaugcuuuuaaaaagcuauuucaauguaauuuuuuaaaaguacauuuaauuucuuauaaaaaguucagugcuacuaugaacuuauacuagagggcaucaaagaaucccgaauaaugcugcccaaaucuacaaaacuuuguaggaaaaaaacucauaccauuuuaaaguuguucaaauacuuaaaagcaagaaucaaaugcugcugccacacaagcuccacacaguaguuacauguguaugcaacacuguauuucagccuauugauggacaacauaggacugugagagaaaaaaugaucucaaaaauggcccugcuaugauggaaggcaugaacaaggagacuauauuguucuaaagaguuuucccaaucauaucuaugaggggcucacagauuaaagagcaucccacugcagaaagggagguugguccauacauccauuugaauaucuuagcuauacauucagaagacaucaauuuuacuaacccacuaacucacaacaccagauuccuuuuaggcgauaggagccaaaucacuuugccaaaaggaugcaccuuccugcaguguuugaugguuccaguuuauucaguuuacuucaacacaaucaaauucauauugagaaccuauuacagaugugcuagguauuaaaggucuauauauaaucaucuaauucaaauuuauuucauuuuuacuccacucuuggugucauaauuuaccauacuuaugaaaacuuuugaaaucuggcuuguaagcugcuugcuauuucaaauuuauauggaugcuuucaccucuccccgcuuaacauugaauacauguccuccacucuuugccagcuuaguucuuucuuuccaauaauuuaggugcuuggaugagguccuuagccuagguuauuaaaaaggaagagcugaacagaucuuaucagaaguuuguuucagauuaucaggaauauggaaugagggugagauuuuaaaauacucuuaugaacuuaaauaauuuuaaaauauaugcucaauuggauuauacuguaucuuguaaauuauagaaguaaauaauucaaauuuuguuauuugcauagaaaauaaacaucauugauugagaaggaaaaacaaacugaaaaguaagcuuucagauuucucucucuuccugauuaucaaauaaacucaaguaauguugucuaaaucaaaauaugaaacaacuuuucaacagagacuuacgucuuuuuccuaaauccuacccuuucccacacaauuuuuugaagaacaggauaaugguagcucuauauauacaaauuaucucuuuauucuucuaccuaaaugagugaauuuugauaugaaaacaauaaacacauauagagaaaaaauaaauuagucuaaccuuuaagaaaauauucauaaaaagcucaaauugcaacuaaauuuccuaauccaggaagacacaugcacaaaucaccauggcuuuucuaacuuaauguauacuggagucacuuauucuacuaaggacccauauuugagggucuuaccaucuaacgaacugauuaccauauacaacugacuagaugacgugcaaggccaaacagaauuaacuauaaauucuggucugcugccaacaguaucugcaguuccacauacuuagucucucuuaguaaucacccuucuuuaaagagaaacuaagaugagcgcugauggagggggguguccaaugguguacaguaaguuugagacucaccaggaacuuauuuuacacuaugagaaaugacaugaagauaauggcauuuugaagaauccuagcauuuccugaaaggcuauguagcuaucuugagucuauuuuccauuuguauuucccuuucuugauucuucuuuuuaagugguuaguucccuaaucuugaaguucucuacuuucuuaaaauuauuuguuguuauuguuguugcuuuaguuuuuccauuuuucuggaaauccugaacuguauuaagcuaggguuaccuuugcagacuuccccucuagauuuagauaaucaacuagcuuuuuaaccuaguauaaauaucuacucaacuagacuaaauuuccugagaacuaggaucuccaguguaugauagauacauaguaggcacuaaauuauaucuguuguaagaaugaaugaauucaguaucauuuaaagggucuacaccuaauuuaauuagucuccacauuuaucaccaaaaaguagcagcuaguagaaaugaugaguuuacugaagugucacaacaaccuguuauguuccagagacuauggcaggcauucacuuuauaggauuauuacauaaguuucuggcuuuaaagaguucagagucuaucagggaacccagaucaguaaaagaacaauggaaauaccauugauauucauugauagagugauaccagugaaacuuaaaauaaaauucaacauaaguuuuauaaccuuaaacugacagauaccugcauuucuucugcacauguucauaucugcaaccugucuccaugcguuaguggugggaucauauacuucaacacuuuuucguacuaaagggccaucaugaccuccuacagcauacaauaaauuguuuaacacaccaacaccuauaaaacacaaccagccaaauagaggggcaaaaagaacaagagauuuauaucauauuagguuuauuuaaaugacuuguaacuaaaacuuucgaaguuauaauucauaauaaaagcaagcugauacuauagccuacaauuuaagaaauggaaaucaauacaauugaugauuaaauaagcaucucaacaaacuauuauucugaaaaaagaggcaugucaaacagaauaaaaauauuaauaacauguaggugaaacacagggagggaaaaaguccuuuaauguaauccuuuugaaaacaauauccauaguaaaauaaccgcauauuaaagcacaaaauuuuaagaaauauacaugaaaagacuugauuauuaagcaaguuccccaauaagcacuaaaaacaaaaaacuaaaaggagugcuaacaacuugaauauauaaaugaaacagaaaugucuauggcacuuagacauuaaauuuuaaaguaaaauuacuuuguaauuacucccauuaccugcacaauucaaaagacauuuagcagugccacuaaaaucagcauaucauauauuuucagauaauguaaagugaugccacugaaucauuuuacuuuaacuauuuuccaucauuuuugugcuucaguugcuaaaacagguucacauguaccugcuccacuccgccuggugcucauuucugcuauauagguccacucauuuguuguagcauuauagcauucuacugugcuaagacacugacgugaugcuccaucauaaccuccuacagcauagagcaaaccuacacauaaaaucacauagaaagccaaauuuauuaaaaaacaaacaaacaaaaaacacuaauuuuucaagccagaaaauauuaauauauuuuccuucauggcagcagaguuuccccuuaaagugcugcugauuuuuaugaaauauauuagggucuugccuaauggugacagaugggguaaucaaaucauguuaugaagaucugcaggguauagcugaugauguuaauuuuauacuuucaucaauaaucugauaaaauagcacacucauuauaucuuuagguaacacuauuugauaagugaacaacauccuguaagacagaauuaaauaccaaaguuaucuuaggaaaucggaaaaaagguuaaaucaaaaauuaauaacagaaugcaaugcaauauuacuuggcauuaaaaaggcaugaaguacuaauaaaugccucaguauaaauaaacaaaucuugaaaacaucacccuaagccaaagaagugagucaccaaagaucacauacuguaugacuaaaauauucagaagaggcaaaucucuaagugauagaaaguagacuagcaguugcugaagguuggguaagauacgaguaagagccaagggaagcaggauugcuuuuagaggauaauaaaaauguuuuaaaaugaauugcagugauggaugcacaaugaacuguauacaugaaaugggugaauuguaugauguggauuauaucacaauaaagcuguuuuuuucuaagugcacagauuacaccuacgaugaggaggggguggaaaccugcaaauuugcccaagucaauuaaaaaaaaauaauaauaauaauacuuagagccuuccuuaacuucuguugggagacaaaguaggauauaaauaaauaacuguggcaauccaucccuuaacagcccuucuccagauauaaaauuacacauuuaugucaccugaauuguucccccaagcaacuguuaaaaucaguugacagucuuauacagcagcaguccccaaaccgcaggccauggaccgguaccugucuggaaccuguuaggaaccgggcugcacaacaggaggugagcggcaggugagcaaguauuacagcugagcucuacuuccugucagaucagcagcggcauuagauucucacagaagugugaacccuaucuugaaaugcacauuugagggaccuagguugugcacuccuuaugacacucuaaugccugaugaucugaggugggaacaguuucaucccaaaaccauccccccaacccaccccuguccauggaaaaauugucuuccacaaaaccagucccuagugccaaaaagguuggggacugcuguuauauaagucaaacacacacguguuauauaagucaaacacacacaguuauauaagucaaacacacacacacacacacacacacacacacacacacagagagaaaggaggagggauaaagggagggggauagagagggagagaaaaggcuuuauauagguugauuuauauagagaagcuaauuuuaaaaagaggauaacugaaauuuuacaguaauuacgacuuuucuuuuuaaaaugauaauuagcuugcccauucagaaaacuaaaguugagauuacuggaagaaccacucucaaggaucaaaaugccacauguaccugaaagaacugucaacaccuaccuccaacaacacccacaccaacacugcuccuccuuguauucaugggagcuacaugaaaccacucauuagacuuuauguuguaugcuuccacagaugacaaaccuauaauaaagcacaauagucuucauuuccuucucuaaaaaaugucaauaguucauauauauggaaaaauacuucagguauguuauacugggcuaaaauuaagagaagaaaaugguggaacauaaacacagcaauuacaugaaaaacagguacagcuuguuuuccagaaggcuccuaccuaagcuacugauauuuauaagcuuuuaaaauuugaugacugauacugaugcauaagaaagaaaauuuauauacucaccacucauaucauuuaaggaaauucuugauaaaauuuuaaacuuaucuuuaaauaccaguuaaaaccucacauguuguaaucccagcacuuugggaggccgaggugggcggaucacaaagucaggagauugagaccauccuggcuaacauggugaaaccccgucucuacuaaaaaauacaaaaaaaauuagccgggcgugguggcgggcaccuauagucccagcugcucgggaggcugaggcaggagaauggcaugaacccggcaggcggagcuugcagugagccgagauugcgccacuguacuccagccugggcgacggagcaagacuccaucucaaaaaaaaaaaaaaaaacacaaaaaaccucacaugugcccuaauguugccacaauuuauuccauaaacaugacuacuacguuaauuuuagcagcaauguagaauaaaugaaaaggaaauuaccuguacucccaucaaagccucccacagcguauaauaauccauuuaacacagcagcucccaaagugcuucuccggucucucauguuagcaacgcugguccacugguccuucacagggucguaggaaucuacagugcgaacucuuaaugagccauuaaagccaccaacagcaaaaacaaguccagccauguagaccaugccugcaaaaggaguacagcauuuaaugaucaacaugcaacucaacuaccaccaauauccaaagauugcuuucugauaaaucuauagcuguugucagaacaugcuacucuuaggaggagccugauuaaauaaauccuugaaaaugcuauucauuugcaagaacauccaaucacuaaauugucuuucuuucuaagguuauuauuauuauuauuucuuccuuucuuuauuuugagacggagucucacucugucgcccaggcuggagugcaguggcgccaucucagcucacugcaagcucagccucccguguucacaccauucuccugccucagccuccugaguagcugggacuacaggcgcccgccaccacacccaacuaauuuuuuguauuuuuaguagagaugggguuucacuguggucuugaucuccugaccucgugaucugcccgccuuggccucccaaacugcugggauuacaagcgugagccacugcaccuggccuucuuucuaagguuauuaaaaaaugcaauggcaugggcuaaaguaccauguugacucuugguuuuuuuaaauaucaauuuacaagcuuaaauaaugagccauuauuuuccaacuacuugaaccuguacucaccucccauagcuuucaauuuuggaucuucuaguggauauucuuagaaugaaacuccauacgcuuauaauuuauuugcauaacguauuccuaguuuaucauguuagugggcuaaaucaggggucggcaaauuuacagcuacaggcuaaauuugguccagcgaacuauuucuguagaacccauaagcuaagcaugguuuuuauauuuuuaaauggcugaaaaacaaccaaaagaggaauaauauuucaugacauguaaaaagcuauaugaaauucaaauuucaccauccauaaauauaguuuuauuggaacacugccacacucauucauuuacauauggcugguuuugcacuauagcaguagauaagaagcugugacagagaccauauaaccacaaagccuaaaauacuuauucucugguccuucaagagaaagucugcugauccuugggcuaaagagauauuacggaaucagugaauggagaaacuagacugcuagacucagguuucaaccaucuuuucacuuuucucaacuuuuuucaugcugcuguccuaaucggacaggcuccuaucaccaucuacucuguucucuuuaacucugaauccucaguuaaaguuccacauucucuaugaugccuucccuguccacuuuagccuaaaagggauuauguccagcucccgaacccuauagcaaauaacaucuauguuguguacuucagguuuaauaaauguaccgucuauaauauaauuacuuuaaauuguucaaauuuuuauuguucuuaguucuauaauguuuaugucccugugccagccugagggcaggcaauguggcucacaguucucugaaucccuguagggagaacuggaaucaccagauauguuugacgagcucaauguuuugcagauguuaucaggcaagagauguaccucugccccuuacugucuuaaccucuggugcuuuauucccccaccccuguaaaaauacacggaaaugcaguccuccauauggcaacaagaccuuuccaguucagaugaaguugccuguuuuggcccccugcuagcacagaauuuaacagacauccuaagagggccuggagacucgugagcagcaacauaccaggcagcauguuucagcaugaaacaauccuguaucccaaaaucauaacuaacuccagggaauguucauugugggaaucuugcccauugcaauuuucauuuuccuuucucuacccacaaaauaacacuacaaauaugccaucucuuagaaguaacauaguaugcuuaccaagguuuagagaauuuuaggucacagagaggaagaaaauaaaugaaucaaucuaugaagugcccccuaccaaaggcucugggucuggagaagggacugaacuaaaagaaguaugauaaccucccaaaguuaucaggaaacugaagugcccagaaguuuaauuacacaguuuauuaaaauuuggccaaguuuacacaguuaaggacauuggcucuaaucugaaggagggagaggaaagagggcaugaugaagauaaaauuuauucauaguuacccaauaaguaaagaauacauuuugcaauaaaaugagucaaaugacuuauggccucaaugaaaagggaacuguauuaggaaucagauaugaauuaagaaaccaguuaguaaauggcauacaagacuccauuucagauaguaacgauaaagauaaaacaccuaaaaauaaacuugccaagaaacacagaggaccauuggaagaaaauguuaaaaaucuacugaaggauauaaaagaagacaggaguccuaucacuaguuucauaacauaguaaaacauauuauaaagcucaguaacuaaaauuggcuuugucuugaugcaugaauaggcaagacaaaucaauggaagagaacagaaaauuuagaauaaaaccaaguaaauguggaaauuuaauacaugauaaaggcagcauuucaucaaaugaauggagacagauaagucaauaagggguauuuggacaacugacuagccauuaaaaaccaaaaucuauaccuuacaucuuagacuaaaauacagcccagauaucuuagauacauauauuuauaaauaaaacuguaaagguacuagaacaacaaauguuuuuaaaauauaauuuugucauaggguagaaaccuggcagauaccaccuuaaccaagagaacaagguuacccucacaaaaaauaaucauacuaagucaauuuaaccauggaaaaauaucagacaaauccaacuugagagacacucuucaaaauaucugaccaguccuccucaaagaaucaagggcauaaaagauaagaaaagacucugggacuaucucagauaagaagauaugacaacuaaaugcaaagcaggauccuagaacagcauaagagaaucaauggaaaaaugguaaauaugaagucuguauuucaguuaauauuaauaugccaaugcuaauuucuaguuuugauaacuguaucacaguaagauauuaauauuggggaaagaauauaccagaauucuuuguucuaucuuugcaacucuucuguaaguaaaauuauuucaacauaaaguuuuuuuguuuuuuuguuuguuuguuuguuuuuugagacggagucucacucuauugccuaggcuggagugcaguggcgaggucuuggcucacugcaaccuccgccucccagguucaagcgauucuccugcuucagccuccugaguagcugguauuacaggugccugccaccauacccagcuaucuuuuguauuuuuaguagagaagggguuucaucauguuggccaggcuggucucaagcuucugaccuugugaucggcccaccuuggccucccaaagcgcugggauuacaggcaugacccacugcgccuggccccacauaaaguuuuuaaaaaauauguuuguguguguauacacacacucacacgcacauauagauaacuuuggcauauggcuuucuaugcaagaaacaaaauuuuaaguccagagacacaaaacuuugguauacaggacuacauuaaaagauaaaguuuuuacauggcaaaaauagcacaaagucaaaagauaaaagauuaauacaaauaaguauucacacuacauaucacagacaaaaaggcuacuuuccuuaacauaacuguaucugugacaucaauaaaacuauuaaaauggcaaaaaucaugaacugacaauucagagagaaagauauuuaacuucccucauaauuacauaaguacaaauuaaggcauuuuucacccaccagauuggcaaagcucaaaacauuuaauuacaaaguacugucaggaguuuagggaaacuggcaccuucauauuuuacuguuagugggaguaauaauuggcauauccuuuuaagacauccuuugaaucaguaagucuaguuuauccugccaaaauauauuagcauauguacacaaugauguauguauaagagauuuguuguagcauuguuuauaacauuaagauuaaaaacauuuguaaugcucuauuaaaaacuaguaaaaacuauguccagaccaaaauaaaacacuagacagcucuuauugaaugagguaacuccagauaugcugauauguaacaaucuccaagauguauuguuaaaguacuaccaucauagaaacguuccauuacauacagaacucauuucgcuaugggagacagaaauuauggauccaaguuuaagucccaggaaaaauucugaguuuguauaauaacugcuucuuuugaucacagcuuuggcuaaaugaaagucuauuucaacaaauguuuguaaaacagaugccuugaagaaggcaauuaugccuuauaacugagggacuuaacaguaccuuauagcugagggaaucuccuagaacuaagggucccaaccuaaagaauuccccucucaacacuucaggcaaauguaacuaggaaauauccggcaaauuacuagcucucccaccuuacacuaaacaaucagaaagauauguaaagguggagacagaguagcuaucccaucaaugucuugagaggcauaugaggccccugaauuacuguuuaacuacauagcuauuuuacucaaagcuuuuuugauagagauuuuucuaauuaauaaaauaagaccugaaaaagaagcucccaaugacccaggaguagagaauugaccaugaugcaucaugcuuaccugcccugcaccuccuggaaggcaacucugcuacuuggugccaccuuucuucuuuaaagucauagcauuccacacuccggauagccuuuggugcuuggcccccaaccaccaccaucaacuacaagggcagaaauguaagcacuugaacaaaugacuauuacauauucaggauuuaaaauguccuacaaagacacuggugugggaaguguuaggaugaagaugauagggugagcuggcgaauacaaacaucuaaccaccuaaccaacauuucauaaacaucaaccaaggggacacacguuaaaaauacaauucuaucguccagcacauuuagucaaaaauaaggacuucagaaacuaaguuucugauccuucaagcaaaagcaguuauuuaagcaaaaaaacagcacgcaguuauuacuggcaaggcugcaguaugucauagggcuugcuauaaacuagauccugguuuuugcaaugaccaggcauuagaacuccauaauccaggagagaagauagaaaugaaacauauguuacuggguaggugaagugaaacggacaguaaguauuaaaagaaagauggaagaaggaaaaaaaauauugaaaaaggaggaguaauugaauuggagcucacaagaguacagauucccgaaucuccaguagagaccuuuccugaugccccacaaauaaaacaaccuaacaggacauguaauggagaugcuagauaucauaaugaacaaauacauaaaagucuacuuuugagaauaaaugaggucuauaaguucccucaacucaauccaacaacuauuuacuaaaugccuacggucuauauguguccagaacuauguuagguguuauacauaagaaauauaagacauggucucuacccuucaagacuugauagaucucacuaaggagacaagacuuaugaaguaacucaagaagaguacacaauuacauaugaucgaaaaauuaugugauuaguauagacguaacugcuacugcugaucagaaaaugaaaagcugccguaauuuagugaaagcuuccuggaaccugaucuauggucuugcuaaauggauagaauuuagaaaucaaugugucugccuuuuacugaguaugcacagacacucucuggcaacagugaaaauaacagccaucaaaucagaauaauguaaacauuaaugaugucucaaaucaaaaacuguaaagaauggcaaggaccuucaggaaaagaagagauaaugauuggaaaaauagauguuagaaagaaacaaaaaauaaaaacaaacagaauauggaguaacucauauacacaaaaagaggagauuugcagccuugacuaggcaaugaccuaccuguacuuagaauuaaagaaagauggguacaaagcaaaaaaugauuccugaaucagagagcaaaucccaaauuuccaaaaagaagcccauuuuaguuuuugguaacuggagagcagaaugaauuuuaaaagucuuaaaagaagacugaacauaaaccaacuacauaauuuuuuucaggccuguuauucuucuuggccagguaugguggcucacgucuguaaucccagcacuuugggaggcugaagcggacagaucaugagcucaggaguucaagaccagccugguuaacagcaaguccccuuucuccacaaaaaauaacaaaaauuaaaaauuggccaggcaugguggugcacaccuguaaucccagcuacuggggaagcugaggcaugggaaucacuugaacccaggagguggaaguugcagugagccgagauugcaccauuacacuucagccugggcaacagagugagacucugucucacaaacaaacaaacagacaacauuuugguuggccaggcacgguggcucacuccuguaaucccagcacuuugggaggccagugcgguuggaucgcuuugagaucaggaguucgagaccagccuggccaagauggcgaaaccccgucucuaccaaaaauacaaaaauuagccaggcaugauagugcgugccuguaaucccagcuacuugggaggcugaggcaugagaaucucuugaaccugggaggcagagguugcagugagcugagacugcacuaaugcacuccagccugggcgaaagagcgacacucuaucucaaaaaauaaauaaauaaaauaaacauaauuaauaaagaaaauauacaauacccucaccucugaccacccaaaaacggcggggggggcaagguuguaaaaauuacagaauugggaugcauguuaagauaaaccuuguauuuaggguucuguucaaaacuucaaaacugcccaagagacaauaguugaaagagucuuagaugauauaucugaugaagaccaauuuuucuaaaauuucagaagggaacauuuuuuaaauuuuuugauaaauaacacugaguuauagauuucauaauccucaaaguuugaauauaagauuucuauuuccacgcaauaguucacuuuuacacauuaaaaugaagaugaaaaggaaaacugugcuauuacauacagagaacaguaguaauauuuguccuuuacucacccaagagagggaaaaugggguaacgauuugggucuccaggaaucagggauaaaggagacaaggagaacgugcaauggggggacaggaaggcaggaauauuuauauaaaaccaagagacugugucauaaaccauuguguggcuaccaaaagaguugcucauaaugcugacaucccaguuaucuguaaaagacacagguauuugagaaacaccauacuaauuaugcuaugaaggaacaagaaaagaagaccuuuuguaaggaaaaguuaaaaguaacauauuugaagagggcaagggguaggagguuaagcaaauucacuaaucauccugaaauguacgucaauuaaacuuuguuccuuuuauuuuaccuauuaaauaaauauuaguugaaaauuaacuccugaaaaaucaagauucuaacugaaaacuucaauaaauauacuggguaaaaauauuuuuaaaauauaauauauacccagaaauaugacagcccuuauaaaaauacagauuccaaagagaaaagcuaacaaaauacaaaagaagcaaaacacacacaauuuuuauuaugaugugcaaauccaaggauaccuuauacaaucuguuuauugagaagccaaaacuaaugucugagauaugaaaagaaucauucaugcaaauuaaaaaucagaguguaauauaaaaaguacuaauucacucucaugguaaaauauuaucaaaaccuuguaauuucuucagcacgacuaccacauuuuguucaauuugacucauuauuacgaugauaaaaggcaucauuacuaugaaauaauaagcauaagaaauuaaucuuugcuucauucuuacccaacuccuuagacuuaaucugaacauaacaacucuaaaaugacaaauggugguguuggaaaauuguucaucaccagcaccuuuucgaaaauauguguggauaaacaaacacacugagaagggaucauacaaguaaacaugcaaagucaaagcaacagggcugcucacugcuauccagcaagucugcugccccacccaccacccugauagagcagaaugaaagagaaccuccagggacccacauacccagcacaaaauaacagcuagagaacugagaaaucuaaaaguauaacacagcuauaggaguccuacuccaaaaccacaaccagagaaguccaggaacaauguaaacacaacaccacaaaagagaaaguaaguacuugauaggcuuuuaccgagaacucuagguuucaaaaaugacauguuuauuccagaaaucaaaaaugaauucacuuucacucuaaaggucucugcagcauagcuaaauauaggaaagucugaagaugcuagaggaaggaauauacaagaagaaauucuuuuuuacaaauaugaaguauuuaaaaaguauuaaagauauagcacauuauuuagaaggaaguuggaaagacuuacauaaaauaauaaaauaaaauaaauggcaaccuuaaacucacugccaagacugaacaauuuuuauaaauggauuauuuuguaagaacaaaaacugacaccaaauaagauggacaaauaugaauuaaugaagacuuaaaagauggguacuuauaaaagcagguguaaggguauuugaaaaauguaaacacauauaaaaucagcagaccuggcaugaauacugagguauuaagggaacuagcuaauguacuuacugagccacuuacaauuauuucugaaaaaucucagagaacugaggauagaucagaaaauuuaaagaaagcaaauaccaaauuuucaaaccaggauaggaagugaauaccuuguaaauacacuuuguuaagugaugauaauucugaguaaaaauuuagaagauuuugagaaaagcauuugaacuucuaggggccaauaaaauaccaugcagaagaauguuuaaaaagucaugccaaauuugaauccauuugauccucaaccucaucagauguuauaugccaaacuacuuauuuuggcuuagauaauaaucauauagaaugaaacuuuccacaaauagacugugucaguggcuggcuacuucuaacaaggugccaccaagagaguuuugagaucaauucuaaauuaaaauauuugcuaacgaucuagaaaaauaagucaacagcauccuggcaaaucugcaguuaguuauaaauugagaacuguuguuaguaauaggcaaaacagaaaaacaauaccaauauagauuugcagcaauuaaaaauguagacuccaaaguaaaacuuagaaaaauauuaaaguauuaaagugaaagaauuuaaaaaacaauucaauggaaaggacagaguaauaacugaagaugauauaagaaaacgagagaacagauucuuauuucuuaauccagcauugcccgaaacauauacaagaguuaaaaauaaauacauaaauaaagucuuuauauuaugagucauucugauuagaccacgcacaaaauggugcuuaaaguauuggucguacuauaaagauguaaacagagcagaaggaauugccaacagagacagaaaugagggguuauuucauaagaaaaauugaauugguaaaauaugaauggccacagcuaaaaagaccaagguagaauauaaacauucacauaggaaaauaugaacacgagacacacgggaagacaugggaauguaugcugaaauggcuacauaugaugugcagggaaccaucaaaugguauacagcagggaacagcaaugagaugaacugaacaagcuauuuuuaucaucuguaguucuaauguguaauucugugaaacuacuggguuuucaguuauuaaacaaacaccuagcuuacaaaauaauucuuuuuuuuuuuuuuucuuuuuuugagacagagccugucacauuguugcccagacuggagugcagugggcacuccacucagcucacugcaaccuccgccuccuggguucaggugauucucugccucagccuccugaguagcagagauuacaggcaccugccaccacacguggcuaauuuuuguauuuuuaguagagacacgguuucacguagauggccaggcuggucucaaacuccugaccucaggugauccacuggccucagucucacaaagugcugggauuacaggcaugaaucacagcaccccaggccuacagagaaauccuucuaccuggucugauuuuuuuggacuauaauuagagcuuucuacuauaauuagagcuaauaaaacucagaggggacaaaaaccaguugucuucuguuccagaagagugacaucaugcaguuuauaaaaauuaaacggaccaaagaauccccacccuuaacauauaaaaucaauagagguugaauuacauacacuacaaugcauucuuaggcacauuuucucuugaaggaaaacuaaaacaauaaaucacggaaauucaaaugagcaaaauacuaacagcuucacuuauaagccuuuugcaugagguaauaacaagcaugagaaacagauccuacuuugggaagguucauggguguccucagccggguccggacacucuucauuaauauacgcugcucuguuggcagcaaaugguacuucauugcuucaaugagguaaucuuugcaagcacugcuauucuugaccaaugcuuccucuucaacccucuguaacaagaaaucagacacacccacugaggguagggcuauuucauaauuaaauugccaaagaaaaagaaguaaaggagaggaaaaaagcaguaacuauauccuuuaguuuagucuaaaaauaaacgaggaaaguuuauaaauacaucuaagagaaaaauaaauauaaccaaaaaaugcucaaguaucuggccugcagagaaaaacauauauagguaauaaaaagaagaaccacagugaaaaaugauaaacuucaauguuagcuauggaauaugaugaacucuucggauauuauauccaccuguguaucuuuaaccuuuaagacaaaaaguaagcaaaacaagaaacaaaguuuagauaauacauccuucaggugaagacaauacuaauaaguuaaugauaccuuuuucaaacacaagugggcaaguaaaauaucccaaaaagagauuagaaauaccuuaaagcaacguacccauaacacaaauaaaucuuguacugccuagccugaccucaaacgcaggacaggcuucuggguucguuuucuuuuuucuggggggggagggggggcggggggaagggaacagagucucacucuguugcccgggcuggaguucagugguacaauccuggcaaacuccaccugccggguuccagcaauucuccucccucaccuucuugaguagcugggacuacaggcaccugccaccaugucuggcuaauuuuuuguauuuuuaguagagacggggauucaccacguuagccaggcuggucucgaacuccuggccucaugccugccuccgccucccuaagugcugggauuauagacgugagccacugaccgcacccacccuuuuggaucaucuucuuaauaccagaagacccaugauuacacagaucacaaaaaguaaugagauuucaagaaauccuaaaauguucaaaucuaauuucuuaauaaaugauucuuucaaugguuucaauuauuaaaauaaugcugaaauguuccuagcgggauucuaauaaaaaaaacaguaaauuuaaaauuauuuggagaccacuaaagaaucauuuuucacauuuauuucaaauaauguuuucccucagcuuagaaauaaagacagaaaucaaaugcaugccacuauuaaauuacgaaguaaaauuaaacgguauuugggucagaccucaaaauuccaggucugcaggggaaucagaagagacuauggaaagaaaaaaacaguaaagaagaugcaaagcagugacugccacagggacauuuauuuacauguauuuaagugaccacaaauacuaccuugauaagcucuaguacuugcuuacccaaaucaaaaauaggggcaaaagcaaauuucuaagaacggggaaugguggcuggguguggugccucacaaggccuguaaucccaguaguuugggaggccgaggcggguagaucacuugaggucaggaguucgagaccagccuggccaacagggcaaaaccccaacucuacugaaaauacaaaaauuagcugggguuguagcaugcaccuguagucccagcuacucaguaggcagagguacaagaaucacuugagcccgggagguggagguugcggagagccgagaugacgccacugcacuccagccugcgggguccuuuacugucuucuguccuguacuccacagaucugcauucuacagcucuuaucacugcuugauagggaucuacaugcugucaggccagugacacagugcuguguggauucauauguuuugcauaugcauuuaccugaacuaaauauucccgaggaagcaaagguaaccguacauguuccaucagucgggccauaaacucuugccucacauccuugucaugguucacccaugcuauuacugcuucaaauaccuugcagaaaauauaggagaagaaaaaauaagaaaugaguuguguaucaaggcaucuggauaaaauaugagacuacauuuuauauauaacucuugcuaagacauccaaguuuaauucacagcucaaguguuuucaaaauccugacuugcaauguacuuacaaagccauucaccccauuucuuuucuguucuuuuuuuuuuuauuuacccaaaauaauaaagcaaagugauauucuggaaugaaaaucauguauccuuauaaacaauucauguuuggcuuuuucuucagguuuacaaacaaauguuagaccauacacauaaaucgaagguuuguacaauagaucgacucagcucuguaauagcagaauauauuaaaauguaguauuuugaaauuuuuuuuuacaaauuaaaaaauaagggcauuauuuuuuacaauacauaauugugagaaagcuaauaagcuaauaugaagacacuguuugucuacauaauuuucuucucaacugaugaauauaucacuuaauaaucuuuaaagguuugcaggaaauguuugacaauaugcaauuggauaacugagaccaaaaauagguuauuuugauccaggaauaaagcaagaaacuaauucucucauacuuuguggaucagcuuacauuuuggcaaccuuuuauugauuucugcaaauaaauaacaagaaugaacagaauggagguaguaaaacauuuugcaaaguuugaaaaaaaaaagcaagaaacuaaaaauaaugcacauuaaaauuaacaccccucuuuaauucauucugucaacaaguauuuaucaagugucucuacgugccaggugccagagauuaggugaacaagauagucggccuucuggcaauucuaucuaauauuucucaguucugucuucucuccccccugcuucuaucaucccauaucggaaccugcugcucacugguaugacuucaacauccucucaucuggcccucaccucauuuuugguccauacugcccaccaccaccagauagcuagucuccaaagauagccuccuaauaaaccacaucucccagauccauacccuuauauaguaacccuccacacugaaucuaagcuggcccuguuaaccaguagagugcggaggaagggacacugugcaauuucugaagguaggucuuaagcagccucacuacuucuacucugcucucuugaaaugcucauuugaaggaagccaaaugucauguaagaagucuggcuacuugaaaccaccacaccaugagaaacccaugcaaguuacagagaagaaaggaggggagaggagggagaccuagagagagaccaaucaaccgggagccccggagccagacaaaaguagguggaggagccaccuuggacauuacagacccauaagaugccaugugcagaagaacugaagcuccagaucuauggcuccaguagaaccaugccagguaucuccaggcaucugggucaccuuagccgaggucucagacacuguggagcagagacaagcugucccuauuguucugcaugaauucugaccauagaauuguuagcauaaaaugguuauuguuuaugcuuuuacauuuggcaaugacuugaguagcagcagaaaaccagaacagcccucaugauauuucuauaaugcagguuuuggcaugguuuucuccucuggcuuaaaacccuuuuaaggcucaucacuacaauacaguuaauuuucuuuaacauagcugagaagauauuuuauuauaucaucuucuaauuuuaucuuccaccaaugucucauauucuaaacucccaucauacugaacacauugaauacaauuacucuuucauaucucuuuacauuuguauauucugcuucuucuaccuggaaugcccucugcauucccacccaucccuauuucucuggcaaacucagacucauuuuuaaaagacuugaaauauacaucugaaccaaguugaacuaccauccccauaccuaucccauuccuggaaaaguuaaaugcuccuaaggcacccuuuacagcauucuguaaucaauuauuuacucuacuggcugucccacuagucuaugaguaacaaauucuauucugcuaaucuucucuucucuaggagcccauggcagugucugguacauggaaggcacucaauacaugucuauuaagugugaaaguaaugucaucuuccucuguauuucuaggaugcuaagauuauauaugucacaaaugcuuucacauuuuuuaauacuguaaauauuagaguaaaugugucuuuaaccccaggugaaaugaauagccuugagaaagagaaucagaauuuacacaacuugaaaugcuaagcacacaaaggagaaacucaaguuucauuuccucuaagcacagcuuuugugcucugauucccgugugcuacaaaacccacccaaggaaaaacagcccacuaaaaggagcuucucucuccaacuauacgaaaagugcagguggcugacaaagguaauucaaaacguggagagacaaaagacuacaaccagaagcaguagcugcacagagagggagggaggcagggagggagagagucagggaggcaggcaggcugaacggacuggcaggggugagguauuaugucacaggaaaucaaucuaaaggaaggugacaaucaagaauguucagucuagaacuaccaaaacuucgccauccuagguaaccucuuucaacucagaagacaaggaaacuaauuuagugacaaauauuauguucacaucauaauuccuacaggcauugaguuguaggaagaaacuaguuuccaaaaaagcauuuguuucagauagucuaaugugugcaagcucuugcuguggaggucaaguacaaaacuguaguggcuaaaaauuuagggaaccucccacaaagugaagaccgggaguaauuuacauagacaaucaacaaguccugaguuucuuuuuuuucuccuggaauccuuuccugaaguaacuagcugaguuucuuaacuuccaguugaaacaucacuggcugucacuacacauacaggaucacaaagcuauaaaaaaaagugaaauuaaaaaaaaaaaaagggaaacaucauugcacacugggaaaagaaaaauauccuuaccuucucuucugaagaaaugguaaguuugucacuugagauuaagcugcacacuuguucgaugccaagauugagaaauucuucacuaaguacaacaucugcaaaauguugcucuguuugggaauuaaaaagaaaauccacuaacaucaacauuccauuaucauaguuucaaacugcuuaaaaaagguuuuucuuaauuuaaucuaacuuaagaaugagaaaaccaauugcacaccuccaggcaagaacuaacaagacaaacccaaacaaacucagagacaccuggggauguaccuucagugauuuguuuauacaacagcacaguagcagugcaaggagggaagcugccuuaauauacacgcacuuaguugaaucauucuuguuuuacauggugguauuuuaggcuuaaaaaaaucuauuccuuauaugguaugacaccaucaguacuuaaauuuguaaaaccuuuugauuauauaaaucagauaaagaacaugaugucauauugucauauccuacaugucauaucaugugaaacauuagaggguuguuccuuauggaguaaggaaaaaagcccugcuuuauuuggaaacuaaagaaaucucaaaugcuagccaaucugaauauaugaccaacauuuuuuuaaaaagagagaauugggccgggcgcaguggcucaugccuauaaucccagcacuuugggaggcagaggcgggcggaucacaaggucaggagaucgagaccauccuggcuaacacagugaaaccccgucucuacuaaaaauacaaaaaaaaaaaaaaaaaaauuagccaggcauggugauggacaccuguagucccaguuacucaggaggcugaggcaggagaauggcaaugaaccugggaggcgaagcuugcagugagcugagaucgcagcacugcacuccagccuggaugacagacagagcaagacuccgucucagaaaaaaaaaaaaaaagagagacagaauugguuuaugauauagauagcucugaauucuaaauaaauaguuuauuucggaucaaauuccaggauuuuaugccucaacccauuuccagaaacuuguaaaauuaguaauucuuaaauacuuaaaaaauuuuuuucccuugauuucacaaauauggccacucuucccaaggggaaaaaagaucgcuucuuggccuuuuggcuaagaucaaguguaguaucuguucuuaucaguuuaauauccgauacguccuccauccaaggggggaaaagacuaucagugcaaugauugaaaaccuuacaaagaacgaaucuuuuguaaaauaaccuuucuugcaaaucugccucacaagggaauguggugguuugggcugcggauucagacauaccaggguugaaucccagcucugccauaugcuagcuuguacaaccuugggcaguuaacguaauuucccuaagccuugguuuccucaucuguaaaaugaggauaauaaaaauaagauugcugugaggauuaaauaagcuagugguuuauaaagcaccuagaacugugucuguagagaguaaggauucaauaacuuagcucuuguuaauauuauaaauucuaaaguaaaauuuugcuagaaaaucuagguuaauuucuaggucgucacaaugaaccauauuuauuucaccuuauaaaacccuuauaaauagaguuuauaaaacuguuuuauaaggugaaauaaaagauucauuucaaauauguauuucaacauaccauaaaaaggaacaguuggcuuccccuucaaugacauuugaaaaauaaaaccugcauuuucauaaaucucaugaaaaacuauucaauuuacaaaagguuggcagggcaugguggcucacgccuguaaucucagcacucugggaggccaaggugggcggaugaccugaggucaggaguccaagaccagccuggacaauauggcgaaaccccgucucuacaaaaaauacaaaaaguagccaggcaugguggcacacaccuguacucccagcuacuugggaggcugaggaggcaggauugcuugaaccugggaggaggagguugcaguaagccgagaucacgccacugcacccaagccugggcaacagaguaagauucugucucaaaaaaaaauaaaaaaguucaccccaagauaacuauaaaaaaaacaagcagcucuaaaauguuuguauuuacaaaauuuuuugaaacucaaaaguuuuuugacacacaauuguuuaaaacucagacuugacaaagcaagguauugcacugaaauaaauaugaaauugaagauguaaaugacaaauacaguuggaucuccauauccacaaguucuacaucugcagauucaaccaaccggugguucaaccaaccucaaaucaaaaauauugcgaaaaaaauacaauaaaaaacaacuauagcacauacacuauauuagguauuauaaauaaucuagagauuauuuaaaguauaugggacaccgagcacaguggcucacaccuguaaucccaccauguugagaggcugaggcaggaggacugccuaagcagaggaguuugaggcugcagugagcuaggaucacaccacugcucuccagccugggcaacuggguaacggcuugucucuuuaaaaaaaaaaauuaaaaauaaaguauacgggaggaugugaguaggcuguaugcaaauacuaccccauuuuauauaagagacuggagaacccacggauuuugguaccuguuggggguccuagaaucaauaccccauggauguggauaccaagggaugacuguaggucgacacaacagaauagagagcccagaaagagaccccacaaaaacacaggcaacugaucugugacaaagaagcaaagccaauucaauagaaaaagaagagucuuuucaacaaaugauguugcaacaacugaacauccauaugcaaaacaguaaaucuagacacagacuccacuucucacaaaaauuaacucaaaauggaucagcaacuuaaauguaaaacacaaaauuuagcuucuagaagauaacauaggagaaaauuuaacuaaccuuggguauggcaaugacuuuuuagauacaacaucaaaaguauuauccaugaaaaaaaaaugguuaaguuggacuucauuaaaauuaacaacuucucugcucugcaaaggaugcucuuaagaaauuaaaagacaagccacagacugggggaaaaucuuugcaaaacacauaucucauaaaggacuguuaccuaaaauauaaaaagagcacuuaaaggucaagaagaaaauaaacaacucaacuaaacaaugggcaaaaagaucuaaauggacacuucaccaaagaagacauauacaaauggcaaauaagcacauggaaagaugcucaauauuacaugucauuagagaacugcauauuaaaacaucaaugagauaccauuuacguaucuaucagaauagcuaaaauccaaaacacugacaacaccaauucugacaaggauguggaaugacaggaacuuucauucacugcugguaggaaaucaguuuggcaguuucuuccaaaaucaaacaaacuccacccccuggguucaagcgauucuccugacucagccuucugaguagcugggauuacaggcaccugccaccucaucuagcuaauuuuuguauuuuugguagagacgggguuucaccauguuggcuaggcuggucucgaacuccugacucaggugaaccuccaggcucagccucccaaagugcugggauuacaggcaugagccaucacacccagcuggauuauagauuuuaaaaagccaucaugauuaauugcaaaaguaccuucuauaucuaaaauauaaucccgcuaauuccugacuuuaccagaaguuuauauaaaaaaauuauacacuaaggaaguuuucuuuauacacuaagaaaaaagggaaaacuuuuucaauaguugaguuuguuuuuuaaagacugaacauauuuaaacaaacaaacaaacaaaaaacaagguucuuuauauuaaaaguuccaaaguaggccaggcgcaguggcucacgccuguaaucccagaaucuugggaggcugaggagggugggucacuugaguccagggguucaagaccagccuggccaacauaguaaaacaccaucucuacaaaaaauuagcugggcaugguggugcauguuuguagucccaacuacuugggagacuaagguaggaagaucaccugugcccaggaggucaaggcuacagugagccaugaucgugccacuauacuccugccugacagagugagacccugucucaaaaaaaaacaaauaaaaaaagagcucuaaaauauugagaaauaaauucauuuuaaugaaaagcuggcaaacagcauauaaauuuagaaacauuuaugaauaccaacuuggaaauucaaacagaaaacacagcagccacugaacaaaagagaagcuaacauaaaucucuuucuauccauuauaaaaauauuuucaccuucaaauguaugucuacagugauuuuggguuaaguuucuucuguauauuuuaaaucugaaucaaagcaagagauugcuggccgccuuaugcuuuucaugaggggaaagaacucuccagugguaacaaacauaacugagagaacuuuuccauacugugacuacauguuaucuuagucucugcuucacugaccagaaaaaaauggacuugcuaaaaagccaacuugguggugauuuuuuaaaagucagcaauuacauaaauguagaagggcauuaguaaacucuauccaaaaccaagucugggaucuaaauucauuguguauucuuuccuaguguaucaaagaagguuaagagggcaaggaaaauagucaacuauuacaacuuuauugacaaaaccauaacacagcugucacucaaacaccaccccuucaccacuuaccaaaaaaaaaaaaaaaaaaaaaccaaaccaaaaauuagccuaaaggaaaagugaagaagaaauguucaaauuaaaaguaacuuucauuguguacauauacauguuuuuaaauaauucuaauucucaaauacuuuuauuuucuauuggaacaaucccuccuccuuagaaaaauuuuuaaguauugauaucuaauguuuacauucuuauacugagcuuucuuuggaaaggaugugguuaacauauauggagcauuacuaaaauauagagggcacuauuuggcaacaucuggaguaaauuaguuuacuuuagggccugccuuucuucuauuuauauuaacuguauauuucuucaaguguucuacaguauuuacugauaggcaauuuaaugagauuguugcuuguaacacacuuccuaaggacccaacacuuuacacagucaggaagcacuagaugacuggcaaagucacucuaaggcaugcauggaaaauucuauaggaagaaaggcaagaagccuagugcagcucaccuguuauuuuauauguucuugaugccaaucacuauuagucugucuggugcuuaguucaugacauuaaaugcucuuauauuaccacuaguacuaauaaaaaugauguaacaugaacauuccuucccuggccucaagccacaaaaccaugaggaucaaaguuaaaaaaaaaaaaaaaagcaacaacccuauuaugaaacaguaugcuauuucauacugcuggugggaguauaaaucagcacaaucuuuacagagagcaauuuugaaaucucauccuacaaauauacuugaccacucaugaaaugacacacucugaguuauucacuguagcacugcuuuuaacaacuacaaaagagaguucaucaguagacacuaguuuaaaacauaguauauccauacaauggaauauucugcaucuguaaaaaugaacaaggaagcucaugauaugaaaaaagcuuuaggaaauacugucagcuuagaaaggaagaacgacagaugugagaaugcauuuuuucaguggcuagauuguuuguucuaugaaccaugugaauggauuacuuauccucuccaugcaagaaaacaaaacaaaaccgagaaacuaauaauagugauuaucuuuagaggggagagaaaugaggaacaagggugaaaggaugacucuuucaauguauaccguucaaauauuuuuaaauccucauguauaugguaaaaugaucuuugacaagagugccaagaccacucaaugggaaaagaacaaucucuucaacaaauugugcuaggaaaacuagacauccacauagaaaagaaugaagguggaucauauacgccauacacaaaaauuaauucaaaauggacuaaggaucuaaauguaagacucaaaacuauaaaauuccuagaaguaaacacaggggggaaaguuucgugacacuggauuugucaauaauuucuuggaaaugacaccaaaagcucaggcaacgaagacaaaugggacuacaucaaaguuaaaaguucagugcaucaaaggacacaauaaagaaaaaaggcaaccuguagaagagaagaaaauauuugcaagucauguaucugacaaagaguuaauauccagaauauaaaaauaucuccuacaacucaacaacaacaaaaaucaaauaacccaauuuaaaaaugagcaaaggacuggaauaaacguuucuccaaagacgauauacaaauugccaauaagcguaugaauagaugauagauguucaacauaacuaaucaucagagaaaauacaacucaaaaccacaaugagauauuaccccacacccauuaggguggcuacuagcaaacaaacaaacaaaccagaaaauaacaauuguuggcaaagauguuaagauacuagaaaccuugugcacuguugguaagauuauaaaauaaugcaacuauuauaaaaaaaagcauggagguuacucgaaaaauuaaaaguagaacuaccauaugauccaacaaucccacuucuguguauauauccagaagaauggaaagcagggucuugaagacauauuuguacacccauguucacagaagcaugacucacaauagcaagaggcagaagcagguauccacugauuaaugaauggauaaaugaaauugguauauacauacacuauauauacauacaauuccuuaaaaaggaaggaaauccugucacaaugcaacauggaugaagcuugagaacauuaugcuaaguguagugagccagucacaaaaauaaaaaaauacuguaugauuccacuaauaugagguaucuaaaggagucaaauuuauagaaacaggaaguauaauaauacuugccagggacagcggaaaguagaaaagacgaguuguuuaaaagguacagaguuucaguuuugcaaaaugaagacguucuagagaucuguuucacaauaaagcaaguacuuauacaugacacuacugaguggaacacuuaaaauggcuaaggugguaaauuucauguuauauguuccuuaacacaaauauuuuuaaaaguuuauaaccauuugaaaacacuggugaugaaaauuaaaaaacaaaaauaaaaacaaagcaagcaacuagauccaacuacuuuccuuccccagugagaaaggaaguguugcuauagacagucaaugcaugucacugucuugacuucaguggacaaauaccugcucugcuaaaaaagaaagaucacuggguuaacaucccuauguuuggcugcuguccuaccuugucagccuccacaccagacuucucaagagcagaucucaauucugaagccucugcgugcugaugcacacucacaucuuuauguuauggcauagccucuggcucaauuuuaccuugaaauaguucuuuggaagucuuuuucuuggcauugguccuucucaaccucucugcugauuuuaagcuuaauggccuucucuacugguuaggauucuauauauguuucuaccuuucugaccacugaaucugccuccuuuaccucccuaaaacuagguauuacuaugguccugccugccuucagccuccuuuugauucuccacuuguucugucuuaacuaucuaauguauauuacuguccacaguuaucuuuauuacccuaauauuguugcucccagauccaaccucuccccccaaaccccaauguuugaauuucuagcugucuguuagucuccauaugaauaugaucuaaucaucauggcucuuuuaaacaagacagagccacccauacaccaugaaaccaguaccacauacaagcaguccucuaaaaccuucagauuaauuacuaccuugggccacuuaccuuggccuguuuugagcucuguggucugacuuuucaucauugugcauuuuuccacugaugcuaugcuucacucuuuggccugauacuuugauaaagauucucuaaugucuguugauauuccucucaacauaaaucaaguucuuccucuggccaagcugucuuuggcuacuguuaaacaucuugcccaaucugagaaccuuuaaauugauacugcacuucacugcuggcucucccucaagcaaacaagaugaggauauaccuacguuucaaaccguuucagugaccuccuccagacaccugcuggaccucccguguucccuuuguauccuaauggcuucacucugauuccaaggaugaaugaagucuuagucacagucauuuuugccucccucccucuauuaugugauuaaaaacauaaaauuuaccaccguaaccauuuuuaaguguaaaguuuaacaguguuaaguauauccacacugggccaggcauggcggcucaugccuguaaucccagcacuuugggaggccgaggcagguggaacaccugaggucaaaaguucgauaccagccuggccaacaugaugaaaccccgucucuacuaaaaauacaaaaauuagccaggaaugguggcgggaaccuguaaucccagcuacuugggaggcugaggcaggagaauugcuugaacccaggaggcagagguugcagugagccuagauugcaccacugcacucuagccuagggaacaagaacgaaacuccaucucaaaaaaaguaguauauucacacuguuaugaaaaagaucuaacauuuucaucuugcaaauaugaaauucauuaaguaacuacccuuucccucaucaucccacucuuuuuuaaccccuaaugugaauuauuucauaaacccuguuaauucuuucucaguaaugccauaaaaaucauaagauuuaaugguauaagagaucugaaaggucaccugacacagcuucuauaauauguauucguaaccucaaaaauuuucacaauaaaugguuaucuggcuguaguuuacacacaucaacagauggcaagacagucauaucauccuugaacacugauaagguuuggcucuguguccccauccaaaucucaucuuguaacucccauaauucccauguguugugggagggaccuggugggagaugauugaauuaugugggcaggucuuucucaugcuguucucaugauagugaaugagucucacgagaucugacgguuuuaaaaaugggaguuuccuugcacaagcucuguuugccugcugccauccauguaggaugugacuugcuucuccuuacauuccaccaugauugugaggccuccccagccauguggaacuguuaaguccaauaaaccuuucuuuuguaaauugccgagucucagauaugucuuuaucagcagugugaaaaugaaccaguacaguaaauugguaccaguaaaguggggugcugcagaaaagauacccagaaaugcggaagcgacuuuggaacugaguaacaggcagagguuggaacaguuuggagagcucagaagaagaugacagaaaaaugugagaaaguuuagaagucccuagagauuuguugaauggcuuugacaaaaaugcugauaaugauauggacaaugaaauccacgccgagauggugucauauggagaugagaaacuuguugggaaaugaagcaaaggugacucuuguuauguuuuagcaaagagacuggcggcauuuugucccugcccuagagaacuguggaacuuugaacuugagagagaugauuuaggguaucuaguggaagaaauuucuaagcaaagcauucaagaggugacuuggguacuguuaaaggcauucaguuucgaaagggaaacagagcauaaaaguuuggaaaauuugcagccugacaauacaauagaaaagaaaaucccauuuucucaggcaaaauucaagacagcugcagaaauuugcauaaguuacaaggaacugacuguuaaucaccaagacaauggggaaaaugucuccagggcaugucagagaccuuugcagcagccccuuccaucacaggcccagaggccuaggaggaaaaagugguuucauaggcugagcccagggucccugugcugugugcagccuaaggacacggugcccugugucccagccacuccagccguggcugaaaggggccaacauagagcucaggccguggccuccaagggugcaagccucaagccuuggcagcuuccacgugguguugagccugugaguacacagaagucaagaauugagguuugguaaccuccaccucgauuucagauguaugaaaaugccuguaugcccaggcagaaguuugcugcaggggcgggguccucauggggaaccucugcuagggcagugcagaagagaaauguggggucagaguccccacacagaaucccuacugggguacugccuaguggagcugugagaagagggccaccauccuccagaacccagaaugguaucacugauagccugcaccaugugccuggaaaagccauagacacucaacaccagccccugaaggcagccaggagguaggagcugcccaagacugugggaaccuacaucuugcaucagugucaccuggaugugagacaugcagucaaaggagaucauucuggagcuuuaagauuugacugccccacuggauuucagacuugcauggggccaguagccccuuuguuuuggccaauuucucccauuuggaauggcuguauuuacccaaugcuuguauccccauuguaucuaagaaguaacuaacuugccuuugauuuuacaggcucauaggcgaaagggacuugacuugucugggaugagacuuuggacugugcaccucugaguuaaugcugaaauaaguuaagacuuugggggacuguugggaaggcauaauugguuuugaaaugugaggauaugagauuugggaggggccagagguggaaugauauaguuugguucugugucuccacaaaaucucaucuugcagcucccauaauucccauguguugugggagggacccaguggaagacaacugaauuauggggaugggucuuucccaugcuguucucgugauagugaauagguaucaugagaucugaugguuuuaaaaaugggagcuuccuuguacaagcucucuuugccugcugccauccacauaagauaugacuugcuccuccuugccuuucaccaugauugugaggucuccccagccauguggaacuguuaaguccaauaaaccucuuucuuuuguaaauugcccagucucggauaugucuuuaucagcagcauggaaauggacuaauacaaacacuuacuauuagaaguucuucuguacguugcucuaaaaucuuuuucacucuuauuuugcaacacugauaauucugccaccacaauaaacugaacaagauuaaucugucucuuaugaaauuccucaaaaucuuacagagagcauuauauuuucccaaauuauccuucaauggucuguacaguccuauguccuucaaccacugcuugcacaacaugauuuggggucuucaucaucacccugacuauaaauucagggcucuagugcaucagucuuucucaaaacacugaaccgaaaaauaaacucaauuucacagcuauggucugaucuggacagaacagaacaggauaaucaccuuacaccuuucuggacacgaauacauaauugguucccacugaauauaccaucaacuaaaagccuaacaucuuugcaucaguuugguuaauauaagccuaacacaacacagccaaagugaaaaauucuuccguuucagugaaugaauucuuuuucauccuacuguaucucaguaagguacaguaaaaaucaacaguuacugcacacuugcuguaaauaugcacacacuaaaauguaccuacaaagaauuuaccuaaaauguaaugcucaaaggcaggucaucucagaguuuaaucuguuuccucuacuuauacucagaguuaguucccauaucuaugaucuugcuucauucaccuccccucuguguucauugcccuaguucuaacgcuauuaccaaccucaauuauugcuuccaaaccuaucacccacauacugacaggucauuuuguuuauggaucauagcuugugacauuaguaauuuaccuucaguaguucaccacuggccacugaauaaagcccaacauaguuauacugacauuuaaucaucaguugcuuaucucuaaacaaauaccauaacugcaauagggcacaauuccaaguaguaaagacuaugccaucaauaugcuauauacguuaaacacauaaacuacacacacauaauauauaauauacauaugaauccuuccauauauguauguggaauauacauuccauuccuucuauaaugaacauauaugcucauuacucucuaaagcaauugaacuuuucuguuucccucuaggaaauaaaauaagcuaaucaugaaaugaaagacagucccuagaauuugccauaccaggucaagagagagcaucagggcugggcacgguggcucacgccuguaauccuagcacuuugggaggcugaggcggguggaucacgaggucaggagaucgagaccauccuggcuaacacagugaaccccuaucucuacuaaaaauacaaaaaauuagccaggcgagguggcaggcaccuguagucccagcuacuagggaggcugaggcaggagaauggcgugaacccgggaggcagugcucacagugagccgagaucgcaccacugcacuccagccugggugacagagcgagacuccaucucaauaaaaaaugaaaaaaaaaaaaagagagagagagagagcaucagguuaggacccucaucccaaauaaguguaauaaaaucaacaauauaagucucaaguguuauuuguucuguuuuguauccuguaauaagguacaaaguacccuuuguauuugauuucuaaacaccaagcaccuuuuugaacaaaauuaaaaugccaugaugggucuccacaauuccucuauacucaaugcaaagucccauuugaauagugagggcaaaaguaugaauaacaauagucucugagauccacaagcagcucaucccuaacagacaaaguguuuuugggaaaacagaaauaucucuggucuucauuuuccuaauuaauaaaaugaaaguguuagacuagauaacugcuaagauuuccuauaacauuaauacucugugauucuuugacuuucaacacuauuaaucuuuaggagaaaaaaaccauguaugucuccagaaguucuauuaacauaaggcaguuuuaaugaaaccugaaaacaguuaacucauguaagcuagaaaaaauuccugucaacaaggcauagcagagacugcauguaguuuacuaaggaauaaagaggaccauaaugaaugcaugaauauacaaauaauuaacucuuuuaagaagcaucauuugaguuggcaugacuucagcuaaaaagugcuguguaucaagugcuuucacaguucuccaaaggaagaaucuucuguaucaguaaauuaacacugcaauagacccuugaauaaucagcaucuauucuuuggcaugcauaucccauggcuaaggcuagcaauacgauuauuaaaaccacucacucaacacaauuucuuucaagaggguggcauucaaaucaugagcuuauucuaaccgauguuuauuccaagcagugauuccuagccuaaauuacagaaaggugggcaaaugauugaagaaauuuucuguagaagaaacuguuauaaaaacuggucuuacagagaauaaugcauauuccaaauauacuuaauuagggugugaguuuauuguuacuggacuauaaaguuagauuauaagcaaggguuaaauuguacugagccuauuaucuaucacccacaacagugugggcaaugccaggcacauaaagaggauagcuuugaaaugacugacuacugggucuaggcugaacggccaagaguuggcuggaagaacaagggccaaagagcacagauuuaugaagaaauacaagagaaugagaaggcacacaucuaguccgaaccaagguagggaccccagaguucuaaauaccagaaagguccaacagacccuggaacugcagucuaaggugaugaauggguuuguggggggaagaugauagucacagggagcuaugaaggagucucacgugagccaacaguauagauucugaaggcguuuauggcaggagaaacaaaauacgcagggaaagauaaucucaguguuaaagacagauguaugccuggaggccaagacagaaaaugagcugcagagagaacgcaguagccugcuagccagccaguaaagaagugaggcuaguucagcggacucgcgcggccucgcucuuuggacucgucacccuccccucccccucccgccgccgucacccaggaaaccggccgcaaacgcgggcggaccugaagcugguuucauggcagccucaaagaaggcaguuuuggggccauuggugggggcaguggaccaaggcaccaguuccacgcgcuuuuugguuuucaauucaagaacagcugaacuacuuagucaucaucaaguggaaauaaaacaagaguucccaagagaaggauggguggaacaggacccuaaggaaauucuacauucugucuaugaguguauagagaaaacaugugagaaacuuggacagcucaauauugguauuuccaacauaaaagcuauuggugucagcaaccagagggaaaccaccguagucugggacaagauaacuggagagccucucuacaaugcugugguguggcuugaucuaagaacacagucuaccguugagagucuuaguaaaagaauuccaggaaauaauaacuuugucaaguccaagacaggccuuccacuuagcacuuacuucagugcagugaaacuucgcuggcuccucgacaaugugagaaaaguucaaaaggccguugaagaaaaacgagcucuuuuugggacuauugauucauggcuuauuuggaguuugacaggaggcgucaauggagguguccacuguacagauguaacaaaugcaaguaggacuaugcuuuucaacauucauucuuuggaaugggauaaacaacucugugaauuuuuuggaauuccaauggaaauucuuccacauguucggaguucuucugagaucuauggccuaaugaaagcgggggccuuggaaggugugccaauaucuggguguuuaggggaccagucugcugcacuggugggacaaaugugcuuccagauuggacaagccaaaaauacguauggaacaggauguuucuuacuauguaauacaggccauaaguguguauuuucugaucauggccuucucaccacaguggcuuacaaacuuggcagagacaaaccgguauauuacgcuuuggaagguucuguagcuauagcuggugcuguuauucgcuggcuaagagacaaucuuggaauuauaaagaccucagaagaaauugaaaaacuugcuaaagaaguagguacuucuuauggcugcuacuucgucccagcauuuucgggguuauaugcaccuuauugggagcccagcgcaagagggauaaucuguggacucacucaauucacgaauaaaugccauauugcuuuugcugcauuagaagcuguuuguuuccaaacucgagagauuuuggaugccaugaaucgagacuguggaauuccacucagucauuugcagguugauggaggaaugaccagcaacaaaauucuuaugcagcuacaagcagacauucuguauauuccaguagugaagcccuugaugcccgaaaccacugcacugggugcugccauggcggcaggggcugcagaaggagucgacguauggagucuugaaccugaggauuuguccgccgucacgauggagcgguuugaaccucagauuaaugcugaggaaagugaaauucguuauucuacauggaagaaagcugugaugaagucaauggguuggguuacaacucaaucuccagaagguggugacccuagugucuucuguagucugcccuugggcuuuuuuauagugaguagcauggcaauguuaaucggagcaagguacaucucagguauuccauaaaaccuaccaacucauggauucccaagaugcgagcuuuuuacauaaugaaagaacaacccagcaauugucucuuaaugcgaugacacuauucauagacuuugauuuuauuuauaagccacuugcugcgugacccuccaaguagaccuguggcuuaaaauaaagaaaaugcagcaaaaagaaugcuauagaaauauuugguguguguguguguguguguguguguguguguguguguuuuuaacauccacaguuaagguugggccagcuaccuuuggggcugacccccuccauugccauaacauccugcuccauucccucuaagauguacgaagaauucagauccucaccauuggaaucuuccaucaaacauacucaaacacuacuggaacaggacuugagucuuugcaugacauauacuugauuaaaagguuauuacuaaccuguuaaaaaugagcagcucuucgcuuuuaacagauaccccaaaagucuucuuuucuacauaguagaagacggaaacaccuuuacugaauguuugaauagaaauaucuacuaaauuauuaaaauagacauuuaguguucucauagcuuggauauuuuucugaaaaguauuugccaaaacugaaauccuuccaauauuuuccauggucccauuaauuauaaugacuuucugucuagaucuuauaggaaaggauacuuucuuuuuucuuccaucuuuccuuuuuauauuuuuuacuuuguauguauaacauauaugccuauauauuuuauacacugaggguagcccauuuauaaauuaagagcacauuauauucagaagguucuaacagggcuggucuuaagugaaccacuauguauaucaauauguuggaaaacagcuguauacauuuuugggcaaugguuaugcauaauaucuaccagaauuuuuuucuuaaacagccaacauuuaaaauuuauguuuuauguccauaaaagaaaauauacuuuauugugacuucaacuauauuucuuaucccuuacauuuuuauuuaauugucuuagccuaaaaaaagaagaaacuguggaauacuacaguaaauacuguuuucaaacacaagcaauaauucaaauaguuuucuuuugaauuaauuuuagacauauuuuggauccuauugaggggauaagaggaugucaaaaaaguuaaauaccuaaguagaaaaaaauauagaaauaaagccaggaaucucuuucaguucaaauguuaucaauugugaauaagaaauugcuaucugggaugacaaaauuaucucugcuuaguaucuuauuauaacugaaaaaagguuuaucauuauaaaugccuuccaaggaaaccaagaauuucucaaaauauuuaaugucacauauuauaagaagucaccuaaucuagcuucuuaacgucaaucuuuaaaaauaucuuaaaauuacuuuguuuuguaauaaacagugaaaaaaaaaaaaguuaggcugauggcagugagagcaauggucuggaagugguacccuucuaccuagguucccagugggcuguggggagugaucccuucgagaagucugcucacgacauacagguuugggggaaacacaaaguuucauuuaugacaaagacagaggggacacacaugaaaauacuugcgcauauaaaaaaguuugaucauuuuauaggccuaguggaaaggacagaagcuggacagugaggggugccugaacaggccuggguaaaguaguuacuaccgccggggccugggauauauaaacuaauaacagaguuaagagccaaagaauggaaaauaaaaugaaagcauaucaguaacuggaggacuucuuuuuuguuguuguuauuguugagauggagucucucuguugcccaggcuacagugcaguggugugaucucagcucauugcaaccucugccuccugaguuaauguuauucgccugccucagccucccaaauagcugggacuacaagcacaugccaccaugccuggcucuuuuuuuuuuuugguauuuuuaguagagaccugguuuuaccauguuggccaggcuggucucaaacuccaggccucaagcaaucugcccaucucagccucccaaagugcugggauugcaggugugggccaccaugcccagcucugaaggaauucuccacagguaguccuguuacugaggaaugcugagugcuuaccaagcccagaauuucagcuacagcucuagcuugaaaaugguagucaggcugggugugguagcucaugccuguaaucccgacucugggaagccaaggcaggaggacugcuuaaggccaggaguucgagcacagccugggcaacacagcaagagcccgucucuauuuuaaaaaagaaaaagaaaaugauaccacaaacuuccccaaagaucaguuagaacuaguacuaaguaguuucucaaauuuucaguaugggaaguggugagguauaggaaugacuaaaaaucugaaacaauuuuuguccccuuaaaugugcuuggcuaucaauaagaaauacugaauaaaauucauauuucaaguuauaauuaaaauccaauuuccaaagagucuuuugcuagaacuauuaaaaugcaucuaaaccaaugaguucaauuuuuaucuccucuauauuuuuggccugcaaaaaaugcuaaaaauaaaggugcuaaugauuugagaaaugguuaaaauauagauaccacccaacaaacaugagaagaguccacaaaccagcacucucugaauaaguuaguacacuugggguuaacugagaaaaauuucauuuuuagacaugauacaaaaaauaauuucauacagcuuuuuaagcuaaaauaaaauaaaauaaaauaaaauaaaauaaaauaaaauaaaucuuucaggaguguaacgaaggcugaccauaguccagaacaccaugccucagcacauaggccauuuaaccugggcggucuggucacacugagcugucacuccacgccuuggagaagcaggguggucagugcgacaggcugucacugccagugccacgcugcugaagccacgagagcaucucggggugagcagcguggauuccacauccuccccugcucucacucucuaaccuacccauuugguugcucacauuuuuacuuucccuaaagauacugauguuauuaaaaauaagcaggaguucauggaagagaucuccauggaacacuguuaauuuuuucauuauaccuguacaauuuaauuuaauuauaauguauucuagaaagcuuguuuccaaugggcaagagaaagaaaugaagcaguucuuacguccagaaucuccagugaguuuucaaaggauagagagugcucuuccauuuuuuuuuuuuuuuuugagacguagucucacucugucacccaggcuggagugcaguggagagaucucugcucacugcaagcuccgccucccggguucaggccauucaccugccucagccucccaaauagcugggacuacaggcuccugcaaccacgccuggcuaauuguuuguauuuuuaguagagacaggguuucaccauguuagccaggauggucucgaucucaugaccucaugaucugccugccucggccucccaaagugcugggauuacaggcaugagccacugcgcccagcccgagagugcucuucuuaugugcagucacaccauggaccagacaauaccccgagguccugcaggcuuucucuccuuauccauccuuuuuucccucagcuucuuucuccucccuucugcuuuacauguauauauguauguauguauugagucaucuauugcuauuuauuucuucccuuccuucuuuucuuuccuaccuagaaaagccugucacaaguccuacugccuaugauagggaaaagaaaaagaaaaagaaaaagaaaaagaaaaauauuaacuuuacugccacuguguccugucacccucuuggaguucuucacaagcuaugugauuugacuugaaaguaauuugaagguuuggguaaauuuucuggacaaauagagugcuuuaaagacaaaucaccuaaacaacaauuauuuguuuaugguagaaaaggagcuauagacaucuuacugcauggacuccuuaucuccccacuuccuauuugcuuaaaaugucaagaacaaucagauaguuucacuaugaggaacaauugcguauuagucuguuuucaugcugcugauaaagacauaugcaagacuaggcaauuuacaaaaggaagagguuuaauggacuuauaguuccacauggcuggggaggccuuacaaugaugguggaaggcaaggaggagcaagucaugucuuacacggauggcagcaggcaaagagagagagcuugugcagggaaacucccauuuuuaaaaccaucagaucuugugagacuuacuaucacaagaacagcaaaggaaagaccugccccccaugauucaacuacuucccacuggguccuucccaccacacaugggaauucaagaugagaucuggguggggacauagccaaaccauaucaaacuguuuuauaguauuauucuggauuauuuuggaaaguuuauuacaacuaguuaucaauacaccaaagauauggaaauaacuucauuauacaagcauggucuuuguaauggcauuuguuuaaaauauaaggaugaaauacauagguaaagcaugacaauugcuucaagauaauacaagaggauguauaaaauuccucaagcuguagacaugauuuguguacuuuucuauacguacauuagacuucaguaaaauguuugcauauaaaaaaaagggaaggggaguaacgaagguuauaauuaaaacaaaauugucccugaguugacaacuguugaaguuggaucaugaguacuauucuauucuuguacaugcuugcaauuuuucauaaugaaagauguuuuaaaauguuaccuaaaaccuaagaaacucaagcaaauacaagauucagaagcaugguauaaaagcaguacauccuuuaaagcuagauucagaugcaaaauauagugcauuaaaaaugaagaaucaaugcuucuuuauaauuuuacugaaagugaauaauuuuucaugaaaaauucuuggcauaauuacaaaggaggauucuacaaacuaagaaacagaaguguucuaauucugguggaaaauuuuuuauauuuuguaguauacuagaauaaauuuaagauuuuaaauaagagaaagauuuuuaaaaaucuaaugaucuccuaaaaacacaguaaaugaguugcuucugauauaagcaaaacuaagaguucuaguacaucauaugaacuauguuuggauauccugugcauuaauccuacuuuauucauucucuccccaggcacugacccuccucuccccauuagcagucaguaacauuuaucaaucacuauagagaaaacuggcagcccaggaaagauaaaagguuaaauagugauuguuucaugcagcaaaaaauaucuaaaaauacaaaagcuuucuugguuuuccuaauagaagucacuuauaacaggugcauuaagucuagcaguuaauggaaucugaauuuagaaguaauauuuucuacuuaguugaacagaauugcuugcauuggaauacaccaauaaauucauauuugucuuugguuuuucauaaaaugcuucauucuauucaaaagugcugcaugaauagugcuacacacuacaggcauuccccaacuuacagaaggguuguguucuaaaagcucaucuguaaaucggcuuccuagaacucagaucacauuuuuucacugaaauaauuuucuaaagggcaguuaggccaucaggccacccaauagaaaucaauaaggucuaaauuuauuggaccuacugugauuuagugaagcacugugguuuuuguuuuuucaacuaaccacuuugaaccauuauuuauuugguaaaugaaauacggauucuaggacuacuacucuccaaugcucugugcaggcagagacacacauauauauacacacaugcauucucccuuacccacaucuauguaccaaaagcuuccuuacucaucagaguaagcacacugaagcaguuuagacaaaaggcuccugcauuugaaaucuggggaaguuacaguucuagagccuauuaaaggagcagugaacacagaagcuuccacaggaacuauuccuauugagucucauagaugcaaagcagagucuugcaggcaguugguggauuguaacuucuaccagauuuaucuuccagaaauauaguuuaaaaacaaauuagcaacuuccguaagucccagacagaguaaucaggcaaaagaaagaaauaaagggcauccaaauuggaaaagagaaagucaaacuaucucuguuugcugaugauaugaucuuauaccuagaaagcccuaaagacuccuccaaaaggcgccuagcuuugauaaaugaauucaguaaagccucagguuacaaaaucaauguacauaaaucaguagcacugcuacacacgaacaaugaccaagcugagaaucaaauuaagaacucaaucccuuuuauaauagcuacaaaauaaaauaaaauacuuaggaauauauuuaaccaaggaggugaagaacucuacaaggagaacuacaaaacacugcuuaaagaaaucauagaugauacaaacaaauggaaauacaucccauguucacagacuagaagaaucaacaccaugaaaaugaccauacuguccaaagcaaucuacagagucaaugcaauuccuaucaaaaugccaucacucuucacagaauuauaaaaaaaaaauccuaaaaugcauauggaauuuuuuuaaaaaggcccaaauagccaauguaauccuaagcaaaaagaacaaaucuagaggcaugacauuaccugacuucaaauuauacuaauauaaggguaucauaaccagaacaguauggcacuggcauauaaguagauauguagaccaauggaacagaauagagaacccagaaauaaaguaaauauuuacaaacaacugaucuucgacaaagcauacaaaaacauaaacuggggagaacaaaaggcagcagaccgcuucugcagacuuaaaugucccuguuugacaucucugaagagagcagugguucucucagcauggcguuugagcuccgagaagggacaaacugccuccucaagugggucccugaccucuguguagccugacugggagacaccucccaguaggggaugacagacaccucaaacaggugggugccccucugggaugaagcuuccagagggaggaucaggcagcaauaucugcuguucugcagccucugcuggugauacccaggcaaacagggucugaaguggaccuccagcaaacuccaacagaccugcagcugaggggccuguuggaagaaaaacuaacaaacagaaaggaauggcaucagcaucaacaaaaaggacauccacaccaaaaccccaucugcagguccccaacaucaaagacaaaagguaguuaaaaccacaaagauggggagaaaccagagcagaaaaggugaaaauuccaaaaaccagagcaucucuucuccuucaaaggaucgcagcuccucggcagcaagggaacaaaacuggauggagaaugaguuugccaaauugacagaaguaggcuucagaaggcugguaauaacaaacuucucugagcuaaaggagcacguucuaacccaucacaagaaagcuaaaaaccuugaaaaaagguuagacgaauggcuaacuagaauaaacaguguagagaagaccuuaaaugaccugauggagcugaaaaccacagcaagagaacuuugugacucaugcacaagcgucaauagccgauucgaccaaguggaagaaaggauaucacugauugaagaucaaauuaaugaaauaaagcaagaagacaagauuagagaaaaaagagugaaaagaaaugaacaaagccuccaagaaauaugugauuauggauaaagaccaaauauacguuugauugguguaccggagaguuauggggagaauggaaccaaguuagaaaacacucuucaggauauuauccaggagaacuucccuaaccuagcaaggcaggccaacauucaaauucaggaaauauagagaacaccacaaagacaaagauaauccucaagaagagcaaccccaagacacauaauugucagauucaccaagguugaaaugaaggaaaaaauguuaagggcagccagagagaaaggucggguuacccacaaagggaagcucaucagacuaacagcagauuucuuggcagaaacccuacaagccaggaaagaguggagccaauauucgacauucuuaaagaaaaggauuuucaacccagaauuucauauccagccaaacucagcuucauaaguaaaggagaaauaaaauccuuuacagacaagcaaaugccgagagaauuugucaccaccaggccugccuuacaagagagcuccugaaggaagcacuaaacauggaaaggaauaaccgguaccagccacugcaaaaacaugccaaauuguaaagaccauggaugcuaugaagaaacugcaucaauuaacaggcaaaauaaccagcuaacaucauaaugacaggaucaaauucaaacauaacaauauuaaccuuaaauguaaaugggcuaaaugccccaguuaaaagacacaggcugguaaauuggauaaagagucaagacccaucagugugcugcauucacgagacccaucucacaugcaaagacacacacaggcucaaaauaaagggauggaggaagaucuaccaagcaaauggaaaacaaaaaaaaagcagggguugcaaucuagucucugauaaaacagacuuuaaaccaacaaagaucaaaagagacaaagaaggccauuacauaaugguaaagggaucaauucaacaagaauagcuaacauuccuaauauguacccaauacagaagcacccagauucauaaagcaaguccuuagagaccuaaaaagagacuuagacucccacacaauaauaaugggagacuuuaacaccccacugucaauauuagacagaucaacgagacagaagguuaauaacaaggauauccaggacuugaacucagcucuggaccaagcagaccuaauagacaucuacagaacucuccaccccaaaucaacagaauauacauucuucucagcaccacauugcacuuauucuaaaauugaccacauaauuggaaguaaagcacuccucagcaaauguagaagaacagaaaucacaacaaacugucucucagaccacagugcaaucaaauuagaacucaggauuaagaaauucacucaaaaccacacagcuacauggaaacugaacaaccugcuccugaaugacuacuggguacacaacgaaaugaaggcagaaauaaagauguucuuugaagucacugaaaacgaagacagaauguaccagaaucucugggacacauuuaaagcaguguguagcgggaaauuuacagugcuaaaugcccacaagagaaagcagaaaagaucuaaaaucaacacccuaacaucacaauuaaaagaacuagagaagcaagagcaaacacauucaaaagcuagcagaagacaagaaauaacuaagaucagagcagaacugaaggagacagagacacaaaaaacccuucaaaaaaucaaugaauccaggaggugguuuuuuaaaaaaauccacaaaauugauagacugcuagcaagacuaauaaagaagaaaagagagaagaaucaaauagaugcaauaaaaaaaugauaacggggauaucaccaccaaucccacagcaauacaaacuaccaugagagaauacuauaaauuccucuaugcaaauaaacuagaaaaucuagaagaaauggauaaauuccuggacacauacacccucccaagacuaaaccaggaagaagcugaaucucugaauagaccaguaacagguucugaaauugaggcaaucauuaauagccuauuaaccaaaaaaaguccaggaccagauggauucacagccaaauucuaacagagguacaaagaggagcugauaccauuccuucugaaacuauuccaaucaauauaaaaagagggaauccucccuaacucauuuaugaggccagcaucauacugauaccaaaggcuggcagagaaacaacaaaaaaagagaauuuuaggccaauaucccugaugaacaucgaugcaaaaauccucaauaaaauacugacaaaccaaauccagcagcacaucaaaaagcuuauccaccaugaucaagucagcuucaucccugggaugcaaggcugguucaaugcacgcaaauauauaaacguaauccaucacauaaacagaaccaaugacaaaaaccacaugauuaucccaauagaugcagaaaaggccuuugacaaaauucaacagcccuucaugcuaaaaacucucaauaaacuagguauugauggaacguaucucaaaauacuaagagcuauuuaugacaaacccacagccaauaucauacugaaugggcaaaaacuggaagcguucccuuugaaaaccagcacaggacaaggaugcccucucucaccacuccuauuccacauaguguuggaaguucuggcuagggcaaucaggcaagagacagaaauaaaggguauucaguuaggaagagaggaagucaaauuaucucuguuugcagauaacaugauuguauauuuagaaaccccauugucucagcccaaaauauccuuaagcugauaagcaacuucagcaaagucucaggauacaaaaucaaugugcaaaaaucacaagcauuccuauacaccaauaauagagagccaaaucaugagcaaacucccauucacaauugcuaaaaagagaauaaaauaccuaggaauacaacuuacaagggauaugaaggaccucuucaaggagaacuacaaaccacugcucaaaaaaauaaaagaggacacaaacaaauggaagaacauuccaugcucauggauaggaagaaucaauaucuugaaaauggccauacugcccaagguaauuuauagauucaaugcuauccccaucaggcuaccacugacuuucuucacagaauuggaaaaaacuacuuuaaauuucauauggaaacaaaaaagagcccacauagccaagacaaucuuaagcaaaaagaacaaagcuggaggcaucacgcuaccugacuucaaaguauacuacaaggcuacaguaaccaaaacagcaugguacugguaccaaaacagagauauagaccaauggaacagaacagaggccucagaaauaacaccacaccucuaaaaccaucugaucuuugacaaacuugacaaaaaccagcaauggggaaaggacucccuauuuaauaaauggugcugggaaaacaggcuagccauaugcagaaagcugaaacuggaucccuuccuuacaccauauaaaaaauuaacucaagaugaguuaaagacuuaaauguuagaccuaaaaccauaaaaaccccagaagaaaaccuaggcaauaccauucaggacauaggcaugggcaaagacaucaugacuaaaacaccaaaagcaauggcaacaaaagccaaaauugacaaaugggaucuaauuaaacuaaagagcuucugcacagcaaaagaaacuaucaucagagugaagaggcaacuuacagaaugggagaaaauauuugcaaacuacccaucugacaaagggcuaauauccagacucuacaaagaacuuaaacaaauuuacaagaaaaaaacaaacaaccccaucaaaaaguggacaaaggauauaaacagacacuucucaaaagaagacauuuaugcagccaacagacauauaaaaaaugcucaugaucacuggucaucagagaaaugcaaaucaaaaccacagugagauaccaucucaggccaguuagaauggcgaucauuaaaaagucagaaaacaacaggugcuggauaggauguggagaaauaggaaugcuuuuacacuguuggugggaguguaaauuaguucaaccaucguggaagacaguguggcaauuccucaaggaucuaaaacuacaaauaccauuugacccagcaaucccauuacuggguauauacccaaagcauuauauaucauacuacuauaaagacacacgcacacauguuuauugcgacacuauucacaauagcaaagacuuggaaccucccaauguccaucaaugauagacuggauuaagaaaauguggcacauauacaccauggaauacuauguaaccauuaaaaaaggaugaguucguguccuuugcagggacauggaugaagcuggaaaccaucacguugugcucguguacacguuuuauauauggugagagaucccuaucucucaccauauauaaaaauuaacccaagauggauuaaagacuuaaaucuaagaccugaaaccaucaaaauucuagaagaaaacuuaggaaaaacuucugggcauuggccgaaacaaaaaauuuaugacaaagaccccaaaugcaaaugugacaaacacaaaaauaaauaaaugggaccuaauuaaacaaaaaaaacuuccacaagaccaaagaaauaaucaccagaguaaacacacaaccuauagaaugggaggaaauauuugcaaaauaugccucugacaaaggacuaauauccagaaucuaaaaggaacucaaacaagucagcaagaaaaaaucaaauaaucccauuaaacagugggcaaaugacaugaacagauauuucuuaaaaagaagauauacaaauggucaacaaacaugaaagaaaugcugaacaucacuaaucaucaggaaaaugcaaauuaaaaccucagcgagauaccaccuugcccuaaccagaauagcuauuauuaaaagugaaaaaacaauagauguugguguggauguggugaaacgggaacgcuuauaugcugcuggugggaauguaaauucguacaaccucuauggaaaacagucuggagauuccucaaagaaauuaaaauccaauccagcaauuucacuaccgaguaucuaccuaaaggaaaagaaaucauuaaaucaaaaagacacccagauguguauguuuaucacaguacaauucacaauugcaaagauauggaaucaaccuaagugcccaucagccaaugaguggauaauguuuuauauauauauauauauauauauauacauauauauauauauauauguauauauauauauauacacacacacacacacacacacauacauauacguauguagacauauauguauauacauguguguacauauauacguguauauacguacguguguguguguauauauauauauauauauaugauggaauacuacucugccauaaaaaaagaaagaaauaaugucuuuugcagcaacuuggaugaaaccggaggccauuauucuaaguuaaguaacucaggaauggaaaaccaaauacuacauauucacacuuauaagugggagcuaagcuaucaguaugcaaaggcagacagagugguauaauggacaugggagacucagaaguggggagguugagaggauggugauggaugaaaaacuaccgauuagaguacaaugucuacuacucaggugacggguacauuaaaaucccagaccucgugacuauacaagucauucauguaaccaaaaaccacuuguacuccuaaagcuauuagaauaaaaaaaaaaggauguaaucauuaaaugaaagcauaaacuaaaaaaagaaauuuccuaauaaucacuuuuaauauauauuuuuguuuauaaacucaaauaaaauauagauuacauuugugaacuaugugugugcauucaaagcuauaacaaugucuccuccccaacugcagagaugaggggucugaagggccugaagagcagcuaaagcaagggcuccuugaaaacagcaacaggcccucccucugccacagggaaaugccagcaguagcaguaggccauggaaccagcaugcaaggagugggcugcuucuauuggucuacuuuucuacuccaccaaauguaucuauauuucacugcuuugaagauuuuuuuaagccacaaaauuguuuucauggaugcaaaaaaaaaaaaaaaaaaaaaaaacaauguaaaaaaucagagcuaaaauaacuucacaugcauauacuuucucauaugccuauucauuuaacaauuugaaagaaaaauacauacagcuauucuucuugaacccuggaggcggagguugcaaugagccaagauugcaccaccacaccgcagccugggugacagggcaagacuccgucucaaaaaaaaaaaaacaaaaaaaccuagcuauuccuagcuauucuauuauucaggcccaaucccaauguauaguugcuugcuuuuuaaguucagaauuuuaugaguaugcuucaguuaugcagugugaccauuauaagauuuuaaauguauuuuuauaaagcccagauccagaaauaugacaugacuuuccagagaccacuguggaaucauaucaaaaaccaagcaguuuccucccaaauucagcugaggucuacuccacuugccugcauagguguuggccuuguucagaaggucgguacaugcaugcauaucagcaaaagcccggauuccuaagcaguugacagggugaagcugggauuccaaaaauucacaacaagucuucuucacauccuguaacuguaagagaccagcugcugggagaaguaccugcaacacacacaucaauauucuuaggcacuuggguggaaaaacacugccucuuugaccacuucuacauaggacacaagauguucagccauaguuuauuaucugcguccauacccccauauucccuagaaaacaaauauaaaaauuauuuuuaauaacaaugaugacucuucacauuccccauaauuuccauguaaucuuucaaaggccucuucuccuuggucagaagaauaugagauaucagaucuuauaagauuaaugguuuguuucauaagcauaaacaaaauguuauuuugacuucuaaaaacacaaauucuuggcagggcauggugacucacaccuguaaucccggcacuuugggaggccaagacaggaggaucgcuugaguucagaaguuugagaccaggcugggcaacauagcaagaccucaucucuacaaaaaauauaaaaauuagccuggugugguggcacgcaacuguagugccagcuacucaggaggcagaggugggaggaucacuugagccugagaggucgaggcuguaguaaucugugaucaccccacagcacuccauccugggugacagagugagaccccaucucaaaaacaaaacaaaacaacaacaacaaaagcccguaaauuauuaggaugcuagggggugcuaugauucaaugaaaaugguuuuguucucuuaguucaagcagucaugcacuucaguuaucuguggggaaggaguggccccagaguaauccauaucacaacaaagccucauuuugcugaaggccuguuuuuccacuguaugaguaucauaacaacugcuuuccuuacgggguagaacaauuuaaaguucaacaacagucucuaccuauaagcagacaguuucucuagaauguaauauaugugcuaacaaggaaaauguaauaggugauuaucuaauaacuuuuuaauuugcauuuuuauuugaguaacuccaagcaauuuuauauuaauuauagguuauucugugggauugaaccacuaucuucacuaugaauacuauauccaacacuacaagugcuuuucaaauaagucaauaauagaaaaacauuuuuccuuguaagugaauuauuacaguguuauauaaaggaccauauuugaaagucaaauuaaggagaaaaacuucaaaaaaagguuaucgaauucuggugauccuuuauaaaagccaaagaaaccccacaaaaaaaccuucaacuauucgaacaaugguaaauuuuagaaaagacuacauuagcauuaaaaaaagaucuaaguuccuucagaaauugacuuucauauaugccacacugcagcccaaagacagaaaaauaauagugguuuaugacuauauguuaugacuuuccuaaaucuauggaguaaguccuaaacauagaaaagaaagacaucauucacaucucucuguaacaaacuucuuaccuucuuaaaggaagcacagaagcuuuaacuccugaaucuaaaggcucaagaaaaaauagaaacaguauccagacauaaggccuuuuccuucugaguuuaagaaaaauaggucaggcgugguggcucacgccuguaaucccagcacuuuaggaggccgaggcagguggaucacuugaggucaggaguuugagaccaccuggccaacauggugaaagcccaaucuacucaaaauacaaaaauuagcuggguguaguggcacacaccuguagucucagcuacucaggaggcugaggaaggagcaucacuugaacccuggaggcagagguugcaaugagccgagaucacaccaccgcacuccagccugggugacagagagagacuccgucucaaaaaauaaaaauaaaaauagaaaauaaaguauaaauaacguuacagccaaacuuuuugcaugauauguauaguagguuucauuauguuaugagaaugaauauccacagaaggcuuuaauuuguugauaauuuucaaauugcagguuuuuccaugccaguguaauugcgcucugaagcaacauaaagugcguuccaagaugcuuaauaguacagccauuuaauucagcaaauuaaauuucuacauauaguuuagaaaguggucuucaguguaaaauucaaucucugugaaaucugcacaaauaguaugaucacuccucuaauuagcauuuuccuagagaaaacaguauaauacuuaaauuguuuggucacacagaacgaugaggaaaaagugguugggcaggaaacaggcucacuuacacauuguuggugggagcacauauugguccaaccuccaugaagaacaauuuguuuauuucaaauucaaaauuacaaaugcacauguccucugacccagcaauuuaaccuauagauaugcuaacauaugcacaaaaucucacaugcacaagauauucauuacagcauuauuguggcuaauagaaguuagaaaaaagccuuuaauguccaucauaaggagacugaucaaauaauuggaaucauccauucaauugcagucauucaaacgaaagaggaaacuaauaaaugagauaauuucuaaaauauauuccugagugaaaaaaaaauuagucguugguauauuaugcuaacauauacaccccccccacacacacacauauauguguguguagcaggcuuuuaaaauuucauuuugcuuuauugauuucaacuuaaucauuaccaaguucagaucuaccguauuaggagaccgaaauucauaaaauuguagauucuccuaucuggaaggggcauaacaagucaucuagguagaaauauaaaguuauuucaacagugguccauguggcuagauuauauucacauauaauuuuuuuugaugacagugaaacgugguuacaugcuugacaaauauaugcuaaacauaaaauaaauguaagucaaauguacaaaaaguuuguucauauuuuucuuuugucaguaaaucuuuugaaauugccuugguuuuaugauguaguuuuacuaggacuaaacuucaauagcucauaauuauguaauuaauuauauacagcuucaaaagcaauuacuaauugacccagcuugcuaacaugacgccuggugaccaucagucacugauaaugaaaacaggaaaacagcuggggccacaucaacuccuagcuuauuuugggugccaaacagccacuuaaaacaaaauuuaaaaugcucugacuucagaugaaccacaucccaugaucaaaaccacucaaacagcugucacccugcaagcugaaaguuuugagaucaaaucaaaucaaaccuucuaauuugugugaugaagaaaccacacccucgagggguuaaacggcuugaccaagucauacagcgagucauggaaagcuagggauauaaucaaauuggucagcucuuuggucuacuguucuaauaccuucaaccccaaauuuaggugcagaauggaaguauuuguauaauuucuaaaucuccaacacuguccuuuucaugaagaauaauaaagacaacaaccacuucaacaaugcauuauugcaguuacuuccauuuacugaguaauuacuacaucaggcacugugcuaagcacuugccagacaauaauaucucauuaucuccaucauacacaagcgaauacagaggguaggagaaguuggguaacuugcuaaaggucacacaccugguaugggacaggccaagccugcuaugagagcgguacuaaccaaaaugugcauaaugauuuuagaugacauacagauaaacuucuugcauuaauaguuaagaauauagguucagggcaggcuugguggcucacaccuguaaucccagcacuuugggaggcuaaggugggcagagcauuugaggucaggaguaggaguucaagaccagccuggccaacauagcaaaaccucguuucuacuaaaaauacaaaaauuagcugggcaugguggugcacaccuguaaucccagcuacuugagaggcugaggaaggagaauugcuugaacccaggaggcggagguugcagugagccaagaucggaccacuguacuccagccugggugacacagugagacuccaucucaaagaaaaaaaaaaaagaauauagguucauaguuagaaauacauuuuuuuaaguuauuuuccauuuauuucaauaauacaauaauauaaacauuccuucucaaguaaacuuauuuaagcaaaaauugacucacuguagagaaaaacauuaaaaauuuaauagcaucagcacuuguagaauauagcaaaauccugaagcuggcccacaaaugauuacaagugaucagaauuuggaaaacccugauuuaggagaucagauuuaauauucuagucuuucaauaucuaauguaauucugauccugugguuuuacauaucacugaaaaugaagaaugugcuuuaaucuggagcuaucauaaucccuuggcuuacuuucuacugaaguagauacauuguacuauugguaacaaaugugagaaacaccuagcaauguaaagaggugauuucuuaauuugcuauuuaggucacaaaaauaucuugggcauuguaacuaaaagguccaaugaauaaauuuaugucuuugaaacuuauuuucugagcucucugaagcaaaggagcaguugaacagugcugcuucucauaugagguagaauuacauugauacaauaaacccccagccaccaucuaauggaaauuuccaucuagugcagaguugcacuaguguuaacccugagauugauuaaaaauaaccccaaggcacucuaugauccuuuuuuuuuuuuuuuuuugucauaguuaagcacagaccaucaugcaguaccuuggauuucuauacaguacucuugguaugauaugaaaaaaaaaauucugcccuaaauuuuguuauucucuggauuuaaguauauuccaaaacaucaaagauggagcaauuauaauuugauauauauuuugaauguuaaaaauauuuucuaagaaucuaagagugauuaaauuccauauaguguaugcacugagggaaggccacacuccaaaagccaaaauaucucucuuggguacaucugccucuaggaaaaauguaaagcggacagugaauguaaagaggcccucgccccuccuuccuacauccuucuccuuuaguucuauuccaucaaccgaacccugagucucuucacucucaguuuaucugugugccaucuaaaaucaugagaacccugguguucucaccaugggcucagucccuuucaagucacuacuaacagcacugcuccauuucauuugcuucacagcaccuacugcugucagcacugauguuauguauuuguucccauguuuacugucuuccugcaaaggaauguaagcucuguggcaguaggaucacgucuguuacccccugccacauccucaggucucagaauguguaccucauaaaugaaucaaccugaacauaauuuuaugacucccauguguauuucuauuuugagauacaauugugcauguccuuugagacaaaauuacaagcucuguuucuaggaauguauauguaccagacacuucuuguagccuaccacaaaucuucucagccuuacuucuugcccaacccaccacugcagcaaccaggcccaagcaggcuuugaccaccuuucugaagauguaacguaacagggccucaccccagccccuggccauaccucucucuggcuuccuauccuaggccuucagugaugcacugggcucauacccacacagucuggaagcaugcaggaaauaaugcugugggaccacccuugacuaguggagaaugcaucaaaggaagagaaauacuucccccugguauucuccuagaagacaguucugagacauauuuuauaaggcuuucaaaggucccgucacauguagcuauggccagaucuguacugcaccuaugaaccgguuuucccuccuuuccagcucaaguccuccauucacucacuguggcuccuugggaucacuucccaaauaaaugaacugcacauaagccuugcuugcagaaggaccccaagcuguuauauuacacaauggaacaaacugcgaaugugaauauacuuagcuaaagaacuauuaauuauagugcuguuuaaauuauaaaaaauugagaagaacuuaaauguccaauaacaagagaaaaauaaagucaauucuauaauaucaaugaaauugaauauuuuucagcucuuaaaagagauacaguagacaaauauuuaaugacuuggaaaaauguuucuaauacauuuaguauaaaaagcuaguuucuaaaagaaucuacaguaugaccccuuuuuuggguaaacacauguguacauaacaacaaacaguauuagagggcuauaccacaauuguuaauauguuuuaucucugguuaggugugauaugaacauuuccuauuuauuuuuacauauuuguuaaauuuuauguauuuguuaaguggugcauuuucuauguaccauuuaaauggucaaauauuauuuaaaagaaagucagggagaagcaaguaaagaaauuucuuucuggaucucuacaaugcuagcaaauauaacaaggguuaaggggagcuauauauggacuguggcuucuccgggaaauauuacccaccacucacuagagauugccucacuuuggcguguugaaaggccuuuggagucugaaaggccuuugaucaucaagccaguguuuuguagaacaguaaccaggcucuacacguuacucuuccuguucggugaacagcaacaguuuuaaguguuuggagaaacaugaaguagaaggacauagcaccugauuaaauaaaucuaacuuaaaauguugucauuuugaaaaacggggaaaaaaaagcuuuuuuauuuguacauguugauuuccaaccaauggagacaaauaaaaggcugcacauuuuuuaccguggagaugcuuucugcaauaaacaaagaaacggaggggagaagccaccacugaucagagaagacacuguagagcaugagaaauggaagacacccaagccaaacaauuagcaucugugugacacucucacaccagcugcacauuguaaagaugcuuucauccuacuucacauuguuugacaagccaaauuacauagaagauguuucgcuuagacaaguauacuccuucugcuuggcuauuaggaucuguaguuuauuuucagcuugcauauuuauuccauagggggaaauaauuuauguaguaugucuuuuaaauccugagccauuagcaguuugcuuauuaggaagagacuaccaaaggguccgauugcuccacauauauauaacuucuaaauaucuaagaaaacaugcaagcaugaaaagacagcuuuuguuguugcuguuguuuuugacucagcuagccauagcuauccugcaagguggagcuuggggaggaguguggggagaagguaggcaagggugauguguuuagaagaugaaacgcuuagugacaagaaaggcagaucuggguggagagucaugguuggaugcacauagcagagggcuggguuuugcggccaaggaguaggguuuugagauguagaaguaugaauaaggagauggcagagugccaaggacaaacauuuccuaugucaaaacucugcaccgggccagcccccuacaucccagaaagaggaaggaaacuuucuuccuccuccuuuccuguaccccacaugcaaccucgccugccuccucccaacacuccaccccuaggaauagguaugucccacagaguuuaaaaaaaacaaaaacaaccucccccuccccacaaaaaaacugucugauuagcucauauuaauggcuaauaacacaagaucuuccagaauaaaucccuucuagggguuuuuaacauuuuaagagagguugacucuuaagcagaauacaacugcaauugguggcauuuccaauguuauaauuaaugaaguagaaaagcaaagguaguauggagaggagaaauuugggggcaaagcagccucaggcagacugaaagccaucucuccuacacuauccuuuuuccaguugcuacuucuacuacuuuuaacccaagguuucucuuaaaaguccaacuuauuugagaguggcucaaauggauaaugaagacaccaccuaccuuucaggguuauugaaaaauuaaaugucagucaacgauuuaacacaaugcauggcaaugaccauguagcacaucagcucugacucagcgcuuuuuuucuuggauugaacauucuaccucaugagaauugaacaccaagauuuacucucucccgcauaagaugauguuuuaucccagaucauucacaauauagguagcuuccuuuuuugaucaaauauucucaacauaaaagauguaaucagggaaaauuugcaaaagaagaaacauagcauacaaaaaugauaaauguauuugaugccucauuaguuaucaagcgaauauagaaccaugagagugcauuuuauaacuacaauacaaaauguuuuuacuuuucuuucuagcaccucccaauucaaacaacaaaauguuuccagacaauauauauucaaacuaaaguacaguaagccuuggcccuuagcauaucuuugcugucacuguaaacuaaucaacugucuuagaaaacaaauaaggaacauugaucaauagauaccaaaaaauauaaacguuuaaaacauuugacccuaaaauuauguuucugaaaaucuaccuugagaaaaaaguccaaaaaauggaauaagauacguaaaugacuuuuacuuuagcauuacuuaguagaaaaaaaaccagaaccaacuaaagaucuaacaauauggcaacaauuaaguaaaauaugauaaauccacaugaugaaauguuauaaucaguaauaauaaagacuaauaauggcuuuaaaaauaacuaacauuucuaaaguauuugcuauaacaaacaauccuauuauaaaauuaaauggacuuggcacacagcuuuaaccuaucaucauauuagaacaacuuaauggacaacaagcuccucugaucucaggaaacuuaaauaauaaaacaauguugacacaaacagaacgaacuacugaacacuuccacaccaaguauuuuuaacacauaguggacagaguaaagaaaguguucuacuggcuuuuuuaaugacagcuuggcuccugcccuugcauccuucacuccuacagcuugcagcacuggaucuggaucuggaucccaucccgucucuagucagaggagacacauauccauuaacaugcuaaacuguaauaaacccuuacaaugcaauacucaucaauaaacagggacgacuacugaaauacacaacagcauagaugacucucacaaauauguuaugaggaagaagucagccuuaaaagaaauacauucuguaugauucuauuuauaugaaguucaagaacagggaaaacuaaccuauuauaauagaaaucacaucaaugguugccuggaaagggagugggagauuuauugggaagagaccugagguuauaaaugcucaauaccuugauuuggguguggauuaauagauguguacauuuguuauaacuuagcaaacuguacaguuaagaucuacaguauguaaauuauaucccacuaggggaaaaacaaucaaguacagugaacccuccaugggauucaaccaaccucagaucaaaaauauucaggaaaaauagugcaucuguacugauuauauacaaacuuuuuuuccugucauuaugcccuaaaccauaccauauuaaugauuauuugcacagcauuuacauuguauuagguauuguacacaaacuagagaugauuuaaaguauacaggaggggccaagcauagugccucacaucuguaaucccagcacuuugggaggccgaggcgguuggaucaccugagaucaggaguucgagaccagccuggccaacauggugaaaccugucucuacuaaaaauacaaaaaguagucaggcaugguggugggugccuguaaucccaacuacucaggaggcuggggcaagagaaucgccugaacccaggaggaggcagagguugcagugagccgagaucgcaccacugcauuccagccugggcaacagagcgagacuccgucucaaaaaaauaaaaaauaaaaaaguauacaggaggaugugcauguguuauaugccaauauuaauacuaugccacuuuaagucagggaccagagcaugcuuagauuuugguacccaagggaagucauggaaccaaacucccacagauacugagggacagcuguacuuuaaauccauacuaauagauuaaccagaggucaacggacagcauuuauaagccaugaaauaaauuuucaaauagaaaauaauaauccuaccugauagaauccaaaauaagaggcaaccccgcaaaaaugcauuuacaugaccaaauugcuacacuagcauugauaaacuuauuuuaaaacaguagcuugugcauccaugucagugauauagcuauauucuauuuucgcaagaaauaaaguuuucaauuagcaauaaucaugccucagauaaaccucauuggcuaugauacugccauuguacaaagcuagaaauaaaguuuucauaaauuauauagccuaagaaaaggcauaauacacuuaagccagauuaucagaagcacauuaauuuuacuaaccuaacaaugagauuaagacauuaagguccaagagguaauaauauuuuuaagacuauaugucaauaaugcuaggguuuauaaaaccuuuggcuggugucaaaccaaacaugccagaaccacauauaauuuaacaacucuagacugugaccaccuggacuggauuggagaggcguacccugaacacuggcaacuagccugauacaaaugugcuaucccacacacaggcuccauaccuaaacaacaucacaaacaagaaaaaaaaaauccacuuugaacuggauauauuucuaguaaggacuuugauuuguuucuauuugucuuguucgaguucaaauuacaaagaugcuguuauaagaugcuaaaucauaaucaggauggagucauuuuuuuguucaucaagauaaaugccuuuuauguaccacaugaaacuacuuaaaacgugacucucaaaaugauucagccauggagacaucuucaaggaccauauauuuuaauaauacaaagccacaaguaacucaauuacuaacgcuucuagaguaccuagccuugcuccgaacaauaaauuuuuuaaaaaccacuuuggggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaacaaaaaaaaaaaaccacuuuggguuucguauccaucuagcuuuauaagaugcucuuauacuaagguuucuagguuuucucaaacuagcugaccucaauggccauuccauauuaaauuuuaaauaagacuuuuuuuauucuauauucuuauauugaauaaaaauaauuuaacuagaauggagaauggauguucuaguuggucuaauauuuugauuaaaacuaugaggauuaccaaauucagacuuaaaauauaauaaaauacaauuaacaucaaaacucaaaugguaaauaauuuaaauuuuuaugccucuggauaauaauaaauuaguacuaaccagguaaagugauaaaauaucaagguaacugauuucugggugcuagaaugucagauaaauucauuacaaugauauaaguacccaugguuauaucauaaacaaccacuaauccugaagguuugauacaggaauuuauguauuuuuuuuuuuuaaguuuuaaccuguguuuuccaagcacaucaucugccaaacccuuuuuuacucacaaaggacuucuaucccauaagagaaagaaaacagaaauggaaaagcaauaagccuuccauagacacugcugggagauacauaacuuuuucucuaaccauuacaugucaaaccaauggaacaggugauucuaaaucaaagauuuagcaugguacuacaaucacccgaguguggucuccaugccaacucaaaugcacaagagggagagaacucuauagcaaauuagggacauuuuuuauaugaccugauucagaauauaaagagggaaggaaaagucauaggagcuauuuucuacccagugaucccaaauaauuuuaaugaguuauucuuuuucuuggucuuaagucuuuuuauuccugcccaucucuuauuucugcucaacauuuauagagcauuuagauauuuuugcaagcuuuaacugguauauuuuuacacgauuucaaugcaguggcaaagcacuguuggccucauuuaauagcugagaaacagaaagguuaauaucuuacucaaggcccuucuugaagucaguaauaaauucaagauuugagcucugaauuuuaauacuauaauuagccaaaguccacugggccaugaaguuuacuagaaagccaaucuaagggcuccuuauuauuuucugaguuguuccacauuaauguaaauaugcagcauuauacguauaauucaaaugauuuuaccuugaggaguuguuaacaacauuuuaaaaaacugcucaguagauguuucuguucaccuugaagaugaacuuucuacagaacuccuugcuacuuggcaacuucuagauguguggcuacgaaugaagcauggucauccacucaaaauggguggagggcaauguuggaggagcagaucuggaauaugacuguaacaaagcucaaaacauaaucaaauauauagugauagucucugucagaacaaacuauuuuuuuuuuuuuugagacggagucucacucuguugcccaggcuggagugcaguggggugaucucggcuuacugcaagcuccgccuccuggguucacaccauucuccugccucagccucccuaguagcugggaccacaggcgcccgccaccacgcccagcuaauuuuuuguauuuuuaguagagacgggguuucaccguguuagccaggauggucucgaucuccugaccucaugauccaccugccucggccucccaaagugcugggauuacaggcgugagccaccguacccggccaaaagaaacuauuuuuaacaugagguuuaaaaugguccacauuauuaaaucuccacaaggagauaaauaagaauuaaaaauaccagggcacccugcccucuaguugagaaucucugugucaaugaaccacugugucugguggaguuuggcacauccucaagugcuuggggacagaaaaagacaacuaccagauuacaaaaaaauucagaaauggguuauccaaagagcaauuauuugucagaguuuucccaguaccaugaaagguaaggagacauuggauuucacaguauguaaucaauacucaaaucacuagaaagguauauuuugcagugggaugccaguuugguaagacuuuccauuaccacuuugaaguaaauucccuuuccuugugauucccugcucaccaaaugaagcucugauuacuaauucuaucacuuagguaucuagguccugagaaugaugcacaccggauaauguaaacacagucccuagaaacaccuguuacccacugaaaauuaguuuaagaucauuuugguuuauguauuaguguucugauuuuggcuacucugagcuauuucccaaaagucugaucaacucugaaggagcuaacaaaauaguuucuagaccugcaaagccaagaaauagauugggcaagcgaugucuaacccccacugugacaucaccuucauugcucaccaucucaagcagguccaucugaaucucugugcccuguuccaggaauugcaccaugagccagcauagaaaacaaaguauacuuucuggauuaccacugaguaccuaugucuuccugauaucuaagcagucaacaucuauuagucaucuguuggguauuuccaugcuagaaaugcaugcugaagaauacagucuagaaaaauaaaauauauacacaaauaacauaaaaaucacuguauuuaugcauaaacaauaacauauauucaguuacaucucuacuguucaugaaacuuuucucucucacacuccaaguaacuuauagcugaauuuucgaauucuuuugaccacacuacauaguaagacuuuuuaccucacaaccuagaacucaaaguuucacaaaaccugcagacuugcuaggaucugcuauuuucuucugaaacagacuuuaagcuugaauagcauuuccuacucuugucucuaauuuuucucuuaaaugcuaauaaugaccuacuaaguuuauuucuugacccacuaguugaucaccauccacaccugaaaaacaaaaaugcugcuuuaaggccuggagaugcagcuccccauugcuauuuccuuucuccuuucuccaaaaacccccgcuccuuggaagcacgugucugcucaccuuccucauugggacuaucuaaccacaacucagucacuccuacucauuuacagaugacuuuuuuuacuuggccaacuucgucuaguauacuaagauggaacaggugguucuaaaucaaagauuuaguaugguacuacaaucaccccagaguguugucaucaugcuaacucaaacacaagagagagaacuuuuuaaaaccuaaaucaccauucucuccaccacaacugcugacaauuuuugaugacauaaacauccaaauagaacaucucgguuuccugaguuccaacuaccacuuccuccuccacucuuucucaacuacccacucauguagucuugcucuagacuuucuuauuccagaauaauuuuuaaaacaugguguagagccaaucacccagccaaccucagccuagauuaguugauccucagccaaucugcaaauccguaagaauaaaugauuuuuuuauuaagccacugagcuuuggcauacuuuguucuguggcauuuuuguggcaauagcuaacuaacacauucaucaucucuauacuaaguauuaagugguuuaacauggcugaagaaaaucacacaaccauucuaccugauauuuaugacugcgaaucucaaaugagcucccaauauggccugacaauucgacuacacuucacuaguaaauucaucuucauccuuugcaagacaaugauuuaucauguuuaguucaaaucuccagcaucccucuuccucaucuuccuuuuggcuaauuacuugccacagccuuuauaauuauaugcaagcugauaaaauaccuaccuuuccaccauccaagccacuaacuuguaucugacaacaacacagucugccuucucucugguuaacagagaaguuuuccugcucccaucuaagguaaaccccuucauuuuguuuuagaugccaaccccucucacuuuugcaauuauacccuuuguuucuuucuccccuuuaucacaucaacuuucgcuuuucuacuagguuauucuaauuaacauaaaaaaugcuuuaaaauauuacccaucaaaaaacaaaacaaaacaaacaaacaaaaacacccuuaaacucaucauccccuucagccagcacauucucuccccuuucauagcaaagggcauuaaaagaacuuucgguacucucugaguccacuuauucuuaguccacuccaaaccaguuuucauucucaccaucaccucuacauagcuuuucccaaggucacuaaugaccagugugaccauauaauuuaucauccacacuggaacauuucugaguaaaguaaacacuaaucagacaagacaccagauuagcaggcauaaaauaggacugucucaggcaaacgaauguaaugacaccuacacugauauggcucaauucacuuucuugaccuaucaagaacaucugacacagccaaacacugucuccuugaagcaccuucuucucuagaacuagcauucugugacaccacauacaccugcuuuuccuccuacaucaccaguacuccaucucccucaucugcucaucuaaaaucuggaaugccccagauuaugucuuuggcuugcuugcuuucucugucuacacuaccucuuaaagugaccucauccacuucaauaugccaccaauacaccaaaucuaccucccuaaccugacccuucccaucacagaaccaaccuauucagcaucuccacuuguaagcccaacugguaaaaguuaacacaaccaaaauagaaccauuaauucccaccaccccaaaaauauguccccaucccaugucuucaccaucucagacaacagcacuauaauccacccaguugcucaggccaaaaaugcaggagccauucuugaucauucuccuuccuccauaccgucaugcaaauccauuaguaaauuccacugacccuaccuccaaauaucucccaaaucuauuguucaccaucucacgccaacaacccaggcccaagccacuagucucucacuuagccuaccccaacagguaucuaaagggccuccaacuucuucuacugcccccacaguccauccuccagcuagcagaugggaaaggggaacaaacugucuaaagcaugaauucccugcccaaacuacaacuggaacaaaaucaaaccuccuuaucauagucuacaaacccacuuugucuggcccuauuuaccuuucuaaucuaaucucaucuuucuccacucucucaucauuuacucugcucaaauaauaaucguccuuuucuuucuggcccauaaaacacgccaaacuuauucacaucucagguccuuugcuccugcugcuuggaauguuaucugccuuuacuuuuacaucacucccuucucuucauucaagucucugcucaaaugacuccuccccagagaauaacguaaaagucaccuguuucucuaucuauggguauauuaucugucucgucccuaccccuccucuacaauguaaagccuuucaagacagggaccuuaucuauccugcuugacauuguaacaccaaugguuggaacagugucuggcauagaauagauaccccauaaauauuuaguaaacuauugauugaaagaugaaauucaucaggaucaauacuggcagugaaaaaaagagguaagcucaacagcuuagauauagggaagggaaagggcaagccauguauaaaaagcaguaaagugguucuucauccauaccugaucuggccugauccagcuacaggucuuacaaaucuuagaucuucaagugcaguucaauucgguccuaaacuaauccugaccaauaccacaaagcuuauugggcaccauaucaguguuuacagucuggcguuaaucuugcugcccuaaaugugaugugccccccaaguacccucaugcuugccaagccacagcgugacuccuaaugccccacauaacaagccccagauccuggguuuguugcccagcuuccuacgggaaugcagacccuccacaaucucaauauuacuugguuguggucauuacaauugcccagcccuuaccaagucucuuucuagacuagccagaaacauaagagcuauaggcuugaguguucacccagggcagcucuuccuggauaaaggcacugccaucagccuaagaguauaugcuaccaccacuaccaacaccacgaaaguccugaggccagguucucugcagcaucucauucagaccugaaucuguaacucaccucuaaacauuucaguuuggacugcaugcuacccucaguuuuuuuuguuguuguuauuuugagaugaaaucucacucugcugcccaggcuggagugcaguggugcgaucuucguuuacugcaaccuccaccucccggguucaagcgauucuccugcuucagccucacgaguagcugggaccacaagugugcaccaccacgccuggcuaacuuuuguaauuuuaguggagaugagguuucaccauguugggcaggcuggccuugaacuccugagcucaggugauccgccucccuuggcaucccucccaaagugcugggauuacaggcaugagccacugugcccagccuacccucaguuuuaaaauuauuuuuugaaaaugucaaaaaaaacacacacacaaacacaaacagaaaaaaaauacuuguugagugcuuguuccaucaggucagugcuccuacgccuagcccuauucaucccuggcucaagcuccaaugccaaucagagguuaagcaacuuaggcaaggucacauggcauuuaaacagcaaagccaagauccaaacccagucuaaguauauacucuauucauuacgcuuuguucccuguuccuuuuuuguuuguuuguuuguuuguuuguuuuuguagcaccaggaccgaguacuuaucagauauuccaucaaugacuguuuaacugauagggugucuuaaauauuuuuaagacagauuuuuaaaacaaaucuccaccuaaugggaauuucauuucaauguuuacccacacaauauagaaauacacaaagcaaaagcacucuucaccaaaaucuacuuuaccuacucaccugaugaaccaauucucuccaugcccucaguaacuacauucuacugugcuugcacacgucugcuccuccagcugggaugcauuuuaccaacucauacauguuggauuugcucccacaucuguuuaugacacuugcacuuauugaaauuacacaauuuaaguaaaugaauucaaugaaaugugaauguaaaaagagcucuuucuaugaaaacuaaguuggcugcuuuggaguggcuugaucaacgugcuacuggaaaaaaaauaaauguuuucaauccaauuagacacgggaggaaugaaagagaaacuguauaauucauagaagauuuugcauugagauuucaagugucucaguucuugcugcacuuaaaaaaaaagccuggaaauuauaguuggugcaugauuauggugugguuugugcaaaaaaggacauguggcucuugaaacagcuuaccacacuuaguuuuacaaacaaagauuggaauacaauuguaaaccuacauauuugagguuaaaauauuuaggguacacauguauucuguuuuggugauuucccuacuuuggcuggcuuuuuauugauuaagccaacuuaaagcuuuuucaacuaugucaacaggccugguaccauguaagccccuccaugugauguccuccuuccgggaacaugcagaguaaaacacuaucuauacagcauacuccuagcaguugugguuugaaguaaaacaacaacaaccugcccuauaccaccaauaaaauggacacacuauguugaauuuucuacuauacugagacuguguuaaacauuuagucuguuuauuaccaauaauugauuuuagaugucccuugaaaaacucucauuuaaauuuuguuucauuucuaaagagauagaaaguguccgucucaaauaauuccaauucauccaacauauauuucaugaacuuuuuaaaacccauccauucaaaacugucagauguuucucaaauucuucuagaugauaacaguucuaauauggaaagaaucuguagaugaguacucauaauauuaauuuaggaauagaaagcauuuacuuucaugggcacuguuuauuaacagcauuaccuuuguuuguaacacuuacaucaagugaaaaacucuuaccuacuuuuaggaagccaaaacaaauacccaaaggcggagaagucaaacucauguaacaaaacuacaaauuuagcaaugaaguaaaugcuuuaagaaguucaagauccuuuaggauucuccaaaaguguuaauuaacacaucuaaugacauagcauguaucuugaauaauuuuuggaucgugaaaaaaauuuucaguuauaaagacauuuacauuuuugaauuuauaaacucucuuuguaagcaauacuaguuaaugacgauuuaauaguugcugugugaugcugagcaaauuauuuaaccuucuuaagccuauuucuucaaucacauugggguaacaccuaucuuauauggaggcaaaaacaucaaaugagcuacauauaaaaugcuuagcauauaacuagagauauacucaugugaaaauccuucauacaugcacauacacacacagacucacacacacuuauauauuuauauuuuuuauaucuaaagccaaguauucuuggccaggagugguagcucaugccuauaaucccagcacuugaggaggccaagguuggcagacugcuugaggucagaaguucaagaccagccuggccaacauggugaaaccccaucucuacuaaaaauacaaaaauuagccgggcgugauggugcaugucuguagucccagcuacuuggaaggcugaggugggagaauugcuugaaccugggaagagaagguugcaacgagccaagaucacaccacugaccacagccugggcaacagagcaagacucugucucaauaaaauaaaaaaauuuaaaaauuuaaaaauaaagccaaguauucuuaacaguggaagguggggcaagcagcaagguacauggauucucugaaaguguauugaaaauguaugcaaaacuuugugcagauaagcuaaugugcccuuuccuuagaaaaggguugacaguuuuucaucauauucucaaagguguccauaaccaccaaaugucaaagagcauacuuuucaauagccuuugacuguauuuucucuauuucccagauuuaugcaguucauaaaguuugcuuugaaacucuagacacaaguuaaauuuuaauucacucaacagcaacaacaacaaaaaaguugaauuacaaguguagucauagguaaaauauugguucuccuuuuaucucccuuuaaaaaaaaaccuguaaauucauuuagcucaaauuauccuccaauucugccauaaauaaaaccaaauauccaaacuuaaagccaaaguuuaaaaaccuaaacaaacaaaaaaacaacagcagcaacaaacacacaaaaagcuaggaaaccuggaauggccaagaauuaaagcccuauugcuuguauaaaucagaagggacuauaauaacaauagucccuucuuuggaguuaauuuuuuaaauuacucauucccucauucugacuccaaguuaacaaccuucacuucaaauagguauuauauuguuuaaaauuaguguaauaaggagaccauaugguaucauggaagagacccuacacuaguaaucugggaaaccagggguauggcccuguucugucgccaacugacugccaacagauggcuggaccucagcauucuacggcacaaugauucugcaucaaaacaugcaaucccaaagauacuuucuagcccaauauuauacuuuacuacuaaaacagaaacuuucaaaagggaggucaccugguaaaagauuugagucuagguccagugagaaaaauauaccaccaccaagaaacauuugaauuacagaaacuucuguucccacugucagcaccuucagggcauauaaauucagagcauggcuuccaguuagggccacuuaaaacuucagcuuaacauuaauaacaacagacaccuucuucuuuaagguggacagcacuuuacaagaaagauuuaacaaaauauagauugacaaaaaauauacaaagcaggaaauaggagucugguguaucuuuacaugguauagucuuauuuuuuucauugaaaaacacauguuauggaaaaaguagcuacuuuuaaucuaauuuauuucucaacugccuuuuccaaaacaaguauuuuucaauugaaaauaaaagaaagcuuuacaaaucaugauagcccuaugcugaagagauaucccucucccucuuaaaaacuuaaaacaaaacaaaacuauacaaauguuaagcauuuaauaagccugccaaauguaacucuuagaauguauuccugcauauucuaaaagcuaagcaauauauacacaagaggcaaauuaggauggcaagaguuuucugaaaggcugugaugacuaauauuucaggacuggaacaugauaguuauuaaaagaaacaugagagguguucuccuaauuccuaauaggcccauguccccaccacaagaacuacuacaaacaacauucagggcugaauucacacaguuuagucucuaaggccuaaaugaguuuucucaauuuucucccauguggcccauuaugugaaucaaagaaaucaguaauucauuuguugaaggucaaauauaaggacauaaugaggcccaugcacuaaaaugaauaaaaagaaugaacaaaaagaaaccaagauaaacucuuguugaaaacaaugccccagaaucuagcaaauagucuaaauguaccuaaaagaccagaacgagaugacauauuaguucagugaucucaugacauauaccaaacacuuucuuccauguuaaaaaaaaaaaaaaaaaguucaucuagcaucugaugcauacauuuagaaacaaccccaauauugaccaagguuuuucaaaugccuuaccucacaacuggaacuucuaagcaaaagcuaaugaggccaucugggaaagaucaccaggaggccuuacuacugccaguauuucacauggaacaaucgauagcaugucuuaacaagugcaaagauuucagucuccgaauucauucuguagcauauuucaacuaguuagcagggauaaggauugagccaacaacuuccuauuugugcaaguagaauuuaaagauuauuucuuaagaauuuaguccuaguuauuuuuguuguccucaaaacacagugucccuguuagaaggaauauaaauaaacacacauuuucagauggcaauuuggcauugcuaucaaaaaauuaauauaugcauguacucuuugauccaccaauuccauuuugaggaauccagcuuauaaaauuuggggaugcaaauauaaaaauguucacucauugcacuguuuuuauaaaggugaaaaaucauacauauauauauauagcugauuaacaugaguuagacccauauacacuaaugugugaagaccccuaagacacuguucaguucaaaaagcaaguuucagaacaaguauaguauuucuuauguaaaaaaauuguguguacguuugugugaauaaaugcauggaaaacagucugaagggauucacaguauauaacagaagcugcccucuagagaagaagaagugaaucaauguauguggacugggguagguucgaagagaagguccguuuucuaaagagggauuuucaccuuuuacuccacacccaucuguauuauuuaaacauuuauguaacacacauaaaacauuuguucuuuauagaaaauaagaugcaauaucaacuuuuaccuaaacuccagaaucacuuaaagaggaugcucaaauaguaaaacaaagaauaggcugggcauauggugguucacaccuauaaucccagcacuuugggaggcugaagagggcggaucacuugagcccaagaguuugagaucagccuggggaacacagugagaccucucuacaaaaaaauaagaaaauuagcugggcauaguggcacacgccuguagucccagccaaguagcugggaggcugcagcgggaggacuccuugagccuaggaggucgaggcugcaugauccaugaucacaccaccacacaccacccugagagacagaccaagaucggguaucaaaaaaaaaaaaaaaaagacagaaauaaaaaauauuggcagucaaaaacauacuuuguagacuauauccuuccaaggaauaaagaaaaauugugggcagcaucaaucaacaguuauaaaugaauaugacaguguuuucaugaaagaacaagcaucauucagagaacuaaaggauuuguaucucagaucuuaaggaauauaaaagauacugaacucagaaacauuacuaaaaagguguaaucauuccaaauauuuuuuagaaauacaauuuucacaaugaauccuauuauuuuggugcaaauuguauacugugugggugugcuuuuuuuauuaaaaaaacuguaugcauaaaaagcuagauggugugaaguguuuacucuuaccuguacauuuucuucuguaaccugaauuucugcaguguaaacauaaucaauuagcauccucaggguccagccaucuaccucuuuuauucuaacucucuuugcucggcucucacucaucucaccuaaaacacaaaggaauaagagugauguuacagcaagacacugcuguggaaguuccaaugccaauguagauugauacaucuucuugccacucacuguauucaacaggcagcauaaucagccacuuuuugcaggccgaaaauacuccccccuuccucuuccaaaagcucaccugagcaaaucauaaaauguacuuuuguuacccacuugcaccugaaaaucauaucacaacaaugaacgugccauauguccagcugcaugaacuauucuuguggcuauaggaucaguagcugaggcugucccugcuuuugggcacuuguugucuuuauggauuuccagucaugacuagaagaguaacgauguuacugccuuuggcuaauagcaaugaacagcugcugaaaaggacccaccugguuagcauuacuccuucaacaaacacacaaaugccugccggggcaugcauagccugcaccagacacagaggcuccacccucagugagaggucacaacccucaugccagagacaacgagaaaacaaauuacuuaugaugcuuagagaaugcaaggcauaacagggaucacaauaauaacaaagaguuagucaacaacaaagcuuguuacagagaucuucuagcucagauucaguuccuguuugucaacugcagcaacuucacgcugaagucauuuccauaccagcuuuauuacuaaaaccagguauccuucuacaaaacugccugcaaagaaaacaguaaaagacuuucuuccuaauacccacuuguggaaaagaaauagggaaggaggaaagagaagggauggucccuaagccaaggagacuuggggagaguaggaggcaaguuuaagcaccgaggugugacaacauaagugaacuaugauacauggagacacaagcaauugaaugcggguggggagggauucaauuaaaaacuaaaaggacaguccaagaauaaugcugagggccaugggcaaaaaagauuuggcucuagaauucacuaaguuucaaagguaaaagaagcaugagaacgugccacuauucaucaccuucacuuuaacccagcaucucuuauuaaaccauaacauagccucaagauuucuugaaagcucacuucuuuuucugauacaaugcacugucagcgaccauaaacuaucagaaaagucuaugggaaaucauaauuacacaaaauuccuuuguaaacaaaacccugggagaagagaaauaacaauagugguguacaaaacugcgugcuucccuggagauuaucuuugacaagaucucagaaagaagcuguucaucucagagcuaaaauaucccaaaaaacuacccugcuacuucccaggaagaaaaacaucucuuuguaugacaagggaaguaggagaguuaaugagaaagauguaccuauaccuacauagcaggaugaaaggggacugaguuguaugucuggugcuacggcaaauguuuuuccccugcuuacagaaaggaggaaaaaggaaggucaaggaauacagaaaaauaagucuucagccacauauaaggcaccuuucucuauccuauucuugcuggauccugugaauaguugggguauaaacugauagucuguauaaacugaagccucuuuugugccaaaaguuaagacauucuggugauucccacuuggacuugagacaaaggccauaacugauucaccuacagagccccaauaauaugcaaagcccuucagggccuggggccacaugagcacaaagccaaacagccaguacucaguuaagcgugacuuaccuuaggcaaaaccaagugggacuuuaauuuacauguaugacugaaaaauaauuaguucucugccaaacaguuuuuaauauuauaguuuuuaagguauugcuauaagaugcauuuugcuaguucaaauauuugucauuuuuaagauuauuuuucuccccagagaacuguaucugcuuccaauaaauucaauuucaauuauauacuguuuugaauauuuuuauauuaauuuacaaaaacaguaagaaaaauaaaaaaugugcccaugacuguauuaaugguuuaaaaauucuaauuacuaugaaucaaagcccauacuaaagaguauuguaaaaguuauuuauaucuaauuccaguuguuacauuauuaccuuaguuuuugcccuaugcuguguuuucagaggaaaucuuuaaacaguauggcuuugugagauuucugauugcuaaugcauuuuaaaaacuaugaaugagagucaggugcuguggcucacuccuguaaucccagcuacuagggagacugaagcaggagaaucacuugagcccaggaguucaagacuagccugggcaacacagcaagacucuguccuauuuaaaacaaacagaaaaaaaacuaggcuacccaaugauacuguacauaguuuauccuuaccauuuguaaccucccauagucucuauagagauuauaguuuauuguuuauguuuugaucacauaacucugagguuauaucagaacucugaagcuacauuaugcuauccauacaaacaccuauacuaaaaaccucagugagagucauccuugauucucuccucuuccuuacccaccagucccacaguucacuaaaacuugcagaacuaaccuuggauagaucucaaauaaaucuucucaccuucucaccauuggggauccuauaaucucuugcuaacaccaauguagccaccuccuaauuauuuuccugccuccaguacugacuccacaaauuugggcacggaguucaaaaauccuuugguuucucccaguccaagcacacauguccagccccugauucauuaccuagccuucucucucuccucccgcuauuucuaaacuugaaauacauuauugagaagcuguuuguuguuuucuacagacaccaagcaaugucuuaccccugaugcucuuguugaacauuguccucucugucuccccacccacucauuucccaggcuaaucuccacuggaaccucucuagguagccuuaucuguuaguggcccauggcuggauuagguacaguuggguaccucaugcaaauccacucugucauaaucaacucuuuaccuaguucuccuccucugaauucuuaagcucacugagaacagggaugaagccuuucuuaucucuguauaacaugucugacaucuaguagauacccaauaaauacugguuagauaaguaaaugacuagaugaauaaaaaguaaagcaagugccaauuuaaaauguagcauuuuggcugggcacaggggcucaugccuguaaucccagugcuuugggaggccaaggcaggcggaucaugugaggucaggaguccaacaccagccuggccaacauggcgaaacccuaucucuacuaaaaauacaaaaauuagccaggcaugcugguacaugccuguaaucccagcuacgugagaggcugaggcaggagaauugcaugaacccgggagguggagguuacagugagcuaagaccgcaccacugcacucuagccugggugacagagaaagacucuaucuuaccaaauaaauaaauaaguaaauaaauaaauuaacugaauaaauacauaaaauauagcauuuuuacuuaacguaacuaauggcacuuuaaaauuagucuuaaacacggauauucuagcuauguaggauuucagucaacauuuauugaacaucacuguacauuacagagugagccaagcacuuucacuagcaaauaccacaucaucucuaccuuuuuuuuugagacagagucucauucuguugcccaggaugaagugcaauugcguaaucacagcucacugcagccuugaacucauggccucaaaugauucuuccgccuuggccucccaaaguacugggauuauaggcauaagccaccguacccagucuccuaucuacuuuuauugagaaaaaaaggaaguccuccaaaucaugaaaguguaagaacacauauauggcuaaaaacauuuccaucucgcaugccuauagucccagcuacucaggaggcugaggcaggagaaucgcuugaaaccgggagacggaggcugcagugagcugagaucaugccacugcacuccagccugguacagagcgagacuccaucucaaaaaaaaaaaaaaaaaaaaauuccaacucaaggaucuuuaaucaggacuccugaagcccaacauaaacugguaacuucacuuauccauugcaaaaugaauuuauccaauguauaaaugaaaagugaauagguuuaaaaagauaaacgcuaaaauucauuucauuuuaaaaauucuaugauucuaauuucaguuauuuagcacacaaaacaucugaaaaaaaauaaaaguguaacacagaaacucugacuaugcugaaacucuaagaaauaaauaacaaauuuauagcuauguuuaauaaacaaaucuuauuccauuacuuugcaaguuccacuugucaucuacucuaauuacuaccaccuuuuuguucuuagguuacaaagcaguuacugacacacaggcauuuucaguuuggcaagcugaucuggguggcccaccagccacucucugugauggucagaguauguaacucuccaguucuacagcaaaucuaagaccaacaugguaacugcauugcccugccaguuuuguucugguuuggguaacuucugagaaagguuucuuagcuccuaaaagacagaguccuccuuccuugagauguuggguccacucuugcaggcaucuuucauuuaggagaggaacaaaccuuaggauauuuuuauugaggauagaaggguagagagacagaagaagauucuugaugaaauuuucaagcuguagauccaaucaugucuggugcccagccugcuuucuuaguauuuaaaccaguuugaguggcauuugcuguuacaggcagccuaaagcauuccaacuuaaguucuuugugcaacauucuauuuaauuuuuuucagagccaucaucaauaucagaaauuaucuuuuguguguuuacuuacugucuaaccuuucuucuucuuccuaacuauaaucaugagaacaggaacuuaucuguuuuauucaucacucuaguccccaaagccuaggacaaugccuagcagagaagauucucaauaaauauuccuugaugaaugaaagcaugaaucuuagacaaacauaaccauguauauagcuuuuuaaaaucuuacuucuuagucacucaaacaauaaucugucuuuuccuauucuaauuuauuuuacugaaucauguucaauaugacaaaagaaaucaaaaagcacaccaaaaaaaaggcuaaaaauaaaaauuuaguauucaguacuucccaccagauuucagaaauguuagccuguggcacaaauaaaucucaaaguauguguuaagcaaacagcuuucuaaaugccacauuuguaaccaagaaguaaucuaaaaacacgagaacccaauuugguauguucuuucuuaaguaacaguuaaacaacuuggccuugcucuaaauaggcccauacuucacaaaguaaaacccugugacuacuucacagaauuacuuuucacuucccuucucuacucaaauacuuggaacuaugacgaguaacagaauuauuucuuaggugacauaauuuaaaugaaaacuucaccuacaguuuaugagauuaaaaguaagacccaacaaagaacaucugcauauuccccauuuccuaauagguuagucacaggaaaacaaaagaagaguagggaaacucccugucccugagcaagagaauguaaauguacaugauguuugguggaaugaaagcauccaauggucuacuuguuaaccucaccauaauuuuuaccaaaaaaaaaaaaaaaaaaaaaaaaaagcuuaacaggguuucagaccaugaaaaacaaagaaacaaaguacucauacucuggcaaauacuuaaaugagucuacauacacuaaauuaccuagacccaauccccgugucuucuuuuuuucuuuuucauuuuuugagacagggucauauucucacucuguugcccagguggagggcaguggcaugaucucagcucagugcaaccucugcuuccuaggcucaagcgauccuccugccucagccuccccaguaucugggacugacuauacaggcacgugugaccaugcucagucaauuuuuuuaaaaaucuuuuuagagaugagaucucccuauuucucccaggcugguuuagaacuuaugggcucaagcaauucugccaccucggccucccaaagugcugggauuacaggcaugagccacugcgcccugccuuuaucuuuuuuuuuuuuuuuugagacagagucuugcucugucgcccaggcuggauugcaguggugcuaucucggcucacugcaaguuccaccuccuggguucacgccauucuccugccucagccucccgaguaggugggacuacaggugcccgccaccacgcccggcuaauuuuuuuuuuguauuuuuaguagagacaggguuucaccauguuagccaggauggucucaaucuccugaccucgugauccaccugccucagcuucccaaaguggccuuuaucuuaucuaauuucugccaaauuguuggcuaaacaguagauucaaaaguagaagaaaaaaaacaguacaaagauugcuaaaaagucaaauaacaucuacugcugaaaaaccauaaaaguuuagccuaaauaauaagcauauagaaagaugcuugacaucauugguuauuagaaaaaugcaaauuaaaacuacaauacuaugcuacuucaacacccacuagaagggcuauaauuuuuuaaaaagcgguaccaaguguuggcaaggauguggagaaauaggaaguuucaaacauugcuaguaggaauguaaaaugguacaguaacuuuggaaaaacagcuuagcagaauuuuuuaaguauaaauuuaccaugugacccggcaauuacacuccuagauaucuacucccaagagaaauaaaaauauauguccacacaaagaacugcacaugaauauucauagcaguauuauucauaauagccaaaaaucgaaacaacacaaaaacauccaucaacugguaaauggaaagucaaaagcagucuauccacagagaaugcuauuuagcaauaagaacagcaaaccuuccuuugaaacauuuaugacacggaugaaccucaaaaacauuaugugagaacaaaaauguucuaaaauugauuuauggugauggcaguacgacucaguaaauuugcuaaaaaucagugaguugugcacuuaauauagguaauuuuuuuuuucucacucugucacccaggcuagcaugcaauggcaccaucuugguucacugcaaccucugccucccaggcucaagugauccuuccaccucagccuccugaguagcugggacuauagacuagugccaccacacuaagcugauuuuuuauauuuugauagagauggguuuucaccauguggccaaggcuggucuugaaccccucaagcaauccaccugccucagccuccuaaagugcuggaauuacaggugugagccauugcauccagcccugaaaugaguaaauuuuaugauauauaaaauaugccucaauaaacuaguaaaaaaaaaguuagguacucaauucacauuuuguauaugugccagaaauuaacauaguauuccuauuuucaaguacuuuagcgcauagcaaucuaaaauuuggcuaagcauaaaagguauauucucagacagaaaccaguugaacugcaaaagcaccuaccuacuaguuaguuguaauacacuauaaauacuuagaaaaucagaaugucuucaaugccucauucccuucauuaggcaaagcucacauauucauaaaccacgucagcuaaaucaugaagcauagagaaccauuagacaaaaacagaagagggaaacugaaaugcaguuuagauuauaaagcaaacagaaaagagagcuaaaaacauaauaagcucuccuaucuccaccuagcauccauuucacuggaugucuaaggcucagggaguuuggagacacuaagucuccaaagccauuugaggggaaagaaaacuaaccuugaucuuacagguguaaguuaaucacucuauuuuugucacucuguggacaauaaaacauuuaucaaaaaaaaaaaaagagccuagcuuaaagcuuuccaaucuuguacagaauauaaagaaauuuaggaaguuagaguaaaaaagaauggugaugaugaccauaauaauuacugucaaaauuaacugaucauuuucuaugcgucaagugcuaagaaauucacacauaugaucucauuuaaucuuuacaaaaacucuaggauguggguaauauuauuauucccauuuuccagauggggaaacugaagcacagauuaaguuuuccaaagaccuaguaguuccaacaaguaaguggcaacagcagugucaucugaaggaaggccaccaaggggacagcacuuuacaagguaauuccuaaaguagcccaacacauuccagaucgaauccuucucuuacaagccuuagagacucucucucucuagaaaaguguccagcaguaauaaauaagauguaaaugaagagacuagagugaaccccaagacauaaaaaucugacuagucucacuucacggguauugacuuuucagaucaaccucagcucucagcugaaaggcaacccucccaaacuuggcucagagcccaccugcuauccuucuucauuccugauuauuuaacucuguucuggaagagcaagaucauaaaaggcugaaaacugagcggggcucuggucuccucacuacucccaagacacccagaaaaguuuucacucagucugucuucuccaucugaccuucuacacucaucuucaucuguguaaaccccucaauccaucaggucuggggaaauccuucucucagugcugcccaucacagccgucaacgucugaccacugcugugagcacucagaucuuccauacacuauuaccuauuaaagggugcacauccaucugccuagcuacacaggaagcuuuuggggcaggaagcuguucacauuguuuuuguaugccuugaaguaucuaguaaaacaguagcaccagaaauacuuaauaguuucuaaaguaagaagagcuuuguauuuuugcuuuuugguauaacuacauuucuauuuguauuuucuauuuggcauaccaauacccuaagauuauaaacucauugauguaacagauaaaaacuucguuucuuuguacaguauauuuuaaaaaagaaugagaguaagggauucaagugugacagacauaaauuacuucuuuuccagaaguacuaaaaucauucuauauauuuucacaguugccaaaguagaacaugagcuuguagauaaaucgcuuuauuuucuuauauuuccaaaugaaggauauuaaauaaacaucuuuuuguucaauguaacacuggaugaaacaaauguaaaaaucauuuuaaaaaauguaaaguggcuuccuuuugucaaaauaauaaagugccaaaaagcuauuauaaauggcagaaacuaauauacauaaguauaacuuacagggagaaaguugagcauaaaauugugaguguaccuauguauaggcuuacugaccuccaacaaugcaaaacaaagacgaggaggaauuuggaacaaagcaagaacauuuucuuccacuauaauucuucauuucauaaaaguaaaaugucaauaacaaaagaaaaugugguaagaaaagcacagaucugaauacauuuuuuaaaaugccuauaacuaaaauauuucauaccuguaaacauggcaugaaaauaaggacuacaggcggccagcaccacucuaugagcagaaauuuccaugucuucugccacaauugugacaucgcacagcaaauuuugacuguguaaaaagcagagagaaaaaauuuaaaugauaucaacaacgaauguauugaacauccuaugcaaaaauauuacaguaaagcccacuuucaucaaguggagacuaacguaaaagacagccauccuuugggacaugaucccuaaacaugaaguacauagaaaacagcugggauaaagguccaacaugccuuggacucucacuaagaauccugccuuugaaaaacacagaaauccucccaaacuugauuacugauuucucaaccuaaaggcaauuacuggcagcaaaccaucaauggacugcaaaagaagagggugucugaauaagaaguaguggcagaaguggcagguguagucugacaugaagaugaagaaaaaacacauaccgaaaacuaaauugggucaaauacccauccccucucaaaaaaaaaaaaaaucuuaaaagacgcuaguucaucaagcaaugguaaaauuauauucaguuacacuugcugcuuaaaaggcuuugcacauuugaagcuuaacuuaaucacaacauuuuaccaaugcaaaauaucucauccuucaaggccagaaaauauuacaucuaaaguuaaaaaacacuuuggccaggugcaguggcucaugccuauaaucccaacacuuugggaggccaagguagauggauggaucacuugaagccagaaguuugagaccagccuggccaacauggcgaaacccagccucuauuaaaaauacaaauauuagccaggcaugguagaccacaccuaugaucgcagcuacugaggaggcugagacacaagaaucacuugaaccugggaggcagagguugcauucagccaagaucgcaccaccgcacuccagccugggugacagagugagacucuguuucaaaaaaaaaaaaaaagcauuuuguuaccucaaaaccauuauucagcaaccauaauuauuauaucucuaauuuuaaaacauccauuauaauucacucaaaaacauguggugagcauuuuugacaugcaaugcguggugccagaucauacucuccagguaauuaauaaugucacagaauauuuuuaacagaaaacguugcugaugcuuauucuagaacaagcaaaaaggcuccaaagccuaaaaccugccuugcuaguagucauacuaugaaugacugaaacagguguggugaaagcaaaugucccuuccacaccuuacauacccaagcacugaauuuaugucuaugugcauagugcaugcaggucacacuuggcacccuccucuacuguucuauuuccuaaaaagguggccugccuacuucuguaauuuucuaguagcuuacaagcaacauuucccaugagcuugaccaaguccuugaaguuuuccaccuguccauacugcuugcaaacuuguucccauaaaguucaugccaaaacuuuuuggagagccuacugguaacuauucuccuuccaguuuaggagaaauggaagaaaaaaagaguaccccagcaucagugaugacugcaucccagggccucauugcugaugagacugcuaugccauuuagauuaugguauggcuuguguguuaccaguuuaauggcucaugaugcuguaugagacauaaagcaggucccguauuggagucauaaaagguggcacaguaucacuaauuuauaauuccuccagaucauuuuagagaacugacaaaguuuaccaucugcucugagaauauaaaaccauucugcaauucuaugaauucuauggguucacauauaacuaggguggaaaagucaguggugucagcaguguuuucaggaagguacuaugcaagaguuuuaccugcauguauuauuucauuuagugcccaccacaauguuauaagguauuauuuuuauccccaaauuuauagcuggggaaaccaagguuaaaguccuccaacuagaggcagugccaggauucgaauccacaggcugacuccagagccucuugaccacuacacaaaaccuaaagcuauacgguuuuaagaucuguuaaaguuugaauaaaacaagaaagagaaauaauaaauaaauaauaaauaauuuauuuuuugacauaauauauacuagaaaguauuuuuaaguucuauauauagcuaauaaaagcuccaauuuuaguggguuuuaagcacuaccucuacagaauauuuuuaaaaaucaaaguuuguucauucauucaacaaaguacugcaagaccaucucugcccuuaagaagacgagcagaaaaaacuggcaaugcaaaaauuauaggauaaaguggaaagcaccguaauaaagauguuauggaaaggcugggguggggggcugcauuuaaaucagacuggggaucagaaagggcuuccugcagcuauuggccuuaagcugaguucuaaaaacaaguaagaguuagcuggaucgagaaggagcaaaagaaucccaaagagaacaugauguacuaucgcauggagaccugaagcagcaaagcagaaugcggaacugugggccaagaagaguggggacagagaagggugggagcgaagaaacucuggaggcagguaagcagggucagcagagcaugcauggucucucuagaauaaagcaauccagguuucucuuuugugaccuggggauuugaacacaacucaaacaugagucaagugcaucuuuaugccuauuuuccuuuugucaguaauccuuccuagugcuuuaguuucaagauggaacacaaguggaauuacaccugaacaccucaaaaaucacauaacuaauuacauuugguuucaauuacaauuauucauugauccaaaccuucuaacauaauaccugcuggcugucacuuacauaauuaacuuggccuuacugacuuauuaguugauguuaguuaacuaauaagguuaaaacacugcuaaaauauuaugcagccacauccuggguuaggucucagagacacuuuacaaauuaaggacauguuuaguuuuaguauucaauuuuuuauuugucuucaguaauaacauauuuuaaaacagcauucagagaugagagagcuaacaaacucuuacuaguuugggucacugaguauaaaaugaguguauaucaguguguguacacugagucuggcccuuaccucuuuccaaauuugcaugcuuacaagaagcugaauguuuugagugagacagcuacgaaugaaaagucuggcacuaaaaauaagaaaaacuucuuuuagcagcccauaugcaaagucuuccauggugaauuucuaaguuuauguuccuauuacuugaaaucuaaugagggaauaaacuguaggaaaacaacgccuccaaaauaaugguauaaauaaguuguuauuuagcaaaauuugcauguauucauucacuuaucaaggacugugugagcuuaccaaaauaaacaagauuaacagccaugacaguaugaaguuuacagucaugugagggagacagacaaggaaauaagugauuauaaaaugaacccaugacuuuaagauggggcaagugugggauauuuggaaacacacaggagaagcuaggcccaaccuuauggaaaagcuucagaaugaaaguggcuucuaagcucaaaucuaaagggaaaagaacaggaguuagauaggcuuaauauaaaacucaaauagcacagaauaaagaaaggcacuccaucuccuaaauaaaauuauaucaugaaaauugguccuucccaggaaaaaaagaaacugcuuugaaaagguaugaaacaugccugaacauacuaaggcauccuugggucuucugauauaaaaugaaugaauuccuaagacugagaaaaaccugucacugcuuuuaaaaugcacggugucuaucuucuuaaaaguaaaauaugucucacaauagggugacuguagucaauaauaauuuaaugauacauuuaaaaauaacuaaaagauuauaacuggauuguuuauaacaccaaggauaaaugcuugaggucauggauaucccauuuacucuaaugugauuauuauacauuauaaaccuguaucaaaauaucucagguauaccugaagaaaaagggagacucacuuaaguucacuguuuaauucacuugccaucuaagcaacaaaguaugaauucauacaacagccacaauaacaauuuagccaaaauucaacagccacaaaucaaauguuuuuauggaugcacaucagauaaucuaauccuaguagugauauaggucccaugaugccuaaaauccuggaggaaaaacacaauaaccauuccuuuaagagggcaggucaggcuauuuugcuuaaauaucuucuggaauguuaagaacugcuguuaugaacgaacaacucaauauuuauggguuguacaggauauaaaggugaacauuugaauugcuucauaugauucauccuuacugaacacuuucaacuccuaaauauuaaggaucaaacuuacauuccuuguaaauaaagcuaauagguugugcccccaccacuaauacucauugaaauuguuaaagcucaaguacagucuuauccuauagccuaaaaaacaguagguuuuuuuuuuuuuaauuuauuuuaaacacaaaaugccaccuuucaacaguugcucuuuggucuucuccaaaagcuagcaaucuaauuuugucaauaaaacuuauuugggccagccuagccaacauggcaaaauccugucucuacuaaaaauauaaaaaauuagcugggugugacggcacgcaccuguaaucccagcuacucgggaggcugaggugggacaaucgcuugaacccaggagucggagguugcagugagcugagaucacgccacugcauuccagccuggguggcagagugagauugucucgaaaaaaagaaaaagaaaaaacuuaccugggguacagucugcuucucuguccccucuauagaccuaauacaguguguugcacauuauaagcauucugugaagaucuauuggguugauuuugaaaauguugguguuuugaaaaauuucccccauccacacuugggaaauuuagaguuaagaucugaauuucccaccagagaugcacugcugaccuaaaagccauccuuucacaacuccaacaucauuaaucuuagcaugaugcuccguuucucaaaagccuucacugaaucccacugcccagaggauuaaguccgaauucaucauacuauucaagccugccacaauucugcucuucucuugcuuccuaaccuuuucugcacagacuccccaggaugaacccuugauucacuuuauccaacagaugacguuuauucccucccuggcuugugcaauuaaucaugccaggaagaccuucccacuccauccccucagugaauccugcugcacucccaucaaggcccaacugaagcccaccucugugggcugugugaauuuuccccaugagaauucuuuugggcacccacgauuugcacacuuuuucacugccucauccuccucucuguauguguccagcagcucucuagacacucagagggcauggccuaagucugauacuguuuuuggaucccacacagccuuucaggcauauuagcugauuaggugcucaccaauacuuguugaauacauuguuuacauaugacugcaggguuuuuaaaccaaauaauuucaagauauucaagcucuuaccaggcugggauauaaagcuaggucucugggccuccugucuaaaaacaauuaguuuaagaaaacaauaaaaugucauguacuuuuucuaucaaacaauuuuaauucuguaacuuaaaccuuacagaacuccugucuuccuacccccauucccacaaccacaccuuacaucagccauaauugaaagugacuuuuauuccuaaaauuuugcuuccauuagccaaagguucacauuaacauuguucggaguacagcuguugcucuaccacuuugagguuagagcccaagggcagaguggugagaacaaggaaguuuucccuucccagaagucaggaaaccacucucagcuacccuuucugggcaagaggaaguugacgcaaggacaggaaauaauuaaugauuuucagcuguauaaggaauaggccucuuuagagauuuuuuuuuaaagaauuacucaaaauggcuauaagauuuaagaguggaagggaaugacauuuuuaaaaaggucugaugaacuccaacgacaguccauuuuuaaaaauacuguuguuguuggcacuuucauuaaaacaauccggguuauagaccuggcagccaacacucuggcuauucaaaggucauucuuuguucugaaaaucagcaucgacuaccagcccagugacauaccagacccagcugcugaaagggugccacacaaagaacaagaagguacuaucucacaguuauagaguucacauccaaaaaggggcaaacagaugaaugaagacuggagcuuauaaauaauccuagggccaggcaaggacaccacagggcuugcagguaagcaggaaaaacaucucuaggcugagaaugucagagcagcacugaaccuuagacaccauccuguccauuccucucauuuuagucaggcucaaacaaguaaaauaauuggcucgagaccagagucugucccaaaacucaggucauucaccccaagggaaggagcacuugguguuaccuucccugcaguuuagugagucaugcccaggucaacagagacccacucacauuaacaccagcagaaagccaaggcuacccgugccccacccauaggaguggggaaaaagaacauuugaauaguccuauuaaaagucagucuuuuuagacuucucaaagagaaaaaagagccauuaaagaucccagucuuaaaacaaccagacuauuuuucuuacuuuucuugcaguuccacuuaguaaccaaugcauuuuacauucuaauaacuacugucaaaacaggauuaaaauccugaaacagcacccucagacuugcuggauuaucccaguuauauauucucccaaagaauaagugaaaacccacauucugaaaauguugucaaagcgguacuagaaagcaaauuaaaugauccaauauucaguuuaacuuucucuuaucucucuccaauccauucuccacccagcagccaguguguucaaaauauaaaucugaucaggucacauucccgcuuaacacucuccacuggcuuucucucaaggcaacucuugauuaagaccaaaauuucaggaccucaguccaauggccccuccuaccuacucagcugccucuccugugugauuccaccgccacgugcacugcagcaacacugucaguuccuccgaugaggccagcuccuuccuacccuaagauguggcacagcauucccaaugccuggaacacuguucucccucuccucacucccauccugacuuuauccccuuaucuucuuuuccuucuagauaucagcauaauuauuccugucuucucaagaaagccuuuccugaccacuguuauccaccuuucuagcaccagcagcccuccucugcaacacuuacuaucauuacaguaaauuauuuuugugauucuuugaugaaugccugcuuccugcagucagcuaugggcccacaaggguggcaaccauauuuguucuugcucaccauuguaccuacaguaccuagcagauaaauauuuauugaaucccuaauuuaauuaaagaagaaacaaacaaaugaugggccuaaaagggagagcuuuuaggcagcacagaaagauuaagggaagguuuaaucccuucuuagccaggcuuucagcauuucagauagauauacguagaguacuuucacaaacggaaugcugggaaaaagcagaucuuucauaaagugcuaagaaaauaaaaccaagacucuuaauacauauauuacccuuuuaauuaaaaaaaaagcuacucauuuuucaaucaacuuuuaauacuacuuaaaaguugcagugauccuuaguacacuugagaauuaccucagcaacaggcaggucacugccccccaaaacuaccaccacucccacaaaacaaugguuacauuuuucucuaaaaguuucuuuccauacucuuugccacaguaaguuagaagcccuagaccagcacuguccaauauaaacauaaugcaagucacaauuuuauaguaaucacauuaaaaagguaaaaagaaacaagagaaauuaauuucaauaauauauucucuuauuuuuaacuuuaacagaaagaaaauagggacagagucucacuguguugaccaggcuggucucaaacuccuggcuucaagugauccuccugcccuggccucucaaagugcugggauuauaggcaugagucaccgcaccuggccuacuguauucuuuuuaacucaaaauaucuaguauauuaucauuucuacauggaaucaauauauuuaaaaguauuaauaaaauauuuacauuucuuuuuuuugcauuuagaaauccccuguguauuuuucaccuccaaacuaucucaucagacuagcuguauguggcuaagcggcuaccacacuaauagaggagccccacaccauccacacuucugauaaauuauuugcucuuuuccuuuaaaaaacuugcagaaaaagcuuuuaauguucuguguaccagacaaagcaacaauggaagguugauuauauauucacuacaaacaacugaaaaauaaagggacgaaaccaaugguugcauguacauuaguauaaugauaccuucuuaauucguucaugacuuugaaagcuuucuucauaugccaaggauucacugucacugggcaguguuuuucgguauuaucaucuuuugaaucgagaggcuucugaugacccugcuuugugcaucuguacauaaaagaaaagaacaaaaacagaaaaagaucuuauuaaagaucauuuaguucagcuuaucaagcuacaagagagacaaugaaugucuccuuccccuacuuauuuagaggaagucucauggacagaauaucccaauguaagguuaagacaauuaagaacaguuucugauggacacuaugguuucaauuaaaaaguggguaauuaccucccugguguccaaguuccgucaaagaucaacacagaauauucagcagaaguggcuuagcagauaucuccaaauaaaacuguugagaaaugaucuucuccauuggaaauuaacuugcuuuuacaaacuucuauagucauacguuauuaacaaaccaagacagagcaggaucauauuuuacacaaacuucagaaacuuagaaucugauuuaaauuuugcucucuaccugccaggauauauuaaccccauauauuuugaccuauacuaacaagagauuaaucgagauuaaucauguuaguuaauaguuauugaguauuuaccauauggcagcccugugcugaguaguuuacuuucauuauuugguuaauccucacaacaacucucugagcaaauuacuauuauuauccccauuuaacagaugaagagaauaguuugaguaacgggguaaaugguagggcuggguaagaguauggccagucugauucuccaucuuguucuuuucacuaauauuucaauaccauuuccuacacugaacagugaauauuuaaauuuacauuuuuuaagcacacaaggcuauacuagcauugcuacaugaauuauucuuucaagacuuaggacauaaaauuaaccaaaaaaaucagggucccaugaggaggggggcaagaauuaacugcaaauuaaugaacacaagacaacuuuuugaagcaaugguuauaaaacuuuauaaauuuaauaaaaaucauuagauugcacaauuauaauggguggauuuaugguauguaaauuauaccucaauaaagcuauuacauaaaaaaucagggcaccaauuuuuuaacuaggcuuaaaaaaugaagucuaaaaauaucauacuuguauauauaucaaagaacaagcaaacaucauuauuaauugcugcacuucucuuccuuuccugacccauuucuaaaaggaugauucauuuuuaaacauuaucguucauuaauucauucagcaauuguuuuuaguaccaaccauguaccaaucacuacucuuaaggcacuuggaauauaucagugaauaaaacaaagaucccuguccucauagagcuuggagucugguggggggaaagggaaagacagcacaagucagggaagcaacuggcauguugggaaaugguguuauggaaguagaaaaagcagggcagcgugaagagagagagaaauguggggacgguggagggguguaaucugcaguaaauagggugcucagggaaggccuaguugagaacugagauuugaacaaaagacuagggggugugggaacauccggauggaaguaguaacuacagcaaaggccaauauguaccugguauguuccaggaacugugacccaugcagcuuuggcaaaaggcuggggcugagcaggagaggggagugcagaucacaaagggccuuuuaggauauccuaaggccuuucacuuugagugaaaugaggagacacugcaaaagagugauacaauccgacuuacguuuuccaaagaccacuuuggcugcugguugagaacacucuacacgggucaaagaugaaaagggggcaacuauuuagcaggauauuacaauaauucacuaaaaaaugacaguggcuuagggaggacagucgcaguggaggugaugaaaacuggcuggguucuggacauuuugaagauacagccaacgagaucuguugaaacaaccauaugacaugucaaagaaagucagaaugacuccaagucuuuuggccugaacaagagaaaggacugaguuucuguucauugagaugaagaaggcugcagguggaaacuguuugagauaggcagagaucaagagcuguuuuuauaccuaaugguuuuaaaacaucagacauccaagugaaggcaucaaaucaccagauaaauauuggagucuagagcuggagagaaaaguuuagcuggagucagaaaugugggaaucacugguuacauggaugguacacgaagccaugaaacagguacucaacaugaauauaaccucuaaaauuaagcaaaccccaaaccccagaaucagcacuaguugaagcaccugacucucugagggcuugccuacuacaagugcacaucaguucuacuuccucaccgcuugagaguuuuuaaggggccuaacaaaugaauuagcgcaaggcuuuaccuccacagggaaagccuacagcugaagugggagaauaaggaggugccacucuacucccuaugcccucuugaagguguguguguagggaauuaguuacacccagucuaagaaaggaaaagcacugauaagucuagaagccaaaaagauggcagaacauucacgucuggagggagagaacuggagaaacacuuuauaguauaagacagauauucucauucuaccuguaaaggaaacaguaagaaaccagggaaaggggaaaaugcguagauauaugcaacccaugcaaacuuucuaaccauguaacacugcaugucuauauacgauagcaagguaauacuuauucuauauuugcuucuaguuuaauaauuuagaaggugcaacaaaggaagaauguuauacugaggauuagcaaaacuaucauaaaagaauuuucaaugcuugaaaguggaagcaaaagcaacucugccccagaaagaaugucaugauuuaagagucaggaguguuuauauuugcuuaagaacuuaggaauuaaaauucccugcauuggagaauucacuuuaagacaguugccauacaacaaucaaugcccacauuggugcucucuuaaaccuauuuucagcuccuccuuuuucugauguacuacagaaacccugcaaagaagacuuuauucaaaggcuuaaaggaauaaguaagaaaaaacacugaauuuuguuaaguguucucuguaccgagagucacuuacaaauacaucaccccuucugcaaacguccauuuucaaaacgaaugcccuuuccauaaauuuccauucccuguguggcuuuguguuagauggcuucucauucagaagcagaacagaaaaugaugcauaaugucuaaaacuauagaugugagacauauauacauauacauacuaggaauaacuaguuaagugagagguaaagguuuacccuuuagguuguaccacauuaaaugaagaauuacaccuuugcccugcuucucuucugaagcaaagugcuagccuuuuccagaaaagcuucucauucugagaacugucucccuuaaaauaccugaagaagauauuuuuccaaguuccuuucaccuuuaagucuuuaugcaacucuuagacuccucaaguagucuggcaauuauccaauagccuauuguuaucaacacauacucuaaaauaguugagguuucccaggguuuggaucccaguguacugcuauguuuuaucauagauauccuaaagccuuccuucagugacugacuucugcaaauucccagcuguggacacagguggcuucucagaugaggugacuuucugacucugccuaagaauacacuauugaugauaacugaauucucagacaggaagaaaacaaagacucuaacagggcugucucucucaaauagucaagauuuccaaaccaggcaaagguuuaaaccugcuguaacaauucugagaacaccacagaaaugaaguaaaacuucuuuagauauuuauuauuggcuuugaaacaaugguuuucagcagcgugaaagagaaagaucagaaucacccaagcaauuuuuucaagccacaaauaaccaccccuucucacaugaagagucacacaagcccuuuuuagaauuagcuauacauacaugauggcaucuccaggaguauaggagaaagccagcaaugcgugauuuuuaaaaauaauaauaauaacaaaagucauguaauauguccugccaccaacuuaccucccaccucagaaucaucccagauuaaaaacaaaugcuuuagaaaauauguuguauuuuuagaaaaaaaaaaugcaaccauucaugugaaugaugcagcugcaaaguuuaacaggagaucaaagacauuuugacauuuaggacauaaauacuuggcccuuggguggccaccaucacuguucuccccuuugccuguucaccucaaaagcugcaagacuccccugcuugcaaugagucacccaccauuacucacaaauuucugccaaguucacgucagcagcuguuguuuucaaagucaacauccaugcuguaauguuuugagguuucuccauuacuuuauaauauuucuucuauuucucugcugucuucccagccaaacuugcauucagaagcaggcaucuuacuagcauugcucucauaaacaaauccaggauaucagaaguacagagucaaccauaacuaacauuuuaacuaaaauuuguuaugucauucuacaguuucucaacaaaauacucucacauccuucaaacaaauaaccacuauauuacuuagaggcugugaagguagaagacuuucucaguuggaaacacguuugggucuaugguaggguugugauuucaauuuuugcaguuagcuaaggcaaagagacacacugcaaauuuucuucacaugucuggaauuuaaacuuuuauuagguauggaaacaguagacuaaucuacaaacauauguucauauuaccaaauaaauagagcuuuuuaaaaauguuaacauuugcccuauagacauguaagaacuuggauuaggucuucaguauguagaacugaauaugagguaucuugugagauaaaaacuucuaucucuuuuuucuuuguauuacuuacuucuccaagaaaaaaaaaaaacuucugaucuugcaucaagucacagaaugccuuucagacaauaucauaaugccauugaauauuuuaaacauauauaguuaaaaauuauuuuuccaauuuuccagagcugaaaaggaaacaucuagaaaagcuugaauugccaaacuuuacuaaaauauauuagcaguuaaaaagcagagcccugaacucacugaagggcagagggagguauuaaagagcacccuauucucucuggagaacucaguugugcggcuguauguuaaguguguggggaagcauuggcaggaggaggagguugggaugucugagguggauggaaguuggaguauaauugcucucugauaguagaacaauggagcuguaaaaagcucugcuucaguucaacucagcuuucucucccucuuucccucccaccuacaugacaaacagaacacaaucaggcacuuuuugucccugacagugacuauuaccaggaaaaggaccacgguaaaagcaugucuuaugcaagaucaaucuccuaaggaauauuuuauaaauaacuaacaaagcauugucagagugggauauuugugaggugcuaaaauagggaaaaggagguugaugauccauuucaaacauuuccauuuauuuuaucacuuauauuucugacuuuuccuuugccccucuuccuacuauugccaucacuucguugguaagggggcggcaauacgacuccgcaauucaguugacugggauacauuuuccagcacugaaaugaaaagguacuagaugagaaccagaaucagaaagaagcccaaaauuguaguucugucuaugccaaauacuaaccaagagacccuggauuagucacuuagccucucugggcuucagacuacuuauaaaauuuauuucacaaauaugucugaugugaaauguaauaugaaagucaaagauaguaauaucucaccuaccuaucucagggagcuguauaggcacuaggcacuauaugaauguaaacaaaguuuagaagaaaauuguugaauucaggaucuaaacugaauaugcagauauauuuuuauggaucuuauuggccuucauuuuuaauugcaacauucaauucaaaguuaauagcaauauucaaaaugaccaaagccaauaaauuaaguauuuaagugcugccuagaugcccacugcaugccauguacuaagaaggguaagaaacauuaggaaggcugaauugagaucuuccuccauuuaccaucuaaacaggaagguacaugggaaaccacuaaggaauggcacaagucaguacauaggugcagugacaaacaccauaggaaugcaacgaugagcuggaaugaguuggaguaaagaggaaagacuuggugaaggagauggggcuccaauggggccuuggaggaacuucaaguuguuguaacaggggagagaagaagagaagcauaggaaaaggcuggagaauccuggcuuguggacaagggagaguuuuaaaagcacaugaugaucuuggauauauaggauaagauaaaaugaugaaaggcugugacugccugagucucugguuuugauaagucacuucacaugacucuaagauguuggaggguuaaaacaguguggggacugaaggaugaggagagaauacacagagcucaauagaagaccagugaaaaaguucagguaucaagugaugaaauccauucaucagaauaguagcaaccagaauggacacuugaaaccaagaccacaguuccuggggacugauaagauguggaggaugaagaaagagagagaaaucaaagacuauuccaaugcuuugguuaucagggaccagaagaaugguuaucccauugaauaaguggaaauguuauaaaaugaagucaguuugugaacaaacaucaguuuuggauauauuggguuuagaggcaugagcuaagaguagagaugugagaaguucaaaauuccacaccaaagcacagaccuagagccccgacuuaagauauagauggagcuagagcucaaugauuaacaggugauugaaaagaacuggccaaggccuacuuccgugaggaaauacugcccacaagcagugauagaagagaagucaugcaagacagaaaaaagugauacaacagagagauuagaaucccacuuuuucuaauacuugauaagcuugagagaguaacuuaaacucuacuucuucaucugauaaauaagacaccuaccacuauaagguuguugacaagacuaagugagauuaagugauaaaguaugcaaaucacauuuagcaaccuaaaaaccagaguaggaaaacaagaaaaagagcuaucauaaaaagcaggggcuuguuuuucaagguaaaaucagagaauggaacuggucaaaggaauauuuuagcaaaugccaauagucugaaauguaagaaaguacagugcguaacacacaaaaaguuacggacccacucacugcagcaauuaucucaucaggggaagaauucaagaaugccuuugugcuugcuauucucucucccuggaaugcuauucccccucuggauugugcuaaaauaucaccucgucaaagacacccugacccuaucugaacuauuauucuuauuauucucuacccuuuuauccugcuucauuuuuguuuacuguaauacuacuaacaauauuacauauuuguuugcuauuaguuucaaucauaggaaaaggaacuuuguuuucugagauauccccaaaaucuggccauaguaggcacucaauaaauauaaauuaaaaacucaaacuaccucaucauaaagaguaaaugcauuuggauuugguagaacacuacagaaaugcaacauaaagugaauuuccuucucuggaucaccuugaaaaaaccugccugaucuuaagaaagaaguucaguggucuucauaagcacuacuaguguaaauccguaacagccauagaugaguaaacuuacagucaccuucagaaaagcacauuuacuaauaguuacugcaugccuaccauguacaucagaaacaaaagguuuggggcauuuugcagggaguagguggagugauuucccagcaucagaaauuuuuuaaacuacuacauaaaugcuaccuauuuccagaauucacuucucaaguucccaaaugcaccucaaaguugucucuauauguaacacuuccuucaacacacauugauccacaugucuucuuucaccauuaccuuguuugugggccauuauuacuccuaaauauuuuaaaugucuuugucuaucacuggggagauucaccugugauaugagagaugcccaauguacauuuaguuaaacaaaaauaagaauacacuccaaugcacuauaacagacaaacaaaugaauacuggguauccuguagcaagguuccaaauucacagcaauugaaucuuagaaagaacauuaaaggucauccgguccagcggacugcaaaugucaggcuucagugaacuuuuuacugaucuaugucaaaaugaggacaauguaauaaguuuucauaaggcuaaguuuuuuaaauuuaaagacaauccuuuagucagauuauauucuuccuuauauuugaggaaggauacuaaaauguuuuuuucuuucauaaaaagauggugauaguugaucauuguuguuucauaaauaauucuuuuacuuagcaaaacaaaaaacuuagcaauuguuagacuucaauuguuuuuuucuuuuuuuaauuuuacaggucaguuaaauucaaaaaugugagaaccucugcucuaauccaaccaauuuucugcugccuaaaugccuuagaacauggucaacaaguuguuuuucugccuaugcaugaccaccucugacgacaagucucuaguaauguggaaccaucaacugaaaaaagauaugguucuaucugagggauguuugcuuaguuuugugaaggaaaagcaaaaaaaucaaggcuuacagagaguaagccgacuugugaaaauggagccaguaaaaaaacaagugccaagaagacugaucaguaagagaagaucagagggaugcacucaggccuauaccucacagucuuccuucaacuuauuaugaaaauccuuuauacaaauaacuauaaaagccagacuguaaaauacauuccugaggucagggcuggucaauuuacauuuccuuuugcacaucucaguuuaccaucugaaauuccuuuacuaaucuacaucuaaacuacaucucucaauuuacuaccugaaauuccuuuacuaagcuacaucuuuuaguuacacaucuuucagguuugaucagaagcaaauguaacacagucucaauaucacccagacccagaaugcaacagaaucuaaaugccacauauacucaaguaugcaaaaaacaauaagcacaaauauauaguccaacgacaauuuuuaauuauaugagaauuaaaaaggaugaaaguuggaggcaaggaauagaaaaagcacaaaagaucaaaagcuaauuucaaggaguccauccugaaggaaccaggaaugguggguacagaugccugaccucccuccaagacaaugugccaacaggccaguggagaacaaggugggaucugagaacaauguaaauuuggauguuaaaagagaacacaagcaaaagcaccacgcacagugccaggcagagacaggcauucaaauauuugcacauugaaugaauuaauaaacagacacuuacacaaagagaaucuggggccgugcuuccaaccauaccauaaggcacuuuaaguccaggucaucuuucuuugacuuaaagcucaggcuaaaaaucuaacuucaugaaaagcugagucuuccuaauaguuuccacuggccucuguucuagcccagcucuggcagu

SEQ ID NO: 191874 - RNA, 26019 nt, Homo sapiens
ugaaauugcagaaauaaauuuuauuuuuaauuuucagaaguaaaaaaaguuauaauacuuuaacuguuaacaaggcuuaguugauauccaguuaaccuaauacugcauuaauguuuuuauucuuuucuugaaaauacucaaauacaccuacauugugcucuuuuaaaaaaaaaauaaggauacuuacauuuaaaaaguuuuuugaggaagaaaauuguacaacauucauguuuuucaugacacugaaugauauaucaauuuaucucuuagaagaaaaaguagcauaauuaaaaucacugguucccuaaucuucaacucucucuccacaaauaaaaccuaccucuuuucacaauaaaaaagcaaaaaauaauauacaaucaaaaggagcuaaacugaaacucuuuauccccuuugucaaaagauaaauuaauugugggagaucaacauaacaaucaucacugauuuuuuuucuuuuaccauuuagcucugguucaaaagauaaauaauaaucuauaauccagaaauguauacaaacuucuuaucacauuuucccuuauucuguaaaaaaggaaaauagguuuaauguuuaaaagaagcauuagugugauauuauuaccgaaaaacaauuuugcuauuaucacagcucaaaaaguacccacaggaaucuuucaggaaacagguuacuguccauuucacaaaacgugaaauuaggugaucauaaauacacaagaaaaacaaaacauuuuuuguccuuaguuauauugcucccucccagccugaaauucagaugaagacuaaacaacuucugcagaucacaucuaucuauuuuagcaacuuaauggaaaugaaaagcaaucuucauuuuaaaauaaguaucauaacaccauuuuugaaacgcaaaugaaacucucaucauauaagagaaugucaguaucaaauuuuuguaucaugacaauuagguaccauaaucaaugaauauaauuugaagcucucaaauuauuuauuuucaauucaagugaagacaauuaggccacugcagucauuuccucaucugaaucacuugauucaucguuuaguuccaauucccccaaaucuuggucuacaguuauaauaguuuuccucuugcacgucuugggaauugcaucauuagcgcaaauuuuucucauuuuaauguuugguaauuucuucagaucaaagucccauucccuagacaaaaggaaaaaaaaaaaagagugcagaguguugguaagaguuaauguggaaaaacaggagauaguaaauuuucgaaacucugaggauccuacauauucaaaacuucaaaagcguuaaaggaaaauauuaggcacaaauuacuagaaagcuguucuauucuuucauccucucuaaccugaguaucuccuucucucaugcuacccagaucaagaauugcaaucaaaaguaggaacuguaucauaccugacaaaucuccaaaauacagucagaagagguuuuccuuuucacacacagaaguacaucccaguuaaguuucaguaaucaacuguuauucuuauaauggaaaauuuucaguuuuucaaccucaguauuguauuaauuacuuuagacguaaugugaauauuauuuugggaacugaacucuuaaccagaaggcuauacucaucucuuuucuuguuucuggcuuuggaggagguagaagauauauuguuuuagaaauaaagagcauauuuauauauuuaagauuacaggcaaaauaaaauuaagguauaaaaagaaucuuaacuccacauacuuaaauuauaaauacaugcuauacauaagcucaaaagugaacugcaccuuaaacaugauagaugaauucuauuaaagcuaauuuaguuucaaugaauucaaaaguauagacaaugacuggauuuaaauuuaccuaauuucaauuaacauuaaauauaagaccccucaacauggucuaguuaagaccaaaaugauuaauaaaaaucuauguuuaaaaacuaaaaaacugcuuguugauucauuuguuucuuauagauuccagauauuaggccuuuguugaauacaaacaauuugagaauauuuucucccauucuauagguugucuauuuauucccuugacaguuuauccugcugugcagaaauuaggucccauuugucaaucuucguuuuuacugcaauugcuugaggacuuagccauaaauuuuuugucaaggcugcuaucaagaaggguauuuacuagguuuucuucuaggauuuuuacagauuauccuaagugaacuaacacagaaacacaaaaccaaauacuacauguucucacuuauaaguaggagcuaaacauuggguacacaaggucauaaacaagggaacaauagacacuggguaauacaaguugggggaaggaaagggguaagagcuaaaaacaccacguacugggugcuaugcucacuaccuggguagauucauucuuacuccaauccucaacauuacacaguacaccuuuguaauaaaccuacucauguaccucugaauuuaaaaucaaaguugaaaaaagaaaaaaaaaaaaccuaaaaaaucgaaauccuacucgguaguuucccaguuuacaaaagaguacaacuagaaaccacuggacaaagcgggucuugaugacuuaaccuguucccuggagucauuccuauaaccaucuucucugcaaaagaggcugcuacagaacagccuggggauaugacucugagccaucacgucuguugcuguuacuucuuuuuuaaaaaaauaaaacuggggaggaauagugagaucacauacuuugagguacuauaacaauguaucuuaaaccauuuugaaaaacaaaaagcacaccagguuaccauccuguuggugcagaucaacuguuuguacgcccaacuucagaaaauucuuacuuggucagauaaaaaagaaaagguuaaaagaaacccgauuuucuuuuaguucuaccggcuagacucaaaggggaagaaaguucaccugucagguacuuuacacacagcuucaggggaacaauacaagacagacucaccuaaauguuuucagauuacuugcauuuagaaugucuggaaucucuggaaaagaaaguaauuuaucuccaugaggcaauguuuucuaaaucacauaauuuuauguacaacaaauaauaauuuuuagcaagaauauccaacagaaaacaaaauuucgaaguauugcuguaauuaacaugaaaaauuugcaaaagggguuaguuuaagaugacuuaagaaaaauccuauuaaaugauaaauucuagcauagaauccaugaaauaaaacaaagcuauuaggccaggcgcgguggcucaugccuguaaucccagcacuuuggaaggcugaggcagguggaucaggaggucaggagaucaagaccauccuggcuaacaaggugaaaccccaucucuacugaaaauacaaaaauuagccgggcguggugacgggcaccuguagucccagcuacucgggaggcugaggcaggagaaaaaaaacaaaacaaaaccaaagcuauuaacaaaauaaacccuguccuuuuuuaacaauaaaagguaccuggcaaaguauaacugucaauucacuaaaauaacaugccagguuguauauuuuuucuucgugaaaaguacaauguuuucaaacguauaaucugccuucacaagguagaauuuaucucaggaaugcaagaauuaauguuuaaaaaaaucacauuuuuccaaaugugaaaaaaagacuuuuuuaaauuaaaaaaaaaauuuugcuuaaagaaguucaauaaaacuuaaauccauuuuuaauaaaaaccagguauaugguaguucuuuaccauauuucaaaaguuccaucauaaaccaauaugcaugauacacuuaaauuggugaaauacaagaggcaugaacaacaaaaacuggaaggcugcugccaauaucuggccaauucaauacaauguuaaaugaaauuuaguaucaaguaauaaagaagauaaaauaagcauguuugcuacaacugucuauugacuuuuucaauaguuucagagaauaacaguaugaggggcuagguguuaaaaaguauaaauaagcacaaaaacaauuuguaaaggaaucuuaaugaaucagaaauaguuacaccacauaaggaggggagaggggaugguucuaucuagucuucucaaaaucuuaucaaaacagaauuuggugacaauuuccccaaagggaaacggacaccugcaaacucaucagagucuguucaucagacccauccccugauucugggaaaagcacugcagcacagcagaucugaguuuuaguccuagcuguaucaccaacaaaugguuuacuuuggaugugcucugauaaauacugccaacucaucuggcugcuacauguugaacagacuuuagcaggaaagaguggagguacagagagcaacugggaggcuauuaccauaguacaggugagacgauaguggccugaaccagggaagugggagaugguaguaguaguagucaaagucaucagauucuaaacgcuuugcugacggguuggauguggacuaugaaagugacuguagaguuucugaucugagcaacugggcaggugguaaugccacugacuggaauaagaaaccugcaggaggagcaaguuuuaggagaaaagcuggccuuuguuucaugacaugucaagucugagaugcccaaaagacaugcaaguagagaguuugagaaauccauaugugauacugcaaauuuggaguucuggagacaaguuaggguugacaagaucaaugugaaaguaaucaguauuacuaucacgguaaaaaagacaugaugucacaucacugucacaaacuugauaguuuuguugggaauguaggggaaaaaaaaagaauccaaaauuuuucuaaacccucacaaagaaaaagacaucaaaggaagaaaaucaaaugaaauaaacaagaucuaaaauaaaaccuuugaaaucaaucacaaauugauacugcuaugucauauaaaaggaaaauaaaaaaucagugagcacaccaaggccauaucccucaaacugcugucgcucccgcuccaucgucugcuugaugacggucucccgggaacagugccgccuccccugccugucccugauacuguuauguaacucaaucugcuccagcucacugcugaaucgauuuaaguaccugaaaaauacgaaaaugauuuguguuacauacaaaguauauguauugggcuuacauuacuuaauggaaaacuuaguauccagccuucauguggccuuuaaauguuuauguuucucugaguuccucagguccucaaaccucuuuuacccauucccuggauaacucgaccauuucuuuaacuucagugaccaaaucgcagccuucuaucaaacugcagacccucacauucaaccaccaucucaaucuggauguccccuaguggcuucaccguuagcacaucaaaacugaacuugucaucacccuguccccaccuaccccccaccaaacccccuccaucuccuggguucccuaucucaggaaacaguuguccagacgaggaaucugauggcuuccuugacugcucucuaucccuuuuauuccacaccuaaguuuucacugaacacugagacuucuaccuucuuaauuucuuuggaaucuuucacuucuuuaucaggcuaugagccaagcugaggccaccaucauuucuggccuggauuguuacagcaaccuuucaacgguuuccugaccagagucaugaaccucucagucuguuuucuucauucucaaugugucccuucuaauguuaaguaugaucauuucaguugcuugcuguaaaagccuccugugguuccuaauguccuuggauaaggucccaacuuuuagacugacaucugaggucuuucaugagcuagcuaucacuuauuguaccugccacaguucccuccuucaacuuauuuuagucauauuaaaugucuggcagaucacuaaauacguuaucuucauucucacuucugggcauuuuuaaauauucuucuuucuugcuagggguuuuucaaacuaccuugccucgaucugcuaacccccaccuuucagcugccaguuuagaugacacuucuccaggaagcccauccugaucccaagaaaguggccuaacuaccacucugagacccaaauagguuacaaaccuccuauagugacuaagccaggaaauagucuuccugauaacaaagcccauuugcucuucugcaaauccguaacagagcucugugucuuaaagaaccaggcuggacaauucccuuuucugacccuuugcucauaauaugcccaguguuuaccuuucaauuaguucacaagcaucuuucuuugaauaucucuuuuuuuggggaucaagaugauuuugaaaccauugcaguuuuucaccuauaaacaacaaguaccaagacaguuuaccccacaagucaucauuuaagcaaguaaauauucauuaucauuuucaacauuaacguguuuaaaacagaaccaaaauuuaugucaauguuaaacauaaagccuugugugggcucaaagcuaauuaaaccagucugucacaaauuaaacugucagauuuuaauuuagagaagaaagaggagugggagggaugcgcuucuguauauauuucuuauccaauauggaugcaaaaaaggaaaaugauuauuuagucgagcuugaacuucuaaguauuuaaaagcaaaggacagcuugucaaaaauaauaaaaugaaaacuccauuaaugaugagaaugauauuugcugaguauuuaauaagcuguaggcacuauguaaauagcuuuauaaucccaugagaauuaguacuauuauuacccccauuuguagaugagagauguuaaaugaccuguccagggccccaaaguuagcaaauacauuaagcauauaagagcugccagguacuguguagaguaauugauauauauuaccaaagagccaacaaaauucacccuugugaguaaaccugaccgucagggucacuuucaguuagauuucucaagauuacagaucaaaaaaaaucacccggcccuguacaaugagaucccauuuaaaaauacuauucuauuaccugaugaagcauugaugggaguucaaauaccuuuaauuuuaauaaaagagccuaacagucaguauuuaaaucucagauuugugaguaaaaaauuauuagcaauaaaucugaccaaaaaaacagugacaugacacugagauacaaacugaagauguguauguccacaucauuaaauaaauaugaauugugguuucuaccuaggccauaauccuucauaauucuaaugguuagggagguagaguuaaacaucagauagauggacagauggauaugaauguuauguguagacagguagguagguagauaaauauaaacuaacaguuucuggaaaacugagcuagaaaucauuaacacuguuuauuccaaaaguuuaaugauugauuugcuuuguuuagaucaagucugaucaaauucacuuugauaaaaacaguauuucacuaaaagaguaaaaagaaaaacaaguauagggcagaaaugcccuauacucuagccagaguuucaaauaaguaaacccacuuaccaacaagguugagacgcaaggccuuuucauucuucaaucuuugaaggaaagguaaauauauguguuagaaaauuuccaaagcaaguuuuaaaacucugacaauaacaacgaaaagaaaaacugccuaaagaacucuaauuaaaaggucauucuuuuacaaauuugagaauaauuuuguuaacagaaacauuaaauacuaugcuucucuuuugaaucacuagaauuuuaucagaaacuuccuuuaagcaccucaaugucuaaaggaagccuauagaacaaaccaguuuugaaaacacaacugaaagcuuuucugaauugugaacauucagauggguucuguaauaugcagaauacuugagcacaagaguaaugcaaaccuucuggaagacugaguacugccaccaagaucaaaaugcacuacugucaucuuuuaaauuucaauaagaacaaaacagaaugguuacuuucaaugaauuugaaaagaauuauaacaaacaaaaauuucaucuaugcucagaaaguguauagguaacacaugccuccuauuacugauauucuaaacacuuacucauucaggagaccucuggauaccaagucuuugccagacuuuaguuucugauagccccaaaggauacagccaugaacaaaaaaaauucacugucccuguccugaaaaaccuuaaaaucuaagggcaauaaaaacauggagaagcauacagagcuauaaaagcauauuuaaaaagcaccuaccauauguuuuaggauuugggaagguuuuccagagaaguaaauuuuaagcugagaccugaacauacagagaaguuauucaggauuaaaaaaaaaaaaagauagggacuacgggaaugguaaaagaaaaaucuuagccauaggagaaggcuuuguauaaagcaggaaguauacauggcuuuuauccacaaagaaguaagcaaaccagauuuauccucccauuuuacacaacuagaaaacuggagaaauaaaaugaaaucuuuuguuauuauuaucauuauuaucauuagagacagggccucacuguguagcucgagcaggacugcaguagugcugucauugcucaccacagccucaaacuccugggcucaagcaaccauccugccucagccucccauguaguuaggacuacuguuauauaccaccaugccuggcuacuuuuuuuuuuuuuuuuacuuuuauuuuuguagagacagagucucacugugucacccaggcucgucucaaacuccuggccucaagcgguccucucaccuuggccucccaaagcacugggauuacaaggaugagccaccauacuaggccaaaaccuucuuuauauaaaauuuuuaaguuacagauuaggagaaaauauucauaacacaaauaacaaaggacuuguaucuagaauauauaaacaguccuuacuacuuaacaacagauuaacccaguaccaaaaaggcaaaagauucggacagauucuccaucaagaaaacacaaaugaccaaaaagaaccuaaaaagaugcucaacaucauuagucaucaagaaaugaaaauuaaaaccacacugaaauaccacuauacaccuacuagauuggcuaaaauuaaagagaaaaaaaaaacccugacaacauaacaugucaaagaggauauacagcaaauagaacucucauacucugguggugaaaauguaaaaugguacuaucacuuugagaaagguaauuucauauauacuuaaauauacaccaaaugauccagcaauucuuauauacccaaauucucauauacuuaagcaaacaucuuaaguguguuaaccuaacgucuuauaaacugaauuucuuauaaacucaaacaucuacccaacaauuauaguucuaggaaguaaaagaaaaaugaaaacguauguccacacaaacaccuguacaugaauguuuuacaggaaugaacuuuauuccuaacagcagagguugacaauauuuucuucaauggucaaguagucacauuuuaggcuuugggggcuguguaccuguaacaauuacucagcucugccacugcagcaugaaugcagcuauagaaaacacaaaaggaaccagcauugauguuuuccaacaaaacuuuucguaauaacagguggcuaaugccuuagcuugccgaccucugauaacagccaaaaaugaaaauauaaccaaacgaacauagacagugaauggauaagcaaggugcauauccagugaauggauauaaauaaauugccugaggauggaauaauacucccaauaaaaggaaagaacaacuaauacauaaaaugacauggauaagucucucaaacauuaugcuacgugaaagacgcuggcacaaaaaaccacauacagcaugaucccauuuauauuaaacauuagaaagauaaaucucaccuaucaaaauaaagagcaaauuaguggcugcccgaggcuagggguagagggugaggacugacugggaagauacacaagggaauuuucuaggaagaugaaauuguauacuacauacugaucaggguggcuacaccaauguauacaauugucaaaacccaaaaacuacacuuaaaauguguucgcuuuauuauauauuaauuauaccccaaaguugaucuuaaaaaacaaagaacacuucauaaaaaguuggagaauggcucugaggggaauuucuuccuuuuaaauaaggcuggagggaagaaucuaguuagaagucaaguugcaauaauucugaauggacucagugggaaccugaacuuacagugguaucagcuggaaugaagaaaaguagagagaugugagaauuauuuaaaacaguacuugcauguaaauaugaaaaaauucuuaaaacaauauguaaacaugaguuuuaaagagaaucaauaagauuaauucucaaagguaguuguuucugagauucuuacccaucaugcuuaguuuccuuuguuaaucuuccauuaggagucauuuucauuugcuaucuagaauuauuugccaaaauguugcuauacugugaaaucauaaaacaaaaaucacaucauaucaaagagccacuugcugcuuguaaauuguucauugucgggaaugugcuagucuucaaaccauccuaguuccugucauacaguccuaaaucagagcuuuucaaauguugaagauaaagaauaugcuugaacuuuuacucuagcauuguuauccacuccuacaguaucuuuucugaggucugccaacagccaugugaggaagcuuggaagcagaaauucucccuagcaagcucugagaugaaugcagucccagacaacagcuuagcugcaggcuugugaaagaugcugggucagaaacacccaguuaaguggcaacgggauuccuaccugauccagaaacuguguuuguuuuaagcugcuaaauuguagcagaauuucuuaugcagcaacaguuacuaaaacaacaucugguaacugcuauucauuucuaagaagccacagguacccaaguucaaguuguccuguugguaccuucuucaaucaccuugcuuaaaguugucccaaccaucuggguaucuugucaccaaucaucuuuugaaauggggcagggaaucagcagcguuucaacgugccuuuugugaccacauucccauuuaaaguuaaguaugacucgugguuacugaugcugcuacucaaaaaacugacaucuauaguggccuaagccuaugauuucauaacauaaaauaauguuaaguacuauuaaaauuguauauuugguucuagagccaugacuacuaagagagugacuuuuugaaaauaaauuuuaaaaagggaaaaaauccaaucuauuuagaacauugucuaagcagaaaaauuaagugcuuucuacucugcauuacuaaaauaaaagucuuggccaauaaacagaauuuucuuaggacaauauauacauaucagauuagcauguuguucuguuuuauucuuccauaauuuuucuauaacgcuaauucuguaaaucaauacacaacaugcugaauauaccugacaacauacaaacauuguaggcucacggucacaaugacagugaaccaaguacuuaaucauauucuaaagcaguuacuugcuaaaauauugcauaucauaccacugguacuauauguaagguaagcaguucauagacacagaauuaaacaaucuuuaauaaaaugguaagcacguugcuuccccuuccuccauuuucuuuugauccuuucacuuuacauuaaggacaaaaguguggguuuguuuuaccagucuuccaaccuucaccagaucuuuucaccaaacauauacaaaaguuaugucucagccucagaccauuuacagcagguaauaguaucuauuugauuuuaagagagaaaaaauaucuccuuuuuaaaaaaugguacuuaagggaaaauaaauaauaguauaggucagugauucucauaguguggucccuaaaccagcagcaacagcaccagcauuaccuggagacuuguuggaaguggaaacccuuaagccagaaacccaaaccuucagaauagaaaauucuagggguuggaacaaacaguuuuaauaaguucuacagauguauuucauguacuuaaguuugcaaaauacugauauauaugagagcagaaacugcaaaaucacaguacuaauaaaucauauuaaaaagauacagcaaaaaucauaaaagugaugcauaaauagcugaaguuugaaaacuacugugcuaaagcaaaacugcuaucaucacaguaaaucuuuauguugaaaaaaauaaaaaacuacccugcagaaaauaaagaaaauuugacucugcuaucacaacacuuauuuccuucuagccaaaucacugugaaacagguaaccuuuacuauauaaagcuuaucuuaagcaaagaaucaacauuuaaaaauauacuggcuuccauuaucugguaugcaaauguaucuaacauucaugaaaauggcaagggcauucuaaaauagucaaaacgaugauguuuauuugaacuucacuucauuuuaaggaaucuuugaaacagccuucuuucuccuccuucucagucucacuuguggaaugcuccuucuuuuccuaaccucuaaaugguagagggccacugaacucaguaauuggcucucuucucuuuccugucaacaguuacuccuuaggugaacugauccuauccagucucacggcuugaaaucccacauggaugcugaucgcucccaaauuugugucaauaccccuaaccuauucucugaacacuagacucaacauaucuaacuauccauuccauaucuccucuuacaugucucaugggcacuuuaaccuacaugccuuauauacagaccucacauuuuucaacucucuguucaaauguaacuucuucagagaaggcuuccaugacuaucccacguaaaacaacuucucccucacuguccaucccauaacuuuuuaaauuuuucauggcacucaucaccuacugcuacauaaauuacuuaucuguuuuagguaagcucuaaaagaguagaguccuuguucaguuucacccucugcauacagaacacacuuaauaaauauuuaugaaagggagacaauacugugaaaggauauauguuugaaagauaaaaguauaaaggggcuuuuuaccaacgaguaauacaaaugaugaaaagauacuuacuuuuccuuuuuuucuuguuugugggccucucucguaauuugagcugcuuuucuacuauauggauggaugacuuuuuuuucccguccugcacuuuuucccuuuggugcuuugggcuaaaauguaugaaaacacaugacacauauagucagauauguaagugccuucagucccaaaaauauucuuuacaaauaaauuuuaaaaacaguaauaugacagaaauacaguaagcuaaaacuauuacaagaaaaaucaggagauaagccaggaucauuaaauaauucuaauaaucuguugccaugguaaugacagaaacgauauauucagaggugcucuccaaugacagaagaaaggcacagaaggagucaauaaacucagcucuucaacaacauguucuaucuucaaagaagauacagggacuacagauagugaggagacucacagccagaaauuuguuacaguuaagaaaauuaaggggucagaagggacuuggauuauuaguaggggcuugauuguagauguuucacauggaacaaagcgggcaaugaaucaugcaaaaucaaagcugggcucauugccuguacaaauuaggaauagagaaaauaauagaagccaucucaaaauuaguauauccaaaaggaaaaauguaucauuuucccacugaagccuuaugccaguuaaucagcccacaauucauuagguccuccaaacuagacaucucagguuucuuuuauuccuacauaauccuguaucuuaccucaccuauaaugaucuaggaaucauauuuggcucucuguaauaaaaaccccaaauaauggcauaacccagcuuaaguuugguucuuuauuguuaaaaguaggagcugaagguucuguuccacaaagcccuuagggauccaggauccuuccauuuuuuugucuacuagccucaggcuauaccuccuaucuaguucaagacagccuaauaccaggucuacacucaagccaguaugaaguaggaaaagaaaaaucugaagguacauccccuuuuuuuaagagcaugaccugggaaguugcagauccuuuugcucacaucccacugaccaaaauuuauucacaguguuacauaagggagaguaguaaauauaauccuuauucugugagaaaaagauccauucauauagaaaaacagaaagaauacauuaggggacagcuggcagucuccaacauaccuauuccagaaaaaggccaaguggcuuuacacucuucuucaaaauuauugucaauugcuuaauucaauccucagaaucuuucauaaucaggauagucuuuagauucuccccacuaguccuuucuucggcaaagcuacagagcuugucuucauaaaacacuaauauaguaaagucccucuccccugcuuaaagugcucuacuagcucacaguuaggucccaagucuuuagcacagaaacaaucuagccccaaccugcuucuccaccauuauuucccaugcuccucuauaaaagauucuucacgccauucuuacugaacuucucaccauuccagaacauaccaagcuauuucauaacuucuugagacugcacuuguuauuaccucugccugcaaaauacuuuacuugcccuuugauaagaugcaguucaaaauuacuuccuuuguaaaacuaggcagaacuauuuaaaauaaccacaaauuccucauucacaaauauauucauucuuucaacacucauugagcgcucugcucgcuuucugauaaaccugagaagauauauccacaucugaaucuuaagguaucacuggaaguugguuacagguauaggaaaauauguagaaccaucauauaagaguauauguacucuuuuauguaucucucugcucacauggcaagugcagaggagaaaggcagguguaaugaggaauuuuugagauuaaaguaccuagcaaacaugaaucaaguaaaaacuuucaggacauuuggcaggcugccucuaagauggacccaauaaaccccaccuccugauccucaugcccuuauggaauccccuccuuuugaaugugggcuggaccuaccgacucacuuuuaaugaagagcauuuagcaaaagcaaugaaaugccaauucugagauuagguuaucaaagaagucuggcuuccaucuuucccccucucauggaaaccagcuguccuguagugagcugccauauggaggggccacaugacaaauaacugagggaggccuccagacaacagcuagugaagaagugaggccugcaguucaacaguccacgaggagcugaauccuaccaagaaccagcuuaacaauccuaccaacagcaagcuuagaggcagauccucagccaagcaugguggcucaugccuguaaucccagcacucugggaggcugaggcagguggaaucacuuguggccuggaguucaaguccagccuggccaacauagcaaaacuccaucucuacuaaaaauauaaaaaugugcuggguguggugacacaugccuguaaucccaucuauucaagaggcugaggugggaggauagcuugaacuacggagguggagacugcagcgagcauagauggcaccacugcacucuagccugggcaacagggucagacucugccucaaaacaaaacaacaacaaaaagaaguagacucuccgcagcugugccuugaaaucacacccccaaguaauacuuucacugcaaccuugugagaaaccuugagggagaggagaccaguaagccaugccugauuccugacccaaagaaagggagagaucauaaauauugguuuaagccaucaaauuuuaggauaucuuguuacacaggaauaaaugacuaaugcaagaccaaaaaaccaaagcaaagaugcauccugugaaaagagaucugaucccacauaucauuauuaaaaaaugcuuaacaauauuuuaaaaauucacaaaaaucccagggaagaaaauauaaagucucugaagcugcuaaaacugaaaaugcauagccaugaaguuccagcaauauguucaaaacuacaaaaaauguccuuuaaagacucaaaaacuuucuuuagggaaaagaaguuugauaccccuugaauauaaaaacguccucauagcuuuauacgaucuuggcuaaagaaccuucaagacuuaguacaaagaagguacaaagaaauuaacuuauuuuuugacucaacuguaaguuaugauuccuuauaauaauuuauucaugaaaagguugccucaaggcaggauaugaauauacagugagacacagaaauauguacaauaaaauuuacuauauuuuaaaacuuucauauuuuucaauacauuaaaauuuggaaaaaaauguuucaacagggaaaaacuaaaguaaaacucuaucauaaaauaacuaacagaccauuuugaauaucuaugccuaugaaaagacucuggcaccacagaaauaguccaguuagaaaaccugcauuaaaaguaucucuucccuacacucuucagugacuaauucaaaaaauucagucugaaagucuauucucuuuggauucauaacuagaaguaacaaaaaaacacauaguuuauucaaaacgacauaauagaguuauuuuaggggcaauacgcuuuaaauauuccuguuaaaaucauaaguaacaaaaaggaacuuugccuaaaagaccaucaaguugagccgcagucuaggcucaacuagagacagaagugccauuuagacuacucagugaaacaagagacauaaaggagugaucauuucagcaaacacacuugagguccacaaaguguacguaaauacauuuuuuuuuuaaaguuuaagaccaaacccaugccuacaacugagaaagcuuagagugcaauacuguaaacaucauaauacccuuaaacauaaaaauacaggcaugccucacuuaacagggauacuuucugggaaacgagucaguaggugauuuccuuuuuauggaaauauaaaguguacuuacacaaaccuggaugguauagccuacuauacacacaggcucuauggcauagccuauugcuccuaggcuuuaaaccuguccaggacguuacuguacugaauacuguaggcaacuguaacacaaagguaaguauuuguguaucuaaacaugucuaaacauagaaaagguaaagugaaaauacaguauuauaaucuuaugggaccaucaucauauauguggcccacugaugaccaaaaugucauuaugccgugaaugacgguaaauuacaguaaaugauguaccaauuuuacaccagugacaugaucgaaaugauggacuaagcaaaucuacacuuuuuuugcagugaaucuucacugcaaagauaguagugaaaugcaccagugagcccuagugcaucuuccuuccuuaacacauaaauaugaugcaaugacacgugucaaugacaaauaauuaauuagcgcuuccaagaagacuuuaauaguuccauacauaagccuuucuaaaccccacccaaucuucgaagaccacuuaaaggucaaguucaacugcuccuugaagggauccaagaauaauuucauaucucaguagccuuucccucuugguagcauuuaccauuuagcaccuaauaauguacugcacugcucagcauuaauuguacauuuguguguuauuuccuuaauagcagcucauuugagacugcaaauauguccugagguugcaaaucacaguuugagagaaguaaagaaagugggaugcugcccugagugagcauuuacugagcauccacuuuguacuguacaaugggcuacuaugaauuaaaaauauuaaguauguucuuuaaaauagugugagguaucaaauauaaaaguaauuuauaaaauagcucaugauggugccuuccuuaacauuaaaagaauaucuuaauaauucucuaaugcagacuuuaauuuuaucuucauuuuagauucuaauaucuagcucaacuuauguuauuccaaacuuaccuacuaacgucuagucagaauaaacuucucccagauucucuacugccacucuuuacaccgcaaccucauauuaauauauacauauuuuuaauuacugagcacacacuaaauauaccauguacuaggauaagcacugaggcuuccagaucaaaaacugacaugaacuugccuucauggaguuuacaaucuaguuuucucaggaauagcuaacuuaguaagugcuggcuagaaaauggaucaaaagcauaggguccugacucacuuugggaaguaaggaaaggccucccugagaaaguaaccugagaucuaaaaaucaagaaauuuacuaaacauuucucaauuuccaggcuacaaaauaagccuaccaccuaauuaauguggaaguuaauguuuaaaucagaaaaucaaaucaaaauauccuccuugcucccagaacaaaagagagaauaugaaauaauacuguuaaguacagauuuugauccaaugucaacaaacacuugcaucacuguauaucucuggauacagauaaucaaacacucuuugcaacgaaacaacaucuaaaaucaacaaguugaaaaaugauugccuugcauacugguacuuuuuaauggcaaaaugaugagaacuagcaaaccuaaauagcaaaugaaaagagaagcauuaaaauaagcuguagaaagagacacauaaacagacugguuuuaacucucuuuaacuucagucagaauggccuaaccaaaguuugaaagaagaguuuaaagagaagaggucacauauuauaauuguuuuuacuccuguaaaaguagacaauaaacguacuaagaaagaaguagcgugguuuaaacucaucucacacgcaaccccauuuaggucuacccagaauaauaacacaggaaauuaauaugucacuaagugagacuucuaucaaagaccagaauauuugggaucauaaugaaacaaagauauaacuaugaaggaaggacuaguucuuuccagagauaacaguaagcauagucucccaagaauauucagaugggaggcaauaaagaaauaaaggugacuggccugaucaauuuuagugacacaauucuacaauaaaaauaaaaauguuuaccucauuuaaaauuuccuucugacugaauaaaacuuugaaacaaaagcauuuugaaaaacuuuugccaggucacacacaaaauagaucaguuuuuccaacuuaaauacaauaguacuugccuucuaucuuuucuaacacauaguacaggcauacagccacuggaauucuagcacaaauucauguuuauccuucucauuccugggucuuuuauaagaagugaaaaacaagauuguagcuaaaucaguuugacagguuuacuguauuucuaccuaaauuaauugcuccugggagaaacagauuuucuuguuggccuggcccugaaaaggagcaggcgaauagauuaccuauacacuuagaugaacaaaaacucugugccagucccugucagaggcauucuuuuucacugacaaaguuauacagcaagaaagaaggcacugucuuguuugagucaauccaccaaccaccaugaccaccccaacagacauacagcuuucaaaaacccuuaucaaguaauaaauaauggggccggacacaguggcucaagccuguaaccccagcacuuugggaagcugaggcaggcagacugcuugaggucaagaguucaagaccagccuggccaacauggugaaaucccgucucuacuaaaaauacaaaaauuagccaggcgugguggugcacgcuuauaaucccagcuauuugggaggcugagacuggagaauugcuugaaccuuggaggcagagguugcagugagcugagauagcaccaccauacuccagccugggugacagagcaagacuccuacucaaaaaaaaaaaaaaaaaagaaagaaagaauggauaaauaaacuauacguuucuuaaguauuuaaauuaggauauuucauuuauaagccuucauaagucaguuuugggaucuccaaauguacuuuuggauuagauuuagcagugauuuagaaaauagucacuacuuagcaagccuagguuucaagugcugaacauaaagcagaugucacacacgcacaaaaaagaaaauuccuuaaaguguauauuauguaacaaaguaagacaaaaaauaacauuugguaauaauucauccuuuaggucacaaaggcuuagcugagcuacuuauuuauuuguaacauuugcuguguguucaaguuuuagauuagcauuaacuauuucaagcacucaaaaaauguaaauaaauucaguuggcccuccaggcuucacaucuggguauucuaccaacagaggacagaaaauauucagaaaaauaaauaaaaaauaauaauauaacaauaaaaauaauaaaaauuuaaaaaacaauauaaucacuauacagcguuuacauuguaauagguaugguuaaguaugacuuaaaguauacaggagaauaugcacaggcuacacgcaaaaacgacaccauuuuauauaagggaccugagcauccauggauuuagguauucgaguguguccucaacuaauaucccucgauaccaagggacaacuauaaaaagcauaggaaucuuuuuaaaauuugguauaucacucuguauucuaaauuaaguuccucauagaacacauuuaagcauaaaaaaugaaaccacacagaucucagaagaaaagauuuucuuauuuuuuuguagaggagucucagagaaaggucuuucuaaacauuauauaaaauucagaagauuuaaaauaacaaaucuacauaaaaacuuaaaagucugaacuucaaaacauaaaccaagcuaaaaacaaacuacaaaaaacuugcaacacaaacaaaagaguuaauuaucuuaagaaguuauuuuaagauuaauaugaaaaagaucagcaaaagauauauacaaaucacaggaagacuaaaaacaaguguuauuuaaaagcuggaaaaacuuuaaaaacaaaaacuucaaugaaauagaauuauuaauguguaauauuaacaaagagaaaaaauuauucacauugcauuaguggggguguggguguauuaguaaucuuauaguucaagggggugcaagccaguacagucuucuggaaggcaauuugauaguacccaucagggcuaaacacaguggcuucugcccacuaucucaacacuuuugagaggcaaaagugaguagaucauuugaagccagaaguucgagaccagccuggacaacauagugagacccugucucuacaaaaaaaucuaaaaaauuagccaggagaggcuguguaccuccguaaucuuggcuacuggggagacagaggcgucagcccgaguuugaggcugcagcgagcuagcuaugagugugccacuacaugccacgcuaggugacagagugagacuccaucucuaaaaaaaguuuuuuaauaaaauaaaauaaaaauaaagauaguacccaucaagauaaaaauugaaauagaauuucuuggucaaaaaucuuuuaaccagccgggcacaguggcucaugccuguaaucccagcacuuugggaggccgaggcgggcagaucaugaggucaggagaucgagaccaucccggcuaacacggugaaaccccgucucuacuaaaaauacaaaaaauuagccgggcgugguggcgggcaccuguagucccagcuacucgggaggcugaggcaggagaauggcgugaacccgggaggcagagcuugcagugagccgagaucacgccacugcacuacagcaugggugacagagcaagacucugucucaaaaaaaaaaaaaaaaaaaucuuuuaaccaagaaauucuauuaauuuauucuacagacauauuuacacguguaccaaaggggggauaaauaaucaaugcagcaguauugcaaugucugugguagcaaaagaauguaaacaauuuaaaggucuaucacagaucggguuaaguaaguuacagaagcaaacaauggaauauucacuguuuaaaaagcaagaaguggaucuauauguacuuacauagaucuauaagaucagguaagacaaaaaagcaagggacuaagguguccaguauaccauuuauguaaaaagaaagguuagggaacauacauauaugcugguacauacauauaaaguaucugaauugauagcuaagaaacuguuaacaguggcuguuucucaagugaaccagggcauuaggcaagagagcuggaaaaagucuuuuuguggcagacgcaauaaugcucugcccuccuccgaccaaaagauauccacgcccugauuccuccagaaccugggaauauauuaccauauaugacaaaaaggacuugcagaugugauuaagaucuugagauggggaaaauuauccaggugggcccaacauaauccuaaagguccauguaagaggaaggcaggaggaucacugucagagaaaauguaaccuucucugggggaaaauuuaaagaugccaugcugcuggauuugaagagggaaggagccaaagaauguagaugaccucuagaaacagaaaaauucauuagagccccuuaaagaaagacagcccugacaaacaccuuaauuuuaucucaguuaagacucauuuuugaacuucugaccuccagagguuucaggaaaugaauguguugcuuuaagccacuaaaugcauaucacuuuacuauggcaguuaauaagaaacuaauacaauuuuuaugagaaaccauuuuuuaguguuuuaaaccauguacaaguaauauugucucaaaaagauugguauacuagguagauuuccauuaauguuuuucuuuaguuuuacuaacuuucaggagcaaguuuucacuaacagauaaucucuaugagauguauuaagcugauuuguuguuguggcucacauuuauagauguaguccccaaaacacacaaucucuaccauuaagguagucaguaacagcuaaugccccacaguaaugugcauggauaaaugcacggaggaugauggcacacuuuucaaugguauauagucuagcuagggagggaaagaagcacacacaagcucuaugacagguuuauauaaaaaggaguauacccaugggugccuaguaguauuguaugagccauacuuaaaaauacuaaaauccuggcugggcacgguggcccacacuuguaaucacagcacuuugggaggccaaggcggguggaucauuugaggucaggaguucgagaccagccuggccaguguggugaaacccugucucauuugaggucagggguucgagaccagccuggccaauguggugaaacccugucucuacuaaacauacaaaaauuagcugggugugguggcuggcaccuguaaccccagcuacucgggaggcugaggcaggagaaucacuugaauccaggaggcggagguugcaaugagccgcgaucaugccacuggacuccacccugggcaacaagagcaaaacaccgucucaaaaaaaaauaaaaaauaauaaacacuaaaaaccuuuuuaaugcagcauaaagaaguguugaguggaauggauuaauuugaaaagauuauuuauauauaacagguaaacuaaauuuugauauaaagauaugaacuugcuaagcuccagcaaagauuuacaauaagagaacauuaaugagcaaaguaacaaggaugaacaacuauaagcuguacacuguuacuauuuauauaacuaaaguuaauaacaauaacauuuacuaagugccaggcacuagacuaagcacuuuacauuuaauuuccacaauucuaugagguagguacuauuguuaucccaauuaaacagaugggagguuaaguaauuuugccaagauggcaacucagggaaagacaggugcccaacucuguccuuugggaccacauucugagcuguacugaaagaggaugcagcaaaaccacuaaugagguuauaucaaaaaaaaaugacagagccagaaaugagccaaugaaaacagguucauaugccacucuuuugacuucuaugccaaagcaacguacuucuacuauacagccugauaaaaagugaagcucugauagucaaggacaacuacagucaaauaccaaucuaucuccccaaucacucaaacacaaugagauguaauugcuuucauauuccacucugaaaaggggaaaaaaacuaacacuauaaagaguuggaaaucccacaagcaaagugacaagcaaacacugaauuuacacaaauguguacaaucuaaaguacaaaauaugcgucagcaguggaucaaaauaaagcacaaaaaacucgcgaaacaacgaaagaaccagacuguaagacaaaaauggcauacaaugaaaagagaaaaaaaugaaaagaaacaaagaggccacauuguggacacaauaucguaacuucugaccagauuauaaacuuuuaaaauuuugcuuuuauuaaaaauuaauugaaaaaaauuuauaaagcauguuucuaugcaagaauuacucucaagaacacaacgauuacguaaaaaauaggcaagaaacaacauacuguuucaaaauacaaauauauguaguaacuauaaagaaaaguagugaaauuauaaauacaaaacuuagauaauguuugcuucuuaagguuuccugaaaguucaaagaagguaacacagggcuuucaaaggcuauguuuuauuucuuaaaacuacaaaauggguaaacgagaauuccugaaacuguucaucuuuacacuugaaaugugcuuuaguaacacucuuuuguaucuacucaguuuuuaauaaaaacaacaaaacugcuucagugcccuggagcgaaugggggcguaacggcaggauucagggcacuaacgagaggugaacggacgccgaggaagaggcgacuaagcccacauacugagucuacccaggccagagaggcagagguguguagggccagcgaucucagaaguuuugccaaacuccucgaugcguuacaauggaaaggugccggguuucccccaggaaguagugacuagcgagaaguuaggcacaaggcaaagaggagcaaggcgacgugugagcacuucagcacucggacgcggaacucuaagguccaggcguugggccugggacucgccucccagaggcuucgccccgcaccccgcacacucccugaaaauaaacacuuugcauccuccccucuccuagguucccgaaaccgcacccucccucucugccugcucaacaagagccuuccggggaaccaaccgagcgguucgggggagcaggagggggcccaccauggugacguccucguggccacggagcagcuccgcacucuagacccagguaaucucaccaaccgcaggagcagcagcucacaagagcacccgggccgaaucccacguggcgccugagaagcccgcgccgacccaaccggaacaggagaggcgagugcguuucucuaaagcguccccguuaacugagaccgcgucuuuuucgcccguguugggcuuuuaagcucuagcccaacggacagccagaccugcgugcucgccgggagcggcggaagggagcuugcggc

SEQ ID NO: 191875 - RNA, 37934 nt, Homo sapiens
uggcuccuguaagucauuuuacuuugaauauauaggaaacaaaauccacaaacaggaagcuauguucuaugguuaugucuuuuaaacaauguucuguauuuacaaauuguuuuuuucccuaaguaaaagcaccagcugaaaaguuauaggcugcuaaaaccguuacaaauauuacaaacccauuaaaagacauuaugccaaacguacuuauuaaaaaccuuaacaaaacgaagagacaacugacaacgcaaccaaccaauugagccaccaugcugggcuggguggcaguuccaauuuccuugccuguguuucugauaaacggggcugggagugcuuaucccagggagaggauccucgcccaccggcaggugacuacagggacagagcuggggagaggcagcugugucucaaggaaacauggcagccucacuuccugcuguagguggccuccuggucagacccccucaacccacaggacaagggcagaggcauacaggagggucuggccagcuuucggcuguucaucugucaacagaaugccuuucugcgaccuuguccucauccacugaaggguuuggaguuuuuguuuuuuccuagacacuuagcuacaggacacugugugauguguccucagggacuugcugucugccuuccauuguuuuuuuuuuuuuuuuugagacaaagucucaccgucacccaggcuggagugcagugucgcgaucaugcucacugcagccucaaucuccugggcucaagugauccuccugccucagccucccaguuagcugggacuacaggcaugcgccaccgugucuggccucuauucuugcaauugaaugagaugcuaugaggcgcugagcgacccacaggaaaguacuuaucaaaagcuuugugucaugagaagaugcggcuguggaaggagguucaaagcuugcacacacgcacacacacacaugcacaugauuuggcuuccauaaagcucgaguagaauauuaaauauugaguacugaguuuuuaauuguaaacuuaagaucucauccuuaacuuuacauauacauagauaacaggguggucaugaaaagcacuuuaacaucaggacagauguuaaguucugagguucuguuuucaacugcucuacauacaaaaugcccuacaagcaaagaaaggcuuaaauaaauagauggggaugaacaugaugcacgccguggugacaugaguggugugcaggggucggacagugcggaacccgggugggcaggagcacauuguggagacacaagugguggcaucucugggauguaggggaggauguggggggcuccuucaagguggagcuagcagaggccauggcucgggaggaagacaggacagggacaguuugugggccagugccacacgcucuccuauuggcuucaugggccugggggcagcccuggguagcaaaggacagggccaggcucucccccuggagacccagagauggcggugguccucuuaggacaaacccucaccagccccgcccucugaccagccugucacuggugcugaugucaggugguggccagugaggaaggggguuauugacagcccugccuguggcuaaggcacacccagccugggagccccaagcagcugaccugagcaauccagcgucccuuuagucacagacgccaaagcucccagaggcaguuccacugagugagggugacaagaccuaaaaccaccaccuacccugcugagcaggacccccacccccuguagcagggagaggcuccugggccccagaagcuggaggggguggugucuugagcccugacaccugcugcugcuaucuugacccgaccacccgccccaacucggaaugccacacugugaccacuggggcaccuccugauuauccaagaaaaguggauaaaaccaaacgcugcugucugggcccagcggaggcucccuggggccuggcuagggugcggguuucacacugugccccagagacccagcagggaaggugaggcgguggagggaguggggggaccaagaggcugagcagggaaggccacagaucugccaggaagaaagucccugggcuccagaucucgggggcggggggcccgugccacgcacucuaagcuagcugaggaggugaucuuaaauuuaggagacgagcccacucccccgcuuccugccccucagcagccacaagaugggggaagguggcuggugcaacaggagccucagcucccagcuccaucuccacagaucuucaccgcacacccgugugcauccacaugcacacccguguuuacaaucaccugcacccccacggcgggauggcgaguccggucaaggugcagauguuuggaagcugaguuccugggucccugaggguuccugaccagaggccccagcugcugcagggacugaugcuggagagaaagcugggaaaagugcugggaucugugcuucgucccacacuagcgccauuacuucuucccuccaaauucaggccagaaacuggcauccgggcucuggaaauugccuugagcagaggaaacacucuacucccgcucggcaucaaggccugggugauggagagucaggcguggugccccuggggcacugccugcccuggcacacaggauuaggaccugcuggaggccugcacccuacuccuggccgacgugacccagaugcugaggcaggacuggcacugagguccacucugaaggauggcucuggagagacagcgccugugugccaccugugagccucugcacuggggguccugcugcgaggugggaacggcuaccaccccuccugggagggcagggacuggccccgcacauucccaggacuuggaagcucuagagacaaucaggaaggaagcacgccucgggggcaggcuugagugccgucuggguggaagccggagacgcgcaggcccugcggagcuggauggccccaucaaggccucacaggaggcuggccaggcugguguuggguccauucugagcuuggaacugcacgggggguggaccgucuguccacuguggggaggagaggacaugcgagugaggcacuguggaccguucccagggaagaagagguuggaaugcugccuuccuugggcugcucacacagccgggacucuguucuccaugccccaguccaaugggccccgaggagacaccugggucccuugcuugggugggggugcccauggccaucucccccaucaagggaucaccugaggcugaguuaggguuuguuggacaaaagagaaauacagccaaggugccccuuccucuugcagguggggagcccgcuaguccugaucccguccccuaacacccacacccguaccgugaugagguuguguucggggaggcugcaggccucaaugugguccuggagcagcugcugcgagaaguucuggugcaucugggcggcuucaugggcauccauggcguucccacaggcuuuauucaggucugagagugggacaugagcaugggggcccgccuugcccugucacugcccaggcccucccacucggugcagauggagcccuaaggucaagucccagcugcacugguggaucucugggugccuggcacgucacuggaccugagcccugucuugggaucacaaagcccaugcgccagccgcccucauagggcagaacagggcuggcugggcagugaaagcccaaugccaggcuucucgccagcccuccagggagcccauggccagcccucaggcaaacaggcgcucauuggggcaggacgcccaaugcccauccugaggcagcagccccaggcagcccacugcacauggagcaccccgucuccugucaccuccccagggccccaggcgagucuccggaccuuaguuucguaaucuggaaaugggggagcugcgguaacagcaaugauacccgcugagugcccgcccugcucccagagcuagcuggccagcccuacccaauagguauggcugcugucugccuuuccgggaagaagcaaggcugagagcgccacggcuaacagcccaagucuaccagauaccaagucgcagccucuguguccuauagagacugaaccagaccccgagucaagcggaugccacaaaugcacccacugcccucaaccagggucuccugaggagcacccccuacccaugcuagaacuggggcugcggcccacggaggccuaguccgagcuaaggcugagcaggacaugcccagcagccuugaucucuggggagggccaggcuggggcuggggaagagggguggccauugcacucaccucucagcagugcugacgaccacagcuguaccgacauguccgggaucuugcuggcgagcugcauggcaggcaccaccauguuguuacucuccugucaaccaagagcagcaagggggagugaggagccuggaccccacuugccgaacccagcccagguugggguggggauaaucuggaacccaccuacugaacccagcccagguugugaccuccuucugcgucuggugaacuccuaugcuuaccucagagcccaucucaaauggcccucucugaaguaucacugaaaaacaaacugcccucacuucuggcucaugcccucacaggggcauggccaauggacaacuuugggggcuucuaccuguucaagcagagaaaaagcacugauggccguuagcccuagacccacaaugggggcugaucagaaaugcagauucauauaggguuccagguuucagguucugagaagggcagcagccccuccgguuugucuuccacaauugaguuggcucucaugggaggcccccgcagacacgcaggggcucugggggcaccagcauguaagaauccuccaauccggacucccugcuuugugacugcacagggccaccccaguugcagcccuagcauccucaggauguggcaggaagagcucaguaagagccaucagggcccauaaaugcccaucccuguugcuauggcaagggccuggagacggcagacaggagccugugcuacacaggcgaccagcagugcuggacugacccugucuggaccgaggacucaaagcccuguaagccuggaugugggguucagguaagaccuggaaaauucccuagaugauggcuccuggcagcccagggagcacuugggaagccaagauggacacauccccaaaaccaacuccugagaccuggcuuugacgccaccagauacuucuccagagugcagagaugcuccuccugagacacaaagcccaacaacucuacacugcccuguagcugcaccuugaaagugagcuccaggugggucuuggagcuuuuuaaaauucaccaagcccuuuugaaaccucagagcaagaaaaacugcucucuuccgcuaggccuggcuuauugugagccuggcugggcucccuguagaaagccaaggaccucugucugaaagcagccuggggaaggagaguccuccuucagcgcuccuggguagguucccccaaugccagcuugggguaccccacagaaucugguuuugaagacuugagugauccuggggggugucccgcucuuguggacacucuagccuaacaggcucaggacagggcaucccaagcucuucugggccccuggacccucaccugagcccauuguggccauucagccgucugcuccggcacuugugcucugacugcuguggugcccaucucuguggcagccccugccuagccaaccuugcccugccugcaccaacacuaucccggcccccaaggcugccaccuuucuggauguccccagccugaccucacaggacuggcuuggcugugucuggcugugucuccccgagaucuggagucacuuaaggccaggaccuuggucugagaguucuugggcgccgcuugucacccgacaagggcccagggacacagggagcagagggggauucccaaaagagcucuguaagaugcccccacaacaccuaaaacaugggccaggagcagcagugaaccagcugcucaacccuccuugcccugcuccaggcagcuuccagggguuucuacacaaaucagagccagugaggucuggguuccaguccugauucugcggucuggggcugugugacuuuaaccuccccaucugacacacccccaggccacuugcacuguccaguggggacauacagcccucacugugcucagaggcugagggcagggugauagcacauucuagaaggagccagcuacagguuuugacgggguaguggcauccccagugcugaggccaaggcccaccagggccugagcugcagggcccauucgcuggccucugcaaaggcuuaccacacaguuaugugucuguguguugcggugggcgggcaccacguuuguuaacagcauccaugcugagggagcccucagaucacgugaaacuuuacaggccaagacacacaucuugcuuuaucuguccuguggaaauggcuacagugagaaugguuaaacuacagaguagauguggcuucaaaacacucauugccauuaagaaaaaaaaaaaagcuuccaauacagagguguggagaaaggcaaauauaaaauuacccaguggcucacgucuguaaucccagcacuuugggaggcugaaguaggcagaucaccugaggucaggaguuugagacaagccuggccaacauggcgaaaccccauuucuacuaaaaauacaaaaauaagccaggugugauggugcucgacuguaaucccagcuacucgggaggcugaggcaggagaauccguggaaccugggagguagagguugcagugagccgagaucacaccacuacacuccagccugggcaagagagcaagacuucaucucaaaaaaaaaaaaaaaaaaaaaaaaaaaaauuaccaaacaggcugacaagcaaaaccuccacgugggagacgugggcagugggaagggauggaugacagagacaugcaauuuuuuucuguuuugcuucucagccuuuuaauuaugaacaugucauauuuuauaaucuagaaaaauaacuuuuuuuuuuugagacggaucucacuguguuguccaggcuggagugcaguaacaugaucacagcucacugcagccucaaccuccugggcucaagugauccucccaccucagccucccaauuagcugggaccacaagcaugaguccacacacccagcuaauuuuuuuguuugguuuuuguagagaugggaucucagaucuacuauguuggucaggcugauauugaauuccugcgcucaaaugauccuuccaccucugccucccaaaguguugggauuacaggccugagccacugugucuggcuggaaaauaucuuuuuuuuuuuuuuaagagauagcaucucuagggccaggcacagugggucaugcuguaaucuagcacuuugggaggcugaaguggguggaucgcuugagcucaggaguucaagaccagucuggguaacauggagacccagucucuaccaaaaauaaaaaaauuagcugagcaugguggcacacaccuguggccccagcuacuugggaggcugaggugggaggaucacuugagccuacagggggugaagguuaccacgagcugagcugagaucaugccacugcgcuccaacuugggugacggagugagacucggccucaaaaaauaaaauuaaauuaaaaaaaaagagggucucacuagguugcccaggcugguggucuugaacuccugggaucaagggauucucccccauccaccucccaaagggauacaagcaaugagccacugugccuggccaaaaauaucuuuuuuuuuuuuuuugagauggagucuugcuguguugcccaggcuggagugcaguggugggaucucggcucacugcaagcuccgccuuccugguucaugccauucuccugccucagccucccaaauagcugggacuacaggcgccugccaccaugcccggcuaauuuuuuguauuuuuaguagagacgggguuucaccguguuagccaggauggucucgaucuccugaccuugugaucugcccgccuuggccucccaaagugcugggauuacaggcgugagccaccaugcccggccuuuuuuuuuuugagauggagucuugcucucaccuaggcuggauggaguacaaugacacgaccucggcuuacugcaaccucucugccuccuggguucaagcaauucuccugucucagccuccagaauagcugggaguacagaugugugccaccacaccuggcuaauuuuuguauuuucaguagagaugagguuucaccauguugaccaggcuggucuugaacucuugaccucaagugaucugcccaccucagccucccaaagugcugggauuacaggcaugagccaccgugccugucccaaaaacaucuuuuuuuuuuuuuucugagacagagucucacucuguugcccaggcuggagugcagcggcaugaucuccguucaaugcaaccucugccuccuggguucaagugauucucaugccucagccucccgaguagcuuggauuacaggcguccaccaccacgccccacuaauuuuuguauuuuuaguaagagacaggguuucacuauguuggcuaggcuggucuugaacuccugaccucaggugaucugcccgccuuggccucccaaagugcugggauuacaggcgugagccauugugccugcccaaaauaucuucuuaaaaaaaaaaaaaaaaaaaaaaaauucaagaccucgugagaucagugggugagaguaggcgaggaauugacaggaaggacugaggcggccagucccaccagagacuggcugaccuuggguggggaccaaucccaggggccacuuguacccugagaggacacuguguuggccaaggaugauauguuuggaaguccggcugagaggagacaccucucugccccucaggugucaacacauagcaugggguggcugcgucauccccaguagcucagggcagcuccuuugguucuggcuucagcuccccugagcccuggggcucugccugcccaaugucugaggccacacccaucaggccuccugccuuccccccacacccucugugggugcccagcuccucuggcccugccugcccaggcugugggagucagggcauccaccuagacgugcucuucgaggggcauaggaugaacagugccaugccacccuuagggugcuggccggcuccugucccucagccaagccccacaggcacccaagcgaggggcccaggccagggcacucacccugugguuucccagcacauagaagauguggcccagaagcacgagggagcaggcugugagccgguucagguccucagcauuggacaucuucagaguuucccgcagaaaucgccugacaaggagaacauggacgcugauaacugcaggacggggccugggcuacccugagcauggcccucacgccacccucugccccacacuuacuuggccucguuguagcgucccuggaagaaggagaagagcccacgcacauagaaggcggcugcucggaggcagugcgagcugcagggagagugcaguaucacaugggguggugauuuugagaagcagguuuacaaaacggcagugggcagcugggggcuauuucugagagcccccacugcagacugucugugaggagggguauggggugucagggugcaaggggcagucaggggccccaaccaaagagcacggggagccuaggccgugcguggaguggugccuggagcggcucaccugacagggaagcugugguccggguugauccucuccagcagacuguagagcugcgggggaaagagccagucagcaccauucugcaucuucacaggagaaagguccccaagacacacugcagugcaugggaauuucucuacacccccgucgggacuguggccuccaggcugagccuggugacugaccagcaagagcagccucuggugagaagggccgggggcaagauuuccacacccucagccagcccugccugugccacccuguccugcaguaggugacaggggccugggcguccagaaggccuuuguauggucagaguggugcugaggggcuggccuggcaguggguagguuggcaggcuggggcccgugagcccugugggcugugggggugagugggugggauuucucuggaggugcagggaccccgggaggcucugaugggggcgugaucugacugauaauuuagcugcccucuagcugcagaggcacaggggagccaaacuccuccucaacacugcgagcccacguauggcaucggaugacuaagccggggcugggcuuucuuuuuccuuugagacagguucuugcucugucgcccaggcuggagugcaguggcuggaucauggcucacugcagcccucaaucucccuagcucaagcaauccuccugccucagucucccgaguaguugggaccacaggccugcaccccaccaaguuuuuaaaaaauuuuuuuguagaaaugggggucucccuauguugcccaggcuggucuugaacuccugaccucaagugauccuccugccuugcuucccaaagugcugggauuacaggugugagccaagcaccuggccugauacacuuuggagguagacccccagaggugaaggagauacuagaacugagggacauccuagggcugagggggaucccagggcugagugggcaucccagggcugaggagggaaucccagagcugagggggaucccagggcugaggaggggaucccggggcugaggaggggaucccggggcugagggggaucccagggcugaguggggaucccagggcuaaaagggacagaagagggaaccuaacucuuaugcaagcauugguucagaagcgccacgugagggcaacccugggcauccccacccaacacugcagccagugagugccccugauccugcaggggcaucagcacaaccuggggacaaggugcucuggcugcugccccuuaggacugagccucaaugccuggccgacauccuagagcagacagcuugggcuauaagaccuugucugugugauucauacagcuugguuuguuugugauaaagagaaguguucuguggcuaugggaauguuuuugucccagaccuggccucccccggccauagcccgauucaccucugggucgccuugugugucugugucgggugccgcccaucccucaaaaggugaacacccuggggucugcugagaugugcuggugcccaggacaacccccugguuccccaaaaagaagagaacagagagaaaggauaccgaacaugaagcaugucaccuacuaccucuuggugucuauuuccuucccguauauacacacucgccagguuggugacgaugaaggcccacagcuccuggugguuggugagcuggaaugggaggcggggacauuagggggcugggucgggugcugugacccauguggcagugucagagcacccacaaucuccacggagacuacuuuggaaaagacuuguucuuuucauuucaaacacacuuguuuugccuccuaagcucaaggauaacacagcuauuacuucuucucauuauaaaaccaucaucugcguuacggggcaguuagagaacacagaagaggaaaaccagccaccccaauccuacccucagaacaugucggguuuugguccauuuuccacugucucucaggacugagaccugguggacccuuccuccaggccacagccagcaaccugugggacccagguguccacugccaucaaggcauaugcugguccuaggcgggggucacucuucauagggggaaguggggaagaggggagcuguugucccacagggggccagcacaggccccgcuccagguaggugaugcugugucagagaccagaaaugcugcugaugacaggugguggaugggccauggucccuggcucuucuuggcaaaugagaucguucgucaagagaggguccaaucuauguagcucaagcccugcucagacccugguucccaguggggcugggcaagagguggagugagcccaggaagcacagaccccaccugcacagauccccuccuggcacacacccaggaggcccagaggaucuuccgaaucaagcacagaugcucugagacguagcaaggugggagauguuuguuucagggccacaggaggcguguguguuugggguuagggguguugggguugcauccuggcuccaucacuccugggugggccaugaaaaagaggcucucuuuuggccucggggugaggacuccuuaggguacauggccuugggaacuuugacgcggaaccaaaccagcaauagcaaccacuuguggggagugagacggagacggagauggcaggauggcagggccacgaggaggguccuggcccugcugcagucagagugagccaggguccugggagcgaggugaggaggcagaggagugggugcugagucagcccuucccucccaagcaugcugucugcaugucagggcuccugugcaucucugaggccaguggcggggguggcagcacccacaggccugcggggugccguggaaugggaacccuguccaacagucagggcgcacacaggacucccuggugaccuugcccgaguggcagacagagcagccucugcucccugacaccucuccucagggcccuuccuggcaccaccaggaaaaagguguccacagccuccauuuccugugaggagguugaggcugagguggggacacaaugguccagcccugggcuggggcgcuccgugaggauguggcaccagccuucuuccagggccuggcggggcccccgucuaaggccaggagccuggggugcugcuucacccucuccggcccagcaggaccaagaguccuccucuguccaaagagcaccugggagauggcccagcuccaccacuccccaugggagcccugaacccaggauggcucugaguugucagcugacacuugagccaauccagccuugggggugggugccgcaaaaguucccacucaggcaugaaagugguguccccggacgcgucgcaccucucccucacgucugcccuugggucagcucaggaagccccuggccccauagcugucccuuauccagauaaacagcgcgucacugccaaggcuggcaugggcugacuacugugcauugccucuggggcugcggcuuugcauagcugaccuagcgcgacugcuguccucaucacagaccacgcccgacuccuuacucagaaguguggcccgccccgagcagcaaggagggccggcaccuuacccgcagggccguggugaacugggcuuccgcguuguccaugcaguugacagagacacaguacaggcccuggaagaaggugguguugucaucagggccggccccuggggagggggcucagaucagagacacguggugugcccggggccugcacggcugcccuggaggaguaugacaauggcucuaccgagccagcugcaaggcagguaauaugcucacuguccccaccuuucagacccaagccaauguggggugggacaagaugcucacugggagcauuccggaucgugccugggaagguuauaugauuaccuaugggaacauuccggauucugauuagggugcugucaggggguccuucacugggaauguucuggaucugguuagguacuuacuuacugagaacauucuggauucucccgggguguugucacaggguuacucaccagcaaugugugcagcugugcugcaugguuggagaagagccggggggacugcuggcacagcuggcagaccugggagaucugccgggagagaguguacugccaucacaggacugcaaccugggaccuggcgucugagcagcaauggagagaccccauagcuggugggugagcccauguccugucugaccaaacugggguacaaagccccagcagacacguccaccaugagggcaaagggcagcccagaucccaucguggacagggacccuugucuguuacucgucucuuccacucuguccaacaggugucuggguuguaaaggaccuccagccuacugagggcccccaugcccucucaggaggguggguacuggggguagaguguuccuaauggcagggugggguauaacaaucacugucaaaggaccccccaaauccccagagaccaugugcgcuauccccuuggugugcaagcuuuugggccauggcccauuaguuuuuuggguuuuuuuuuuugagauggagucucacucuguugcccagguuggagugcaguagugcgaucucggcucacugcaaccucugccuccuggguucaggcuauucuccugccucagccucucaaguaacugggauuacaggugucugccaccacaccuggcuaauuuuuauauuuuuaguagaggcgggguuucgccauguuggccaggcuggucucaaacuccuggccucaagugauccacccgccucggccucccaaacugcugggaugacaggcgugagccacugcgcccggccuccacugguuuuuguaugagauucucugaucaguggugcccaugcagggcuguaaaacgcuggccgacagcgagacagcaggaugggcuggccugccaguaugcacuuggcgaauucagucucuugucugacacugcugagacccaacaaacuccugggccuucccgccccuccugcuuccagccuuaccuccugcagcgccguggccuugugacccgugacaaggcggcacaugaugaugugcuccagcaggaucacuuggaaggaugacaggauggggcugcaguccagcacuaugggugagagucagggguaagcaugcaggggaggccagaggaggcgccacccccagcccaccgugcccccaccucguuccugucuccugccacacuggcuaggcacccaccccgucaucuccccuaguccccacugcacccucugagugaaggagugugucuugcuguccagguggggagacggagcuggagccagagguugguucccacagugcuccaagaaggguuggcucucacccucacccucacccuacgugcucaagagcuuguggacauggcagguucuagaaauguagaaauguggaaaccacccuggaucaugacaccaugcagcagagccucaggcagucggguagggggaccugggcugggccccaccucccaacagccccaagcaaccauccucauaugggaauaagagaagcacagggccuauccggcuuugggcugccuuggcucugaugccuucucccccagcagcacucacgagggagcaaacagaccgacuaaugggcacacuauaccagccagggacgucugcucuggguuugugcuagucaaaggucccuggauggauuagacacuugagcaucuggaaagaacucacgaccuccaaaggacaugcugguggucagugagggcugaguucugauccuggccucaucccgagugucccugucacaacacugauaauaauugggaaaagcagcuaccaccuguuucaacugagcaugacugggcacaagggaccugaccagucagggagguacccccgaccccaggccugucugcucugcucugacguuggacaccagcauuuaucaacuaggggugacgagacccaccaggcaggguggcugggcgcugcggucacacagggucacugggcccugguacagcuagcgucuggccaggccguccgccaggggucgcuguggccauguggccagccgagcaccugacuuacucuugagcuucuccagcugcaugagggccuuguccguguacuucugcgccuucuccagguagccggccugcauggagugcaucacagucaccuagcgacaagaccagacagcagggguuaccagggcccucucccucucccugcccccgcccccagcccuggcccgggcccugguggggacgcaccagguagacaagcacacacaugugcuccuugggcagccaguggaagaggucagcgggguugcugggcaggaucucaucaucgugcaguguggagauggucuggaugcacugcugcagcugcuucagacacggcuucacgcucuucaccugugcagcacccacacccgagcauccaccugagccuggccucucaggaagccaggcccagcccagccaccccugcuccuuccucuagggagcaucugccuuccccuucugccagggccaccuccugcaagaugaagccgccccugccgcacucccaugaaucagccaggcuuuuggggcauggggcacagccaggcgggcagcugugggacugaggcuuguccacugcccaguguuggguccaacaccaaggcccaggagaggccuauccagacccugcuggagcugcacuuggucuucacgcagccagaccugagacggcagggggaggcugugcucugagggggugggagguggcuuccuggcccaggaaucaggcaggcgcugugguccaucucgcccugaggccccgagggaugucucugcagcccuugcacccugagggaagcguggcugcagucugcucugugucccuaugcgccgagugcagugcuucacccaaugggcaacgauggguauggauggacgaacugggcaacccccuuaccaagcccuguggagacucgccuguggcccacugcgacaggggugggucugaguggcacagggcagcccccagcccccgaagggcugagacugucacacaagcacagagacaaggagcucaaacacagccgcuccccacccacggcagggucaugaguccagucucggacauggcugagcacaucagucccuacucaaccccacagccgggggccagacagacagcaccugggcaucugcugugugcaggugccaucccagcaccucugugguuuauucucaugauucccugaacugccauuggaaucucugagcauccauacacugagcgaguguaugcaaugucacacauaguacucccaaagggaggugggguggccaggacagacccuguucccagauaccagcacucguggcagagcaggacaggaguguguguguccgggacugguaugacagcccuguuguguggcaagguaaggcgaugacacagcugaccucacagcccaagacccauuggccuggguaccacccauacccacuggucacaaccagcagcucgccugagaggcgccacacaccugcccggcauccagauagugggugaccuggagcaccaggaagaagacacgcagcgacuccuucuggaugggguuccccugccaguucuccacgaucugcccgcagagggucagcagcgggugcaccuccugcagcuuucgcuccaucagcagcagcuggggagggagaggcgcagguguaggguacagggcuugcaggggcccucccaggaccgggagcacagggucaccugcccaccugcccugggacugcugccaccaauccagagggcaaggccagccugaaaccccagcccaggcagcuccuaaccaggcucuugccucagcaugaaucccauagggugcagccugaguuucccuccugaacccagcagggcccgggccucacauuccaggcugcucacugugccuaagggucugggcgccuaaggggccaugccauggagaguggguggggucugagcagacucugugggggcccugccucaccuccacaacaccagcugcauccagccaugcccagccucaacuuaccauccccuugcugaggaggaacagcgcccugcaaaacaagaggcaggggucagguccuagcaggcccaggagccuccugggaugacugugauuaccccaaggcucacaggaccuaauaugccaccucaggggacaguucaguggacaacagagaacaguccccuuacaagacugcucuguuuuauccuauugugucuguguuuauuuuuauuuuuauuuauuuauuuauuuuuuugagacggagucucgcucugucgcccaggcuggagugcaguggugcggucucagcucacugcaagcucagccucccagguucacgccauucuccugccucagccuccugaguagcugggacuacaggcgcccgccaccacgcccggcuaauuuuuuguauuuuuaguagagacagaauuucaccguguuagccaggauggucucgaucuccugaccucgugauccacccgccucggccucccaaagugcugggauuacaggugugagccaccgcgcccggccuguuuuuauuuuuuuuauuauuuuuuucuuagagucucacucuguugcccaggcuggagugcaauggugugaucucgauucacugcaaccuaugcuucccggguucaagcgauucuccugccucagccuccugagcaccugggacuacaggcaccuggcaccaugccugguuaauuuuuuuuuuuuuuuuuuugagauggagucucgcucugucgcccaggcuggagugcaguggcgcgaucucagcucacugcaaccuccgcguccuggguucaugccauucucccgccucagccuccugaguagcugggacuacaggcgcccgccaccaugcccagcuaauuuuuuguauuuuuaguagagacgggguuucaccauucacaggauggucuugaucuccugaccucgugaucugcccaccuuggccucccaaagugcugggauuacaggugugagccacugcgcccggccaugccuggcuaauuuuuauauuuuuaguagagacgggguuucaccauguuggccaggcuggucucaaacuccugaccucaugugauccaccugccucggccucccaaagugcugggauuucaggugucagccacugugccuggccuguauuuauuuuucuuacauggcuuagacgcacucacgugaaaagcccagaaggcgguugggugcaauggcucaugccuauaaucccagcacuuugggagaccaaggugggcagaucacuugaggucagaaguuugagaccagccuaggcaacauggugagacccuaucucuacaaaaaaaaaacaacaaaaaaaaacgcggcgguggacacacagcguuggggccagugggcaggcuugggugccugaacucaggcucaaacccgcgccucauggugacuaauuuuuuuuuuuuugagacggagucucgcucugucgccaggcuggaguacaguggcaugaucuuggcucacugcaaccucugccucccggguucaagcuagucuccugccucagccucccgaguaccugggauuacagguacccaccaccacgcccagcuaauuuuuguauuuuuaguagaaacagguuucaccauguuggccagggugggcucaaucucuugaccucgugauccucccacguuagccucucaaagugcugggauuacaggcguaagccacugugcccggacccaauuuuuguauuuuuuguggagaugggguuucacuauguuccccaggcuggucuugaacuccugggcucaagugauccuccuaccuuggccuuccaaagugcugggaauauacugugagcuacuguacuucaccugaaaugccauuucuguuauuuguccuggaccaagauggccaagccccuccuguuaacagagcaggagggaaggaggggagugggugccuaccguguguauucagaucccaccacccgggcguacucggccccuacacccaggaggucacaggccgacaccagguccuucucaagcgugugcaguugcuaaaaaggaaagagagcagugaccuuugcugccaaacccaucaguuuuacgguaccugccuucgugcucuguuagcaaacucaaccaaaccuccccacgucagugaaacugccugugucaguuuugagcuaaauuaaccaaauuaucuuaucaacgcuaauugcuuuggguacacagcuccaguuggccuguaguauauaugucaucuaaacugaauggugccugcaguggacacuaucuaaacuuaauggagcauagaaccagcagccaaggcucacggcacagacccccaaggcugugugagcaccuaaggcuguucugagugcuuuguggggucugucuucaguggggugucccuaguguguuccagggccgacaaggagggacucccucagaggcaagugucaaagucugaacaggcugaaagggaggcacaugccuggcuugacccugcaaggcaauaccuauggggcuguggugaagagcucggcccuugggugugcgugcacauggugccugccaacucuguggcccaggggaggugacucacggccuggccugcuccuuugucugcuaaugggcacaagagugcguggggagauggaaggacacagcauguguaugcagcuucucaucaggccugggggaggagggccucgggaacuccuggcugcugggggagcucuucccugugcguacuuuucucagccagacccuccuggggugagggacucagcuggaggaacucccaacccaggguccacauacugcauaggugucaugggagguggcuaagugguggcccggaaggcaggcugggucauggaagagagaggccgggggccggccacccgccugaggguccccagugcagaaguauggguggagcccaggacaggagaggugccccacgugguggagccugccggccccuccacugcagccgggaaggccgaguucagagucccccaacaaccgagcacuguggagcucagagaccagggcuucaccuauaucugggggggccaaagggagcaugaggaggaacuguguggaucccaggaugagggugugccccagcagccuccaacgugaggggccccaugugggacacaaugcuugacauggccauuuguggccugauaggcagccccuuggagucucaguguagcuccuaaaaaaaacccacagugggucucuggcaggaaauguuccugggauuucaaugagugcaggccaaagaugagaugagaacggcugggagggaggggaacccaaagacacccaacaagcagcaggcccgcugucaguguuggccccggggaagccccgcacucccaccacucaccccuggguguugccgagagccaggcucaagccagagaugcucucaaggauggaggcugaaaggggcuugugugcagguuaaggaaauguucccauguccccaccuacuccaugugccagcccgagggggucugcgcaucguggacucugcuguucuuugcaaauggggcaggugugccccagggucauggucccugccgggcacccucguucccgggccgcgguacucacagcgagcuggaagagcaggcggcagugccaauauggggucugcugugagaucuggaucgccuuccgcagcagcggcuuugcugcaucaacggaauucugaaaggaaauagucacguuugggaauguaagaaaaaaaaaaaacaaggcggcaaucaagcuggauuccuuagcagcagcuguggugccagaaggcaguuccuguucaugcuuaccaaaggauuuuuugggguugccaauuuacuuuauuaaaaguaaaaaaagauauuuuauuggacucacuggcugggaaguuucugcaucacucuuaaaauaacuucucauucaacuggacugaaaguaguuucaguucaaaauucuaaacacucaaaucagacgccaguucccuucuuuuauguucucagaccagagagaggcaucagggugugaagcacacacauucccugcugccaaugccaccuuacccgucaucauucugaggugggaggaaggcagauuucggcuacaauugaaauuaggaaccagauuaagaagagaaacuguacagacuugucaggugaggaacaggcugaucuuuccaacagucuuauguagaaaaggaagcugcuggcccuccuuagcagguggcuacccaccaaagcccuggggcuggggcauaagaggcaggaaaguaaucugaguguuaaaagccaccgggcugggcacagugguuccuguguauaauuuuggcacuuugggaagucgaggcaggauugcuugaggccagccugggcgagaucaucucuagaacaaauaaaaaaaauuagccaggcaugguggugcaugccuauagucccagcugcucgggaggcugaggugggaggaucacuugagcucaggaguuuaaggcugcggugagccaugauugugccaugcacuccagccugggcgacagagugagacccuguccucccaccccgaccaaaaaaacaaaaaaagccggagggauuccaacucccggaaccccaauuuaccaaugugcugucaugucuuagcgacacggagagacacuuugcuuucagaaaccuuaauauguucuuaccucuugacaguacaauucagacaacagacuugcugcuucaaauuuaacaucuucgaacugcgggaucuagugacguccaguuaaggaaguacagacacugcgaaaaaggucgguuugaaagggccacagcuuggggcuccuacccugccaaggucugcagggcacacacgucccugccugcccugaaauuccaaguuuuccuguucccccagugaaccuugagcuugcugcagggcagggcuuggagcuggaugcaagguacgaagagaagcacaaagaggagcacagcgcccaagggcagcagagggccaggugggggacacuccaggugcucugugggccgagccucaacucacagggcaugucgggaggugggauucaagcuuugauacauucuuuuuauuuaaguggagaauuccuuaaagggaaccauaccaacacggaaaggauacuugcugugauaucaaccacugaaaaagaaagaaaacaacgauuaauucucaggcaaacaccuggcaccugguuacuggcucgcucuggggcuuccacagguuguccugagaacagaggcugccagguauccagguaacaagaaggcggcccgcuuggccugagaggguaggcuuacuccccuccaauccagccaggggaauggaagcuauagagccccagugggugccugggcaggaggggacaugcccuucugacaucagaggaggggcucgcacuuggagucagaccccacaggcccaugggugggagcugcuucagaaaggaacagagcucagaggugaccuggccacagcaaggcccccaggugucacacggaaguagggcuggcagucagaggucaggcagagaggaaggacguucagcaaagcauaacacgagaaaucaguuucaacuggagaaugggucuuggggggcaagguuaguccuucugagcaagaggcauuugaaagaugcuuggcuauaagcaaagucagucucucagaggggagggagggggcuccaggaagggcugacacaggcagaacugcgggauggcacugaagaugcacaccaggaaggcaguucagacaacaggcuccaacucagggaccacugugcccuaaaguuccauguuccaacaguucccaggcuaguccaggccacugaccacagcccaucagaccacccagggucccaagcacacaagccuaacgcuguccccagcgacucgcaugugccacacacauucagagcaaccugcaccugacaagagccucggugguugcuggaagguggauccggagcacagcaggagacccuaacucaucgcacucugugggaggacugcauggggcagggcagcauguguggcaaguaugggaagugaggggccaguucuccaggaaaagggggagcaggaggugcuccaggcacugaaaagcccauaaaaaaggcagagggccagggaggugaggcugaagcccgauggucucugccacucaugcggcaacagcggccacuccuagcugagggucagaaugcccuggugucaccccuggaagcugacucagucagggguggaaaaugaaagcaccugcccagaugggaguuuucagaccauccuggaugcagcagagaguauucacgaagggagugcggaggagccagugaggccuggagauccacggcugggggcagccuuggggcuggagaucucuagggcaagggugagcagcagcugggaaugucacaggcacugggaaagcacagagcugcaucgagagcagcuacugccaagacacagggggccaggaggacagcugugggagagagcccgagccccugacacacaugcacccacacgcaggagcccagaccacaggcccucugccagcccaagcgucugccuccugugguccccucuuguggcacggacaggaggggcucgggguccucagaguggcggggccagcaccugccgucagaaguguggccccagaggugaggcuccucagcuagaggcuguguguggggacaguggcaacgugugugaugcaacagaagagcagaaguugggggcuuuuuuccacagaagcugcugcaucccacugagaagccgggucuaacacaagaagcucuggaaggccaccaacuggaagggaugcccaaucacacaggagagaggggacugugacagaggagccguacuagagcugggcugaggucucccugaacccugagauuuggugguucugauuugggcaccauggggcuggcaagggggagcucuucagacacaguccaggguagacagcacugccacacacaagcagcagccccagccugggugagcaaggugcaaaccuggcaccugcagcuaagccuggcaccugugacaaagcuggccccauuucugucacugcaucccagcagagguaagcaaggcgaccagucaacacgugaauucccccuccucccuuugggcggagaagcuuuccuuuccagucuguggccaugggaugcucuccccagagcugacgacagcccacacgugcaugucuguggcggguagacuucaaaaggacauguccagucacuucaugccucagaauacuacacccccuucuacaaagcuuuggccuaugccaccgagcucaggcccauguggguccaacaaugucuccucauagcaacagcuuuuccuuuuuuuugagacacagucucacuguguuguccaggcuggagugcagcaguacaaucagagcucacugcagccuugaccuccugggcugaagugauccucccaccucagccuccugaguagccgggacuacuggugcgaaccaccacgucuggcuaauuuuuuuuauuuuuuguagagauggggucuggcuacgccgcccagacuggucucgaguuccuaggcuugagugauucuccugucuugggcuucaaaggugcugggauuacaggcguuggacaucgugcuuggccagcaacagcuuugugucccuucuccauuuggggccaugauguggcuaacaucaaucuauucagcacacaguuggacuggaccucauuucuccugaccccauggacaucucuucuuuuuuuuuuuugagauggaguuucgcucuuguugcccaggcuggagugcaaugggauaaucucagcucaccgcaaccuccgcuucccagguucaagugauucuccugccucagccucccaaguagcugggauuacaggcaugcgccaccaugccuggcuaauuuuuguauuuucaguagagaugggguuucucuacguuggucaggcuggucucaaacuccugaccucaggugaucugcucgccuuagccucccgaagugcugggauuacaggcgugagccgcagcggcuggccaagacaucucuucuuuacaagccagauaugccugcugcuaacgggcucgccucucugccagcuccguccguccacgggugggcuagacagagaggaucccaucuccccugaggaaggggaggcucucagugagcacuggugagcugggaaguaaugugcccaaaggcuccaaauacaagcauucucuuguggaaggcguccacuagcgucagugggugucaggagcgcugacugggagccagaggauuggguucaagguguggauccacugugaguuagcgaugcucuaaggcacuggagaaauuacauccuagcgcuuuuuaacauccguuucccauguagcuuuaucgcccacuucaaauacauacaaacagaggacauuagauaaagccccucuuuuugugaccggccugggcaacacagcgagacccugucucucgcucuaaaaaaaaaaaaaaaaaaaaaaaaucagccaggcaugguggugcaugcuguaaugccaguuacuugggaggcugacgugggaggaucacuugagcccaggaguuuggggcugcagugagcuaugauugugcuguugcacuccagccugggcaacagggcaagacccugacucuuacaaaaaaaagccccaugauguuugacuuuaaaguuguggcugcaaugccugcagcaagcugacauccaguaggugcucgggaaacaucugcugaucgaacgauggcuuuauccacuuggauaaugaguagaguucauuagaggaaagugagggcuucuguguaagugcaaauggccacagaacggaggcguaugccuuucagacacaaagcccuaaauggcaugggauuucucccugucuuuaaaugccacugcuucuucacugggacaucagugacaccuggaucucucugcaugaggacacacauuccugaagggcaguaugggccuggugucagggugagccagucaauuccccagggccaucaaucugacaccuacuaaaugacuucacuuuuguaucuuuguuagaguuuuguuuuucuuuuuuuuuuguagagacagggaaggucuugcuaugcugcacaggcuggucuugaacuccugggcucaggugaucgucccauuucagccuuccaaaguacugggauugcaguugugagccaccucacccagcccucuguaugacuuguagcauauauuuggaaaucagaaaaauauauccaucucacaaauaaaggauguagaaugccuuacccaagguugcuaccucaucuacgugauuuuuuuuuuuuugagacggaguugcacucugucgcccaggcuggagugcaguggcgcgaucucagcucacugcaagcuccaccucccagguucacgccauucuccugccucagccuccugaguagcugggacuacaggcgcccgccaccacgccuggcuaauuuuucuuuguauuuucaguagaaaucggguuucaccauguuagccaggacggucucggucuccugaccuuguuaucugccugccucggccucccaaagugcugggauuacaggugugagccaccgugcccggguguuuuuuuuuuuuaacuuuguaaugcuaaaaaguagcuuuuauguuuccuuccuuaugauagcaaagcagccaaagugagaggcugcagggagcagggcaaggaggugacugucuccaucagcagccccuggggucaccuuaggguucucagggaaagcaagagaggguugcaacagggccaacagguuucaagugggguggaaggguccagaccagcacagcucuggugccuggaggauucaguccagggcugaguguuucaaggcuucuuauuccuuaaaaccaaaguaacuuuuaaaaaaaaggcuuuuuuugauuguaguuuuuagacaugguaucccucugccacccagggggagugcagugguccucacuguaaccucaaacuccugggcucaagagauccuccuggcucggucucccaaguagcugggacuacaggugcaucucaccagguccuacuaauuuuguuuuuugagaugaauuuucgcucuugcugcccaggcuggagugcaauggugugaucuuggcucauggcacccuccggcucccggguucaagcgauucuccugccucagccucccgaguagcugggauuacaggcaugcgccaucacgccuggcuaauuuuguauuuucaguagagacgggguuucucuauguuggucaggcaggucucgaacuccugaccucaggugaugcacccgccuuggccucccaaagugcugggauuacaggcgugagccauggcgccuggcaggcccaacuaauuguuuuacuuuuuuguagagaugggggucucgcuaucuugcccaggcuggucucaaacuccugggcucaggagauacuaccaccucagccucccaaagugccgggauuacaggcgugagccaccaugccuggccuguuguuguuuuguuuuuauaagagacaggguuggcugggagcaauggcucacgccuguaauccuggcacuuugggaggccaagacagguggacugcuugagcucaggaguuugagaccaaccugggcaacauggcaaaaccccaucucuacaaaauauacaaaaauuagcugggcaugguggugugugccugucacaucagcuacucuggaagcugaggcaaaagaaccacaugagcccaggaggcagaaguggcagggagcuaagauugcgccacugcacuccagccugggugacagagugagacuuuaucucaaaaaaauaaaaaauaaauaaauaaauaaauaaauaaauaauuaaaaagacaggguuuuugucacccaggccggaaugcaguggugcaaucauggcucacuguaaccuugaauucucaggcucaagcacuccuccuacuucagccucccaaguagcugggacuauaggcauguguggcuaauuuuucaauuuuuuuuuuuuuuuaagagacagggucuggcuauguugcccaggcuggucucaaacuccucccgccuuagccucccaaagugcuaggauaacaggcaugagccaccaugccuggcucaaaaucauuuuuuuuuuaaacuacccuauugcuugcaacaccucugggauggaagcacagcauuuagcagcuucccuggccucuugcugcugugugacuguggcuaagcacauucuccugcaguggcugggugucaucacaggugagucugaggugggccuuacccuguuaauuuguugaggauccagggagaccuugcucugugaagcaccaaugcagggccuggcauguaguaggugccaaugaugcuauaguaacuggcaaucaggaaguagaagaaccggggugggagaggaagggaccagcugguagaaccgugaggugaugguuccuaaacagauuucacauccugaagucagaggugacucaagagugagagggaaggaaauagaaacaaaaacaggaggaagcacagaucacuucaugaaacugcguaacggccagcucugcacaagucucugcucccugcagaugggacacggaauuuagcaggacacaguugugauccugaagaaugaaagaacugcuuacgcugggccugaugaggagaggcucagaaccuagcccuguugggucuuaagagaaaaggaagcauuuaaucacuugcugagaaagugaaccauagaugcucaggcuaaaccuggaugcagaauuaaguaucugaccagcacagucuggagcugcuuucuaagucagaugagcaaaaccaccauuaaaaagcagcccuguuccaaccacagagaaagcacgcauggcauugacacagagaaagcaagcauggcauacgcagucagaaaacaccacuguucaaagaaugacugccuggauuauagaaaauaguaaguucuuccagagaggcggcauuuaguccuggguggcuuucaaaccaggaaaaccuaagaaugauggugcacuucccaggccaagggauaaaagggacugugaucagaaguaagaaaguuaaagggguggcugggcgcgguggcucacgccuguaaucccagcacuuugggaggcugaggcgggcggauuacgaggucaggagaucgaaaccauccuggcuaacauggugaaaccccgucucuacuaaaauuacaaaaaauuagccgggcaugguggugggcgccugcagucccagcuacuugggaggcugaggcaggagaauggcaugaacccgggagacggagcuugcagggagccgagaucacgccacugcacuccaaccugggcaacagagugagacucugucucaaaaaaaaaaaaaaaaguuaagggggaaacggauaugcagguacauucucuugauucaacagcagauguccaaaugaccaagauggaucugucugcuuaaaagacaggugggaaaauaagaaaaaagccauagggccuggaagagaggagaagaaugaaaacuuacagggauggguguacagcaagaagagagagaacaagaggaaagcaaaauauagaagaacacaaccugucagaaucugcagaaauggcauugcaaaauuuuuuuuuuuuuuuuuuugagacagggucucucucugucacccagauuggacugcaguggcaggaacacggcucacugaugccucgaccuccugggcucaagugauccucacgccucagcuucccaaguagcuaggacuacagaugugagccaccacgggcccgcuaauuuucaaauuuuuuguagagacaggguagugcccagguuggucacugcgaauucucuagccaagaaaugucuaaguaaagugacaaugcuuauagucaucaacuauuuacuuaggggagucccagagcagccaaaacacacccacaucacugccaaaaccauacucagagaaggaaggcuuucagguaaaguguccugccaugcacuguaacagcuccagaaucugcugagcagacccagggaacaaggcggccggcagguguucugaggcccuacagaggcaagagucaccgagacaccaacuacugugaccccaaaaaagcugcugaggaguucgagaccaguguggccaacauagugaaaccccaucucuaauaaaaguagaggccgggcgcaguggcucacgccuguaaucccagcacuuuggcaggucgaggcggguggaucaugaggucaggagaucaagaccauccuggcuaacacggugaaaccccgucucuacuaaaaauauaaaaaauuagccgggcgugguggcaggcgccuguaguuccagcuacucaggaggcugaggcaggagaauggcaugaacccaggaggcggagcuugcagugagccgagaucgcgccauugcacuccagccugggcgacagagcgagacucugucucaaaauaaauaaauaaauaaauaaauaaauaaauaaauaaauacaaguagaaaaaauuagccuggcaugguggcaggcaccuguaaucccagcugcuugggaggcugaggcaggagaauagucugaaccugagaggcagagguuuuaaugagcugagauugcgccacugcacuccagccugggcaacagagugagaguccaucuaaaaaaaaaaaaaaaaaaagcuccuggggaggcugugugugguggcucacaccuguaaucccagcacuuugagaggccaaggcaggugauugcuugaggcccggaguuuaagaccagccugggcaacacaguuagacccuagcucuauagaaaauauaaaaauaaauacaaucaaauuuuuaaaaaguugcugaggaaaggaagacauacccucuuugacucugauggggauucuuuuuuuaaaguuuugagacagggucucggucuguuguccaggguggagugcaguggcacgaucacagcucacuguagccucaacuuccuggcucaagaauugucuugccuuagccuccugaguagcugggaccagagucaugugccaccaugccugguuaauuuuuguguauauauauauauauguauauauauauauauauacauauauauauuuuuuuuugagacagucucgcucuuucgcccagucuggagugcaguggcgcgaucucagcucacugcaagcuccgccgcccggguucacgccauucuccugccucagccucccgaguagcugggacuacaggcgcccgccaccacgccuggcuaauuuuuguauuuuuuaguagagacaggguuucaccuuguuagccaggauggucucgaucuccugaccucgugauccgcccaccuuggccucccaaagugcugggauuacaggcgugagccaccgcgcccggcuauauuuuuuuuucugguagagacaggguuuugcuauguugccaaggccggucuugaacuccugggcuuaagcaaucugcccacuuuggccucacaaagucuugggauugcaggugugagccaccacaccuggccugauggggacauuuaauggaugauucuuucaaaguuaguugacuugaugaaguagacgaguaaguauguuauauaucuuucuagacgacuuaaaaugcaguugagggccaggcauggugacacacaccuauaaucccagcuacucaggaggcugaggugggaggaucgcuugaacccggagggcggagguuacaaugauuugagauugcgccauugcacuccagccugggcaacaaagugagacucugucucaaaaaaaaaaaaaaaaaaaugcaguugaggagaccauuagaaacugacagaagcagauaaaagagaaauaaccuuaaauaaaaaugugaugaccaaggaggcuggggucucuuagagagaaagcaaaagacagugaaaacaauaggaaagcuggauguagcacugaguucaggggccaauaauagguuuuaccuaagcacuuauguuagagaaaauuaguucagugaagaagagcagagagaugccgggugugguggcaugccuguaaucccggcauuuugggaggcugaggcgggcagaucaccugaggucaggaguucgagaccagcuugacuaacaugaugaaaccuuguuucuacuaaaaauacaaaauuagcugggcaugguggcacaugccuguaauccuagcuacucaggagguugugguaggagaaucguuugaacccgggagguggaguaugcagugagcugaaaucgcaccacugcacuccagccuggguaauaggagugaaacuccuucucaaaaaaaugaaaaauaaaauaggcugggugugguggcucacaccuguaaucccagcacuuugggaggccaaggcggguggaucaccugacgucaggaguucaaggccagccugaccaacguggugaaaccccuucuuuacuaaaaauacaaaaauuagcugggcgugguggugggcgccuguaaucccagcugcuugggaggcugaggcaggagacucgcuugaacccgggaggcagagguugcagugagccaagauugcgccauugcacuccagagccugggugacagagcaagacuacaucucaaaaaauaaauaaauaaaauaaaaguaacaauaaaaauaaaaagaacagcagagagaaugagcaaggagaaaugucacaaacuauugcaaaauacuguuacacuggguuggcucuccaagaagacacuggaaucucuucagccauuugcuuuucagaaguagaaaccagcaaaccaccucuaagcggagaacauacgauucuuuauuaaguagcucuggggaaggaaagaauaaaaguugauagcucccugauugggaaaaaaugcacaauuaauaaagaaugaagaugaaagaaagcaugcuuauguuguaacacaaaaaaaauucacaaacguugguggaaggaaaacaguauagaaaacauuacuuuaacuaaaagcuggaaaaauuuucaguugggaugcgacugacaaaaagaacgggauuuccaggcauaaaguuggcgugagcuacagagggcaccauguggcucaguggaagacccuucaagauucaaaguuccauuugacagagcaaaggcacuucgcaaggagaaggguuuaaauuauggguccaaaagccaagugguaaagcgagcaauuugcagcaugacugcuucuccuagacagggcugagugggcaaaauacgacaguacacacagugacuauuagccacugccagaaacaggcugaacagcccugggagacaagggaaggcagguggugggaguuguucauggagagaaaggagaguuuuagaaccagcacauccacuggagaugcugggccaccagaccccucccagucaauaaagucuggugccucauuugaucucagccucaucaugacccuggagagacccugauaccaucugccaguccccgacagcuuaggcacuccuugccaucaaccugaccccccgagugguucuccaggcucccugccccacccauucaggccucugcucaaaugucacucccacaaauagagacucucucacuaccucugccaaaaauagcuccaagucaacuccaucucuucucccugguucaguucucaagguucuuccaucacugccuaaccucuuacuauaugcuuaucauuugucuuccucaugaaaaccuaggcuuacgugggcagaaacuguuuuagccauugcugaucccccggcaccaaaaauagggcuuggcauccugcaugagcugaacaaguaucuguugaaugaaucaaaggaaaaaaaacuucaccaaaacaauaaugauguaucaucuuggcauguaaccugguuaucacugagcuggaguuugagccuaguuuugucaauaacuuguugugcagccuugggcaaaucacuuuaccucucugggcccauaaugccucccuuuugaaacaaggcaguugaucaagugaggacuaaaguugccuuccacgcugggcacaauggcucaagccuguaguuccagcacuuugggaggcugaggcagguggauggcuugagcucaggaguucaagcccuugucuuuacaaaaaacacaaaaauuagcugggugugguggugcguaccuguggucccaacuacucaggaggcugagaugggaggacugcuugagcccaggaggucaaggcugcagugagcugagaucacgccagugcaccccagccggggugauggagcgagacccugucucaaaauaaauaaauaaauaaauaaauaaaacuggccagauguggugacucacaccuauaauccuagcacuuugggaggacaagaugggcggaucacuugaggucaggaguucgaaaccagccugaccaaauggugaaacucugucucuacuaaaaauacaaaaauuagccagaugauguggugcaagccuguaaucccagcuacucgggaggcugaggcaagagaauugcuugaacccacgagacggaaguugcagugagccaagaccgcgccacugcacuccagccuggugacaaagcgagaaucugucucaaaaaaaaaagaaaaaaaauuaucuggggcugggcgcaguggcucaugccuguaaucucagcacuuugggaggccgaggggaguggaucacaaggucaggaguucaagaccagccuggccaauacugugaacccgucucuacuaaaaauacaaaaauuagcugggugugguggcgcacaccuguagucccagcuacucgggaggcugaggcaggagaaucacuugaacccgggagacggagguugcagugggcugagauccugccauugcgcuacagccccggcaacaagagcgaaacuccgucucaaaauaaacaaauaaauaaaauaaaauaaaauaaagucuccuuccaacuuuucagucugugaaacaaagauuugaucuauuccucaaggcaaguuguuacuagcugagggugggcuuggauuuaccucagauuaaugaguuuuuaaaaucugaguugauucuuuucaauaauuuucuauucaagcaggacagagcuggguaaaagguaaaagggaggcaggggucugacaggaucacagcgcugcugugagaaaaaaacgacuccacagccugaaauuuuauuauuuuuuccuuauuaucuuuuuuuucugagacaggguuucacugucaccaaggcuggagugaaguggcgugaucacugcucacugcagccacgaccucccggggcuuagcugauccucccaccucagccucuggaguagaugggacuacaggcccgcgucaguacgcccagcuaguuuuuguauuuuuuguagagacgggaucucacuguguugcccaggcuggucucaaacuccuggggucuaguaaucugucugccuccgccucccaaaauacugggauuacagacauaagccacugagccuggcccuagaaaguuuauuaaaggggccgggcgcgguggcucaagccuguaaucccagcacugugggaggccgaggugggcagaucaugaggucaggagauggagaccacccuggcuaacacggugaaaccccaucucuacuaaaaaauacaaaaaauuaggcaggcgugguggcgggcgccuguagucucagcuacucaggaggcugaggcaggagaauggccugaacccgggaggcggaacuugcagugagccaagauggcaccacugcacuccagccugggugacagagcaagacuccgucucaaaaaaaaaaaaaaaaagaaaguuuacuaaagggcagaaugacagccacucucccgcauucuuugaggcaccaagaugacacaaaucaaguugggucaggggagggacucacucugacggaagaggauggacugauggaugguagaagucaccaguggauggagaaaaagcaggagcugcuuuuaguuccccuaauacugaaacugaacagcggggccuggaauccagaaccccuguuucuccuccucauaggccucaaaugaccaacuccagacuccgggucucagcuucccucguacgacaccaggcauuauugaugggggcacaagacccuccaaaaaccacgauuaccaaacuucuguguccaaggagaaucaugcccuuccagguuccugagagaccagacuucagauucccgggagaaugccaggggucucgccuucgccaaccccuaccccaagucacuuuagguggaagcguuuggggcugaugcuccggaagcugaaccaggaggagcuaauagcuucaggacccugugauguccccaucgccaccaacaggugggauccuccugaaaaccagacgauuugcggauccuguugcucccaauaacaggcaacuuucagaguacggugacggggcuccuggagcccugucaccagaaacgggaaauaaggcguggggggcgaggcuuucgugucccuugagaggcugguggcuuugggguccggcagaggcggguggggguccugcggcuuugacggaggucgcgcccccaggucgccgaggagcggccccccacccgccgcggucgcgacccgucagcccagaucuugcaaggagcccgcgacuccucccucgcggcccggcccgcgcucaccgccuucuccagguggcugcgcgccugcucgcuguucuugguguggugauagagaacggagcccagcugcagguguguacgggccucgaugcgcugcggcggcuugaaggggaacacggccugcaggcagugcacgcacaggcggauuuugggcgggcuggaagugcggaagugcucagcgaagcccagaagcgccagguaccacgagucggccgccucggccugcgcagccugggccgccgccgccugggccgcugccgccgccugagccgccauuuuggccuccacaacaacaagccgccgccacagggaggc

SEQ ID NO: 191876 - RNA, 18838 nt, Homo sapiens
gggugagugcaccgcguucucgcacgcgucauggugagcgagcgucccgcgaagugggggguucugcagggccgagguccagccgaagggguccagggagacacugagggaauggauugggguuucuucuuggggauuggaggcucugagggauucgggggcacgcugaaggccgugugucccucucugggagcccugcucucgcuacaggaccuccgagggagucggcgggaguuguacccagggggacuagaagccccuaagcguucuggggauucugcccucgagaccuuuuaggggucugggauccuuuugaggggucguggucccacagaggggacuggggaccccagcacauuuggaaccugguuaaggcggugugggguccuguuggggguccacucuggggacggggguccugcaggagcgugggggccgcgccgacaggauccaucgggggucccugcuauaucgggguguguggaacgggcaggggaggccgugggagguggacucaggaggucugguuggccucagggcgggcaagguucucagagugggagacaggaaaguuggaaccuucaggucucacgcggcucuggguccaaccuauugaguguguucuuaaaacuuagcccagccccugggggucaggcuggugcagggagaugggggacucccacaacccugacgggaccggccugggcagagagagggacguggaacuggagggucucugccugggaccauccccgaggaggggcgcuggagauggcccugaaggaagggcacugauggccggaauuauugaaaguggggcgucgucccaggcggaggugcaggacgccguaggagaugaaggcacaggcucccgggaaugaggagggaggcugcauugauuuuaucaggguucuugaguucgagaaucguaaauccagugaagggaaaagaaggagcugauggaagacuccagaaaauucuugcagaugucugcagagcccugacccugagacaggaggcuggguggagggcagggccaucagaacaucccuggacagaccucugggagccuuagguggagagaugcaccccuccaccaccuuuucccuugggggguuuuggggggugguggggucauugaugaagagcccaaagguccaggaagaccucugagacuccagugguugggugcagggagggcugaggagagagcugagcuguggggagguggagggauggucucuagcuaugccugcagggugcagaaccaaguugggggcugacugugagacugggaagggccugaaccaccuggaaggguaugggaugaugggugagugcuagggucucccaggagagccuggaggaggcuacugguugagcucagcagagaggucugggcuggaggugucaccgugcugagguuuugaugggcuggcugauugggugguuaaaacccuggcaggucacaggagagaggucggagagagaggagaaaaacagacuggggggugggagggcaggguccuaggggaaggguggggcuucaacagcccugacccacuggcuugcaggggcccaugggcuggcacucauggucccuaagugccagccagccagucugcacuagggucccggggagggcgagcaaugaggacuuagagaugagaaagaugccgccaccaaccucauuacugaaaaaagauuucuggucucaguuuacaagucacagguacagagaaaauguccuauuagucuguuauuuuauguauuuuuauuuuauuauuauuauuauuuuguuuugagacagagucccacucuguugcccaggcuggagugcaguggcacaaucucggcucacugcaaccucugccucccagguucaagcaauucugcugccucagccucccaaguagcugggauuacaggcgcccaccaccaugucuggcuaauuuuuguauuuuuaguagagacaagguuucaucauguuggccaggcucgucucaaacuccugaccucaagugaucagcccgccucagccucccaacaugcugggauuacaggcacgagccaccgcaccuggccucagcagucauuuugaauuaccgugcuaggcccgguacccaucacauuaggguuuuuccgacuaaauuuagcuuauuuaugccugauuaaaggauuauuuucauaauuaauuuuacuauuaaauaaacuuuauuucauuuugaugauaauuccagaacacuaguagacagcucuccugagcacauaauuuuacauaauuauguaauuacuggcagcaaauggguauuuacugcauucaagcaggaaaacccagcuucaccacagacugauucuucuaaaacguuuaaaaauaaguauaugaaaauguguucugaauuaagaacugggugagaaaauuccuaauuaaaaaaaaaaaaagccuuagcuggguguguuggcacaugacuguaguccuaacuacucgguagguugaggugggaggaucacuugagcccaggaguuugagaccagccuggacaacauagcaagaccccaucucuaaaaauaaaaauaaaaauaggccggacacaguggcucacgccuguaaucccaaccguuugggaggccaaggcaggaggauugcuugagccuaggaguucaagaccagccuggcaacauggagaaacccugucucuacaaaauagacaaaaauuaguuggguaugguggcgagugccuguaaucccagcuacuagggaggcugaugugggagaaucacuugagccugggagguugaggcugcagugagcaccccagcaugccacugcacuccagccugggugacagagcaagacccuguucuccccaccacucccuugccaaaaaaauaaauaaauaaauaaaaauaaauaagcucaccccacucagacauguaggucuucacaccaaaacaggagguggccaggagcauagacgcccuuucaaggagguuaauuacaaagggaagaagagggaggagggugauggaaccaucagggaucacuuaaggugggagacacuuaggggaaggagcuaccaggugaaggagaaagcuagaagcucaaccgagacgcaguggcucccuaggugacaguguggggugcagaaggcggugggagccgcuuucacugaguguggcgggcucgugguuaggggcuggaaggugguggugaggaauacaggagacuacauaggaagcacccauuuccagaugagaaaacugagacuccgggaaauuaauauuauaccugaauccauagcggaggcgggaggcaaaucccauggucuccacugcccuacacucccgcuagguggugaggguggguguugaucucugacgugggagggcagggccaugcuaggugaguccagacucaccccaggacucuccccuaagaagccgcuagagccuaagaggcucgcccuucccccauccagccugacuucucuauaaauagccuggguuccuagggagggagggaacuugugacccucuggcaggugcugccagucauguccccuccccccaggcgguccucggaguacagcugguggugacccugcucacugccacccucaugcacaggcuggcgccacacugcuccuucgcgcgcuggcugcucuguaacggcaggugagccccgccccggcggugggaggggcccgcggagucacgcccccuucuggcuccccacgccccgccucacaaauugcaaagccuugauuuugguuggugggugguggggggaaaaacguuguugagguguaauugaaguacaacaaacugcauauauuuguuuuuucuuuuucuuuuuagagacagggucucacucuguuacccagucuggagugcagugaccugaucauagcucacugcaaccucaaccuccugggcucaagugacccuccugccucaaucuccugaguagcugggacuacaggugugcgccaccaugcccagacaauuuuuaaauuuuuaauagagauggggucuugcuaaguugcccaggcuggucucaaacuccuaggcucaagcgauccuaccacuuuggccucccaaagugcugggauuacaggcgugaguucccaugccugacacaaacuguauauauuugaaguacacaguuggacuaguuuugacagguguacacauguguggaaccaucaccacacuccccacgucccucacucuuccugccucccuguaacccagccuuccuuccaccccugcaucugcuagagcucgccugcucugguuuuuguccuugcgugggucugugaugcuuucugagaaucugguggcaacugaauucucuccugagaaaaauguaugugacaaaaacaaaggcaaaaaaaaaaaacacgucagagaugauagcucaggcccauaaucccaacacugggggaagccaaggugggaggaucacuugaccagccugggcaacauggcaagacccugucucuacaaaauauuuuaaaaauuagccagguaugguggcucacgccugugaucccagcuaaucaggagucugaggcaggaggaucguuugagcccagaaagucaaaucugcagugagcugagauggugccacuguacuccagccugggcgacagaccaaggccuucucucaaaaacaaaaaacaaaggccgggcgagguggcucacaccuguaaucccagcccuuugggaggccggggcggguggaucacuugaggucaggaguuugagaccagccuggccaacauagugaaacccugucucugguaaaaauacaaaaauuagcugggcaugguggcgcaugccuguagucccagcuccucgggaggcugaggcaggagaaucacuugaaccggggaaguggagguugcagugagccaagaucaugccacugcacuccagucugggugacagagggagacucugucucaaaaagaaaaugaaaaagaaaagaaaaguugcacacacuggcuuccccaggagaguuagccagcagauucagggguauccaagcccccggagcccacucagccuagaucuguuggucucacgauuuccccagaauuuccccaugcuguacccucaccuaccucccaguguuccccuggccuaggcuacccucuaacuagaaucccuggauuugggguucacugccucaaccucccaaccccacgccugagcuucccugacugcccguccuugcucucaguuuguuccgauacaagcacccgucugaggaggagcuucgggcccuggcggggaagccgaggcccagaggcaggaaagagcggugagugaccugggccccagccccagccuugggaggguggcuccuccccaggaacggccucaccccugcucagggggcucugggcucagggacacaggaccggcccacccauacuuccaggcgcugaucugggcacaggugaaccgggagacccuaguccaaggagauggucacugucaaguuagcaucuguuuccuggcaguuugcucuagccaguccuguggguggguggggggauccccauaucccagugugcagaggagccaagguuguggaaagagauggucuccaggccagcugcucugagcucugaggguggcuggccucaguggaaugcgugcucaccgucccucuugcuugucaccauccucccaggugggccaauggccuuagugaggagaagccacugucugugccccgagaugccccguuccagcuggagaccugcccccucacgaccguggaugcccuggguaauagcccagucccaucccuaaacucuacucccucagcccugaaggucuccacacccucauggggguggggaggauuugaaggaagaauguucuauuaggaggggagcgagcugggccccagggcugagcagagugccccccacaguccugcgcuucuuccuggaguaccagugguuuguggacuuugcuguguacucgggcggcguguaccucuucacagaggccuacuacuacaugcugggaccagccaaggagacuaacauugcuguguucuggugccugcucacggugaccuucuccauguauccuuccucucugcucccugccaguggggcgggugggagcaggaccugagcuucccuggcuccccuaaacugguguggcaguuuucaccugcugugccacaaacuuccccaagcuuagugacaugaagcagacauuuuaugugcuccagcucuguggguggacagacugggcugggcucagcaggucgguucaucuccacuccacauggucaugcccuuugguggcaguagaaaugccaggaggcaggagggaaugccuugcccaaagucacccaccccaucccuauucuuucuaccacauucuccuuguuuaaggaaaucaccaggccaguccacaaucagggccaagaaagauauggucccuuggcaaaauuuuaaaaaauauauacuccaggcaugguggcucaugcuuguaaucccagcacuuugggaagcugaggcaggcggaucaccugaggucuggaguucaagaccagccuggccaacauggugaaaccccgucucuacuaaaaauacaaaaauuagccaggcgcgguggcucaugccuguaaucccagcacuuugggaggccgaggcagguggaucaucugaggucaggaguucaagaccagccugaccaacauugagaaaccccuucucuacuaaaaguacaaaaauuagccgggggugguggugcauaccuguaaucccagcuacucaggagccugaggcaggagaauugcuugaacccgggagguggagguugcagugagccaagaucaugcuauugcacuccagccugggugacaagagcgaaacuacauccccccaaaaaauuguguguguguguguguguguguguauauauauauauauguguguguguguauguauguacauguauauauauuuguuguuguuguugagacaggaucuugcuuuguugccuaggcugguccugauuggcuucaagugauucuccugccuuggccucccaaagagagcaaauacaugacuuuggggacccaagucugaggaagcacagaaagaaugcuacuccugugacuuuuggagugggaaaccugucuuaaaauccacugguuccccagauucccaugcuuuuuuguuuuuuguuuuguuuuguuuuuugagauggaguuuuacucuuguugcccaggcuggagugcaguggcaugauuuaggcucacuacaaccucugucucccggguucaagugauucuccugccucagccucccaaguagcugggauuacaggcaugcgccaccaugccugacuaauuuuuguauuuuuaguagagacuggguuucaccauguuggucagggcuggucucaaacuccugaccucaggugaucuaccugucucagccucccaaagugcugggauuacaggcaugagccacugcgccuggccuguuguuguuguuugagacaagauaucccucugucgugcaggcuggagugcaguggugcaaucagggcucacugcagcuucaaacuccugggcucaagcgauccucccaccucaggcuccccaguagcugggaccacaggggcuaccacaaaauuauuuuuuguagagaugggggucucacuauguuacccaggcugcucuugaacuccugggcucaagugauccuccugccuuggccucccaaagugcugggauuacaggcaugagccacugugucuggcccccaugcugcauuuugacagcagauuggagaugaagcccuucuauaucugauugcuuuuccaagggaugugaaguaggugaggugggugaaagaggcagggucacccagggcgggaggcuguacagacacgguggccugaugaggccaucucccacucaacgggaacccccagcccacauccugaucugagauccagcaccccaaaaccgaacuccucuaggucauccccaaggccuauuugugcagcagugcuuguucccuggaguucuggggucccagacggaguguggugaaaugggcagaguggggcaguggcaccugaggccuccuuagcuccagccuccagcaagauguuccugacagugacacggcuguacuucagcgccgaggaggggggugagcgcucugucugccucaccuuugccuuccucuuccugcugcuggccaugcuggugcaaguggugcgggaggagacccucgagcugggccuggagccugguaagugcagcccccaacguggggccaccgcagcugucacucccucauguaaucugaccaagaugguuuaacuggcuccguguccagcacgaguaggcaaaggagugggcuccuggggugaaggcaguccccauuagugaccaucucagcuccugaaccuuguugggcuuuggggaagacaggacauugccucucucacugucucugauggacacucauggcuauagcucuuuuuuuuucuuuuuuuuuugagauggaguuucacuuuugucacccaggcaggaguucaguggcaugaucuuggcucacugcaaccucugccuccugcauucaagugauucuccugccucagccucccaagcugggauuaugggugugcaccaccacgccuggcuaauuuuuguauuuuuaguaaagaugggguuucaccauguuggccaggcuggucucaaacuccugaccucaggugauccacccaccucagccuccccaagugcugggauuacagguaugagccacuguguguggccucuuuuuucauuuuuuuaaaaaauuauuuauuuauuuauuuuuauugaaacagggucucacuauguugcccaggcuggucucacacuccugagcucaagcagucugcccgccucagccucccaaauuguuguuauuacaggugugagccaccgugccuggccucuuaaaugauccuuuuaacauauaauuuggaccucaucacuucucugcccggcaccacacucccccggucuuaggagaaagaccauagcccucaccauggcccacaugacccugcugacugcuugaguuuuaccuucuccaauucucccugccuuucaguuuuuaaaauuauauauguuugauauauacaaagaagauguguaugucaauuauaaagcaaaauaaucauaugaguaccugcaaaccuaccccucaaauaauaaguaggugggguagugacugcaccaaucucccaagggggcggcaguaagguuuaaaugaaucaagauccauggauagggcuugauuuuugccaaccuagcccucgucacauggaaugaugcccucuguggccuuaacaugcaugucucugauuaccagggaaguugagcaccuuuuccuguuuauucaugauucaugucucuucugugaaauuuuugugaaauaccuguucacauuguugcccaucuuugaaucuuuuuucucuuugaauuuuuuuucauugugguaaaauagacaaaacauaaaauucaccaucuuaaccauuuuuaaaugugcagcucaguggcauuaaguauauuuagauggccgagcaugguggcucaugccuguaaucccagcacuuugggaggcucaggcaagcagaucaccugaggucgggaguucaagaccagccugaucaacauggagaaacccugucucuacuaaaaauacaaaauuagucgggcguggugacacaugccuguaaucccagcuacuuggauggcugaggcaggagaauugcuugaacccaggaagcggagguuguggugagccaagaucgagccauugugcuccagccugagcaacaagagugaaacuccgucucaaaaaaaaaaaaaaaaaaaaaauguaggccaggugugguggcucacauguguaaucccagcacuuugggaggccaaggcaggcggaucacaaggucaggagaucaagaccauccuggcuaacauggugaaacccugucucuacuaaaaauacaaaaaauuagcuaggcuaauggcacacgccuauagucccagcuacuugggaggcugaggcaggagaauggcgugaaccugguaggcggagcuugcagugagcugagaucgcgccacugcacuccagccugggcgacagagcaagaguccaucucaaaaaaaaaaaaaaaaaaaaagucuauuuagaugucgugcaaccaucaccaccguccaucuccacaacucuuugcucuugcaaaacugaaacuccagcccaucaaacacuaacucccuguuccuccuucuugcagccccugacacccaccauuuuacguccugucucugugaaugugaccacucuggguuccucauauaaguggcaucauacaguauuuguccuuuugugacgugcucauuucaguuagcacaauguccucaaggcauauccauguuguagcagguguuagaauuuuuuuuucuuuuuuugagacaggaucucacucugucaccgaggcuggagugcaguggugcaaucacaacucacugcagccuugaucuccagggcucaagugauccucccaccucagccuuccaaguagcugggaccacaggcacaugccaccacaccuggcuaauuuuuaauuuuuuuuuuuuuuucuguagagauggggucuugcuaugcuucucaggcuggucucaaacuccuggccucgagcaguccucucaccuccgccucccaacgugcugggaugacaggcgugagccacugggcccagccagaauuccauuuuuaagacugaacacugccaggcacgguggcucacgccuguaaucccagcauuuugggaggccaaggcgggcggaucacgaggucaggagaucgagaccauccuggcuaacauggugaaacuccgucucuacuaaaaaaaauacaaaaaauuagccgggugugguggcggguaccuguagucccagcuacucgggaggcugagggaggagaauggugugaacccaggaggcggcgcuugcagugagcuuagauagugccacugcacuccggccugggugaaagagcaagacuccaucucaaaaaaaaaaaaaaaaaaaaagacugaacacuauuucauugucuggguggaacacauuuuguuuauucauccacagaugaaugcuuggguuguucccaacuuuuggcuuuuugacuaauaccgcugugaaccugaguguacagguaucucuuugagaccccauuuucaguuuuggagaguauauauccagaaguggaacugcuggauuauaugauaauucuacuuuuaauuuuuugagggacugccauacuguuuuauacagcagcugaaccauuuuauuuuauuuuugagacagagucucauucuguugcccuggcuggagugcagugguggcgugaucuccacucacugcaaccuuugccucccggauucaagugauucucaugccucaggcucccaaguagcugggacuacaggcucccaccaccacacccagcuaauuuauuuuuuuauuuuuauuuuuauuuuuugagacagucucccucugucacccaggcuagaguacaguggcaugaucuuggcucacugcaaccuccaccuuccaggcucaagugauucucuugccucagccucccaaguagcugggauuacaggugugcgccaccacaccuggcuaauuuuugcauuuuuaguagagaugggguuuugccauguuggccaggcuggucuuuaacuccugaccucaggugauccugcccaucuuggccucccaaagugcugagauuacaggugugagccaccacaucuggcuacacccagauaauuuuuguguuuuuaauagagacagauuuugccauguugcccaggcuagucuugaacucuugaacucaagcaaucgccagccucggccuuccaaagugcugggauuacaggugugcaccacugugcucagcccauuuuauauuuuauauucccagcagcagugcacaaguguuccaaauuuauccacuucauugccaauacuucuuuuguuuucauuugaccacuauuugcauuauuuuccgucugcauacaugcaucacacuuucuuugcugagucgucaaauguaguuguaagugucaccucuagugucuugaugaauggaaguugauuauuuuaguugauauuugucuugaaaaauauccuucccuaaaaucagaaagucauucuacauugucuuuuuuuuuuuuuuugagacagagucucgcucuuucccccaggcuggagugcagugggcgaucucuaguauuuuuuacuagagaugggguuucacuaugcugaccaggcuggucuugaacuccagaccucaggcaauccacccgccucagccucccaaagugcugggauuacaggcgcgagccaccgugcccggccuacuuuuuguauuuuuuacuagagaugggguuucaccacguugaccaggcuggucuugaacuccagaccucaggcaauccaccugccucagccucccaaagugcugggauuacaggcgcuugccaccacgccuggcugaaauauuuuagaagaaaauauagaaugacuggccaggggugguggcucaugccuguaaucccagcacuuugggaggccgagaugggcacaucacgaggucggcagaucgagaccauccuggcuaacaccgugaaaccccgucucuacuaaaaauacaaaaaauuagccaggcgugguggcaggcgccuguagucccagcuacuggggaggcugaggcaggagaauggcgugaacccgggagguggagcuugcagugagccaagaucgcgccacugcacuccagccugggcaacagagcgagacuccgucuaaaaaaaaaaaaaaaaaaaaagcugggcaagguggcaugcaccuguaaucccagcuacucgggaggcugaggcaggagaaucacuugaaccccggaggcagagguugcagugagccgaaaucacgccauugcacucuagccugggcgacaagagcaagacuccaucuuaaaaaucaauaaauaaaauauuucaacuuuuacauuucauauaagcuccuaaacuacucacuguugcugauggacagugacauuaauuuuuguguuaucauauaggggucaaauuugagugucuccacggacuaaccuugcuaaacaauuauauuuuuauugaauugcagauucuuuuugguuuucuuuuguucugucugauccuuccccuuugguguggcuaggaccucuggauuugagaacaguacuggcguaccuccuuuucuuguuuccaauuucucaguuagcuacuuggcucauaaauuuucaaucuuuucuaauuuuauagcauauauagcauuuaaugcuauauauauuuuaccaggucucacuuuuguucaccuaaguuuuuuuuuguuuuuguuuuuguuuugagauggaguuuugcucuugucacccaggcuggagugcaacugugcaaucucagcucacuacaaccucugccuccuggguucaagcaauucuucugccucagccuccugaguagcugggauuacaggugcacgccaccacgccuggcuaauuuuuguauuuuuaguagagacgggguuuuaccauguuggccaggcuggucucaaacuccuaaccucaggugauccacccaccucggccucucaaagugcugggauuacaggugugagccaucacaccuggcaguuuacccaaguuuugacugauauuuuuuauuauucuguuugggguguuuuaacauuucccuucugauuucuguagagauggggucuugcuaugcuuugaccuauggauuauuaaauauuuuuaaauuuuucaaacauagaucuuuaaaaaauacauauuuauuucuagcucaauugcacagauggucuauuugaaauaauuucuuuaaaauuugguaagauuugcccuauggccuggaaugugaucacauuuugugacuauuccuuguuuucuugaaggacauauucuguuuuuguuguuuugccuuuuuucacauguucuaauugaaggacauauucccuggcucuaugaguuuaauaaauucaaaucuccaucuugccuaaccuuuugucugugacuuaucagucagcagaaguuaaucucccucugggacaagagagcucucaauuucccuaucaauucugucaguguuuucuuuauauauuuugcagccuauucacaauucacagauuaguucuauucacagauuuagaacuguuacauuuuccuggugaaucagccauuuuaucaugauguauggaacccuucugucuucuaauacuacuuuuuuuuuuuuugagacagaguuuugcucucguuggccaggcuggagugcaguggcgcaaucucggcucacugcaaccuccaccuccuggguucaagcgauucuccugccucagccucccaaguagcugguauuacccgccaccaugcccagcuauuuuuuggauuuuuaguagagccaggguuucaccauguuggccaggcucgucucgaacuccugacuuugugaucugcccgucuuggccucccaaagugcugagauuacaggugugagccaccgcgccuggccuauucuaauacuacuucuuagucuaguuuggcugguaguaguauagccuuucuagcuugcuuucuuuugauuaguauuugcuguaucuuuuuaacaucccuuuacuuucagucuuccagugacuuuaugucaagguaugucauccuuuaaaaaacauguagcuggauauuuucaauguagucugacagucuuugucauuuaacuuuaaaguuuagucuacuuacauuuauugugauuacugacauauuugacuuuguuucuaccaucuuacuuuuuugcuuucuauuuguuccuuuucuguuguugcaguugacauuggcugucagccuaauuguuguuccuuuguaggugaucugucuuaacucccuggcugcuuuguaauuuuuuuguuuuugguguucugcaguuucacuccauuaugucuagguauggauuucuuuuuauuuacaugguuugauauacuuugugucugucuuucauucugcaaacuucucaaccauucucuuccaguaauuccuuuuauucuucauuccuucucuucccucccucuggggcucugauuugauuugcguugggcucucuguucugucuuccuuaucucuuagccucucuucauauuucucaccuacuuguuuuucugaguuggaaucugagugauuucuucagaucugucuuccaguucaucacuuccuccuuuggcuguuccuaaugugcuguuuaacaaccuauuauuucaauacuuacaguuuuccuuuggaagaguuuaauuugguuccuuugcaacucuacccagucaucugaaggaauucucaugucacuuguucugugauuacagcuuucauuuccuuagucauuugacacauaauugacagcaccaauuucugaagucuuugaggccuaaacuugacuguuguuuuucuguuaacucuccuuuauggugauuuguuuccuuaugcauuuggugauuuugccugugagcucauaugaauuugcuccuuuuuuuuuuuuuuuuugacaaggucuugcucugugcuggagugcaguggcaugaucucagcucacugcaacuuccacauccugggcucaacccauccuucccaccucagccuucacaguagcugggacuauaggcgugcaccaccaccccugguuuuguauuuuuuguagagauggggguuuugccauguugcccaggcuggucucaaacuugugagcucaaacgauccacccgccuuggccucccaaagugcugagacuuacaggugcaagccacugcacccagcccugcucuuaauuuuugaaaaaucuuggguccugaauugaggauuccuuccuccaggaggacuuugguuuucuccugcaggaguccuucaucccccucuagauuccuucuauaaccuagggagcucaggcucaacagauaccccugaauguucccagcccaaucaggagugucugccuggugcauucuguuucguuuucuuugagacugaguuucacucuuguccccaaggcuggagugcaauggugcggucucagcucacugcaaccuccgcuccccauguucaagcgauucuccugccucagccucucaaguagcugggauuacaggcaccugccaccacaccuggcuaauuuuuguauuuuuaguagagacggggguuucacugcauuggccaggcuggucugaaacuccugaucucagaugauccgccugccucagccucccaaagugcugggauuacaggcgugaaccaccacuccaaucuuguuucuuguaaaaaguacuguguaacuagagcacaaaauuguccuugugccuggcucagggccuggcagacccuuguucauuccuacuugggaagcaaacggaugccugagggaugggggguuagggaacagaguggccuuagagacccuaggaauucacucuacucgguccucuucuuaucguccccaggucuggccagcaugacccagaacuuagagccacuucugaagaagcagggcugggacugggcgugaguccugggaaugggggagggaggcaagggcaggcugggacccucccagggucccccaggcaggcucgugaccugguguucuccuaggcuuccuguggccaagcuggcuauccgcgugggacuggcaguggugggcucugugcugggugccuuccucaccuucccaggccugcggcuggcccagacccaccgggacgcacugaccaugucggaggacagacccaugcugcaguuaagugggucgcuugguggguggggggacuagggagcuuaagggagagacucgaggagaggggguacccaggccucacucccuccugcccucaccccccagguuccuccugcacaccagcuuccugucuccccuguucauccuguggcucuggacaaagcccauugcacgggacuuccugcaccagccgccguuuggggagacgcguuucucccugugcguauuggguggggcuaggagguagcuggggcuccccugggugcccuagccucugagauucagggaggagccuggggaagauccuggggggucgggggcgaccuucuuagucccuugcccccggcccucuccgcacaggcuguccgauucugccuucgacucugggcgccucugguugcugguggugcugugccugcugcggcuggcggugacccggccccaccugcaggccuaccugugccuggccaaggcccggguggagcagcugcgaagggaggcuggccgcaucgaagcccgugaaauccagcagaggguauggacgccccgaugaccuaggccagagggaaccuggggcucagggugggguuccugguccuuugggcguggagucgucccaaaccagaaggccuccugcugcagccaccccugcuaccugcccacaggugguccgagucuacugcuaugugaccguggugagcuugcaguaccugacgccgcucauccucacccucaacugcacacuucugcucaagacgcugggugagaugccgcgguguggggguggaggaggggcggaguuggaagauaaaacagaguggagguggacucuggcggggaccgcgguggggggggagaggcggggccuaggcagggggcggagacugugguaaggcagggucugagcaggaagcggagccuggaguggggcuugccuuggacaggaaguggagccuggggaugggugcaaucugagcaggaggcggggccuggguagggggcggggacuguggugaggcagggucugagcaggagguggaguuugggauggcguuugccuuaggagguggagccuggggagggguugcgucuuggcaggaggcggggccuggggagggggcagggcauguauugaggcaggaucugagcaggagguggggccugggguaggguuugccuuggacagggggcagcgccugaggggguggagacugggcuggagauggagucugagacaggggugggagugucuggaggaaugggccuggccccccgugccagcccugucccucgcccccucccccauuuuuccacucauaccucgcuucauccucuucuccuaggaggcuauuccuggggccugggcccagcuccucuacuaucccccgacccauccucagccagcgcugcccccaucggcucuggggaggacgaaguccagcagacugcagcgcggauugccggggcucuggguggccugcuuacuccccucuuccuccguggcguccuggccuaccucaucugguggacggcugccugccagcugcucgccagccuuuucggccucuacuuccaccagcacuuggcaggcuccuagcugccugcagacccuccuggggcccugaggucuguuccuggggcagcgggacacuagccugcccccucuguuugcgcccccguguccccagcugcaagguggggccggacuccccggcguucccuucaccacagugccugacccgcggccccccuuggacgccgaguuucugccucagaacugucucuccugggcccagcagcaugagggucccgaggccauugucuccgaagcguaugugccagguuugaguggcaagggugaugcuggcugcucuucugaacaaauaaaggagcaugccgauuuuua

SEQ ID NO: 191877 - RNA, 18838 nt, Homo sapiens
uaaaaaucggcaugcuccuuuauuuguucagaagagcagccagcaucacccuugccacucaaaccuggcacauacgcuucggagacaauggccucgggacccucaugcugcugggcccaggagagacaguucugaggcagaaacucggcguccaaggggggccgcgggucaggcacuguggugaagggaacgccggggaguccggccccaccuugcagcuggggacacgggggcgcaaacagagggggcaggcuagugucccgcugccccaggaacagaccucagggccccaggagggucugcaggcagcuaggagccugccaagugcugguggaaguagaggccgaaaaggcuggcgagcagcuggcaggcagccguccaccagaugagguaggccaggacgccacggaggaagaggggaguaagcaggccacccagagccccggcaauccgcgcugcagucugcuggacuucguccuccccagagccgaugggggcagcgcuggcugaggaugggucgggggauaguagaggagcugggcccaggccccaggaauagccuccuaggagaagaggaugaagcgagguaugaguggaaaaaugggggagggggcgagggacagggcuggcacggggggccaggcccauuccuccagacacucccaccccugucucagacuccaucuccagcccagucuccacccccucaggcgcugcccccuguccaaggcaaacccuaccccaggccccaccuccugcucagauccugccucaauacaugcccugcccccuccccaggccccgccuccugccaagacgcaaccccuccccaggcuccaccuccuaaggcaaacgccaucccaaacuccaccuccugcucagacccugccucaccacaguccccgcccccuacccaggccccgccuccugcucagauugcacccauccccaggcuccacuuccuguccaaggcaagccccacuccaggcuccgcuuccugcucagacccugccuuaccacagucuccgcccccugccuaggccccgccucuccccccccaccgcgguccccgccagaguccaccuccacucuguuuuaucuuccaacuccgccccuccuccacccccacaccgcggcaucucacccagcgucuugagcagaagugugcaguugagggugaggaugagcggcgucagguacugcaagcucaccacggucacauagcaguagacucggaccaccugugggcagguagcagggguggcugcagcaggaggccuucugguuugggacgacuccacgcccaaaggaccaggaaccccacccugagccccagguucccucuggccuaggucaucggggcguccauacccucugcuggauuucacgggcuucgaugcggccagccucccuucgcagcugcuccacccgggccuuggccaggcacagguaggccugcagguggggccgggucaccgccagccgcagcaggcacagcaccaccagcaaccagaggcgcccagagucgaaggcagaaucggacagccugugcggagagggccgggggcaagggacuaagaaggucgcccccgaccccccaggaucuuccccaggcuccucccugaaucucagaggcuagggcacccaggggagccccagcuaccuccuagccccacccaauacgcacagggagaaacgcgucuccccaaacggcggcuggugcaggaagucccgugcaaugggcuuuguccagagccacaggaugaacaggggagacaggaagcuggugugcaggaggaaccuggggggugagggcaggagggagugaggccuggguacccccucuccucgagucucucccuuaagcucccuaguccccccacccaccaagcgacccacuuaacugcagcaugggucuguccuccgacauggucagugcgucccggugggucugggccagccgcaggccugggaaggugaggaaggcacccagcacagagcccaccacugccagucccacgcggauagccagcuuggccacaggaagccuaggagaacaccaggucacgagccugccugggggacccugggagggucccagccugcccuugccucccucccccauucccaggacucacgcccagucccagcccugcuucuucagaaguggcucuaaguucugggucaugcuggccagaccuggggacgauaagaagaggaccgaguagagugaauuccuagggucucuaaggccacucuguucccuaaccccccaucccucaggcauccguuugcuucccaaguaggaaugaacaagggucugccaggcccugagccaggcacaaggacaauuuugugcucuaguuacacaguacuuuuuacaagaaacaagauuggaguggugguucacgccuguaaucccagcacuuugggaggcugaggcaggcggaucaucugagaucaggaguuucagaccagccuggccaaugcagugaaacccccgucucuacuaaaaauacaaaaauuagccaggugugguggcaggugccuguaaucccagcuacuugagaggcugaggcaggagaaucgcuugaacauggggagcggagguugcagugagcugagaccgcaccauugcacuccagccuuggggacaagagugaaacucagucucaaagaaaacgaaacagaaugcaccaggcagacacuccugauugggcugggaacauucagggguaucuguugagccugagcucccuagguuauagaaggaaucuagagggggaugaaggacuccugcaggagaaaaccaaaguccuccuggaggaaggaauccucaauucaggacccaagauuuuucaaaaauuaagagcagggcugggugcaguggcuugcaccuguaagucucagcacuuugggaggccaaggcggguggaucguuugagcucacaaguuugagaccagccugggcaacauggcaaaacccccaucucuacaaaaaauacaaaaccaggggugguggugcacgccuauagucccagcuacugugaaggcugaggugggaaggauggguugagcccaggauguggaaguugcagugagcugagaucaugccacugcacuccagcacagagcaagaccuugucaaaaaaaaaaaaaaaaaggagcaaauucauaugagcucacaggcaaaaucaccaaaugcauaaggaaacaaaucaccauaaaggagaguuaacagaaaaacaacagucaaguuuaggccucaaagacuucagaaauuggugcugucaauuaugugucaaaugacuaaggaaaugaaagcuguaaucacagaacaagugacaugagaauuccuucagaugacuggguagaguugcaaaggaaccaaauuaaacucuuccaaaggaaaacuguaaguauugaaauaauagguuguuaaacagcacauuaggaacagccaaaggaggaagugaugaacuggaagacagaucugaagaaaucacucagauuccaacucagaaaaacaaguaggugagaaauaugaagagaggcuaagagauaaggaagacagaacagagagcccaacgcaaaucaaaucagagccccagagggagggaagagaaggaaugaagaauaaaaggaauuacuggaagagaaugguugagaaguuugcagaaugaaagacagacacaaaguauaucaaaccauguaaauaaaaagaaauccauaccuagacauaauggagugaaacugcagaacaccaaaaacaaaaaaauuacaaagcagccagggaguuaagacagaucaccuacaaaggaacaacaauuaggcugacagccaaugucaacugcaacaacagaaaaggaacaaauagaaagcaaaaaaguaagaugguagaaacaaagucaaauaugucaguaaucacaauaaauguaaguagacuaaacuuuaaaguuaaaugacaaagacugucagacuacauugaaaauauccagcuacauguuuuuuaaaggaugacauaccuugacauaaagucacuggaagacugaaaguaaagggauguuaaaaagauacagcaaauacuaaucaaaagaaagcaagcuagaaaggcuauacuacuaccagccaaacuagacuaagaaguaguauuagaauaggccaggcgcgguggcucacaccuguaaucucagcacuuugggaggccaagacgggcagaucacaaagucaggaguucgagacgagccuggccaacauggugaaacccuggcucuacuaaaaauccaaaaaauagcugggcaugguggcggguaauaccagcuacuugggaggcugaggcaggagaaucgcuugaacccaggagguggagguugcagugagccgagauugcgccacugcacuccagccuggccaacgagagcaaaacucugucucaaaaaaaaaaaaaguaguauuagaagacagaaggguuccauacaucaugauaaaauggcugauucaccaggaaaauguaacaguucuaaaucugugaauagaacuaaucugugaauugugaauaggcugcaaaauauauaaagaaaacacugacagaauugauagggaaauugagagcucucuugucccagagggagauuaacuucugcugacugauaagucacagacaaaagguuaggcaagauggagauuugaauuuauuaaacucauagagccagggaauauguccuucaauuagaacaugugaaaaaaggcaaaacaacaaaaacagaauauguccuucaagaaaacaaggaauagucacaaaaugugaucacauuccaggccauagggcaaaucuuaccaaauuuuaaagaaauuauuucaaauagaccaucugugcaauugagcuagaaauaaauauguauuuuuuaaagaucuauguuugaaaaauuuaaaaauauuuaauaauccauaggucaaagcauagcaagaccccaucucuacagaaaucagaagggaaauguuaaaacaccccaaacagaauaauaaaaaauaucagucaaaacuuggguaaacugccaggugugauggcucacaccuguaaucccagcacuuugagaggccgagguggguggaucaccugagguuaggaguuugagaccagccuggccaacaugguaaaaccccgucucuacuaaaaauacaaaaauuagccaggcgugguggcgugcaccuguaaucccagcuacucaggaggcugaggcagaagaauugcuugaacccaggaggcagagguuguagugagcugagauugcacaguugcacuccagccugggugacaagagcaaaacuccaucucaaaacaaaaacaaaaacaaaaaaaaacuuaggugaacaaaagugagaccugguaaaauauauauagcauuaaaugcuauauaugcuauaaaauuagaaaagauugaaaauuuaugagccaaguagcuaacugagaaauuggaaacaagaaaaggagguacgccaguacuguucucaaauccagagguccuagccacaccaaaggggaaggaucagacagaacaaaagaaaaccaaaaagaaucugcaauucaauaaaaauauaauuguuuagcaagguuaguccguggagacacucaaauuugaccccuauaugauaacacaaaaauuaaugucacuguccaucagcaacagugaguaguuuaggagcuuauaugaaauguaaaaguugaaauauuuuauuuauugauuuuuaagauggagucuugcucuugucgcccaggcuagagugcaauggcgugauuucggcucacugcaaccucugccuccgggguucaagugauucuccugccucagccucccgaguagcugggauuacaggugcaugccaccuugcccagcuuuuuuuuuuuuuuuuuuuuuagacggagucucgcucuguugcccaggcuggagugcaguggcgcgaucuuggcucacugcaagcuccaccucccggguucacgccauucuccugccucagccuccccaguagcugggacuacaggcgccugccaccacgccuggcuaauuuuuuguauuuuuaguagagacgggguuucacgguguuagccaggauggucucgaucugccgaccucgugaugugcccaucucggccucccaaagugcugggauuacaggcaugagccaccaccccuggccagucauucuauauuuucuucuaaaauauuucagccaggcgugguggcaagcgccuguaaucccagcacuuugggaggcugaggcagguggauugccugaggucuggaguucaagaccagccuggucaacguggugaaaccccaucucuaguaaaaaauacaaaaaguaggccgggcacgguggcucgcgccuguaaucccagcacuuugggaggcugaggcggguggauugccugaggucuggaguucaagaccagccuggucagcauagugaaaccccaucucuaguaaaaaauacuagagaucgcccacugcacuccagccugggggaaagagcgagacucugucucaaaaaaaaaaaaaaagacaauguagaaugacuuucugauuuuagggaaggauauuuuucaagacaaauaucaacuaaaauaaucaacuuccauucaucaagacacuagaggugacacuuacaacuacauuugacgacucagcaaagaaagugugaugcauguaugcagacggaaaauaaugcaaauaguggucaaaugaaaacaaaagaaguauuggcaaugaaguggauaaauuuggaacacuugugcacugcugcugggaauauaaaauauaaaaugggcugagcacaguggugcacaccuguaaucccagcacuuuggaaggccgaggcuggcgauugcuugaguucaagaguucaagacuagccugggcaacauggcaaaaucugucucuauuaaaaacacaaaaauuaucuggguguagccagaugugguggcucacaccuguaaucucagcacuuugggaggccaagaugggcaggaucaccugaggucaggaguuaaagaccagccuggccaacauggcaaaaccccaucucuacuaaaaaugcaaaaauuagccaggugugguggcgcacaccuguaaucccagcuacuugggaggcugaggcaagagaaucacuugagccuggaagguggagguugcagugagccaagaucaugccacuguacucuagccugggugacagagggagacugucucaaaaaauaaaaauaaaaauaaaaaaauaaauuagcugggugugguggugggagccuguagucccagcuacuugggagccugaggcaugagaaucacuugaauccgggaggcaaagguugcagugaguggagaucacgccaccacugcacuccagccagggcaacagaaugagacucugucucaaaaauaaaauaaaaugguucagcugcuguauaaaacaguauggcagucccucaaaaaauuaaaaguagaauuaucauauaauccagcaguuccacuucuggauauauacucuccaaaacugaaaauggggucucaaagagauaccuguacacucagguucacagcgguauuagucaaaaagccaaaaguugggaacaacccaagcauucaucuguggaugaauaaacaaaauguguuccacccagacaaugaaauaguguucagucuuuuuuuuuuuuuuuuuuuuugagauggagucuugcucuuucacccaggccggagugcaguggcacuaucuaagcucacugcaagcgccgccuccuggguucacaccauucuccucccucagccucccgaguagcugggacuacagguacccgccaccacacccggcuaauuuuuuguauuuuuuuuaguagagacggaguuucaccauguuagccaggauggucucgaucuccugaccucgugauccgcccgccuuggccucccaaaaugcugggauuacaggcgugagccaccgugccuggcaguguucagucuuaaaaauggaauucuggcugggcccaguggcucacgccugucaucccagcacguugggaggcggaggugagaggacugcucgaggccaggaguuugagaccagccugagaagcauagcaagaccccaucucuacagaaaaaaaaaaaaaaauuaaaaauuagccaggugugguggcaugugccuguggucccagcuacuuggaaggcugaggugggaggaucacuugagcccuggagaucaaggcugcagugaguugugauugcaccacugcacuccagccucggugacagagugagauccugucucaaaaaaagaaaaaaaaauucuaacaccugcuacaacauggauaugccuugaggacauugugcuaacugaaaugagcacgucacaaaaggacaaauacuguaugaugccacuuauaugaggaacccagaguggucacauucacagagacaggacguaaaauggugggugucaggggcugcaagaaggaggaacagggaguuaguguuugaugggcuggaguuucaguuuugcaagagcaaagaguuguggagauggacgguggugaugguugcacgacaucuaaauagacuuuuuuuuuuuuuuuuuuuuugagauggacucuugcucugucgcccaggcuggagugcaguggcgcgaucucagcucacugcaagcuccgccuaccagguucacgccauucuccugccucagccucccaaguagcugggacuauaggcgugugccauuagccuagcuaauuuuuuguauuuuuaguagagacaggguuucaccauguuagccaggauggucuugaucuccugaccuugugauccgccugccuuggccucccaaagugcugggauuacacaugugagccaccacaccuggccuacauuuuuuuuuuuuuuuuuuuuuugagacggaguuucacucuuguugcucaggcuggagcacaauggcucgaucuuggcucaccacaaccuccgcuuccuggguucaagcaauucuccugccucagccauccaaguagcugggauuacaggcaugugucaccacgcccgacuaauuuuguauuuuuaguagagacaggguuucuccauguugaucaggcuggucuugaacucccgaccucaggugaucugcuugccugagccucccaaagugcugggauuacaggcaugagccaccaugcucggccaucuaaauauacuuaaugccacugagcugcacauuuaaaaaugguuaagauggugaauuuuauguuuugucuauuuuaccacaaugaaaaaaaauucaaagagaaaaaagauucaaagaugggcaacaaugugaacagguauuucacaaaaauuucacagaagagacaugaaucaugaauaaacaggaaaaggugcucaacuucccugguaaucagagacaugcauguuaaggccacagagggcaucauuccaugugacgagggcuagguuggcaaaaaucaagcccuauccauggaucuugauucauuuaaaccuuacugccgcccccuugggagauuggugcagucacuaccccaccuacuuauuauuugagggguagguuugcagguacucauaugauuauuuugcuuuauaauugacauacacaucuucuuuguauauaucaaacauauauaauuuuaaaaacugaaaggcagggagaauuggagaagguaaaacucaagcagucagcagggucaugugggccauggugagggcuauggucuuucuccuaagaccgggggaguguggugccgggcagagaagugaugagguccaaauuauauguuaaaaggaucauuuaagaggccaggcacgguggcucacaccuguaauaacaacaauuugggaggcugaggcgggcagacugcuugagcucaggagugugagaccagccugggcaacauagugagacccuguuucaauaaaaauaaauaaauaaauaauuuuuuaaaaaaaugaaaaaagaggccacacacaguggcucauaccuguaaucccagcacuuggggaggcugagguggguggaucaccugaggucaggaguuugagaccagccuggccaacauggugaaaccccaucuuuacuaaaaauacaaaaauuagccaggcgugguggugcacacccauaaucccagcuugggaggcugaggcaggagaaucacuugaaugcaggaggcagagguugcagugagccaagaucaugccacugaacuccugccugggugacaaaagugaaacuccaucucaaaaaaaaaagaaaaaaaaagagcuauagccaugaguguccaucagagacagugagagaggcaauguccugucuuccccaaagcccaacaagguucaggagcugagauggucacuaauggggacugccuucaccccaggagcccacuccuuugccuacucgugcuggacacggagccaguuaaaccaucuuggucagauuacaugagggagugacagcugcgguggccccacguugggggcugcacuuaccaggcuccaggcccagcucgagggucuccucccgcaccacuugcaccagcauggccagcagcaggaagaggaaggcaaaggugaggcagacagagcgcucaccccccuccucggcgcugaaguacagccgugucacugucaggaacaucuugcuggaggcuggagcuaaggaggccucaggugccacugccccacucugcccauuucaccacacuccgucugggaccccagaacuccagggaacaagcacugcugcacaaauaggccuuggggaugaccuagaggaguucgguuuuggggugcuggaucucagaucaggaugugggcuggggguucccguugagugggagauggccucaucaggccaccgugucuguacagccucccgcccugggugacccugccucuuucacccaccucaccuacuucacaucccuuggaaaagcaaucagauauagaagggcuucaucuccaaucugcugucaaaaugcagcaugggggccagacacaguggcucaugccuguaaucccagcacuuugggaggccaaggcaggaggaucacuugagcccaggaguucaagagcagccuggguaacauagugagacccccaucucuacaaaaaauaauuuugugguagccccuguggucccagcuacuggggagccugaggugggaggaucgcuugagcccaggaguuugaagcugcagugagcccugauugcaccacugcacuccagccugcacgacagagggauaucuugucucaaacaacaacaacaggccaggcgcaguggcucaugccuguaaucccagcacuuugggaggcugagacagguagaucaccugaggucaggaguuugagaccagcccugaccaacauggugaaacccagucucuacuaaaaauacaaaaauuagucaggcaugguggcgcaugccuguaaucccagcuacuugggaggcugaggcaggagaaucacuugaacccgggagacagagguuguagugagccuaaaucaugccacugcacuccagccugggcaacaagaguaaaacuccaucucaaaaaacaaaacaaaacaaaaaacaaaaaagcaugggaaucuggggaaccaguggauuuuaagacagguuucccacuccaaaagucacaggaguagcauucuuucugugcuuccucagacuuggguccccaaagucauguauuugcucucuuugggaggccaaggcaggagaaucacuugaagccaaucaggaccagccuaggcaacaaagcaagauccugucucaacaacaacaacaaauauauauacauguacauacauacacacacacacauauauauauauauacacacacacacacacacacacacaauuuuuuggggggauguaguuucgcucuugucacccaggcuggagugcaauagcaugaucuuggcucacugcaaccuccaccucccggguucaagcaauucuccugccucaggcuccugaguagcugggauuacagguaugcaccaccacccccggcuaauuuuuguacuuuuaguagagaagggguuucucaauguuggucaggcuggucuugaacuccugaccucagaugauccaccugccucggccucccaaagugcugggauuacaggcaugagccaccgcgccuggcuaauuuuuguauuuuuaguagagacgggguuucaccauguuggccaggcuggucuugaacuccagaccucaggugauccgccugccucagcuucccaaagugcugggauuacaagcaugagccaccaugccuggaguauauauuuuuuaaaauuuugccaagggaccauaucuuucuuggcccugauuguggacuggccuggugauuuccuuaaacaaggagaaugugguagaaagaauagggauggggugggugacuuugggcaaggcauucccuccugccuccuggcauuucuacugccaccaaagggcaugaccauguggaguggagaugaaccgaccugcugagcccagcccagucuguccacccacagagcuggagcacauaaaaugucugcuucaugucacuaagcuuggggaaguuuguggcacagcaggugaaaacugccacaccaguuuaggggagccagggaagcucagguccugcucccacccgccccacuggcagggagcagagaggaaggauacauggagaaggucaccgugagcaggcaccagaacacagcaauguuagucuccuuggcuggucccagcauguaguaguaggccucugugaagagguacacgccgcccgaguacacagcaaaguccacaaaccacugguacuccaggaagaagcgcaggacuguggggggcacucugcucagcccuggggcccagcucgcuccccuccuaauagaacauucuuccuucaaauccuccccacccccaugaggguguggagaccuucagggcugagggaguagaguuuagggaugggacugggcuauuacccagggcauccacggucgugagggggcaggucuccagcuggaacggggcaucucggggcacagacaguggcuucuccucacuaaggccauuggcccaccugggaggauggugacaagcaagagggacggugagcacgcauuccacugaggccagccacccucagagcucagagcagcuggccuggagaccaucucuuuccacaaccuuggcuccucugcacacugggauauggggauccccccacccacccacaggacuggcuagagcaaacugccaggaaacagaugcuaacuugacagugaccaucuccuuggacuagggucucccgguucaccugugcccagaucagcgccuggaaguaugggugggccgguccugugucccugagcccagagcccccugagcaggggugaggccguuccuggggaggagccacccucccaaggcuggggcuggggcccaggucacucaccgcucuuuccugccucugggccucggcuuccccgccagggcccgaagcuccuccucagacgggugcuuguaucggaacaaacugagagcaaggacgggcagucagggaagcucaggcgugggguugggagguugaggcagugaaccccaaauccagggauucuaguuagaggguagccuaggccaggggaacacugggagguaggugaggguacagcauggggaaauucuggggaaaucgugagaccaacagaucuaggcugagugggcuccgggggcuuggauaccccugaaucugcuggcuaacucuccuggggaagccagugugugcaacuuuucuuuucuuuuucauuuucuuuuugagacagagucucccucugucacccagacuggagugcaguggcaugaucuuggcucacugcaaccuccacuuccccgguucaagugauucuccugccucagccucccgaggagcugggacuacaggcaugcgccaccaugcccagcuaauuuuuguauuuuuaccagagacaggguuucacuauguuggccaggcuggucucaaacuccugaccucaagugauccacccgccccggccucccaaagggcugggauuacaggugugagccaccucgcccggccuuuguuuuuuguuuuugagagaaggccuuggucugucgcccaggcuggaguacaguggcaccaucucagcucacugcagauuugacuuucugggcucaaacgauccuccugccucagacuccugauuagcugggaucacaggcgugagccaccauaccuggcuaauuuuuaaaauauuuuguagagacagggucuugccauguugcccaggcuggucaagugauccucccaccuuggcuucccccaguguugggauuaugggccugagcuaucaucucugacguguuuuuuuuuuuugccuuuguuuuugucacauacauuuuucucaggagagaauucaguugccaccagauucucagaaagcaucacagacccacgcaaggacaaaaaccagagcaggcgagcucuagcagaugcagggguggaaggaaggcuggguuacagggaggcaggaagagugagggacguggggaguguggugaugguuccacacauguguacaccugucaaaacuaguccaacuguguacuucaaauauauacaguuugugucaggcaugggaacucacgccuguaaucccagcacuuugggaggccaaagugguaggaucgcuugagccuaggaguuugagaccagccugggcaacuuagcaagaccccaucucuauuaaaaauuuaaaaauugucugggcaugguggcgcacaccuguagucccagcuacucaggagauugaggcaggagggucacuugagcccaggagguugagguugcagugagcuaugaucaggucacugcacuccagacuggguaacagagugagacccugucucuaaaaagaaaaagaaaaaacaaauauaugcaguuuguuguacuucaauuacaccucaacaacguuuuuccccccaccacccaccaaccaaaaucaaggcuuugcaauuugugaggcggggcguggggagccagaagggggcgugacuccgcgggccccucccaccgccggggcggggcucaccugccguuacagagcagccagcgcgcgaaggagcaguguggcgccagccugugcaugaggguggcagugagcagggucaccaccagcuguacuccgaggaccgccuggggggaggggacaugacuggcagcaccugccagagggucacaaguucccucccucccuaggaacccaggcuauuuauagagaagucaggcuggaugggggaagggcgagccucuuaggcucuagcggcuucuuaggggagaguccuggggugagucuggacucaccuagcauggcccugcccucccacgucagagaucaacacccacccucaccaccuagcgggaguguagggcaguggagaccaugggauuugccucccgccuccgcuauggauucagguauaauauuaauuucccggagucucaguuuucucaucuggaaaugggugcuuccuauguagucuccuguauuccucaccaccaccuuccagccccuaaccacgagcccgccacacucagugaaagcggcucccaccgccuucugcaccccacacugucaccuagggagccacugcgucucgguugagcuucuagcuuucuccuucaccugguagcuccuuccccuaagugucucccaccuuaagugaucccugaugguuccaucacccuccucccucuucuucccuuuguaauuaaccuccuugaaagggcgucuaugcuccuggccaccuccuguuuuggugugaagaccuacaugucugaguggggugagcuuauuuauuuuuauuuauuuauuuauuuuuuuggcaagggagugguggggagaacagggucuugcucugucacccaggcuggagugcaguggcaugcuggggugcucacugcagccucaaccucccaggcucaagugauucucccacaucagccucccuaguagcugggauuacaggcacucgccaccauacccaacuaauuuuugucuauuuuguagagacaggguuucuccauguugccaggcuggucuugaacuccuaggcucaagcaauccuccugccuuggccucccaaacgguugggauuacaggcgugagccacuguguccggccuauuuuuauuuuuauuuuuagagauggggucuugcuauguuguccaggcuggucucaaacuccugggcucaagugauccucccaccucaaccuaccgaguaguuaggacuacagucaugugccaacacacccagcuaaggcuuuuuuuuuuuuuaauuaggaauuuucucacccaguucuuaauucagaacacauuuucauauacuuauuuuuaaacguuuuagaagaaucagucuguggugaagcuggguuuuccugcuugaaugcaguaaauacccauuugcugccaguaauuacauaauuauguaaaauuaugugcucaggagagcugucuacuaguguucuggaauuaucaucaaaaugaaauaaaguuuauuuaauaguaaaauuaauuaugaaaauaauccuuuaaucaggcauaaauaagcuaaauuuagucggaaaaacccuaaugugauggguaccgggccuagcacgguaauucaaaaugacugcugaggccaggugcgguggcucgugccuguaaucccagcauguugggaggcugaggcgggcugaucacuugaggucaggaguuugagacgagccuggccaacaugaugaaaccuugucucuacuaaaaauacaaaaauuagccagacaugguggugggcgccuguaaucccagcuacuugggaggcugaggcagcagaauugcuugaaccugggaggcagagguugcagugagccgagauugugccacugcacuccagccugggcaacagagugggacucugucucaaaacaaaauaauaauaauaauaaaauaaaaauacauaaaauaacagacuaauaggacauuuucucuguaccugugacuuguaaacugagaccagaaaucuuuuuucaguaaugagguugguggcggcaucuuucucaucucuaaguccucauugcucgcccuccccgggacccuagugcagacuggcuggcuggcacuuagggaccaugagugccagcccaugggccccugcaagccagugggucagggcuguugaagccccacccuuccccuaggacccugcccucccaccccccagucuguuuuucuccucucucuccgaccucucuccugugaccugccaggguuuuaaccacccaaucagccagcccaucaaaaccucagcacggugacaccuccagcccagaccucucugcugagcucaaccaguagccuccuccaggcucuccugggagacccuagcacucacccaucaucccauacccuuccaggugguucaggcccuucccagucucacagucagcccccaacuugguucugcacccugcaggcauagcuagagaccaucccuccaccuccccacagcucagcucucuccucagcccucccugcacccaaccacuggagucucagaggucuuccuggaccuuugggcucuucaucaaugaccccaccaccccccaaaaccccccaagggaaaaggugguggaggggugcaucucuccaccuaaggcucccagaggucuguccagggauguucugauggcccugcccuccacccagccuccugucucagggucagggcucugcagacaucugcaagaauuuucuggagucuuccaucagcuccuucuuuucccuucacuggauuuacgauucucgaacucaagaacccugauaaaaucaaugcagccucccuccucauucccgggagccugugccuucaucuccuacggcguccugcaccuccgccugggacgacgccccacuuucaauaauuccggccaucagugcccuuccuucagggccaucuccagcgccccuccucggggauggucccaggcagagacccuccaguuccacgucccucucucugcccaggccggucccgucaggguugugggagucccccaucucccugcaccagccugacccccaggggcugggcuaaguuuuaagaacacacucaauagguuggacccagagccgcgugagaccugaagguuccaacuuuccugucucccacucugagaaccuugcccgcccugaggccaaccagaccuccugaguccaccucccacggccuccccugcccguuccacacaccccgauauagcagggacccccgauggauccugucggcgcggcccccacgcuccugcaggacccccguccccagaguggacccccaacaggaccccacaccgccuuaaccagguuccaaaugugcugggguccccaguccccucugugggaccacgaccccucaaaaggaucccagaccccuaaaaggucucgagggcagaauccccagaacgcuuaggggcuucuagucccccuggguacaacucccgccgacucccucggagguccuguagcgagagcagggcucccagagagggacacacggccuucagcgugcccccgaaucccucagagccuccaauccccaagaagaaaccccaauccauucccucagugucucccuggaccccuucggcuggaccucggcccugcagaaccccccacuucgcgggacgcucgcucaccaugacgcgugcgagaacgcggugcacucaccc

SEQ ID NO: 191878 - RNA, 11152 nt, Homo sapiens
gccacgcuuagaaauguaaucgggggaucuagaaauucuacacaaugagaagcucaaaaacagccccaaagcugccaacaaccagagccgacuggggcccaccccagcccagcccggcccggcccacccagggcuaaguugggaccccccagucccuuuccaggacgaaugggcccaacuaugccgccugcagccuggcccgcaucccaggccggaaucguucauagaaaaccagccccggcucagggcgcagccucagccaggcgggccaggcccucacgcagcucacucagcucaaacaggcugacguccagcagcugcgcugcccggcccaccucagcccgcgcccgcucccgcucugcccgugccuccuccaggcugcgcuccaucgcccgcagcuggugcuccaacuccgcauugcgggucuccagguccugccaggaaagggugggcaggguugggggccccaacaaaucaccaguccugcccgaggcauccagagucugaccaccuucaugucccucuucugcccagagccauccuagggcgcccaacacaccaggaauaaaaugcacaccccacaggggccuagcuucugcccucauuucuuuuguuuguuuguuuguuuuugagaaggaguuucgcucuugucgcccaggcuggagugcaauggcgugaucucggcucacuacaaccuccgccucccagguucaagcaauucuccugccucagccucccaaguagcugggauuacaggcauacaccaccacgcccagugauggcuuacaccuguaaucccagaacuuugggaggcggaggcagguggauccccugaggucaggaguucaagaccagcuuggccaacaugguaaaacuccaucucuacuaaaaauacaaaaauuagcugggcaugguggugcacaccuguagucccagcuacucuggaggcugaggcaggagaaucgcuugagcucagaaggcggagcuugcagugagccgagaucgcgccacugcacuccagccugggugacagagugagacuccaucucaaaaaaaaaaaaaaaaggcugggcgcagugguuuacgccuauaaucccagcacuuugggaggccgaggcgaguggaucauaaggucaagagaucgagacuauccuggcuaacauggugaaaccccgucucuaccaaaaaauacaaaaaauuagccgggcaugguggcgagcaccuguaguuccagcuacucgggaggcugaggcaggagaauggagugaaccugggaggcggagcuugcgccacugcacuccagccugggcaacagagugagacuccgucucaaaaaaaaaaaaaaguacccccugaacauuucucagauaaagccuuuagcaaaagccaagccaaggccagucguggugacucaagccuauaaucccagcacuuugggaggcugagggcagauugcucacggucaggaguucgagaccagucuggccaacaugaggaaaccccaucucuacuaaaaacacaaaaaaugcccgggcacgguggcgcaugucuguaaucccagcacuuugggaggccgaggcgggcaaaucaugagaucaggaguugagaccagccuggccaacauggugaaacccugucucuacuaaaaauacaaaaaauuagcuggguguaguggcgggcgccuguaaucccagcuacucaggaggcugaggcaggagaauugcuucaacccgggagguggagguugcagugagcugagaucgugccauugcacuccagccugggcaacagagcgagacuccaucucaaagaauuaaaaaaaaauaaagccaagccaagccagaccuaguuccaaugcaggcucugugaucucaggcugagaacaggaggaauugacggggucuggcaugggaauacagcaggaacucaagcauugcuuguugaacccauagauggauaugaaacuguaccaacagccacuguucacgcggcaccugcugggcaucaggccuuccacaggacugggccucccaauacuuuaucaucuuagguagauauuguccugagugucuguugaggugacugucacccaccgucaccccaccuccuugugcccacacacaccugcaccuucugcugagucuccucacgcucggcagccuccagggccucgcggggccccccagucugacucuucagggucugaaucuccuagaggagaagaguucccagggucuguugcggggguccuggcuuucccacaggaggugagggaaggcgaggcccaggaaccacacuuggcacucaccugguccuugguuugcaccagagcuuccagcuguuccagcgacuggcccuggcccagccccuccuucucaccggugggggucaccucugaagcugccugagccuccagcucagccaccuguagggcaggaauagcagccccugacgcccccgccugcacucucccuugcucgcccaaccucuagggaaucugccuccugucuggccacgcccaggaccgagcacccaucucccuugguuggugccaccaccccccucugcacagcuuggacuuuagugucugaucacccucugaggcuggcauugucucaaacccauuuuacagagcaagaaacugaggcugggucagugaccugcugaggucacacagcuaguccaugaacccagggcagaugggaacugccgaggcgcggucuccacaguugcccgggccaggugggggucucucggagggaggggugcccucacccgcugccgcagccgcucggccucugcacgcugagccuccagcugcugccuccacugggcugcggcggcguuggccucucgcagggcgccugccagcuuguuguugcuguccugcagugcgaaaaacucggccucccacuguaccucgcccacggagcugcagagacacgagggucggcagugggugacacggggcuggggggcggagucgggcgaugcugggcuagggggcggggccaggggugggauagcucugggcuuaggucagggcgaaggcuggcgagggugcggagucgugcgcgaaguuggacuagggggcggggcagggguggaguggcacugggcugggggcggagucagcggcaaugcucgguuagggggcggggccaggguggguggcgcugggcugaggcggagucacgggcgaugcugggcuagggggcggggccagaggagggguggcuuugggcuagggcacggagucagggccacgcagggcuggggauguggcgacacugauugcugagcuuggggauggggcagucccgcagaagcggggucuugucgaggaccgagucaaagaagggggcacguggaguccgcccagugacacugugggaauguugagggagggaugggagguuggggagagucagccgaugggggcguggucagggugguuauccuaagaccagagaggcaucgacggggcgagguuagcagcgagaagagacagggauggggucaaaacagaggggcguggccaacgcaggguaggggcggggucggcucuggauggggcagcauucagauccucauccccuuccccaggucuugaguccacaguuagaucccgccguccuggcacucccuuggcuuccaagaaccgccuccucgucccccaccccuacccccgccccugccacgcccccaagucccgccccucaccccucagacaacaucuucuuuagccgcucgcgcucuguggggccgggggcaucagcgcucuggcugcggaacaguuuuuccucgccggggccguuggcacugacgagagggcucgggggcaccuaggcacggggaaaagaauaggucacgaccccacaucagcugggaucaaggcugaugugacuggggucgucacaucgggggugcaauugaccuaugcacccuaagcagguccuucacagcacaggauccaagugugucccuccccaccucacccacccuccauggcucccuguggccccuaagcugggaguuccaugcccacgcccucgaccuugccuuccugggcuuucaccacccccaggagcaagucugaugcagguuagucuaaaccaagauacuuagaaccuguaagguaggggagggguacaaucggacaccucccugcuguucccuucccugaggccgaacuucaacaucacguuuaggauuucagcaggaagcccugcccaggccgaauucguguuucgugagcaaccccacugccuggaccacuggcucugaggguagacaagcuggcgggugcccugcgagaggccagcgccaccgcagcccagugcaggcagcagcuggaggcucaugcuuuuuuucaucucuccaaccccugugcacagcccucggccugguacacagcaggugcucaauaaauaaugcugaauaaauuaaugugggaaaacacgcagggacaguucguuguucugccucacacuuagccauuucuuucuuucuuuuuuuuuuugagacagagucacacucugucacccaggcuggagugcaguggcacgaucucggcucacugcaaccuccaucuccuggguucaagcgauucuccugccucagccucccgaguagcugggacuacaggcgcaugccaccacgccuggcuaauuuuuguauuuuuuagcagagguggaguaucaccauguuggccaggcuggucucgaacucuuggccucaagucauccucccuccucagccucccaaauugcugggauuacaggcgugagccaccgcacccggccacacuuagccauuucaauuucuagucuuccauccugccaucugagcugguuuugcuacugggaccuacuggguguaccccaccggccccaggcaagguccagacccucuaugacacacuccacaccacuccucuguggucccugcugugggucuaaccuuaggucaucuggaagcauugggucuugacgaccagcagagugccccggucucccaauaucaaggucccccaauaucaguugagcgccuggcugacucacaggugcccaggcaggcauaggggaguagggagugcugaccuggugggaggcgagccccagggcuggacuggugagcuccccgccauccugagauuucucccuggccagccuggcugcuuccuucacuuccuggaacuucucggcaaacuaagggaguggggaggaaaagacaguaaaaccccagcccauccucccaaacaggucaccaucacucagugacagccccgccacuuucgaaccguacccauccccuuaucacacaccuuggaagaaggagagaaacuuugaaaaaugauguaccauggugggugggcagguggcaucagaucacagagguggcauuuaaauacauugggccacauugagaaagggaaaggaauucccauguccucuuuuuaggaaagggucucacuuugucacccaggcugcaguacaguggcaugaucucggcucacugcagccuugaccucccuggcucaagugacccuuccaccuuaccccuccaccaaggagcugggacuacaggugugugccaucaugcccggcuaauuuuuucuagagacggggucuagccauguuccccagaauggcccuuuuccuguuuuuuguuuuuuuuuuuuuugagauggagucuugcucuguugcccaggcuggagugcagugacaugaucuuggcucacggcagccucugcuucagccucaugaguagcugggauuacaggcaugcaccagcaugccuggcuaauuuucauauuuuuaguagagaugugguuuuaccauguuggccaggcugaucuuaaauucccggcuugaagugauccgccugccucagccucccaaaguggugggauuacaggcacagcacccagccuuuuuuuuuuuuuuuuuuggggggggacagaaucucgcuuugucacccuggcuggagugcaguggcaccaucucagcucacugcaaccucugccucccagguucaagcgagucuucugccucaaccucccgaguagcuaggacuacaggcccgugccaccacgcccagcuaauuuuuguauuuaguacagaugggguuucaccauauuggccaugcuggucucgaacuccugaccccgugauccacccaccucggccucccaaagugugagaaugacagguaugagccaacauguggggucccuuuuaaucuuuaucagggcuauuucaacaaagagagccucaggugggugcuaaucugucuuuaacaccuguuauuauuccuuuauaacaaagagauuaggucucaggcucugagagacaucagaagucaaugagaaaguaaucaucucauucuuguuuuuguuguauuaaauguuuacauguuuacauuuaccaccuauuuaugacaaagcaauaccaguuuuccaguuaggauaggauauguuuccccccaccaccccgguuuuaaaauaaauuuccuuaguuuaaaaauaauuuuuuaggccgggugcgguggcucacaccuguaaucccagcacuuugggagaccaaggcgggcggaucauuugaggucaggaguucgaaaccagccuggccaacauggugaaaccccaucucuacuaaaaacacaaaaauuagccaggcaugguggugggcgccuguaauccuaguacuugggaggcugaggcaggagaauugcuugagcccaggagguggagguugcagugagcugagauugugccauugcacuccagccugggugacagagcaaaacucugucucaaaauaaauagauaaggccaugugugguggcucacgcuuguaaucccagcacuuugggaggccgaggcagguggaucaugaggucaggaguucaagagcaggcugaccaacauggugaaaccccaugucuacuaaaaauacaaaaucagccaggcaugguggcacaugacuguaaucccagcuacuugggaggcugaggaaggagaauugcuugaaccggggaggcggaaguugcggugagccgagaucgcaccauugcacuccagccugggggacaagagugaaacucugucucaaaaaaauaaauaaauaaauaaauaaauaaaugauuuuuuaggcugggugcaguggcucacaccuguaaucccaucacuuugggagccugaggcaggcggauuaccugaagucaggaguuugagaccagccuggccaacauagugaaacccugucucugcuaagaauacaaaaauuaaaaaaacaaaaauuuuguaaaaauacaaaaauuagccagguguggugugucuguaaucccaacuacuugggaagcugaggcaggagaauugcuugaaccuggagagaagagguugcagugagccgagaucgggccacugcacuccagccuggcaacagagcuagacucugucuccaaaaaaaaaaaaaagaccuaaauuagaaagguaaauuguuggggccgggcgcgguggcucacaccuguaaucccagcacuuugggaggccaagguggguggaucacgaggucaggagaucgagaccauccuggcuaacacggugaaacccccgucucuauuaaaaauacaaaaaaaauuagcagggcgugguggcaggcgccuguagucccagcuacuagggaggcugaggcagaagaaucagaagaauggugugaaccugggaggcagagcuugcagugagccaagaucgcgccacugcacuccagccugugcgacagagcgagacuccgucucaaaaaaaaaaaaaaaaguaaauugucugggugcaguggcucaagccuguaaucccagcacuuuaggaggccaaagugagaggcucgcuugaggccaggagucaagaacagccuggacaacauagugagauccuaucucuaaaaaaaauaagauuaaagauauuagcuaggcaugguggcauacgccuauagucucagcuagucaggaggcugaggugggaggaucccuugugcccaggaguuugaggcugcagugagccaugauugcacugcuucacuccagccuggacagcagagcaagaucuuguuaaaaaaaaaaaaaaaaagaagggagggagggagggaaaaaaaaagaagaaagguaaauucuaaaccuucuagaagaaaacaaagaaagccuggugugguagcucaugccuguaaucccagcacuuugggaggccgaggcagguggaucaucugaggucaggaguucaagaccacccuggccaacaaaaucccaucuccacuaaaaauacaaaaauuagcugggcgagguggugggcaccuguaaucccagcuacuccagaggcugaggcaggagaaucgcuugaacccgggagguggagguugcagugagccgagaucgugccacugcacuccagccugggggacagagcaaggcauuaucuccaaaaaaaaaaaaaaaaaaagaagaagaucuucgugaaagcacucaucaucaacaaaaccacggauaaagauaauaauggaaguauagagacggcacagggugcagggaggugaggaugaagguauugcuggggcaugugggaaagugcccagcccagcccagccacccauuugaugucccaaagaggagcaggguguguccaaaauuagagcuacaggcaguagaacuaggacucaagagcagguacaguggcucaugccuguaauugcagcacuuugggaggccgaggcaggcagaucauuucaggucaggaguucgagaccagccuggccaacauggugaaacccugucucuaauaaaauacaaaaaauuagcugggcgugguggcggacuccuguagucccagcuacucaggaggcugaggcaggagaaucgcuugaacccgggaggcggagguugcgugagccaagaucacugcagccuaucucaaaaaaaaaacagaaaaaugaacuaggaaucaaaccggggaagcuuaaaggggcuucagucucaacucauccuacaaucccauccugcagaugggaagauaggggaccugcccaagaucccagagugagcccaggagaagacuugggcccagucucaucgguucccuccacucucccccucacccggcccaccugugucagaugcuguucagaggcaaagcccaggccguagacuguguuggcgcgacugucggcccacugcccgaacuucugggaaguuuuggugaaggucauguugggagugacagugcuguugaugauggccuagggucggggaacaaaguucaagguagaugggacagauacuaacaaacaugaaaccccccagguauuaccuuguauuagggucuugaaggucuuuacucugaacccuuucaggagauagagacuagggccugggaaggcuuaggguuuccugucccuugggcacacagcaagccagccaccagacccaagguugucaccaggacuccuggugccucugccccacccagaccccacccugaccuuggcgccuccgaugcugaugaugcgguacacauugcggguggcaucguagaaauaggagacagugagugcgugcuugcccgcugggauccaguuucgcuugguggcugggucaauuuggaacacgugcgcccgugugcugaagauuggcugcucccugcguggggagaggguguuuggugggggccaggcacccccacuuagaaagcucagggccaggcugggggaggugggagcucaccuggcuguggacauuggucaggcugggaugggcaggcucuagggggcagccagagagguggcaggagcacugguuuggccccuagggagagaggagggacuaugagugucccucaggccaggcugagggaggccaagcagguuccaucucaggacccaucaccaggugugcccgucauggaacuuucaaucaaaaaggcaggagaggcccaaaguacaccuggugcuuugggaggcugagucaggaggauccuuugagcccaggaguucgagaccauccugagcaacauggcgagaccccaucucuaccaaaaauuuaaacaauuagcugggugugguggcaugugccugccgucccagcuacuggggaggcugaggugggaggaucacuugagcccaggaggucaaggcugcagugcagugagcuauggucaggccacugcacuccagccuggacaagagagugagacccugucucaaaaaagaaagaaauuauaaaaagaaacaaaaagguaagauaauuauuauagauaacucagagcaagcagaccccaucuuucuuugucuaggggaagcccccacaacacccuguacaggagauggcccucugagaggagccugguggccgcugacauccagauguaaauuucucauuguccugguuauugcacccccgugaaguccccuccaucccaggcugagcuguggaggccaaaucucugcugaguucuuuccaccacauucacccaugacuggccagagcggggcucuccaccaaaaaauggggcguugagagguguguaguaccaggagaccaguuccccacuacacccugcagagggaccccacccccagcagcucccacccuagggcagaagcacaccuugaaguccagaguccaaauccccagggagcccccagccaaguuaaaaagacaagauguagacaaacagccaaucccaaugcccaccaugagggcagagcagaauccacacugggagaccagggcuccccaaccuccccauugggccauucagcaaccccgaaucugcaggggaccaaggaggaguuuggaggagggggaagacaggugggggaggggaggcccuggcccagcggccucuguggucaaaggggggaugcccccccuauccuguccugggcagcugcuguccuggucacagggucugaaaccggagccccugaguggggguggggcggcagcucuggccuggacugggggcggguccugcgccgggugggaguuggggaacacagggguccccggaacccaggcccuuccgguccggcagcuccugcugcgacuugcagcguuuggggaaaguuacucaccaacuagucaugcgccucggaugccgccggcc

SEQ ID NO: 191879 - RNA, 8959 nt, Homo sapiens
gucggcgcgcgccggaagcgcggaucacacgggccccuacaaggggccccuacaagcggccacaaggauggcaggcuucgcggagcucgggcugucaucguggcucguggaacaaugucggcagcuggguuugaagcagcccacgcccgugcagcucggcugcauccccgccauccuggagggugaguauggcccagggccuuccccaagaggccucuccgcuccucucgacuccuuucccuucucgcaaccuuugcuuauuccggucccacgaggcgaggggcaaccucgggcguuacaggagauccgggguuccggaggacgacuggacaguguuggcauuuagguugcaugacugacucgcuuuguguucguacgcaagugauguaaucucugaaauuuucauagucucagcacagggaggguuugauggaugacuaguccgauaguaucgcaaaauccugcagaccugguacugcuaucuuuauuuuacaaauagaaguugaggcugucaaaauugcugguagauccaggacuccuugguccugugauugcuccucuaggagaaggucuucucucugcuccucuagcccaacccaguuucgccauuaaagagaggcccacaggaagccuaagaugugauaagucagggauuaaauaaacaaaugaaggggucaacagggagcacaagaugcauaugagggaagggaauucuggauuccccaaauucacgugcuccuggacggaguuagaacgaggugguaggaagcugugggcaucucgggucaaauggauauggguuccaguccagccugccacucacuggcaguguguccugggcaaggucucugaaacccagcuguccacacauggaggguguugaugcugcuuuguccccaacccaggucgagacugcuugggcugugcuaagacaggcagugggaagacagcagcguuuguccuucccaucuugcagaagcugucugaggaucccuauggcaucuucugccucguccugacacccaccagguaagcccccagcaggccuccuggguauggguuaaccagcugugcucucuugggcaagcaccuuucccucucugagcgcccuuuucccacgugugagaugagcaugaaaaucuugcuacccgcuucuuagggguccugcagaauuaaacaagauggccccggugcaguggcucacaccuguaaucccagcacuuugggagcuccaggugagcggaucacuugaggccaggaguuugagaccagccugaccaacauggagaaaccccgucucuacuaaaaauacaaaaaauuagcugggcaugguagcgcaugccguaaucccagcuacucgggaggccgaggcaggagaaucgcuugaacccaggaggcggagguugcggugagccaagaucgugccauugcacuccagccugggcaacaagagcaaaacucugucucaaaaaaaaaaaaaagaaagaaagaaagaggcaggcagcagaaaggguacugggaccugggcauauuggagccaguuugagaaaggccuugaaugccaggcggaggguuagaauugauucugggggugugugagcaggaaaggucaugagccagggagaggccaggacagaguugguugggggcagaaaggaggcugaugcuugagacccucuggcuggggcaacuggcugguggugaggccauugcugaaaggcgaacugggggaaggcacagguuugggauaggaagagaugcugaggucagcuugggucgggcuggugaaggagggauguuccaggcugagccuggcgagggggcaggggccacaauggccuccaaggcucagcaucagagccuuugugaacaggacugggcaagucaggagccugggggcucagggaggaacccuggggauggagaggggaauggggggcagguccagaaccacuaccugacccagccuggccccuucacacccacagggagcuggccuaccagaucgcagagcaguuccggguccuggggaagccucuagggcugaaagacugcaucaucgucgguggcauggguacgggagcugggaggcgggggaagccccagcaugggacccuagcagcuuuggaccaccugcccagcccugccucucaugcucugucccccagacaugguggcccaggcgcuggagcucucucggaaaccacacguggucaucgccacgccggggcgccuggcagaucaccugcgcagcuccaacacuuuuaguauaaagaagauccgcuuccuggugaguucgccccgccccugcagaccucaggagcugggcucggagccuccaggcccaaugucagagccuggggcaccaucucauccauuuaggaaacguauguccguuagacuguccaguaaaacgcuaggaacagugacaaggaccguucaaggaccaacaagagggggcccaguccuagcaauguuauucggggguagggccuugcugagacuugggugaggggcaggccucccuuggaaggaggguacuccagggccuaggguccauguccaugccucucaaagaggccugcuucagggguggccaagacccggggccauggacggcacccucaccccugcccccauuggcacggcaggugauggaugaggcagaccggcugcuggaacagggcugcacugacuucaccguggaccuggaggccauccuggcggcugugccggcccgcaggcagacacugcuguucagcgccacgcugaccgacacacuccgggagcugcagggucuggccaccaaccagcccuucuucugggaagcacaggccccgugaguccacagcccagacagcguggggagggcagccccauccuacagacagggacacugaggcguggcggucuaucuguccauccccagggugagcaccguggagcagcuggaccagcgcuaccugcuggugccugagaaggucaaggacgccuaccugguccaccugauccagcgcuuccaggaugagcacgaggacugguccauuaucaucuucaccaacacgugcaagugagcggggcccgccucuccccucccaccgcccuucaaaggaggagguggcccgacgucuuuggucugggacacacagccagucucagcacuccccagccucugcucagccuggaggucaugggggcuucccucaaggagccaaggucccucaaucugaaggugcagccggccuuugggguuccucagcccagccguugauggaagggccaggaaaccccugcaagcagcuguuugagcagcccauuugcuguguucugggggugucacugagcuuuccugggccuuuagucccaucucagaggaaguugugacaacuaacaggccuggugugcgucugcacagacagagaccccuggggagggcaguucauaucuucauugaauuguuugggaaggucauugagaagcuggaggcucuuccagcaugagccaggauagaagggcagaaaucaaggcgcuuuaaaugcguuaccucccagaagagaaaaguugggacugggugcagugacucacaccuguaaucccagcacuuugggaggccgagguaggcggaucaccugaggucaggaguucgagaccagccugcccaacguggugaaacuucaucucgacuaaaaauacaaaaauuagccaggcaugguggcgagcaccuguagucccagcuacuggggaaggugaggcgggagaaucacuugaacccgguagguggagguuacagugagccgagaucacgccacugcacuccauccugggggacaaagugagacugucucagggaaaaagagagaaaaguuuggcugcaggguggcugucaggcguggcaggauccagcagcuuaugugaugguccccauccuuucucccugugccccucuuucuccucuguuuuccucugcuggcuccuucuuggccuucuugguaacagugaccaccccuagcaagucaguuuccagccuuccagcccugcagucccagggccaacucuugucaguuccagcuccagggagggaucagcagagaggacaucaggcaggcaagccgucugucaacccucauccugccucuuuuuuuuuuuuuuuuuuuugagagucucacgcugucccccaggcuggagugcaauggcgcaaucucggcucacugcaaccucugucuccuggguucaaacaauucuccugccucagccuccugaguagcugaggcuacagucauacaccaucaugcccggcuaauuuuuguguuuuuaguacagaugggguuuugccauguugggcaggcuggucuugaacuccuggccucaagugauccacccgccucagucucccaaagugcugggauuacaggcaugagccaccgugccuggccugcugccucuccuuucuaagcugcaugaggccacugugcuaggugucucaggggcgggugggggcaggaacaccuucccagaaccugagagcuggagggguugacaggcacauccuucccgccaggaccugccagauucugugcaugaugcugcgcaaauucagcuuccccaccguggcucugcacuccaugaugaagcaggugaggccacccuggggcccgccagccucacccugggauaccuuccccgccucagacauuggccccgauccuuccuucugccgggcgccuucuuccugccaccuggucucuucuggucccagaauaucgcagcucaagaggcccucccugaccgcaucucuuuuagccgucauucauuugucccggucugacuucucauggccaccuuccucaauggacggcuggggacugucccggccuccacccugucccgaggccucacacagaaaacccugccuucaugcauucccaauuuucuucccaacccugugcagaaagaacgcuuugccgcccuagccaaguucaaguccagcaucuaccggauccugaucgcaacagacguggccucccggugagcagcccccagucuccugccaagggcacucccucuuuuacuacaaggccccacagaugagaaggcuggccucaggcaugucaggcagcccuagcaucccugcugagugacccugggugaguccuugccucgguuuccccacauggacaguggagcugaccagccaccucugccuccaggggccuggacaucccuacgguacagguggucaucaaccacaacacccccgggcuccccaagaucuacauccaccgagucggccggacggcccgugcaggugagcaguggagggggaggccgagccuugggccucugucccuccagccugcccagcaaauucaggugguaggacguggguagggugcagcccacagaugagagcuacucagggccauguuugcaaguuggggaguuguccuuucuaaagcaaaggugaaucccagcuacucgggaggcugaggcaagaagaucacuugaacccgggagguugcggcaagcugagaaugcacuauugcaccccagccugggcaaaaagagcaaaacucugucuccaaaaaaauaaaauaaaauaggccaggugcgguggcucacgccuguaaucuuagcacuuugggaggccgagguggguggaucacgaggucaggaguucgagaccagccuggccaacauagugaaacacugucuuacuaaaaauacaaaaaaauuagccaggcgugguggagggugccuguaaucccagcuacucgggaggcugaggcaggagaauugcuugaacccgggaagcggagguugcaaugaguggagaucgcacaauugcacuccagccugagcaacaguguaagacucugucucaaaaaauaauaauaaacuaaaauaaguaaauaaaauaaaauuguaaaauaaagcaaaugcaagucaggugcugccuucacccaagccaggugaugaacugagcaguguggggcugcccccugggagggugcacacacagcuccggcccccacuacuugcugcugccucgucagggaggggcaugguguccaugagaugcugucaguucugaagccaggaaagaugugguugcuggggucggacugggccuggaccuucuauccugacccuguggugcugggcaggucacuuccacucccuagaccucacaugguggauaaugagaauggugacguccucguggggcugccaugagggucacggaccuuguccaccaucagugcaguuucggcccuagucaacgucacagaaaacagcaagcagagaucuugggcugaggcccgucagggcuaauggcuggcauuacuuagacuggguucccuggcagccaagccaaaaagggaaaucgggcaguaacuaacugcuguguaaggccagacuggcagaccugccucuccccagcgacccguccuccacacagugguccugcuuggggucaagcccagacacucugggcugaucccucccaagcccaagcccuuguucagcaucuccaggaccccugagcuguguagcugucaggaucuaccuuuauucgccccauguccugacgcccagcacauagcagauaaccggcacauccccacagggcggcagggucaggccaucacgcuggugacacaguacgacauccaccuggugcacgccaucgaggagcagaucagugagugggguuggggugggugguagagaaggagggguggggugggcagaggugggcaccucggggugagacccauuuucccgucagacaccagccggccugcucccgugagcagauuuaggcuggggcuuccuucccuaggcacccccaaaagaaguucuuuugcccauuuauugaaacaaacuccccauaguugucgccagcagcugaaagccacaucagucaggaggggacuuggguuucuuagacugagauguauggaaggucccugagaugucagaggccccauugacagggccuggccugcuaaaaaccccugggaaugguuucauaugcagccaagacagagacacuuccuaagguaucucugaucacugcauagacuguccugaaauuuagaaacaucuggacuuggccaggcacaguggcucacacuuguaauccuagcacuuugagaggccgaggugggcggaucacuugagcccaggaguucaagaccaaccugggcaacauggugaaaccccgucucuacuaaaaauacaaaaauuagccaggugugguggcgcacgccuguaauugcagcuacuugggagggugaggcaugagaauuacuugaacccgggaggcaaagguugcagugagccaaggucgcgccauuacgcuccagccugggugacagugagacucugucucaaaaaaaaaaaaaaaaaaaaaaagagaaacaucuggacuuuaaggccgggcacgguggcucacaccuguaaucccagcacuuugggaggccaagguggguggaucacuugagcccaggaguuugagaucagccugggcaauguggagaaacccugccucuccaaaaaauauagaaacuagcagcacacgcccguaguuccaacuacucaagaggcugagguuggaagauugcuugagcggaggcuacagugaccugauugagccaccacgcuccagcaugggcgacagaguaagacccugucuucaaaaaaaaagaaagaaauaucuggacuuuaaaggacacuguuugcaagaaauuaauauucaugguuaaacucauaaugcugcuaacaccgaaaaaaaauggcggggggaggcugaggcaugagaauuacuugaacccgggaggcggauguugcagugagccgagauagugccacugcacuccagcuugggugaccgugagacucugaaagacagcgguccauaccuuccuuaccucagaaaucccugaucuugcucagcugacccuuaccugauauggccccagauggccuugcauaccccacagcauggggaacucacuacuuggcugaacucccucuccaugucacgucuccuccccacccccacccccggcuuugcuguccccacagagaagaagcuggaggaguucuccguggaagaggccgaggugcuacagauccucacacaggucaacguggugcgaagagagugugagaucgugagugucagaggcgggcaggaacuaaagugcucuccagggccgggggugcucccuuccagguggggcccccgugaccagcaucuccuuaccccacuucccuccaccagaaacuggaggcggcccacuuugacgaaaagaaggagaucaacaaacggaagcagcugauccuggaggggaaggugagggccgagcccgcagguaggggguggguggccagguucccuggcgggggccgccagcucagccauccccugguccucccugugccaggacccugaccuggaggccaagcgcaaggcugagcuggccaagaucaagcagaagaaccggcgcuucaaggagaagguggaggagacgcugaagcgacagaaggcuggcagggcuggccacaaggggcguccacccaggacaccgucugggucccacucaggcccaguccccucccagggccuggucugagccccacacggccaucugcccaguccuugacucguccauggagcugagggucggaggaaccuuccuugggggcagcagcccuucccgggggccuacccagugccccacagcagaacccgugggcgcucguguugugcgggcccugcuccucugccccgaaaccacuggcuggucccuucccugagcccuggccaagauucaggcugcaggggaagaaagaacaugaccgggagguugugaccccaacccaaggucaccccccaggggugccgcauacaggaggugcuuaauaaacgggucuuuugacuuccucaguc

SEQ ID NO: 191880 - RNA, 27593 nt, Homo sapiens
acgcggggcgcgcggcuccgucggcuaccgcgggcgggcgcaggcgacgggcacggcgggcgagcgggcgguauggcggcggcggggcccgcggcggggccgacggggcccgagcccaugccgagcuacgcgcagcuagugcagcgcggcuggggcagcgcgcuggcggcggcgcggggcugcacggacugcggcugggggcuggcgcgucgcggccuggcugagcacgcgcaccuggcgccgcccgagcugcugcugcuggcgcucggcgcgcugggcuggaccgcccugcgcuccgcggccacugcgcgccucuuucgggucaguguggccgggggccgggacgaggggaccccggacugggggaagccgggaccggggaccuggggccgccggcgcguuccuuucuuccagcgcuggcugcugcggaugaaggggucgccggaacgugggugggggccucgggcuggagaggcccaggacguuggagccccaggauaaggucucucgggccgccgcgcgcccccuucagacagugcugcgugggggaaccggguagaugcggggguguggccgggcuggggugagucugggacauggggggcccgagacaggugggauguuugagacgugggggaccgaggcacggcccuuuccggucaguuugggaccagggggccccgcgcgguggauggcuccggccaccgcgcgcucuuuccggcagggccgagccagacacugagaagcccaggaccgggaacgggagggcucggcgcaccgcggccugcgccaugcgccucccugccaugcgggcugcgccccggcccggagcgagguccgcugcccguuuucugcuggguccgugcggcggcggggccggcuugcccgcuguaaucgggaagaggcaggagcugcccggucgcugccuugugccuaucuggggucagcgccacccuccgaccagggauggcaagggccugggugcucuggccacgccaguggucgcucccuuggaggugacauggcccggggcuucaggguuggacugugcugccuccaagaggcgacagcagaauuccccaguuucugcggagaccaucgccccugcgagagagugaccaugauggugacauuggcgccugaccccacucacuucccuggggaggggucgcuguggcaggagcugguuggaagguguuugggccuuuagcuuggccuggacacccccguggaccagcuggugucaccccgcccgucuggcuggagggugcagggacaaugugcccagcgccaacaaaggggccuuucucugcuggccgggaagaggcuggcccuugugaggucgaugaugggauguugucugacugccacucuccccacucccguccccauaucacccacaugagggagagaccccagccacaccccuacugugggagggggagacagggcuguccagggccccucccuggguccgcaguggucuuuauccugcuuguugccccugccuucuucccaguuuccagcugggaagcccgagacccaggagggcaagccgucccccaccccugcgggacaggaggauguggcggcugguagacuaccagggccgagccccgggggcccuccccagccccuuggguggggugcucgccccauuucgaggcucgcccuuccucagaaauggguggaggggcugccggguguuccaaagcugaucuucuuggcagcagccugguugccagggguuaccggagccggcuccagcugucuccaugacaacugcugggugcucugggcuccggcccccucagccucugggaagggggugggacuuguccagggguggggcuuggccgggcagcucuggagccgcgccccgccacccacccacccaccgcacuccccaaccccugccuuggagccagcagcuuccucugcacucccaauguccccucagggucucaccucgccugugacaccuuuuccgccuccuguccccuuuuucugccuccagccccuccuccccuuucaucgcccccagguucccauguccccgccacaccuucccccuagucucucccagcccucuagccucuccagaaucucccacugagggggcggcuuccucacaaguucuuccucuccccucugugucggucccauggggcucucuguguuucccaagaugcccccauauaacccccuccauguucccuucaagggucacccccaccagcccaacucccuugggcugacgcauccauccgucucccucaucguaagcccaagugucccccuucuggcccccagagcccuccugcuccccucggggccuccccccucacuccccucccagcaccgcggcggccggacagcugggcacuaaguuuagccuuggcaggcgccugugggcucuguuuaugcuccagguggcugugggcaugggggacaggccuucccagugcugcccggccuggggagucccugggccucaguuuccccaccccaaaggagcagucucuggcccccagcaccaauggcugcccgccugucuucucccccauagccccuggcgaagcggugcugccuccagcccagagaugccgccaagaugcccgagagcgcuuggaaguuucucuucuaccugggcagcuggagcuacagugccuaccugcuguuuggcaccgacuaccccuucuuccaugacccaccaucugucuucuacgguaggggcccugaggggauggccgggagggcucugcuuaaaacacaaagacgccaggcuuguggucccagcuacucaugaggcagaagcaggaggaucacuggagcccaggaguuggaggccaaggggagcuaugagcacgccacugcacuccagccuggacgacagagugagacccugucuuguaucaaaaaagaaaaagagggccaggcgcaguggcucacgccuguaaucccagcacuuugggaggccaaggugaguggaucacgagguuaggagaucgagaccauccuggcuaacauggugaaaccccgucucuacuaaaaauacaaaaaauuagccggguguggugggcgccuguaaucccagcuacucgggaggcugaggcaggagaaucgcuugaaccugggaggcagagguugcagugagccgaguucgcgccacugcacuccagccugggcaacagagcgagacucuguauuaaaaaagaaaagaaaaaaagaacaguguaaggggaugcuuaucagaaucagagcuccuaugggugucucagaaguuaagccagccccaagacaaaggugaucccuggggacaggaaaggggguaucuggccguguuggagcucagggaagacauccuggaaggaccccuguguggguccaggcaggcauuccaggugucgguaacagcacgugcaaaggcccggaggcacucacguuucauggggacaggaggaggguggcugcagagagcugaggcagcagcuugaguucuguucuggaugugguuguuuuucuuuuuuugagauggagucucgcucugucgcccaggcuagagugcaguggcgcgaucucggcucacugugagcuccgccuccuggguucacgccauucuccugccucagccuccugaguagcugggaccacaggcgcccgccaccacgcccggcuaauuuuuuguauuuuuaguagagacgggguuucaccguguuagccaggauggucucaaucuccugaucucaugaucugcccgccucagccucccaaagugcugggauuacaggugugagccacugcaccuagccugaaugugauguuuuuaagcacagcauggagaggauuggguuuuguggaugacaaaaugcuuccucuggcugcccuauggaggugggaggguccccucggcuugcaccaucuuggugaggagauaaacaugaugaagccuggugcgauggcucacgccuguuaucccagcacuuugggaggcugaggcagguggaucacuugaggucaggaguucaagacuagcacggccaacauggugaaacccugucuguacuaaaaauacaaaaauaaauuagccaggcaugguggcgcgugccuguaaucucagcuacuugggaggcugagucaggagaaucacuugaacccgggaggcggagguugcagugagccgagauggugccacugcacuccagccugggugacagagcaagacuucauuuccaaaaaaaaaaaaaaagaugagaaugagaagugggcugggcgugguggcucacuggcucacaccuguaauccuaacacuuugggaggcggaggugggaggauuacuugagcacaggaguucaagagcagcuggggcaacaugguaagaccuccaucucuacaaaaaauuagccugguaugguggggcacgucuguaguaccagcuacuugggaggcugaggugggagaauugcuugaacccgguagguggagguugcagugagcugaggucaugccacugcacuccagccugggcaacagagcgagacccugccuggggguuggggguguggaggggaagaugauaagaaguggcuguguccaauugauuggaguggauguggccugagcuccgggugggcugggcagggaggugacugcagcgcgcucugugugaccuguccuggcagagaaugcagggcagggccggcaucgccacugggcaggcugauguaggaaaccccaucugcgauggggcagugggggcugcggcuucucugcccugcgaggaccaccagggcugugggccagggacacacaugauagcuguuuccugccaugugaugggaacagccuagagggcuccugguggcacggagcccagaguguacaguggaugugccacccauggggccaguuuucccauguaacacaccuugauccccuagaggggagguguuagcuguugcucaguuuuccuucuagacggaugacccaugaucgaacucucauaacuuuuuuuuuuuuuuuugagacagucucacucugucacccagucuggagugcaauggcacgaucucggcucacugcaaucuccaccucccagguucaagcgauucuccugccucagccuccuaaguagcuggaauuauaggcacgcgccaccacccucggcuaauuuuuguauuuuuaguagagacgagguuucaccauguuggccaggcuggucucaaacuccugaccucaggugauccgcccgccucagccucccaaagugucaggauuacaggcaugagccaccacgcccagccucucuuaacauuuugggcauggacuugccuuuagcugcuuuuuuuuuuuuuuuuuuuuccccagacgcggucuuacucuguugcucaggcuggaguacaguggcacgaucacagcucacugcagccuggaccuccugggcucaagcaaucaucccaccucagccuucugaguagcugggaccacaggugugugccaccacccccagcgaauuuuuuuguguuuuuugguagagauggggucucacuauguuggccaggcuggucuugaacuccuggccucaagcaguccucccaccucagccucccaaaguggugggauuacaggcaugagccaccucguccagccuuaguugcuuuuuguaaaugacacucacaaguuagcugauuauuuccaugucuauuuauugagcgacuacuguaugccacagcugagacacagcuaguaacgggucagagaaagcccugugcccucaugaagcuggccguguggcaggggcaacagacggugcaguacgcagucuaucaacagcaauaaguguggaugagaaaacuuguguggagagaagaggcagugugcuguguuggggagguggggaggggcaguuuuuagcagggacagggguggccccacuuaaggggacugagugagggccuggaggugccuggagcaggcaggagaggcagggacugcuguccaggcaagugggggccaugccauccaggccucggaggccacggucaggauuuguuacuuaucugugggcugggagcagaggagggaugucacccuggguugggcaucuaccccagggguccaggagggggcugacagcaggagcuggagccugaagggacucccaccaggauugagcugaggggaggggaugggagcaaaguggccaauuuuagaaauguuuagaaggcagagcugauaguauuugcugccacccuagagguggugugaaaggaagagggugaggaugaugcuagggucuugugagaugggggcuggucagggagaccaagauucuggauucagggauggagacaaggcagggguggcauugagugucccaacagcaggugggauaugaguaugaagaggugggacaggccaggugcggugacucacuccuggaaucccaguacuuugggaggccaaggugggaggaucacuugagcccaggaguucgagaccaaccuugggaauauagugagacgccaucucuacaaaaaauaaaaaaauaaaauuagcuggauaugguggcgcgugccuguggucccagcuccuggggaggcuggggcaggaggcugaggcugaggcuugagcccgggaggucgaggcugcagugagccaagauugcaccacuacauuccagccagguugacagagugaggcccuuucucaaaaaacgagggagaggagauuugagaccucugaacuaagccaggacuuccccccuauccuguggggaaggagcuacaggacgguuggggggccucuguuggaaaggugggcaacagauccagcaggguggcccugggcaaaagcucgggcucacauguuucuggagagucaggauggagaggaucagggcauuucagaguuucagacaauuuucauugaaauucuggaagagggcugaagugggccgggugcaguggcucacaccuguaauccuagcauuuugggaggcugaggugggcggaucacuugaggccgggaguuccagaccagccuggccaacauggugaaacccugucucuacuaaaaauacaaaaauuagccaggcguggggaugcaugccuguaaucccaguuacucggcaggcugaggcaagagaaucgcuugaaccugggagguagagguugcagugagucgagaucaugcuacugcacuccagccuaggcgacagagcaagacucugucucaaaaaaaaaaaaaaaaaaaagaaagaaagaaauucuggaauaggggaggguuuuuuguuuguuuguuguuuguuuuuuugagacagaguuucgcucuuguugcccaggcuggaguacaaugccacgaucuuggcucaccacagccucugccuccuggguucaagcaauucuccugccucagccuccggaguagcugggaucacaggcauguacuaccacacccggcuaauuuuguauuuuuaguagagacaggguuucaccauguuggucaggcuggucuugaacucccgacuucaggugaucugccucccuuggccucccaaagugcugggauuacaggcaugagccaccgcaccuagccuguuuuuuuuuuuuuuuuuuuuuuuuuuuaagagacagggucucacucugucgcccaggcuggagugugguggugugaucucagcucacuggaaccuuugccuccuggguucaagggauucuccugccucagccucaugaguggcugggauuacaggcacgagccaccacacccagcuaauuuuuuuuuugagauggagucucgcucugucacccaggcuggagugcgguggcaccaucucagcucacugcaaccucugccucccagguucaagcgauucuccugccucagccucccgaauagcugggacuacagguguguaucaccaugucuggcuaauuuuaguauuuuaguagagcugggguuucaccauguuggccaggcuggucuugaacuucugaccucaagugauccacccaccuuggccucccaaaguggugggauuacaggcgugagccaccucaguuggccuccauuucuuauugagguaaaauguauguagcuugaaauuaggcauuuuagccaaucacaaaaagacaaauacuaugugauuccacuuauaugagguuccuacagucaucccacucauagagacagaaagugggauggggggugccagggcugggggaggggaauggggagagacuguuuaauggggacagaggacuguuccauuggggaagaaggagaauguucuggagauggcugcuggugaugguugcacaauaauguguacuuaacaaauggcuuagaugguaaguuuuugccauauaaaucuuaacacaauuuuuuuuuuuuuuuuuugagauggaguuucacucuugcugcccaggcuggagugcaguggugugaucucggcucaccacaaccuccgccucccggguuuaagugaugcuccugccucagccuucgaguaggugggauuacaggcaugcgccaccaugcccagcuaauuuuuguauuuuuaguacagacaggguuucgccauguuggccaggcuggucuccaacuccugaccucaggugauccaccugccuccaccuccuggccaaaaauuaaccauuuuaaagcgaacaguucaucagcuuuuaguccauucacaguguuguucaaccacccccucugucuaggucuggaacauuaucaucccccacaaaaggaaaccccgucccauuagcagucacucaccaguccucucccccagccccuggcagccaccaaucuacuuccuaucucuguagauuugccuguucugggcauuucagaucacuggagucucacacugugugaccuuuuguguuuggcuucucuuacucagcaucauguuuuugggguucacccacauuguagcauggauccgugcuucauucuuuuucauggcugcauaguauuccacuguguggagguaaccuaucuauucuucauccauccacugaugcacauucggguugugucugccuuuugguugugugcugcuguagacagggacacaugaguaucucuuugaguccccguuuuccauugucaggcacacacccuaguggacuugcugggucauggugaccguuuguguguacauggccuucagggcugagugaggagaguggacaaacagucaugggggccagggaucgcuggagagaugugggcaggagacaacagugccuggacugggguggggguggcaugggccaaagaggggacccuggauggggguccuaguguaacucggcugcagaaggggccaggccgagaugaaaguugucgcagaggcgguucauggggcaucuggaggcagcugggcugcagggcaggucaccaaggcaggggccaggaagccgcagauggaggcuggagggucugucuugggggucugcagaaagggaguggccagagaacagggagcaacccagagaguuccagguuggugugggcagagcacagcauggcuucccgccuuuuuuuguuguuuguuuguuuguuuguuuuguuuugagacagggucuggcugugucucccaggcuggagugcaguggcaacaucuuaguuccugccaccaccucugccucccuucaggacucaagugauccucccaccucagccucccgaguagcugggaccacaggcgcccaccaccacacccggcuaauuuuuuguauuuuuaguagagacgggguuucacuguguuaaccaggauggucuugaucuccugaccuugugauccgcccgccucggccucccaaagugcugggauuacaggcgugagccacugcgcccggccccagcuaauuuuuauauauuuuuuugcagagacagcgucucaccauguuguccaggcuggucucgaacuccuggacucaagcaacucuccugccucggccucucaaaaugcugggauuacaggcaugagccaccgugcccguccagagcauagcccuugaauuuggugucuggcagccucuggggauguggcugaggagaggaggagguggacgugguggggugggcuggugugucacccaucaccugagcgugguggucaggugcaccaggaggcaggaggaggggaaggugaggcaggacccgcuuggcgggagacccugcgcuugguggcauggugugcccgggcauggcaagacuccgugggcagccgcaucugucagggccagggauuugcagggagugggcccaggacacccgcaaggcagggcucuguuaaagacaggaagaggccgggcgcagcggcucacgcccguaaucccagcacuuugggaggccgaggcgggcggaucacaaggucaggaguucaagaccagccuggccaacaugaugacacccugucucuacugaaaaaaaaaaaaauuagccaggcaugguggugggugccuguaaucccagcuacuuggcaugcugaggcaggagaaucacuugaaccccggauauggagguugcagugagccgagaucccgccacugcacuccagccugggcuacagagcaagacuccaucucaaaaaaaaaaaaaaaaaaaaaaaaaacgagaaggggcgcugggcugggugagguggcucaucccuguaaccccagcacuuugggaggccaaggcaggaggauugcuugagcccaggaguucgagaucacccugggcaacauggcaacacaaaaauuaaaaaagaaauaaauuaucuaggcaugguuaugggugccuguggucccagcuacucaggaggcugaggugggaggaucacuugagcccaggaggucgaggcugcagugaacuaugaucacaccacugcacuccagcaugggccacagaacaagccaacucuaaaacuauauauaaaacauuuuaaauguauauaaugauaauaaugugucuauauuaguucagcauuuguagcaaauauaccacuuaaagccagggaaauggaaaucuguggguauguuggggcagaagaaagaaaggaacuuucuguccuaucugcucaauuuuccuagaaacccaaaacucuuccuaaaauaaaaaucccugcuggccgggcacgguggcucacgccuguaaucccagcacuuugggaggccgaggcagguggaucaccugagaucaggaguucaaguccagucuguccaacauggcaaaagcccaucucuacuaaaaauacaaaaaaauuagccgggcaugguguccagcgccuguaaucccagcuacucuggaggcugaggcaggagaauugcuugaaccugggagguggagguugcagugagcugagaucgugccgcugcacuccagucuggugacagaacgagacucugucucaaaaaaaaaaaaaaaaaaaaaaagacggcugggcgggguggcucacgccuguaaucccagaacuuugggaggccgaggcaggugaaucaugaggucaggagaucgagaccauccuggguaacacagugaaaccccgucucuacuaaaaauacaaaaaauuagccgggcuugguggcaugcaccuguaguccuagcuacucaggaggcugaagcaggagaaucguuugaacccaggauguggagcugagaucaugccacugcacuccagccugggcgacagagggagacuccgucucaaagaaaaaaaaaaaaaaauagaauugggaauggaaagccagcagucagacacgcaugguuaccuggguacugggaggacacguguggcuuggagggugucaccgggucauggaggcgaucgucuagaggcuucgcagggcccugacugugagauuuggcucuccccagacuggacgccgggcauggcagugccacgggacauugcagccgccuaccugcuccagggaagcuucuauggccacuccaucuacgcuacgcuauacauggacaccuggcgcaaggacucgguggucaugcugcuccaccacguggucacucucauccucaucgucuccuccuacgccuuccgguaaggacaggaucggguggcagggggccgaggcacagcccacacagagugcggaggcugauguugcggcggggcacagaggaggccguggaggggaucacaucaggucggagugcucaggguuccaaggucagagugcucagggguccgacgaggggacagaccagaggcaggaaggcugaggaggggaugugggcccggagauuccugagggagauuccgcugggauggggugaaacaggcccagagagccauagccaccccaccccacucacccacccagcucuucagacgcugcccuugaccagccaggucacacacccaggaguuccugagcaccugccacgcccaagcaaugggggcauggcugugaacgcagcugacacacccugauguucuagagccaaccacagccgucagugagccuuucagauggagucuguccaaaccucaccaugcugugugcauaaaacccacccggcuucaaagccuucacauacaaacgagugaaaauaucuuauccacccuuuuauuucucucucucuuuuuuuuuugagacaaggucucacucugucacccaggcuggagugcaguggcgugaccauugcucacugcagccuggaccuccugggcucaagugauccucccaccucagcuccccgaaguguggggauuacaggugugcgccaccacgccuggccuuguuaucucgacuccauauugaaaugacaauauuuuggauauacugaauuaauuagaaugcauuauuaaaauuaauauuaccuguucuuuucucuuucuuguuaaauguggccaauagaaacuuuaaaaugaaauacacugcucauauacuauuccuacgggacuagcugcucuagcugcgauaauaggguagccacgccccacaaauauagagcaacaaagagguggcccuuucaacuuuaauuagacuuaaauaaaacuccaggagcaguagcucaugccuguagucccccagcuacuuagaaggcugagucaggaggauugcuugaacccagaaguuugaguucaaccuaggcaacguagggagacccugucucuaauaaauaaauuuuuaggcugagugcgguggcucacgccuguaaucccaccacuuugcgaggccgaggcgagcggaucaugaggucaggagaucgagaccauccuggcuaacacagugaaaccgugucucuacuaaaaauacaaaaauuagcugggcgugguggugggcgccuguagucccagcuacucaggaggcugagacaggagaauggcaugaacccgggaggcggagguugcagugagccgagaucaugccacugcacuccagccugggcgacagagcgagacuccgucucaaaaauaaacaaacacguacauaaauacauuuuuaaaauuacuuuaucuuauuuauuuacuuacuuauuuuuuugagacagagucucgcucugucgcccaggcuggagugcagugccaugacauuggcuuacugcaaccuccggcucccagguucaagcaauccucccgccucgccucagccucccaaguagcugggauuacagggguaugacaucacaccggcuaauuauuauauuuuuaguagagaugggguuucaccauguuggccaggcuggacucgaacuccugaccucaagugauccaccugccucggccucccaaagugcugggauuacaggugugagccaccacgucugguuaguuuaaaaaauaauuuuaaaaagccccuauuccauuccucagccacacaagccacaguucaagggcucaguggccacaaguggcugguggcucccauguuggacaguacagguuuagaacauucccauaguucuagaaaguucuauaauucaaggcucucuagagggcagaaucagaugauagaaccaaaaaggaaggaaggaacaguucauuugaaggugauaagaauuauggagaaaaggccaggugcaguggcucaugccuguaaucccagcacuuugggaggccgagguggguggaucaccugaggucaggaguuugagaacagccuggccaacauggugaaacccugugucugcuaaaaauaaaaaaauuagcugggcauggugaugagugccuguaguccaagcuacucaagaggcugaggugggagaaucgcuugaacccgggaggcagagguggcugugagccgaggcauuccagccugggcaacagagugaggcugugucuccaaaaaaaaauuguggcugcagguguuagguguuaguuggucugggggugacagaugagcagaugagcagagacugaaaggagugaagggaggugcugaaugccaggcacuggcaugcugggucauggggacagcacgugcaaaggaccuguggcaggagcccaggagcugucaggagacagagcaaggaacagggacuuggugagagacacuuccccacguccagggugaauccaggacccucgggcagcucaucugucagauggagacucuguggaaggacaggggauggccuucgggcuuauuaagauccuaauggggccgggcacgguggcucacaccuguaaucccagcacuucgggaggccaaggcgggugggucacaugagguugggaauucgagaucagcgggaccaacauggugaaaccccgucucuacuaaaaauacaaaauuaacugggcgugguggcacauaccuguaaugccagcuacuugggaaggcugaggcaggagaauugcuugaacccgggagguggagguugcggugagcugagaucgugccauugcgcuccagccugggcaacaagagcaagacucugucucaaaaaaaaaaaaaaauuaaaaaaaaaaaggauccugaugggcugcggcagaggccuuuccugcagcgauggccaggcugcacguacagaccuggaagucucaucaugguggugguguccaaagugagggacaagcucauggaggaucuggacacagaguaccccaggccugugagagucgggggucauagagggucagaggucaccaagaugaggaggggccagcaaggaacuuccaagaccgggcacaguggcucgcgccuguaaucccagcacuuugggaggccaaggugagaagaucgcuugagcccaggaguuugaggccauucugggcaacauagcaagacccagucucuacuaaaaauuaaaaaaauuagccgugugugguguugcuuuccuguagucccagcuucuccgggggcugaggugggaggaucacuugagccuaggaguuugaggcugcagugggcccgaucacaccacugcaccccagccugggccacagagcaagacccugucucaaaagaaaaauaaacuuccagggagcucccugggccacauggggacacugaggcagggaagaugagggucugguugggggugcacggcuaagugggggacagugaggaaagggcauccugggaaguggagaugggcagggcaggcgaggcaggaaggguggcuuugaagaggcccacggggagccugagguguagcccagggacucugcugggggccuuagugcagaguggaggucccccaaugugagcugcccucuccucucugccugcugcucccccagguaccacaaugugggcauccuugugcucuuccugcacgauaucagugacgugcagcuugaguucaccaagcucaacauuuacuucaagucccgcggcggcuccuaccaucggcugcaugccuuggcagcagacuugggcugccucagcuucggcuucagcuggugagugguagggagugcugggcagggagggagguguggccuggugagguggguguguccagaaaaggggcgggaccaggcagggaaggaggcggggcccggugagguggguguguggcaugacaggggaggggccucaugauuugggugggacugaaggggcggggcuauacaggaaaggaguaggacaaggguggggccaacugagcuaggaguggggcugggcagaaaaggauaagccaggugagguggguggauccaggaaggggaggggccuggugagauagguugggccaggcauggaaggggaagagcuagacuaauacagagcaagccagggguggggccaagcaggguugggguagggcuaggcagagaaagagguagggcuuuggugugguggggaagaccuggcagagaaagggaggcgcugugcagggaaggaggugggggcuuggugaggugggcggggccuggcagagaaggggagggacugggcagggaaggagguggggccuuggugagguggguggggccuggcaggaaaggggagggacugggcagggaaggaggugggguuuggugagguagguggggccuagcagagaaggggagggacugggaaggggaggagguggggccuuggcgaggugggugaggccuggcagggaaguggggggccaggcggggaaggauguggggccuuggcgaggugggcggggcauggcaggggaggggaaggacagagcaguaguagaaacaggugggcagaggugggcaaggaugggauaagggggcaagggugggucuaggacgggauaggacagggacuggguagggcaccgucccccuccacccacggccuccugacuccucccaccgcagguucugguuccgccucuacugguucccgcucaagguccuguaugccaccagucacugcagucugcgcacggugccugacauccccuucuacuucuucuucaaugcgcuccugcugcugcucacccuuaugaaccucuacugguuccuggugagucggccccggcucuccuccacaguggcggucccguccucgucccaaucccuguccccuccucaggcagucccggggaggggcacguuagguggcagacagcccguguggagggcccgggacaggagcacauggcugucagcagggcaguggcgugggggcuuucuucucacuggcaccuccccuccccucucgcaguacaucguggcguuugcagccaagguguugacaggccaggugcacgagcugaaggaccugcgggaguaugacacagccgaggcccagagccugaagcccagcaaagccgagugaguguggaggggcccgcaccccgcguucccuccuuuagugucacccguccaagcguguucgugggcaggcccccaagacccagcagcagaugaggccgacgcggaugcugccccccaagccuacuccaaaacagagacugcaauaaaggcguggacgauguggccaguacccugaaggacaggacagugaggaaggggagggagaggcuggggaggggcaggcagggcgacaggcagggucucagcgguagggacacugagggccaggccuaguggcugguguggcgggaguggcgagccagggcccuguggguggugaggaguaguugcuggccagccuggaugacgaccucugacccaugucgccacuggagcugguggcaguggggcuggggaggaaggaacgccaagggccacagagagaacccaggcuccaucugggccgagacauccuggccucugaguuugacaggggagcccacugcccggccaaacaggagcuggggcugggagcucagacucaguccagcccaggugggaguccuggggaaggagauagcccacgagccucaccagcccugggugacagccagaugguguccgaagccccaggccuggggcaggcagggggugucugggccagggaugaacggaggccaaacuggguaacaagcagagucgggugugcagugucucauaggcaacgugaggaguguuugagcaggagccggggcaggagguuguggaaggcccuggaaggugccgaccagccaggcccucugauuuggccggugggggccaucggugacgugggaacgaugguuucagggaagcaguggcucagagcuccgugacguuuuuuggaacgggaggugcgagaugcagacauuuaacacauccggggcuguagccaggcagaggagcgucagaccccccacccuguuuggaagggagaacccaucagauucgccuuggguguagaugaaacagaaauaaaagaaucaaagacgacucaagacuuuuggcucgagcugguauugacugagaugggauuggggcagagggucacauggguucuggcagaugcggcguuaggagccuccuuuugaggguguuagauugcgcuguccuuugagcaugagucaagaauucuuuuuuuuuuuuuuuuuugagacagggucucacucugucguccaggcuggagugugcaguggcacgaucucggcucgcugcaaccgccgccucccaggcccaggaagugauccuccugccucagccucccaaguagcugggcccacaggcaugcaccaccaugcugugcuaacuuuuguauuuuuuguagagcugggguuuccucauguugcucaggcuggucucaaacaccugggcucaagugguccacaugccuuagccucccaaagcugcugggauuacaggcaugagccacugcagccggccugagucgggaauucuccagagaucagcuaggucucuccaaggagucuuccaaagguggcgauggcuaaagggggcaccaguuuggccacaucuagacaccaggaagguccucuugcuguagaacagugagcucaugguggggacauccucggaggugcagaacccagaacaagaggaagccagaccucccagccccaccagugucuggcucuguccccgcugaggaugucucaucagaacacaggguaagagcuggcauguccucuaggacagcaaagcaugcacccuguacagaagugccagagaguaucagggaacacccugugaugauugaucccauaggcaccaccagcagaauucgauucuccaaggacagccggaguuagugcaguuggguauaaaacaggaugggacgaaggcagucaggcugagagacgucuuccaaaagagcccgucaggaugcccagaaacugucaagaucaugggaaucagggaaagaccgaggaacaauccagggucagaggagaccaaggagacagaugccaccugcagcaugggcuccuggaccaggaaagggaccuucaccaagaagcuggugaauucaaaucauguggagaguuuaguuaauagcaaagcaccaaugucgguuucuuuagcugcaacccaugugccauggaaauguaagcuguaaugucaggggagcuggauggaggugacaggagcucccucuacucccuuuguagcaucucuguaaaucuaaaauuaaucuaaaauaaaaaaguuuggccaggcgugguggcucacgucuguaaucccagcacuuugggaggccaaggcaggaggauggcuugaggccagguguucaagaccagccugggcaauauagggauaugcaguuccuacacacacacacacacacacacacacacacaacccaaucaaaacaaaacaaaacaaaaaacagccauguguuguggcacacaccuauagucccagcuacucaggaggcugaggugggaggaucacuuaagccagggagcugcagugagccgugaucacaccacuauacuccagagcaacagagcaagacccugucucaaaacaaagaaaaaagacaaaccaaaacaaacaaaaaaguuuauuuuaaaaacagguaugagagaccaucaaaaauggcauugaagaccaggcgcgguggcucacgccuguaaucccagcacuuugggaggccaaggcagguggaucacuugaagucaggaguuggaaaccagccuggcuaacauggugaaaccccaucucuacuaaaaauacgaaaaauuauccaggcaugauggcgcacgccugcaaucccagcuacucaggaggcugaggcaggagaaucgcuugaacucgggaggcagagguugcagugaaaaaaaggcauugaauguuacuuucccaggaacucuauaacaaaaggaacacaagcuugugacuuaaaaccacaggaacuuauucucuaauauuucuggaugacagauguucaaaaucaaggucagcugggcggugcucccucugggaacucuaagcgaggauccccuccuugccucuugggcuucugguggcuccaggcauuucuuguuuuauggcugcauugcuccagucucagucuccgucuucccagggcuuucucuucuucuuuucugucucucuucucucucauaaggacacuuaucauggugaagcaggucagggucacuggucuuguugucuaagguguugucugagcuuguggucucaugaccaagaaaauuaaggaacguggccacaaaggccgagguuggagcaaaaguuuaauaaaagaaagcucuccacagcagagagaggauuccagguggauuaccguuuuaacaguugaauccaaaagcuucuuuuuuuuuuuuuuuugagacagugucucgcucugucgcccaggcuggagugcaguggugugaucucagcucacugcaaccuccgccucccagguucaaguaauucuccugccucagccuccugaguagcugggacuacaggcgugugucaccagacccagcuaauuuuuguauuuuuacaaaugggguuucaccauguuggccaggcuggucuugaacuccugaccucaaguguuccuccugccucagccucccaaauuguugggauuauaggcgugagccaccgcgcccagccuguuucuuucuuucuuuuuuuuuuuuuuuagagacggucccacucugucgcccacgcuggagcgcacuggcucaaucauaguccacugcagccucaaccuccugggcuuaagugauccugccgccucagccucccaaguagcuggaaccacaggcacccaccaucauauccagcuaauuuuaaaguguuuuuguagagacgagaucucacuauauuacccaguuuggucucaaacucauggccucaagcaauccucccaccucagccucccaaagugcuggcauuacaggcaugagccacuuugccugguuccgaaaauucaaucaggauuggaacccuucagaaaaccaagaccgagaaccacuuuuagguaacucaggaggcgugaagcaaaucagagagcaauuaauuggcuugaucucuuccucaccccaucucaccccauugcugcuucuugagcagccucaccuccaggguccccucaucuguaccccuuccccugaauucccuguccuccucauggcccucaggggaccccuggugauguggguagccaguacccuucucuccuacacugacgcccguagcuuccuuguggucacucccauguccuugucaugacucagccccucuguccaaaguccccauugcccucucaggggcugccgggaccggccauccguugagacacucucaccucucucuggaucuggugaccugcacucaaugcuccguaaaucccauuuucaccucugcugcaccugccacugccccugcagcaguucuaaagaacugggcugggcacggugacucacaccuguaaucccagcacuuugggaggccgaggcuggaggauggcuugagcccaggaggucaaggcugcagugagccaugacugcaccacugcaccccagcugcgguaacagagcaagacccugucucaaaaaauaaaaauagaaaacugugaacuucagcaccuacaucuggcccauguaggagcaucuucucuccugaggguuccugggcaccagcuguccccaucaucaucaucuccugcacugauaaucuggccaacauguccccaagaaagcagaaguggccgggugaggauguccagcugcugcuacaguggacaacagucccucucucugaggcuagggauguucacccagcuugccuauucaaggacauuucaacccaggagagaacgugcucucugcucuucuccaccacuggccucaucagccuguuuucccucccuuguagcagaauuccuagauccuccuggguccuccucaaacccagcugugccccaucuuccuccccccaucccgaagaccacuccuguccagcucccauguggcucucuuggugcuaaccccagagaguccccuccccuucuucuucuuuuuuuuuuuuuuucgagacagagucucgcucugucacccaggcuggaguacaguggugagaucucggcucacugcaaccuccgccuuccagguucaagcgauucuccugccucagccucccgaguagcugggauuacaggcguguacaccacaccuggcuaauaguuguauuuuuuuuaguagagaugagguuucacaauguuggcccaggcuggucuugaacaccugaccucaggugauccacccaucuuggccucccaaagugcuaggauuacagguaucagccaccaugcuuggccccggcuaauuuuuaaaauuuuuguagagauggggucucacuguguugcccaggcugaucucaaacuccuagggucaggugauccaccugacucagccucccaaagugcugggauuacaggcgugagccacugcgccuggcccuugaagcccuuuauuuacucugcacuccugcucugucucucuggccuccuggcuggccuccuucucuucuggggcccuuucucuacccacacuuaauccacaccgacuccuacauuucucuccuagccacgcagcuccccugagugccauucuccaucucccguguuugacauuuccagcaucuucuaaaauaucucaaaucagcccccaauuucaccccagacucccucucuagugauagacuagugucaacacuagucuaucgguguugacagcaauuuggggcaaaacccuugcaagagcccagggggucuugucuccucugucucccucuccuccucaucuaugaagaaacaucuagaaagugccugcaucauccuucucucucugcacacucgcucuggcucuuuucaccacagugguggauagaagccaaaagguguccaucagaguaaggccaucucggcccggcaugguggcucacgcccauaaaucccagcacuuugagaggcugaggcggauggaucaccugaggucaggaguucgagaccaaccuggccaacguggugaaaucccaucucuacuaaaaauauaaaaauuagccaggcgcggcgcucacgccuguaaucccagcacuuuggaggcugaggcggguggaucaccugaggucaggaguucuagaccagccuggccaacaugguaaaaccgcaucucuacuaaaaauacaaaaauuaucugggcgugguggcaggcgccuguaaucccagcuacuuggggggcugaggcaggagaaucacuugaacccaggaugcagagguugcagugagccaagaucgugccaccgcauucccgccugggggacaagagcgagacuucgucucaaaaaaaaaaaaaaaaauuaccccgggcaugguguugcaugccuguagucccagcuacuggggaggcugaggcaggagaaucccgugaaccugggaggcagagguugcagugagccaagauugcgccacugcacuccagccugggcgacagagcgagacuccaucucaaaaaaaaacaaaacaagaaaaaaagauaacagagaaaagcuaucucccccaagguggguacaccgccacccacaccucaaaaggcaaauacugacagcuguuucugaguggguagagaacacuuugaagcuuuugcagaaaaaacaaacaagaaucagcaggaaagcucugauaaaaagccccagggcgggggcacccaucaccgaggaugcuaaacuuuaccauuagaggaaucuauacucucugugggaacugaguggagaaacuaaccuaagaccuuaaaaccuuuagcaaauacuaaagaccauccuggagggcaggaauggaaagcacggggacccucuggaaaacacagugagggugugucuuuguuucccauaagccuuagggcaaacccccaccuuauaccaaaggugucgaugcagaaauggaaucccuggagucaucccagagccaaaaggggacagugugucacggagguuuguuuaugggaagaaucgagaagccacaaggguggaugaagaaacgccacucacggucucaaggaucacaggcaaaaucagaagacaagugacagaugggagguccaagcaaggcuuaucuccucucagauaaagaccaacaguccuuggauggggacagccaguuggcugugaaaugcaugcagagaagcugagcuucagccuaagagaagagcgaauuaaagugacagaagcccuuugggaggcggaggagggcugacugcuugagcccaggaguuugagaccagccuggacaacauagcaaccucaccucuacaacauagcgaccucaucucaacaaacaauaaaaaaaguuagcuggggccaggcacgguggcucacgccuguaaucccagcacuuugggaggccaaggugggcggaucaccugaggucaggaguucaagaccagcuugggugauauggugaaacccugucucuacuaaaaauacaaaaauuagcugggugugguggcaggugccaccacacuacucaggaggcugaggcaggagaaucgcuugaacucaggaggcagagguuccagugagcugagauugugccaccacacuccagacuaggcaacagagcaagauucugucucaaaaaaaaaaaaaaaaaaaaauugcugggagugguggcgugccccuguaaucccagcuacucuggaggcugaggugggaggauccauugagccuuggagguugugccacagcucuagccuggaccacagaguaagaccaaaaaaaaaaaaggaaaauaaaagaacauggaagggaaguagguggagacagcagaugccagccagggccacuggagucaaggacuagccuucgugggguggguggcagaggagaggaggaugugcagggucccacuguggaggcgguggaguugucaggcccaggccgguacguggguuuugcccuccagcggccuggagaggcagggaggaggggaagaggaagguuuaauuggagagggggaagcaaggaggaagugccagggugccaggggggacauacgugccuacggggcagguugaaggaggggcagggugaaggcaaggaggggcagggugaaggcgaggaggaagccacaaggcgaggcccgggccuggccggguaaaaggagccagggggugugaaacggccagagaagaagcgggaaagagggccaggcggccgcguggggcucccaggcuaaccugcgccgguucugacccccaggaagccacugaggaacggccuggugaaggacaagcgcuucugaaccccucggccccgcccccguggacccggccccaccccgaauaccccggccacgcuccccguccuuggccgccccuccacccccuccaacucugcuccucuagggccgccgccaccuccccugggaccccgcccccucauccugccuccaguucccggccacgccccccaggaccccugccccuccggggacaccggccccgcccucagcccacuggucccgggccgccgcggacccugcgcacucucuggucaucgccugggaggaagaugccaccgccgcagcaaggucccugcggccaccaccuccuccuccuccuggcccugcugcugcccucgcugccccugacccgcgcccccgugcccccaggcccagccgccgcccugcuccaggcucuaggacugcgcgaugagccccagggugcccccaggcuccggccgguucccccggucauguggcgccuguuucgacgccgggacccccaggagaccaggucuggcucgcggcggacguccccaggggucacccugcaaccgugccacguggaggagcugggggucgccggaaacaucgugcgccacaucccggaccgcggugaguggggcuuucgcuggggacacugguccuggaggccagaccucgcagggcgagccucgagaguggcccggggaugcccgagcagcuccgaggguccccacccgcccuguccaggcuacuagcaacuucggccaccgcaccucacccuuuccucgucaucugcugcacgccggggacacaugucaggggguucccaagaccaguccuucugcuugaugcugaagcccuguccccaccccaugcccacccccaccucuugacacuaaugccuuccugcagaugccauccccacacccuagcauggcuuccccaggggcccagguucuggcucaugucucccacuucggccaccccuccuccuaugccccccgccgagggcagcccaccccccccgccgcaccccgcagggcgccuuccuuggaacucaugcccugcccccacuccaucagcccaccccgccgcuucacacccuucccacagacggugcgccccgagccccagcguucaccuuccucccugucccuaaccgagaccccaugggcaggccggggacgcagcgcgagccgaguuccuguuccuaccuccccaggugcgcccacccgggccucggagccugccucggccgcggggcauugcccugaguggacagucgucuucgaccugucggcuguggaacccgcugagcgcccgagccgggcccgccuggagcugcguuucgcggcggcggcggcggcagccccggagggcggcugggagcugagcguggcgcaagcgggccagggcgcgggcgcggaccccgggccggugcugcuccgccaguuggugcccgcccuggggccgccagugcgcgcggagcugcugggcgccgcuugggcucgcaacgccucauggccgcgcagccuccgccuggcgcuggcgcuacgcccccgggccccugccgccugcgcgcgccuggccgaggccucgcugcugcuggugacccucgacccgcgccugugccacccccuggcccggccgcggcgcgacgccgaacccguguugggcggcggccccgggggcgcuugucgcgcgcggcggcuguacgugagcuuccgcgaggugggcuggcaccgcugggucaucgcgccgcgcggcuuccuggccaacuacugccagggucagugcgcgcugcccgucgcgcugucgggguccggggggccgccggcgcucaaccacgcugugcugcgcgcgcucaugcacgcggccgccccgggagccgccgaccugcccugcugcgugcccgcgcgccugucgcccaucuccgugcucuucuuugacaacagcgacaacguggugcugcggcaguaugaggacauggugguggacgagugcggcugccgcuaacccggggcgggcagggacgcgggcccaacaauaaaugccgcgugg

SEQ ID NO: 191881 - RNA, 36296 nt, Homo sapiens
cacggcgacggcggcgguggcggcaguuccugcucuaggcugcgagcggcuggcggcuucgaggggagcugaggcgcggaggggcucggcggcagcggcggcggcucggcacuguuaccucucgguccggcuggcgccggggcgcgcgguuugguccuuuccgggcgcgcgggggcgacagcggcagcgacccgaggccugcggccuaggccucagcgcggcggcgggcucgagugcagcgcggaaccggcccgagggcccuacccggaggcaccaugagcguggaggcguacgggcccagcucgcagacucucacuuuccuggacacggaggaggccgagcugcuuggcgccgacacacagggcuccgaguucgaguucaccgacuuuacucuuccuagccagacgcagacgccccccggcggccccggcggcccgggcgguggcggcgcgggaggcccgggcggcgcgggcgcgggcgcugcggcgggacagcucgacgcgcaggugagcggcacauggcggugccggaagcccgggcccggccucggcgccugagaccugccccgaacucgccucgggcccggccuguguuuggccggagucccccaucgcggccgggccuggggcgaucugccccggguccccuacucuggcucggccugagcuuaccugccccagguccugcaaucugcccgggccuggccugaucugccccgggucccccgcuccggccgcgaccuggcugaguuccuucggcccccaacuccugggccgggcagacuugccucgaguccuccacuucguucgggaccgagcuaaccugacccuguuccuuuacgccagcuggguuugcucccccuccugggcccgggcugaccugccuugugucccacaaucagucuggccuggaguaaccugcccccugacuuaucugaguucuuccauuccauccgggcuagggugaccugcccuggucccucuuucgcaggucucgguauucugccucgaguucuccuacgaccugggccgggucuugcucaggccggagcuugagugacuucccucagucccuuuccgggaguauccagggugaccugcccuaauccugucucuggccugguccggggguccugcccggucuccccauuggugggucuggccgccugucccaccucccaucuguggucgcagccaucugggcaccccaccuuucacagucacggagcguagguucgacuuuccccaugcauaggggcgcuggccagcggaagguugaggcagagaagaauuuuugccucccauggaggagcacauauuggcuggcuauuaagaucauucaggaagcagguuguauuuuguuuuuucuugcaucgccuguugcugaaaccgaccuguuacauaacuucacaacucuugccuuggaaaaguuggguuugaguuuuguucuuccaauaagacagcaauaauggcuuuacauaaacgagucugccacguuggaaacuuauuuuuaaugauguggauguuuagagaagguuacuuagguauuuuaaaugggggcuuggguugggagaaguaucgggcaugcauuuccugguccugggcgcugcuugccuggggugggagaggggcuggggggguggcgcguguugcaccgggguccuggggaauguccucaucacccucuggauuucagguugcuuucaccuuaggcuugcuuugugccugaccucucgcucagguuuguuuuccugaaugcuccgacaggaagaagcuccgaggcuuaccuuggcacaggugucccuuggcauaugcugguguuucagaacugggggaaccacuccuugcucauccagagugagcucagacccuguccuugcauggggggcuuacgugguagucgauugagucacucucguggguagaccacccacuugggcuuucuuuuagccccuaauggaagcaaaaaacauuugacucauucuaaccccauauuccuuaaaauagaagguggggugugaggagaacaggugugcacguauggguguuuuuuucaguuuuguuuacauuuugcgaagggagggagggagagaggagaguucuccugaagaagggagucugagcugcggaggccccaccuccuuguaguuuucaugcccuguagaccuuucugcuuccgcagcugugaaauggggguggcaguuagauuuuuauuccuuuuaaacauaaaggaaaccuagauccaugugugagucgacuguauacgcugucuguaaucugacguccagccugucggggagacucgguaaagaucucuguggagcagugagccaugagcgugacagcgcggaucgggggguuggcugggugugaaagguaaucauuuucuugugaauccuuuuaacuguagcgagcauaaaacagcaaaccuggggcagccuuuaguucugcuuuuguuucuggcauuccguuugggauuaauuguggggcauguccuucucuuucaguugaaacaauugauuuuuuuuccugcaccugaacacacugggcuguacaaaaggagagcauuaaaacgcuccccuggagguaaacauugcaguugagcucacuagaauucugacgacaucagaggguuuguccugugcuacuuguaauugacccagaugccccacccaccuguuaccuguaauuuggauuuguuuguggggaaugggagugguaccccuuugcaucacaaggggaagaacggaauuugggggcaaggaagucuaugaauaucauucaagggaaagcggaagaaaguuaucucuugugugaauugaaggcagugucugcuaagauauuugggaagacuuucccuguuuguccucaggaguuggccguguaaccagcuguuaaguugggggcuccuggaaacucucauucugcuuuuuuaauuuuuauuuuacuggggaaguggcuaucagcugucaagugcccugcagucacuuuugcuuagcggcuuuauugaaauagaauucacuugccacaacauacaauuuacccauauaaaguguacaguucggcggcuuuuauuuaguauauucagaguugugcagccauuaccacaguaaacuuuagaacauuuuugucaccccagagauaaacccugcaccccuuagcccauccguccuaccuccacagccccuggcaaccacucaccugcuuucugucucaagaugugccuguucugggcauuucacaucaacggaaucauaucauauaugguguuuugugucuggcuccuuucacucugcgugaugugugagaaguagcuacaaggugagcuucguagcuguucccuggccgagcauucaggaaaaugaaccugaucgagguucauccacgcugugguaugugucaucauuucauuccuuuuuuuuuuuugagacagagucucgcucuguugcccaggcuggggugcaguggcgugaucuuggcucacugcaaccugugccucccagguucaagcgauucuccugccucagccuccccaguagcugggauuacaggugcacaccaccaugccccggcuaauuuuuguauuuuuaguagagacgggguuucaccauguuggccagauggucuugauuuccugaccaugugguccacuugccucggccucccaaagugcugggauuacaagcaugagccaccgcaccuggccagcauuucauuccuuuuuaaggcugaguaauauuccauggguggaaugguccagauggauggaccauguuuuguuuaucucgucaucuguugauggacauuuggguuguuuccaccucuuggcuuuugugaauagcacugcuguggccaugaguguacagguuucugcguggauguguuuauagaccugcugggccgcguaguaaccuuggguuuaaugguuucaguaacugcaagacuguuuuccaguguguagccacuuuccauaccaacccuaccugaacugguuuugcgcaguugguuuucccuuaauguguguugaaagacaguguguccccaccgggaugggaaaguggcagcaggggugacucccugcacucagagcugguucagauaacacuccuuuucuuguuuaugaaaugaaacugauauuuaucaaagcccuugagauccugggaugaaaagcgcugacacaguauugccaaguguccuuaagauacagggacaguuuucgagcaucugaccuuuuccugggcccuucucugcugccacuucuccugcucccaggacagugaagguaauuucagaaguccuuugcauaauagcugguguuacaagccuuuuggucugccugguuggaauauuuccucuugacuguagcuucugcccuggauccuccaaacgggaacuagagugaaacucuuaagaguuggaaauacugcucaguauuaagaaggaacaaacuauugauaccugcaacaacauggaugugucucauaauaauuacuuuuuuguaugugucauucaucauaugauuuaauucauaaaaaaauucuagaaauugccagcuagccugcagcaauagaaagcagaccagugguggcuggacagaaaggugggaaaggggaggcaggugacaaagggcacaggaaacuuggggguaauggacguuuuuauuaucgugauuguagugauaguuuuauggguguuuaaguacauugauguaugucaguuucuaaaauggcacacuaaacauuugcagcuuaugguaugucaguuaugccucaaugaaacuggaaagaaaagucagggagauaccacuauccacccauuuuuuuuuuuuuuuuuuuuuggagacggagucucgcucuguugccuaggcuggagugcaguggcacaaucuuggcucacugcaaccuccaccuccuggguucaagcgauucuccugcccuagccucucgaguagcugggacuacaggugugugcuaccaugcccggcuaauuuuuuguauuuuuauagaggcaggguuucaccauguuagucaggauggucuugaucuccugaccucguguuccgcccuccucuaccuccuaaagugcugggauuacagccgugagccacugcgcccagccugccauacuuuuuuuaaaaggcugaaagugcuacuuggguuuuuuguuuuuguuuuaaggcaaagucucauucugucacccaggcuguagugcaguggcguuaucaugggucacugcagccucgaccuccugggcucaagcgauccuuccaccucagccucccaaguagcugggacuacaggugugugccaccacgucuggcugauuuuucuuuuuuuguagagaugggguuuugccauguuacccaggcuggucuugaacuccugggcucaagagauccucucaccucaggccucccaaguguuggaauuacagagugagccauugagccuggcaaaagugcugccuggaacucucaugccauacaccuaccugugaccuagcagagaugaagguguguguacgcagggcugcgccaaaugcugacagcaucucuucaugagaaccccaaaccggaagcagccccaguggccaucagcagaugaauggguaaacaaagcaguguguacauccagugggaaaaaugugugccuauugguuugaguugcuuuucuuagcucaccugaaaguaugaggucuguggguagguacagaccuuuuaggcagcaacacgcauguuuuugugcaggugcucugggugaccuuguagauagaugcugcuugguacuggucccacuuuguuccuucauccucaggucaggucugcacugccuguuccgucuccacuccugguagccugugggagucacagcugaauagucaucucguacugggauuuuacucugagugcaugaguuguuucccuaggaaaaacaugcugucuuucuggaucguaagggacaacuagcuaaagcuccuagccgaccugucguccagcccucacucuccuccugccagacuucucuguauugccuccacuucucugaguguguaaaccugggcucacuuuuccuuuugaagugguaaaauacucaggauagaaaguugcuacuuugucuucaaagccauuguccugaccuauccuugacuguccaggugaacacaccaucuucugcugagcccugagauuaugaccaaggcggggugaguuccauacagucuuggguuccgaaaaguggugaguuuaaaaucugcacauguagcugggcacgauggcccaugccuguaaucccaguacuuugggaggcugaggcaggcagaucauuugagcucaggaguuugagaccagccugggcaaaauguccaugaucgcaccacugcacuccagccugggugacagagugagaccuugucuuaauaaaaagaagaaaauccaggccgggcuugguggcucacgccuguaaucucagcacuuugagaggcagaggcaggugaaucaccggaggucaggaguuccagaccagcuugaccaacauggagaaauccugucucuacuaaaaauacaaaauuagcuggguauaguggcacaugccuguaaucccaguuacuugggaggcugaggcaggagaaucgcuugaacccgggagguggagguugcggugagcugagauugugccauugcacuccagccugggcaacaagagcaaaacuccaucuuaaaaaaaaaaaaugcucaugacuucauuuuggcuuuuugaauccucugguagcccaggugugguuuuagggugccagaacauuggagauaagaugccguuuaccuggaggaguguuggcaaguguuuggucagcacuuaccccuuaguagacuuacugaguguguuuucaaauuguuaggaguuucccagugauuaugugaaagugaccugagcugacacuuuacaguuaguggugaauacacgaaacaauuucuauuuuuaucacaauuaauuacccggauucaggaugacggggugggggauuaugacuaauacuauaccaggacuaacuaaaaaaagaguucccucucagccuagcuaccaccaccacaaaagcuuaccaccaucagcuaccaccacauuucucucauugcuugauugaagucugaugaccuaccagggaacccccuucuuuucuuuuuagacggagucucgcacugucgcccaggcuggagugcaguggcgcgaucuuggcucacuacaaccucugccucccggguuuaagugauuuuccugccucagccucccgaguagcugggauuacaggugcgcaccaccaugcccaacuaauuuuuuuguauuuuuaguagagacgggguuucaccauguuggccaggcuggucuggagcuccugaccucaggugaucugcccaccuuggccuuccaaggugcugagauuacaggcaugagccaccacaccuggccccuuuaaguauagaacuuagugcuguuuuaguaaauuuacggaauugggcagccaccacagcagugccuugcugucucugauuucucuuucgcuccuuuccgcucccuccccaccaccccuugucagacccugugcucaugcccaaggucacccguuagggagguguguccaccgccucagacugagcccugcccuggggaggucagaaacauggccaagcccuggccccaugcucccccgccuuuaagccccgugucuguuaacuuuugcacccucugcgagcugcugggcaaccucuucagccuggcccuggacuucagccauccccugcuguuuucuuacuuccuggccuugcugugcuugugggacugagggcagugaggccagcagagggagagugaagccuuugacccccgcgguugcacuguuagaagacagcacaugccgccuggccagggugcugugagggccccaggaguaggagugggcuccccugcuaagggaaagccugugggaauggcgccucuggaguuguucagaagcuguaccugccaggcagaggggugggcacagcacuuugccuagaaggagggaggguggauguggggccaguggggccagggcaggggcugggcuguguccuggagccuuuaggagcugcuggggugccuugaccaaggcugggaggagggcucugagauggcaguggcggggguuaggggaggggcugugguguuggagguugggcauuguggcccagguuggaccccgaauggauggaggggccacagggcaguggagacggaggacaccgggaucagggcuguguguguacauguguguaugcaugaguaaguguguaagugugugugccugugggaacugccaggguaccggcugcccccucccaguccucacagggagccacagacuuaaaaagcagcuccagcuccugccuguggucucaucaggguccauaauuccccaggcugagccggggcucucuccgcuggggaggcaccguccugagggccuugugagagggagaggccuccccagagcggcugcaaggaagcuaaagggcacaugcugggcagcagcucacaacugaggggcaguuugugcuugucaugguggugagagugcuuucaugguggucgggauagucuagcuuggcagagaagggccgugacacccagcugugcucuguggcauucagggccgaggggccuggcuggaggggcuggugggaggaguggguccgggcccuggcaccagugcuguucggggcuccggaggguucauggccuugagcucuccuugcuggagcacauaccuaugagagcaaaguucugcuuucucugauacauggagggcugcuggguccuggagucugguggcuggcagcagguccuugugccuuuuucuguguuggucgaauagcagcuuaagagccggguaacccagccgggcuucucaggucccgugggccuuugccaggauggugucuagauguguaaagguggcucguugggcucuagagagcccuugugacagugagcauggcaucuuccugaagcaucagcuccuugcagagcgagugcaggcuccuggcggcccugggagaggggguugcagaucccaggcagagguguuuggucagagcugcgcugccugcaccguccucaccucuuuuucaguacggggauccaugcgcauagcuugcagcccugcugcauccuccguguagaaacgucuacgaugaauucucuaacauacaagagcuggugagcccugugccuccgucucccugaugagacaguugugaagguuuucuucucccuguuuucuuuuuuuuucuucacugguguguguuuuuaaagcaagucuuuuguguccuuucaccuuugugucugagguggagcccugugaauuggcgauacucagccauuuugaccugcaguauguaguaugcauuucuagaagcagaaaagggcgccuguccugaauagcugcagcgccguuaucacacaagcagcgucaacaauggcuuuucacgauuguccgauauguagggacaguuggccucucuccacagcagauucuuuacugggauccuggagguccgcuguugagaugauggcugucucugggcccugcguuccgagcggccucucccgcugcuuuucaucucgccaagcugcagucuggccuggguuguuguccugugaggugugcaccuucuggacugaaccccucauugucacacuucagcuucuugcugaagguguggaguggauuucaucucaggcugugggcuccagggagaguggcugauccccgggcugggaaggcaggggcggccugaggugagcuggggaugccuugcacacucggcccguugaaaugaaccucacgcggacucuagcacaccuggcuggaacaagggucugccgguccacacaggugccauuggugagaggggaggcgagaggcccuuucucuuugggaagaacgaaugugagccuaggcaacauauugaaaaauuaaaaaacuuucuaggcauugugcacaccuguagucucagcuacuugggacgcugaggcaagaggaucucuuuuaaguucaggaguuugaggaugcagugagcuaugauucuaccacugcacuccagccuggguggcagagcaagacccugucucaaaaaaauaaaggaauggagagccuggggaccgcugugucggguggugggacuaugugaaagauggucaacuccuagcaguuucacgugguucaaacuaauagauuaaagguggcuaaagagacaucacaaaucacgugcagucauuaacugggacuuggauucuuaaaaaccuguaaaagacguuaugaagacauuggggugaugggugaauguguauuaaccaacaguguggcaggcugggugcgcucaugagccagcuguuuuguggggauguggagaaagcccuccccuggggccggccacucugaaaugggucaggaagagauaagugugugagagcaaggggagucggagugcagggggaugugauggagaguguccagcuggaggggugugggggucggauuucuguagcuuuggaauuuuucaaaauaagaggaaauaucagggcagaauccuuccaguuugggggccagaccuccuggcaacccucugccuugagagggcucagagacccugcagcuucuuggcagucaucacucugaggguguggugaacuuccuauucccuccccuuuuuuuccuuuacaauuuuuuuaauuaaaaaaaauuugggggggugcugggugcaguggcucacaccuguaaucccagcauuuugggaggccaagguggguggaucaccugagguugggaguucgagaccagccagaccaacauggagaaacccugucucuacuaaaaauaggcgugguggcgcaugccuguaaucccagcuacuugggaggcugaggcaggagaaucgcuugaacccgggaggcagagguugcggugagccgagaucgcgccauugcacuccagcguaggcaacgagagugaaacuccgucucaaaaaaaaaaaaaauuuaaauagagauggggccucacuaucuugcccaggcuauucucaaacccugggcucaagauccuccugccuuggccucccagagugcugggauuacagguaugagccaucacgccuggccuccugcccucucuuuuauuuaagccuuggaauuagagaaucaggaaugagcugcuuugccuuuugagcuuggccuuuagccaacaauguugagggccuccuggggugcaggcuccaucuaggugcugggcucauggcagggagcaggacagacaaugccccacgggggccuugagguggggucagaggaugccugccugagaggcacccuguggaccucacccugaggcugagggaacagcaggugcaaggccugggugcuggcaaaugcagacaguggugcaaauguuggaguagaugucugcggccugagaguuuaugauggcacauuuggggggauuuuugaguuuuugaauuucugugguuuucgucugugggaaugaagugacuuucuuuguuuuuuuuuuuuuuuuuugagacagagucuugcucugugacucaggcuggagugcaguggugugaucucggcucacugcaaccuccgccuccuggguucaagcgauucuccugcacggggauuacaggugcgcaucaccaugcccagcuaaucuuuuguauuuuuaguagagaugggguuuugccauguuggccaggcuuguguguguguguguguguguguguguguguguguuguuguuaagagagacagggucuuggucuguugcucaggcuaaaguucagugguaccaucauagcucacagcggccuugaccugcuggggucaagcaauccuccggccucaaccuccugauuagcugggacuacaagugugcgccaccacaccuggcucguuuguguauuuuuuuguggagacaggaucuuggcuguguugcccaggcuggucuugagaacucccgggcucaagcgauccucccaaaguguugggaugacaggugugagccaccauuccuagccuugaagugaccuacuguugugcugcccugaugcacggucugaguucuggagcaugucucugggcagaaagccccuguacagcucuuagauggacuuccaggaugugguuuuagucguagcuagguucacauccagaacuaaaggaguuagagacuccagcucuggggccucguguaugacuaggaagugggaauucuaggauacgucuuuaaauacuguguccagagcagaggugaugggaggagcugcuuuuuuugggggccggggggggguuuggguuuuucuuuuuucuuuuuuuuuuugagauggaguuuugcucuuguugcccaagguggagcgugcaguggcacggucucagcucacugcaaccugcgccuccuggguucaagcaauucuccugucucagccucccaaguagcugagauuacaggcacgugccaccacguccagcuaauuuuuuuuuuuuuugccuuuuuaguaaaaacgagguuucaccauguuggccaggcuggucucgaacuccugaccucaggugauccgcccugccgaggagcugcuucuuggugaaugccugggauggguacagggaggccuugccccuccagagccucccuggugaggggauaaguugacagccucaaaggacuuuauuggaguggcagcucugugccagcugaagaugaugacccucuuguccuucacccaucauguccccuggcgugggcuguggaacuucucugugccaggcacuguccccuacugcuguuuuaccucauuucaugauaguuccuagggucaaauauauuuuugaaauuaauguuuuaucuugaaacuuuucagagagugaagggagaaguuaacccagaagucagcuuguguugugaccagaucacugcagggcagcauugggcccagugugcaucugugcgugcagguagcacgugcccaugcaccccagccaggcgggcuggaggggccucuguggggugcugcuccccaugagcaccugucccuaggcucgcacaggugcugcaucacacagcaagggcauuaggccgaggggcugucuggggugcugggacuggcagugggagauuuggugccgucccuaggggagcucccaucacuccucccuggcccuuaauuuugugccaccuuguguucugccaugacacagugcucccgcugccugaccccguggugggguuagguggccuaugggggccaugccagggacuguuggccaugucauuugaggugcugguacuugggaguggcaugaggagccccaguggcuguguggucuccuugcaaguguccugugcaguuguggccugaugacuuagagccaugcgcugucugccuuugcugaacauagaagaggcgccuucagugaggguguggccucgguugccaaggguaucucaguguucaguuucuacuucauccucaggagagggcugccuugaagggauggggagggugagguggcaguggauguggccagugacauuuccacaucugcauggguggcagcuucguaguguuugaugagccuuacacuguggugggucuggcaucaugaagcuguccucagggcacacugcugucagucuguaaaagucacccugcuccuugugguccucagucaugggaaagaagcaucuuccuaagcauccugguugugggcauggacauggcucuguggcuaggcggggguuagaccagcugugugggggaccgggggguguagaaggccaccaguggcccuuuuuuggccagguagguuugcuagagaagagugaaauccagucagaacaagggaaacugucucaaagcagagaugaggccagggugucacaccagagucaucgaggcugguucuucugcacugaguccuggaagcugcagccucacucaggugacacugcguucugcugcagguugggcccgaaggcauccugcagaacggggcuguggacgacaguguagccaagaccagccaguuguuggcugaguugaacuucgaggaagaugaagaagacaccuauuacacgaaggaccuccccauacacgccugcaggugagcugagcucagcugggccugggcaugugcuggacaggugggugccucuggcaugggccugggacacucaccucccagguacaggguggcgcccuugugcugugacucuggguggcgguguccucgggaguaaggaaauugcucaggccaugugcacagccaaggccuguuaccggucaggaggugggcucagcaaccuccgacacccugaauucaccagcuggugggaaaaguuuuccuuccuuuggccuccucagacccugggggcauugccugguaccugcgcacucacucauagaaagaauuugucauggcauugggugagcaucuggggugggagggugaguggagcagcugagauacccucacaaagcaguugcugcaggguucuggggcaucccugccucccgcugccuuggccgugccuggagaauuggaugugaagacaguaguuaguggauagaccugcauguugacaaauuuagaauucucaucucgagugggaucgucccuuguugaggcuuauuucuguauuuuugugacacacaagugaggaaauguagauuagaagaggggagaagguuuuggccaggcacgguggcucacuccuguaaucccagcacuuugggaggccgaggugggcagaucacgaggucaggagaucgagaccauccuggcuaacacggugaaacccugucuccacuaaaaauacaaaaaauuagccaagcaugguggcgggcgccuguagucccagcuagcuacuugggaggcugaggcaggagaaugacaugaacccgggaggcggagguuguagugagccgagaucgcaccacugcacuccagccugagcgacagucacggcagguuugggccugagcccugccucugucugugggcacccacuuggggcccucccugcagcuccuugcccgcgugcugcccagcgcuccgggacugaggcugcucuucgcuaggcuuggugggcaggcacucuuuccugcaucucagcucuucacucauucucauuuacagauguuuucguguauguaauuguguucucuuaacacacagagauggccauaaguccuggugcagcucuggggagcuaguauuuuuggguuugguauguggauuuucagaaaaccacagccagugguggggugaggcucucccgaggcuccucgcuugggcuucggggccugagcuucagggcgcugcugcugcagggucugugcccagcucccugggagcacagugcccucugcuggagcccagaguucaccaugaccacugggucugaggcuggauuccugaauuucaggccaaagaacggggacuagaauggcccuggaggagugaggccuccuuccagcaggacucuccuuggagguggcuuugcuccuuauccccucggagcuucugccacauaccccuucccugcauucuuggauuugagaagcccugguuaacugguuugauuugguuacugggauuguugggguugaguauguguuuaaugaagaacuuaaaaauguugucagaggaaagaauuucacaucuugccaaaugaaaaccagagagcaagcuuccagcuguaacugucgcuguuuugauuuuuuaguuacuguggaauacacgauccugccugcgugguuuacuguaauaccagcaagaagugguucugcaacggacguggaaauacuucuggcagguagauaaucagaccaugcauguguguuuaaucagugcugugcucagauuuguguguaaauuauggaaauguugaagcaaagcguaauauaaaaucacgcuaacaaaccuggguuuuuuccuccucugugacugguuuaacuugaaacagaugguggugugugaaugccuuaauguauuuacccuugauuuauucucuguggcucuuuuuauuaugcaaguaggguuggcuuaauucuccuucccaguuuuuauuucgauuuuucugcaagaugagcucuuggcacacccgcugaucuucauuaacgggaggauguucccaaggcaguaacgggcauccaggggcgcugguuccugagcaagcuugcucuggccugagcucaucggagcuguccggaggcuaauucaggccagauccugaaucaucggcuucaauuaaguucacuugaccgucggcgcugggcuugccuuccugauguugaucagcugcagcuggacugugucgcuuguucuguguuugggacaggacaguguucucccagugcccaaauuccaaggggggaguucgauggucuugcccgaguggugggacucucguccuggugggucccgugcuagcggcuccccuuccccuccagguugcuguguacaggucacuccacugcuggagaggauggagcagagccugggaggcagagcuccgaggugcuagcaaggaaguguggggucuuuuucugagguucacguucuggagaaagaaaaugaccaaagcccggaggcaggcuuacuugugcugacacaagccccuccugugccuuugacagcugugggucucggaggguuacagauggagcagucagaucucguggcaucucugaguuaguaacuugaaauaugguguuaugagcaaagccagaaaggggcugcuguuuuuaaaagauuuuaaagaaggguaucuucuggauaaccaaaagacauucuugucccauuuucagaaucuucuggguaauuuaaguguugcuauguuugcauuuaguuccucuuguucaggaaaagcaacuaaauaaaacuucucuuagcuggcaaccccagcuuccggucagcauagccaagaacagggaagugagcaaaagggccucugagaaacaacaggcuugagccaagcaccacugagcauucugugcgaggcccaggggaaggugaggaagcagccgcuggcccuuagggaucuuggcugugacagggugaggaugcaugagaagacacggagacagcugauucugcccacguggccggcagggcuccagaguggagucgggcuuuggagaugcucagaguggccauggcugguuagagaauccugggccucguggcagggagaaggguuagaagauuagcugagcugaagcuuuuggcaagaaugguuuuccagaggggaagagagagggcgcggugaggaaggcugggaggcccugcaggcguguucagagcugcuggagacaccggaagagcccaaaggcagagcagcugggcauccuuguuagauacggcagauaggugcuggaggguggcuggcuuggcacagggcaggguucagcccagaccgcgguuuaggugagcaguguccuggccacgucgcagcaaggaaggagccgagccagccagggcuucacacacagcccugggcuucuguagaaccgcccccgccucugcucaaccuuuuugcugcuuuuugcggggguuuccagucgccugcuuaucagauuucccggccugcagcaaagcaggagggacuguugcuccuggaaguaggcacagggccucugaggagugauuucagaagaagccacagaagaugguggcggggguugaccuuggaaagaaggggcuggggccuugugggaaaugucucugaccccacagcagcccugggccaacaauggguuaaauuaggccugauaaguuggauuuaagaaagcaggauuuuuaaaaaaggcaggaacuaugugaaccguguuaaggaaguuuuccuuaaagugguucaaguugggauugauuuuugugcucaguggggagcuaguuugggggagggcuggcccccagagaugccagauggaugaggugugacugccucugcuaauggaccgugaacgguaccggaacuuuuaacaggggcccgaaaauuggaaguggugaaaagccaaauuuuggguguuaaccguuuaucauuuccugguuucagccacauuguaaaucaccuugugagggcaaaaugcaaagaggugacccugcacaaggacgggccccugggggagacaguccuggagugcuacaacugcggcugucgcaacgucuuccuccucggcuucaucccggccaaagcugacucagugguggugcugcugugcaggugagugguccccagaugucuccugggggugaccuuuaagcuccagccgucuccucacaagccuuggcccagcccagcccagccguggcucuaacuccagggaguuguccuccaaagaugguuuuugcugaagggugaggcaugagagcguuuaggcgcugaggcuuguuaaggagucggcagugccguguaacucuuuuggggcguucuggcuaagucauaaaaacaauucuguaaaaacaaagucuguucugaguuuuaagaguucagagcucaagugcacagggagaugcgauuuauuacuaacaguuugaagguaaugugaucacauaauaaaaugcagggcaugccccuuugggugaaaggucagcaugggagggggcccucccugcuccggggcuucagggacgggagcugguccucacggcccccucccgcucugcaggcagcccugugccagccagagcagccucaaggacaucaacugggacagcucgcaguggcagccgcugauccaggaccgcugcuuccuguccuggcuggucaagauccccuccgagcaggagcagcugcgggcacgccagaucacggcacagcagaucaacaagcuggaggagcuguggaagguggggcugcccagcgggccgacccgugccuucgugugguuucugguugcggggaggggagugucuucagagacggcuugacccagugagaccgcuggagauucucugaaaggaauucaggcagaccucugccaccucuacguggaaugaccucagggcaccuuggucaccuuccauccaggcagccuuaccugaccgagaagauccuggccuuggggaaaggaaagcucuggcugcuggaauuuuucuugucuugccggggugaggauggguggugggaggggaagaauggggcuggcugugggcagacuuguccugcagagccugaaccugcccagacaggugggcugcgagaauguccuggggaaauagguuggugucgaggucggcacagucagcugagacagaggggagaggagagggugccgggucaaguagugggugccuggcccuccuuccacagacagcccucacuuuuccccacggaagccuuucugugcuuccagcuguuuaggauuuugugauaaaguaguucuaauaacuaggcuagaaguuuucauuugccucccauucagucagaaaucucacauaggaaaugaagugcaaguuaaaauauuuuuuuaagcauuguucagccggguaccuuuccacuuggauuuuccgguugccagaugauuucaugauucccguuuauaucugaacagcccagaaaauguccuguccccaccagcauggcacucacugagggagcuggcccccaggggaagagcugcgggcccauguuggucuggcucaggguuagcagacgugggagacaggccucccgggcuguggacacagcgagagaaaccgguggucuuuguggcagccugcgaggcggguuagcugcucucguucacaagcugggcauacuuggaggaagcagcuggcucugaaggugcccucugcuguggacagugugucaggcuggugccuggggcuuuguaggcagguucacccaaguaccggaaccccgcuggggugcggagcagcagcugaggcccaggcaugggccaggccggugugcagcucccuguguggcauggaguucccguucccaggguucuccuugcagguggggcugcgccagaaccccuccaugccacccaccguggcccauucugagaagcggcaugugugcuccaucccucuggugccucugcgcccucguucauuugcauguagggaaaaacaggacgaguguggcgcgguguuguugucuucuaggaaaacccuucugccacgcuggaggaccuggagaagccggggguggacgaggagccgcagcauguccuccugcgguacgaggacgccuaccaguaccagaacauauucgggccccuggucaagcuggaggccgacuacgacaagaagcugaaggagucccaggugaugugugcgagagggcuuggccuggggugggcucuggcucucacagcucucuccucaggcuuccagagggagguuuucucuccaggcugugggagcugaugugggcugcagccgcgacaccugagaguuggaacuugcggauccgggccuggcagcccgguggucugagcccccgcccucagaucugacaucagccucaguguuuucuguuuaaauccaacacaucuuucccagugggguccacagcuuugcccacaguugcgagaguuagacucgggcgugaucccugugaagaccacauuuaggcaacgggagcccuggagcgcugaccuccccucccucccuccccuccucuuucugucccucccuccccuccucuuucugucccucccuccccuccucucucucuuccucccucccacagcagcugcucccuggccacggaggccucuggugugcggugaagccuccagacgggauuggccuguguguguuccggggacuccuaauggcuucucuuucagaugugcccuugguggcauuuggggcugcaggugccacucacggcgccugcucucacggcagaggcuugcuguagggcccgccucauggggccucgggcauguggaggccaggcccgggccugugcuggaggcuaaccggggcucuuguuuuucaugugcucagacucaagauaacaucacugucaggugggaccugggccuuaacaagaagagaaucgccuacuucacuuugcccaagacugacucugguaaugaggauuuagucauaauuugguuaagaggugauuuuaaguuuuaaaauauuugugaccauaaguagcauaaauuccuaguuccacccuuguaaagugccccuuaauuugaacucucccugguggaagcgacggcguggguuaaaauggccaccucucucacuuuuuuaccucaagacaugcggcucaugcagggggaugagauaugccugcgguacaaaggggaccuugcgccccuguggaaagggaucggccacgucaucaaggucccugauaguauccuucaugugaagaggguguggccggcuggugggagaggaaagugggggcaucagguggaggccacuguggauuugaugcucacugcugggccagcaucucaugcucuguggugggugcugguuggcaucgcccuccacugcucuuaggagaaucacagggccuucaccuucaggggacagcugguuguaugguugcuuccccucugcccgaauggugauguuggugaugccacuuguguggcgcgucccugggcugacucuggaaguuaauguaugccgcuuguguggcacgucccuggacugacucuggagguuaauguggcugcaggagcgccuuaccuggacgcugacucugcacacggagguuccagaagccaguggucacaugcagacccucugagcacacacuugcucccaggccauguuugggaaugugcagugaccucauggugaugcagccugccggccagaguggggcagcuguaaggcacaggugcagucagaggcuuggguggggaggaguccugggagaagacaccgcgggucagacucaggcugccucuuggugacuggccaaugcugcuggggccugaccauucagcgguggccuccacagggguagggagaguugucucccacacccacccugggccugacaagcucauccugaacacgugagaccgguuuuggggcucggggucgagggaaggguguugccuaccggccacagccuccuggagggcaguuugcuuguguauguggagccuuuugcuuggccguacugggagggguguuguuucuguggaacugugagaagagcugcuguggccaaagcuggguucugcgagcucugccugccccugcuggccacaugugcaggagcucccggugagguccuggggcccaggauguggcugcucccugcuggugagcgcugcuggcuucgcugccgcccucugcgucucugaaaggggccuagauggguggcugggaguggcaaggaggaacuccaggcuggcugggggugggacaccggcucauggugagguagagucuuucuucaaggaugcuguccuucuggucucuggucugguguuggcugcacguuuuuagcguuuggugcagagccagcggugucuuaaguaacuaaauuuuaaaaacgcuguuuaaagagcguguaccaaggguggcccagaaaggucagcccggcuuuugacaaggaugcaaacuuaacucagcacacagauuauggcgaugagaucgccauugagcugcggagcagcgugggugcaccuguggaggugacucacaacuuccagguggauuuuguguggaagucgaccuccuuugacagguacgucuucucccaucacugcccccuguucccugguugccaccuguggcaucuuuaugagcccuccccgucacuguggagugggguuccccacccagcucugcaaacucaggaugucggagaggcggccacagcugugcgugucgccaaccccaaacccuccucacaggaugcagagcgcauugaaaacguuugccguggaugagaccucggugucuggcuacaucuaccacaagcuguugggccacgagguggaggacguaaucaucaagugccagcugcccaagcgcuucacggcgcagggccuccccgaccucaaccacucccaggugcgcgccguccucagcgcgcggggccucgcccaugggccgggacgcaagcggaggcugccccuaacggccgcuuguauugaagguuuaugccgugaagacugugcugcaaagaccacugagccugauccagggcccgccaggcacggggaagacggugacgucggccaccaucgucuaccaccuggcccggcaaggcaacggguagggcugacacggcccuugcgggcaagacccgggagggcuuuaggguggccagauggaaggccuggugcugggagccuugggcucugucacaccgaagagagcacguggcggguagugucgccauggugccuaccgcucucuaugugacauuauucgugucagcuccaaccuuaggauugcauuuuaguaaccaggucugcuacugguuuagaaaacugggggcagggggggcauggcugcagcagcgugaguuccgugugcggcacuuuauaguguggcgggauggugcaaguuccagccuuggcauugcuugcgguggguagagcugugaagccugggcugucuggaucugagcuccuucggcaucgugucauuacugccuguuaaaaaugucaggaguuuaaggccagccugaacagggugagacgucucuacaaaaaaaaaauucagaaauuagcuggggguaguggcgugcaccuguggucccagcuacucaggaggcugaggugggaggauugcuugagcccaggauguugaggcugcaauuagcugagaucacaccacugcacuccagccugggcaacagagcaagacccugucucaaaaaacagagucuuggcuuacuacguucaccgagcuuccucuggguaagcacugagcugccccaaugguguugcaggccggugcuggugugugcuccgagcaacaucgccguggaccagcuaacggagaagauccaccagacggggcuaaaggucgugcgccucugcgccaagagccgugaggccaucgacuccccggugucuuuucuggcccugcacaaccagaucaggaacauggacaggugugugucgaguccaucccucccaguuggucccugagcuucugcgggugacauguacagaacucaggcacccugcugaccugcaugugcuuccagcaugccugagcugcagaagcugcagcagcugaaagacgagacuggggagcugucgucugccgacgagaagcgguaccgggccuugaagcgcaccgcagagagagagcugcugauggugagugccccuccugccugcaaaagggccugugggcuggcggccugaugguuuuuguuugggccaaagcaccuauuugaauuguugcuuugcuucuggaaagagaacuuagaugcucucuacuuggccucucugcgcucaguuguacaguaaauuagggacaucucgcugccuggaacacggucuucuagggagucuccacucccugccagccuccacugggauccggcaguggaucuagaacacuccugcucuuucauaaccaaccagccugaacuggaaucagccugagugcagguuccagcagcucagcacugccccuuggaggcugucgugaggcgcagagcucuugguguggagagguugccuucugugaaacaugaccguuuaaggaucuuaaaaguuuguaaucaccacagccuggaccauguaucuugucugggagggacagcuuguuuuuuauagugucagggagggugagaaacaggagagcuucuguguucugucccaccugcccuccggggucugguggcguuuacagugcaggugcccugaugccucugcacccuuccccagaacgcagaugucaucugcugcacaugugugggcgccggugacccgaggcuggccaagaugcaguuccgcuccauuuuaaucgacgaaagcacccaggccaccgagccggagugcaugguucccgugguccucggggccaagcaggugggcugccuccccugcccuccugugugaaaacucgugugugugauucuugguguuugucuuuuaaaacaccuuguauugacguaggaugcccagcagagugugcgcacacugggggcucccugagggguuuauagaggguggguucugccagcugcacguccagugugcguggugagcaaugccccuguggccaggugguguccugugcauccuggggccccuacuuccuugcuaguguguguugaggcugauucacaccugagcuucuugacuugugggggccccuguuccuacagcugauccuuguaggcgaccacugccagcugggcccaguggugaugugcaagaaggcggccaaggccgggcugucacagucgcucuucgagcgccugguggugcugggcauccggcccauccgccugcagguccaguaccggaugcacccugcacucagcgccuucccauccaacaucuucuacgagggcucccuccagaauggugucacugcagguaacggggcucugcccagggcaggggcuucuacagagaagcggcaucaagggaauguggacuggggagaaggaacuggcccaucagcuuccccugagcggcuucacauagccacugcuugaggucagggcacuuugugcccaaggucuugaugguauggucuuggaucaaguggugucucuggggcauguggggagccuguguccucuguaaaacucagucauugccugagaauucauccaagccucauguggcagcaugcacagcagccaggacaggcuguuaggggagcugagcccgggccuuaacgugggcugugcauucagugcuucaugaagaacagcuguucucagggccugggccccuggggcccgcaagaccguguccggcuucccuggauaacacagaggccucaccugcccuuuuucacucugcugacgcucacacugcuggugacccccuggugcuucugcaagagucagcccagagcagccagacugugcccggaucacaguaagaaacgcccuggaugaggaagugaacaguacaucuuacuaagccucgaguguuucacugugaccagauaaaauuucucgugacaccuuuggguaugccggcgcuugaaggaaguccuuguggacacacccuggguauucaccccaagguguugggcagacuuuuuccaaaaaugaucgaaccugucgcuucauggagaacuaguggcaacaucuguuacaguaguaaaauucaagugaaaaccagaauuuuggaaaacuuaacgucgcuugccaugagcuuggugucuucccaacaccuagagacuuuucuggugaggucugugggggugacagauggaauguuuccaccauugccagugaaaugugucagccuuuggaagaccuacuugacucggugggagauccuuccugaaugaccagcagagugucacgaagucacauggggauggaguggcaaagaguugucacaggccugcagaaacccaccuuuguccagcuugauguggccucagggcuggagacucccagccaugcagaaaggcuguaaaaacaaacccaucucccuuuccagccucaggcauccaugaggccuggcuuccccacagcguccccagagcccaggaggguggacugagcagagguggaccccagggcccagcugccuccgauucagccagauaguaaggagauuugcagaaaugggagacaggaccacucuucuuacuuagcuuauuuuuggagaaauaacuaacacguaauggguuauuuuuaaaugaauuaauauauuuuuuaaauuuccaaguuuagagaauacaguuauccaauaaacaaaagcuguuuggacucccuaacuuuugagaguguaaaggguccugaaagcugccgacacagcgccucaugaacuccaaaccugugagguugguauugucaggccuaguuacaggagaaagugaggcucagagcccaccccccggguugggccacaccacucuuugccuagcgguaggucuugggaguugaugccacuauugacaucgcagggacaccgcuguucccagcgcauggcaaggcugaaaacacaaggccacagagaccuagcuugugcucuggggugucugagcacuggcugggaaaggcguggcucggcgcaggcucagaccccucaugguccccagggcaucggcccagagggcagacgcuggugcacacugcucucuaauugaugcacagcacguaguucacacccaggaaguacauuuuaggaaauucucuauugaaguguaaacauguggccacauuacaagugucuggcucaaugagugguuacuaagugagcauauuuggauagccagcaccugaacccagaaccaccugaccagcugugagaagccgccucaucccugcagguggccacuguccaggggugcgcauccacagcagccccugggcugagggacuucugagcucauccggcggccccugugcucgcuguaacagcagugauccacuuggccucauuuucagcucgacgugggaucauaugauguguccuggcgugucuggcuuccucuguccaugucaggcuggugcugugcaaaaacaccgguuuucuccacugauggaagcucccaguagagugaggagggcaccugugaauugagaaacugguuuuacaguuuuaaggaaacgcaacagggcccagaaaagccaagaugagcaugaagagcccgaagaaaguggcugcucacauggcaggacgccccggcccccaagcugcaguguugggccccggcccaggagggagcccagaggcagagccaccggucaacaggcccucagcaggaauggacaaggcugcagggcagggggacacuguuggcucaacagugucacacacaagucaguuguaggggcuguggcgccuuuaaggcaagcuucuggaaggaagcaggagaauauccuguauccugggguuggcagagauccaggcugcaagaaagcccuggcugagacccuguucccuguucaggggcugagccagcucugugcuggccauggugcucucgguggccucuccucagccuugcccaauccugggcaucucuggccaggggaccggcucaggugaccucaccagggccucacagaucgaagucuccugccccaggaccugcagcacuguagcguagcaacuacauugcccugugucugaacucauuugaggcgggcuagggcuuuugaaguguuacuucuuucccuccccucacagcggaucgugugaagaagggauuugacuuccaguggccccaacccgauaaaccgauguucuucuacgugacccagggccaagaggagauugccagcucgggcaccuccuaccugaacaggugagcagggacaggcccaccggcgucugcaggucuuggggacagcuugagagguuguugacccauucuacuuauuuuuaacaugggacugaaacuuuuuuugccuucauuuccuguuuagccuguuuagacucuaaaccguguuguuucugccuccuuuuccauuguacuuguuuuuuauugggcagauacuugcuaaucccacauggcagccguuucugccccucgagacuccccuggugaaggcuggggaagcucagcugugcaaacgccagugauggcagcugccuucccgcaggguguugugucugcaccccucacggccuccagccucagggcucgggaucccacagguggagcccagcacugacagccuggguuucuuaggaccgaggcugcgaacguggagaagaucaccacgaaguugcugaaggcaggcgccaagccggaccagauuggcaucaucacgcccuacgagggccagcgcuccuaccuggugcaguacaugcaguucagcggcucccugcacaccaagcucuaccaggugcgcugcgcccucgggcacacuuggucuccugggccaugcaaggguauugacccuugaccuuuaaguuaccccccaagaggggcccguccuggcuggagcucagaauggcccaggaagcaccagcuggcccacccucuggggagggcacagacagcacauccccacagacccugcgaaauuccacaugaucaggacagagacuuugagaaauacaucacagggaucagaaacaugggcugagauuggcacaucaagguguuuucucgggaugguugaaacaaguccaagguggaacggcaguggucugugccugccacacacuggauguugugcuguggagaccgugguguucacaccuuuauugacacccggaugaaacacccacugcggguguguggggaggaggcacagcucugccuccaugaggaaaugagcccaagugcugagucugaguggccacauggcagugguuucuguucuguuuuugagcacggcucagguucucugggaugagcacgugugcucuuagugcugagaaacaaaucuccguggcuaaaagagaacaggcuaggugucauggcccacaccuggagucccagcacuuugggaggcugaggcagggaagucgcuugaggcuaggaguuccagaccaaccugggcaacguagggagacccugccuccaccaaaaaaaaauaauaacuggguaugguggcaugugucuauggucccagcuacucaggagacugaggugggaucagcugagccugggaggucaaggcugcagcgagcugagauuguaccacuguacucuagccugggugacagagcaagauccugucucuaaaaaaagaaaacaaaacgaaauggcagcagagccaggacagccccuaggugcggugagcaggcgccaggccccaagcucccgggugggauuugagggugggucuugguguguuuccugcauuuuggggggacugggaaggcagccugcuggcugauagugaccacaaagcucccuuccaggagguggagaucgccaguguggacgccuuucagggacgcgagaaggacuucaucauccuguccugugugcgggccaacgagcaccaaggcauuggcuuuuuaaaugaccccaggcgucugaacguggcccugaccagagcaagguagggaggcugccugcugcaugcugcccagccgcucaucgguccucacuucccagggaauuuggggcuaggguuggggguugccagggccagaggucagaggacucugagcagcaguugagaaacgaugucucacuggagagaucuuuguuuccguguccuggggguuugcuguggccccugugccucagcccagcaggacguauuuuuccaggcccuucuggucugauucaaaauaaaucuugugugugucugucaaguuguuuaaucugagaggcuguaaguuuugguccuguccacuauuuuugguucuaaaauacaacuuuugugaacugaugauagcagaagggaccccgagaacaagguguccauucugucaucccacauaaaacuagacaucaggccaggcauggugucucacacauguaaucccagcacuuugggaggccgaggcagguggaucaccugaggucagguguucucgaccagccuaacauggugaaaccuccucucuacuaaauacaaaaaaaugagccgggcgugguggcacaugccuguaaucugagcuacuugggaggcugaaacaggagaaucgcuuguaccugggaggaggagguuguggugagccgagauugcgccauuacacuccagccacugggcaacaagagcaaaacucugucuccaaaggaaaaaaaaaaacacuagacagcaaggacccauucaccagcuggaaguuggggggaccuggccuguggcuccacccagcacagggagagagccuggugcuccuuccggcucauaugcgcggugguucuccucuaggucaccauggcuuugucauugguuacucccucuuucuaaggcgcccucuuguuuggugggcaguauuggguggguccccccacagcuucgugaggugggcuagaggagcugggcaucgggucagugccccggccugcugggggcccuguggggccgcgugugccccggugccuggaaggccgacucucuugacagcaggucuucucuccaaacguauccacccagccaggugucugccauggggcugcuuagagucggccacaaaaucaacccgugugcagggucaguggcuuggcauugggcuuuggggccugucccuguggcuggcagccugccugcugcccgguccacgccucuguugccuuggauuuggguucugagugaaugcagccuugccucuuggaccguccugugagacgggcagcucuccaccugcguccucagcacugcgcccuuguugcagguauggcgucaucauugugggcaacccgaaggcacuaucaaagcagccgcucuggaaccaccugcugaacuacuauaaggagcagaaggugcugguggaggggccgcucaacaaccugcgugagagccucaugcaguucagcaagccacggaagcuggucaacacuaucaacccggugagcgccugcacaggacagcagggcagcacggagaaacccgggcccaaaacacugcugggaacgugccagcuuggcccgugugcccgugagcugagggagggcucuccuaggggagggugggcucuccuaggggagggugggccagcccacuucuugucucccgagccguguguggcauuuuuggcuuggggccgcuaaguccuggguggccucugggaauugggcucagggcugcugugcugcaugcagcagccugggaccuuggacacgggcaguuggaagcuuugcaagcccggggugaucugguagugagggggugugaagcuuccugagcugaggcccaagggucagcaucagagcccaggucugccgaggagggcaggcgagacccagaggccaugagacagcagcucccuccugucuccagggagagccccuggcacagugucaacaccucacagcugcauaccugccaccucccaggccaccgggcccgugggaaguuguuccuucuguugagaugacaaauuccucaccuaucuaaaccuucgcagggagcccgcuucaugaccacagccauguaugaugcccgggaggccaucaucccaggcuccgucuaugaucggagcagccagggugagucgcucagcaggggaccuggccgaccccuuguccucacaccgggaugcuggccguucccauggcugcagcuuuaggugcccccaucuuuccuuccccucaagggcggugccuggcucccuuggccuccccgccccuagggcaucucuagccccggaacacuccugggguguuugucuuuaaccagaguuuauucauuuguguuuccuggugaucaagcuaguuagcuuuuucuugccuuuugguagggcagggacugcauguaguacaaauagaacauuuucauaaaaaggauuuuuuuuuuccuuugguaaaugcagggugauuuucauuuauuuucuuuuuuuuguuuagagacagggucucccuauguuguccaggcuggucucaaacuccugccucaagcaguccuucugcucagccucccaaagugcugggauuacaggcgugagucacugcaccuggccaauuugcagguguuuuuuuuuuuuuuuuuuuuuuuggagaccgagucucgcucuguugcccaagcuggaguacaguggugugaucuuggcucacugcaaccucccccucuggguucaagcgauucuccugccuuggccucccgaguagcugggauuacaagcacccaccaccaugcccggcuaguuuuuguguuuuuaguagaaacgagguuucgccauguuggccuggcuggucucaaacuccugaucucaggugguccaccucggcuucccagagugcugggauuauaggcuugagccaacacgcccggccccaauuuucaguuuuuaagaucuguguaggccaaugauucccagcagacucuccucggggaaggugccugcccaagcacccagccccaggcaggcugcuguaguuaacauggaguccugcgaauccgcaucuucagccugggcagagccaggacagaugugcagcuccggcugacuggcugguggggugggugggguaucgcugggguuugaccgaggcaggugacaccugccguguuccacugugauuugcaggccggccuuccagcauguacuuccagacccaugaccagauuggcaugaucagugccggcccuagccacguggcugccaugaacauucccauccccuucaaccuggucaugccacccaugccaccgccuggcuauuuuggacaagccaacgggccugcugcaggugagcaucuguggcugcggcuggguguggcccuccugagagcucuugagggugugcuugucugcgaggcccuggccuccuucggaucacccuggacugcugucuuucagggcgaggcaccccgaaaggcaagacuggucgugggggacgccagaagaaccgcuuugggcuuccuggacccagccagacuaaccuccccaacagccaagccagccaggauguggcgucacagcccuucucucagggcgcccugacgcagggcuacaucuccaugagccagccuucccagaugagccagcccggccucucccagccggagcugucccaggugagcccgccccugggacgggacuuaccugagugaggguggggcuaugcaccugaaacauucccucugaagagccccagagagcuggccuggcccauguccacugucugaauuaccugucccugggcuggggucaucagagugggucuccugggucuuaguuuggggacggguuuuccauucuuuucucuggggcugcugagggcuggguggaugugagcacccuuggccuguggcuugcuuaccuccugaccuugucuuucaggacaguuaccuuggugacgaguuuaaaucacaaaucgacguggcgcucucacaggacuccacguaccagggagagcgggcuuaccagcauggcggggugacggggcugucccaguauuaaaaggcaagccccccuggagcaggccuggccccaccccagccucaaggagaaggaugggagggggcucuccccagggagcugcacuggaggggugguaucuggaaaugugugcugugccuggugggggucauaggcccucagggccagcuuggccugugcccuucacugcuagucaggguggcuccucaccccacccuaccccauccugucugcuccggggaccaccgcgggaccucaguuuccucaucagagucggggagggcagcucgggcucucccucacuguccugugugcuggguaccuguggggcucaggucgcagccucucaccgccuccugcccuucucccuccugacagguggcggcggaagagcuaagcaacguggcuuaguccaucagcaucuuauucuggguaauaaaaaauaaaaauaaacggauaccuguuuuccacugcuaaaacugaagcaccacugugugagcaacaggaagggagagcgcacgagggagaggagccgaggccgagcgcccccugcuggcccgcggcggcgaggagcagagggagcggaggaggggccggcccgcgggagccgcggccaccaggaggccccgcuccgucccaucggggcugcggccagggcggagggaggaagacccucaucucagaguagcccuuuccucuguucuuuuauuucuuuuucucuuugauugaaaggggacuacgucuuagcaggaaaaaaaacuucgcauuucugugcccgagcaggcuccuugcaaagacagcagcgugcggggcagagccccgggagggcgcgucuguccacgccuaccggacgcgccgaggucgcgcugccuguguucuccgagggccuucauuuaaagaaaauaaggguguuuuggguuuuucucuuuguuuuuuucaagauucuuuuaaaggaguacugaagaauacuuuccuaaguuugucuguaaaaucuuagcgguggaccugggagauuugagaagcuuccagaaacaguuuaaacaagccagcgcuacuggagaagaggagcaacaccugugccgcggccggaggaguuuuguuguugguuuuagcuuccaguggcuucuuucugcggggcaucaggcugcugggguagccgcccgccgagccuggaagcugcucguucuccgcuggacucagaagccaagcugcuucccgccuagacucggcgcagggccccgcaccggugaggaaggugcuuuuggccccauugcgaggggccuuggccaggacuggcccuguggccaggaggcgagaagguggcuguucccggauugacggcuuuuucccgggggccuuuggaagauuugguggaaggacaagagggccugucccuguccccguccccaggagguaccgacagucccugugcugguuagacacggagcgcugcacaccgaaagcccaaauugggagcucugccugccggcaacuuugcugauggggugauugcugcuucugggggguaaggaaacaaguuacagaaauuaccgcguucugugugaagggacugaggguguggugucauuggcagagggucauuuuaggagagcugccccagccccucgaacgccuggcuuggggugucauucugccuggcggccaggccuccagcuuccccugccccgggccuggggcugucacuggcccugauccgaacaccuccagauuccggcuucuacaugggacagacggggacgcacaggccaccuuccuucuggcagggacucuuauuuauucccauugcucuagggcuuucgguuuccccuucuuccgguaggccgcguagaggcaugcaccggguagguuuccgcggugaccccgcggcggccugagggacgcucccugccccaucccggcuguugggcugggccgcuuugccucugcuucgcccugugcuguguucuccagcuuuguagcagcagccuugacaaacccaggcgcacuguaccaaggcaauguaacuuuugauuuucggucaauuuaaguucuuuugucaccaaauauuaauaaacaguuuugacuuca

SEQ ID NO: 191882 - RNA, 6462 nt, Homo sapiens
gccagaggaacgccagcgaccccagcagcgcugcggacggugcuggccguggccgcugcggcccccguguccaggugggccaggacgcagccucugggcgccgucgcuuuuccagcaucgcagaggcaaaagcguggcagugggacccaaaagguaggacugaggcucuagaacuugcaccugugcagggacugcaaaccagaccugggaggacccuuucagcagcccccacuccacccuaucccaggacuucccagcgacccgccguucugggagauaccgggagcgugaucagggggcggggccguuuccaaggcaaccgcuuauuugcauagggucccguccuggccaacgagggcgccccaaauguucaggacauagaagaagggguuaacuggcccggaucuccuccucgccuuccaagcccgcuaagcacugggguuaucuacccauuccccagaaggggagacugaggcagcccaccagccaaaggaggcgaccagacuggggcugcguuuuaccauuucagaagcggcuugagcuggucugagcuauaauaauaaacacuggcgguggaggcgagggcgaccacagggcugaggucagggcuaggauuccggugucucuacguagguugcuugaauggggggcacccuggcauggacgcugcuguugccgcugcugcugcgggagucagacagccuagaaccgucgugcaccguguccuccgcggauguggacuggaacgcggaguucagugccacgugccugaauuucaguggccucagccugagccugccucacaaccagucucugcgggccagcaacgugauucuccuugaccugucugggaacggccugcgagagcuuccagugaccuucuuugcccaccugcagaagcuugagguccugaacgugcuacgcaaccccuugucucguguggauggggcgcuggccgcccgcugugaccuugaccugcaggccgacugcaacugugcccuggaguccuggcacgacauccgccgagacaacugcucuggccagaagccucugcucugcugggacacaaccagcucccagcacaaccucucugccuuccuggaggucagcugcgccccuggccuggccucugcaacuaucggggcagugguggucagcgggugccugcuucuuggacuugccaucgcuggcccugugcuggccuggagacucuggcgaugccgaguggccagaagccgggagcugaacaaacccugggcugcucaggaugggcccaagcccgguuuaggcuugcagccacgguacggcagccggagcgcccccaagccccaaguggccgugccauccugccccuccacucccgacuaugagaacauguuugugggccagccagcagccgagcaccagugggaugaacaaggguaaguaagccacugagacaccugccaaaguggugaauaauaaggcuccacacccagauggccgagguucaaaucccagcucugccgcuugaaggcugugggaucuuaggugaguagcuuuacuucucugagccucagucuccucaccuauaaaauggggagaggacuggacaugguggcucacaccuguaauccuagcacuuugggaggccaaggcaggcggaucacuugaagucaggaguuugagaccagccuggccaacacggugaaacccagucuguacuaaaaauacaaaaauuagccaggugugguggcgggcgccugugguuccagcuacugaggaggcugaggcaagagaaucucuugaaccugggagucagagguugcagugagccaaguucaugccauugcacuccagccugggugacagagugagacuccaucucaaaaauaaaaucaauaaaauaaaguaaaaugagggagaauuacagcccccaucauaguguguugggguaagaauuaagugaguucccauauaugggacaaacuucccccccuuaugaccuguaaacccaguuucuggcggccaaggauggggagacaggaggcaacugcuugagcggaguuggggcuccgcgguggcggucagcagcauaggcccaggucccaugugacccaaggcugucucugaaccuccauuucugucuccauagaguggggacagccccccauuuccccaugacacacaugagauacuaaagaggugcccuacaaagucccaucaccacuagaugauuuuuuuuuuuuuuuuuuugagauggagucuggcccugucauccaggcuagaguguagugacacgaucucggcucacugccagcuccgccucccggguucaugccauucuccugccucagccucccgaguagcugggacuacaggcgcccgccaccacgccaggcuaauuuuuuguauuuuuaguagagacgggguuucaccguguuagccaggauggucucgaucuccugaccucgugauccgcccaccucagccuccuuaagugcugggauuacaggugugagccaccgcgcccagccgacauuuuuuuuugagacagugucauucugucgcccuggcuggagugcaguggcaccaucacagaucacugcagccucaagcuccuggccucaagugauccuccugccucagucuccagaguaguugggaccacaggcacaugccgccgcacccaacuaauuuuuguauuuuucauagagacgggggucuugcuauauuucucaggcuggucucaaacucuuggccucaagugauccucaugucuuagccucccaaagugcuggcauuaugggugugagccaccgccaccggcuucuggaugauuuugcugggcuuagacaaaugaguugaacuuuucuagguugguguggggugcgguggcucaugccuauaaucccagcacuuuucgaggccaaggcgaggucagaucaccuguggucaggaccucaagaccagccugaccaacaugguggaacccuguuucuacuaaaaaauacaaaaauuaggccgggcacgguggcucaugccuguaaucccaacacuuugggaggccaaggcaggaggaucacgaggucaggaguucgagaccagccuggccaauauggugaaacccugucucuacuaaaaauacaaaaauuagccgggcauggucgugggugccuguaaucccagcuacuugggaggcugaggcaagaagaaucacuugaacccaggagguggagguugcagugagcccagaucgcaccacugcaccccagccugggcgacagagcgagacuccgucucaaaaaaaaaaaaaaagaaagaaagaaagaaaaaaagaaaagaaaagcuuuucuagguuggaaaagggaauggagggaauuucaaggggugggacccucaggggcagagacccagaggugggaaagaacagagaauuugcugugaaugguuuuugagaagggaugacuugaaagcugaggccugaggggaacagggagggccaagcaggaaggggccgcggccauggcuguguuugggcagcagaguccgugccaggagguggggaggcuaucggaaggcuguuggugagaaaggagaaaauaugcaaagcagaugucaacauggcucaaaagcagaaauggucugaggcaggguguugaagacacuggacucgcaaaagcagcuugugcucugauguucaucuuggccucccuguccccgaggcuuccggaucagccuccuuuauguacuggccuccagaaacacuguguuuagaauugacugugucauuuccacccugcaucuuacaguuacagacauggaggcucugggaggcagggaaaugacuuguccaaggucacauagccagucaaaaaaggcaggacacaaacccugcgucccagaccuguucgucccccuacaaccacuuagggguuggugggcaauucguacuagaguauaauugacugauagaugcuguuaacacaaaguagcccuuuugccuuuuuuuuuuucccgcucugucgcccaggcuagagugcaauggcaugaucucggcucacugcaaccuucaccucccggguucaagugauucuccugccuccugccucagccucccgaguagcugggauuacaggcgcccaccaucacacccggcuaauuuuaguagagacgggguuuugccauguuggccaggcuggucuugaacuccugaccucaggugaucugcccaccuuggccucucaaagugcugggauuauaggcgugagccaccgcaccuggcccaguggcccuuuuuacaagaggagcuggguuggaauuagaauguucaggaggcaggaaaauucucuggaggucuugcugaccauaacaaauauuccuaaguagcuaccugcuccuugaccaauucuauagaugcagaaacugaggcucagagacuugcuuuuauauaugagggccacaaagucaguugcuucaguggugaaaacauuucccaucggaaggagcacagagugugggugcagccacuugugugcaugugacugacguggccagagcuuccgauuuuucaagaggaaacaaaaauuuagauuuuaauguaauaaugaacagcuaccucaauuucuguuuuuuuugagacggggucucccucugucauccaggcugcagugcaguggugugauaacggcucacuguaggcucgaccuccugggcucaagcgguccucccaccucagccucccgaggagaugggacuccaggcacacgucaccacgccugaauaauuuuuuaauuuuuuguagagauggggucucacccuguugcucaggauggucucaaacuccuggccucaagcagaccuucugccuuggccucccaaagugcugggauuacaggcaugagucaccgcgccuggccgcuaucucauuuuuaaggaaggaaaaaggguucaggguccucagaccgcagcguuacacccacagaaccuucccuaaaucacugcccucccgcagccuccucagagagaggugggguuggcuaggagucagaacgcuagcccgugccaguuuccccauauguaaauauucgggguggacugagccacucugaagcuuucuuuuuuuuuuuccuucugagauagagucuugcucugucucccaggcugaagugcaauggcacgaucucggcucacuacaaccucuaccuccuggguucaagugauucuccugccucagacucccgaguagcugggacuacaggccugugccaccaugccuggauaauuuuuguauuuuuaguagagacgagguuucaucauguuguccaggcuggucuugaacucaugaucucaggugauccacccaccucagccucccaaagugcuggauuacaggcgugagucagagcaccuggcccacucuggacuuucucaaagcucaugugccuguccccugaguccucccccucccacacuuaccccuggucugucuguccccccagggcucacccuucagaggacaaugacuuuuacaucaacuacaaggacaucgaccuggcuucccagccugucuacuguaaccugcagucacugggccaggccccaauggaugaagaggaguacgugauccccgggcacugagccuaagauguccuaaccuccacccagaaccccuucagucccugcugggugacucagggcguccuaacgccuccauggccucaguuuccccaucugaagaauggguacaggaaaggauuguccuugaggccccaggaagcucugccgcccccucccugucccucaugccgcuccucagcucccucagcuccuagagggggaagaggagagacccccaacaaggggacaggacggucacugugccaauccugucaucacccuccuguggauguacaggcagugcucaauaaaugcuucgaggcugaugaggcugcuggcucagggugcguggguuccucaagguggggauuucugaguucuaagaccaagucuccaucugagacucccaaauugcuccccaccucccaucccuguuuuuuuuuguuguuguuguuuguuuguuuguuuuugaaacugagugucacucugucacccaggcuggagugcaaugcugcggucucagcucacugcaaccuccgccuccuggguucaagugauucuccugccucagccuccugaguagcugggauuacagcacccgccaccaugccgagcuaauuuuuguauuuauaauagagaugggguuucgccauguuggccaggcuggucucgaacuccugaccucaagcgaucugcccgccucggccuccugaagugcugggauuacaggcguggccacugcgcccaggcacauuccucccuucugccccucucagggccccuucccaggucccugaucuccaggcuuggccuccagagcagcccacaccaaccccaaaauaaaaaaauguauauauuccuuua

SEQ ID NO: 191883 - RNA, 29356 nt, Homo sapiens
guaugcguauuucaaguguuuuauuugcuuucuguggugucaaauuuggggucuccuagagcccagccccaggcagaauccggcauauccuucuccgccuggggggcccgggacacaggaguuucagaaaaggcacuggcaaaaguucuagggcgggggucagggagaagccacacugagccuggagggaccgggcccuccuucggcggcagaaaacacagucaccuuuggcagggaaggguuuuuuccuagaaagaaauuuaagacaagauaaaaaccugagauguuagaggagcccccagaaccaagccggugcuccccugggcaggcagagagugaacucggcuuccaaaggcucaggggaggcuugcccggcccucagccaggcucagaugccacaggccuuggcaagcagaaagccuaauucaaaucccuauguggaaucuccuugagacaaagugucacgacacaaaacccccaggccccagaccccaccucugaauggcuugggccagacgcuggucuggaucgucaggagccacggccacuacccagugaccaauuccugucccuuuuuguguguucugugagcgcuggagaggcaggcacuucuguggguaacugggggaggcacagcggggagaaagagcaggaggagaaagggaauuugggggagggggagcaguuuggggugggacugggucccucaaguccugggaguccccccccacucagcuugugacaacuguccuggaaaccaggggacagagucucucagcagguauguucagcguccacccgggaauuagcuuuccagacgugggcacugggcagcgccugccccucaacagccauucugccaagggucuaaguggaaccccagcccucggccggccuccucacugcaaaaacggggaugcuuucccucccaaccagcagccccgggcccucaugaggcacuugugcccagggaagggaaauuuaauccggauuauaaaaacaaagcccucuccugcccccucaaguuaggaugcugaggauggguggcugcauggggcaaccuggcaaagaccugccuccuugaccaugaucagcaccccaugcuggccgucacgcagcucccagaggccucaggauagaggcuggggcugcggagaauagggcuuuguccagcugucuccaaaagggacgucuagguucagacgccacaagaggcagagaggucaaaggccaacagucuagacaguggcagccaaaagggggccagcugugcgggacagauuuccaugagccaucccccuccaccuggucaccuccccagggcacuggagugcagguguaaacauaccagcuggucuugcuuccuggaagaaacuuccaagacuaaaaggcaucuugaaucuacuuuuccagcucucccaucugccccagaguggauacuuucuguucuagauguuucuaugccagcaacgagcagaaaagcagagcagggaauucuuuuuuuuuuuuuuuuuugugacagagucuugcuauguugcccagucuggaaugcaguggcgugaucucacaccacugcaaccucugccucccagguucaagcaauucuccugucucagccucccagguagcugggauuacaggcacgcaccauccacucuugacuaauuuuuguauuuuuaguagagaugggguuuugcuauguuggccaggcuggucgcaaacuccuggccucaagcgaucagucugccuuggccucccaaagugcugggauaacaggcauaagccacugcgccuggccccccuuuuuuuuuucuuaauuuugaggcagggucuugcucuguugcccaggcugggguacaguaguguaaucauggcucauugcagccuucaccuccugggcucagauaagccucccaacucagccucccaaguagcugggacuacaggugcuugacaccacaacuggcuaauuuuuuuuuuuaauuucuguagagauggggucucgccauguugcccagggcuggucucgaacucccgggcucaagcaauccucccaccucagccucccaaagcacugggaucacagacaugaaccaucuccaggauuccccuccuugccgagaaacuacugccaucugggacauuuccuucacacaucuggcucugauggggaagcugugauuucggcccccacccccugucccugcccagcccugccucuccaaguggccucagguuuguuccagcccuugauuggagcaggugggcuagguggccccaagcucagcccacccaccuugaauuccugcuucuuccuuucuuuccuuuccacuccaucuuauuucuuuuuugagcuacauccccacacgcaugcaacugaccuucuuugggguggggagggggugcuaggggccgaauaaaggaauaaaagugcgcagacuugggcaucuuaaaagagaugccaucaucaaguuggucaggguaccaggugcccugaucacugucccugcaccccuguucccugccucagcacccuccaugaggacucaucagggaagcccccccaaucacuucucaccuuucucccccagccuucccaccacaccccucagccugucuuuucaccauugacacuugccaccccuauuccucuucccaacaccugccaagucccacccaccuugcagacccuuccuaugccaccuguagccccuaccccaggcucugaaaaugaggcaagagggaaugggacuugguccuucccuucuugcaugaggauuuuuuuuuuuuuuuuuuuugagacagagucuugcugugucacccgggcuggacuacaguggugugaucauggcucacuggggcuucaaccucccaggcauaggugauccuccugccucagccuccugaguaucugggaccacaggcaugcaccaccacaucuggcuaauucuuguauguuuugguagauaugggaucucuugcuauguugcccaggcuggucuugaacuccuggcucaagggauucuccugccucaaccucccaaagugcuaggauuacaggugugaguaaccacaccuagcccacaugaggauauuuuaagccaagacccaacaaagguggaaaaacacaccagagagugcacagaugaguuccaccaaaagaaaaauauuuguaaaaaacuuggccaggcgcaguagcucacaccuguaaucccagcacuuugggaggccaaggcaggcagaucaccugaggucaggauuucaagaccagccuggccaacauggugaagcugcaucucuacuaaaaauacaaaaauuagccagguguggugacgggcgccuguaaucccagcuacucgggaggcugaggcaggagaauuguguaaacccaggagguggagguugcagugagccgagaucacgccauugcacucuagcccgaguaacagugugagaauccaucucaaaaaauaaaaauaaaaaauaacaaugagaaaaauaaaaugagccaaauguugugcauuaugaggaaggaugggauacuggcuugacuggguaaggaaaugugaaaccacugcaagaauacaaagaugacacacacacacgugacaaugagcagacaauagguuauaucucuaaggagcuaugucacacagugcuuuaaacacagaggugaaaugaagacaaaagaaagauggaaguguggagcccggggcaggugcuuagcucaguucaggccuggcacauccccuuccccauuuugucccugucuuggcuagaccuguuuucuccucagaggcccacagaccagaccuuugaggaauagagcaagaugaaaccugaaguugcuuuccaccagaccucugggugaccccugagucuucaguuguuccccacauucaaaagaggccacagcuucccuucacagaagcuggggggacagaugcagugaugucucccacacucuggauuucucaggacacagagcuaccagggguguggagggggcauuuccagcaaaaaaaaaagcuggcauggagggaacaauagugucccuacucauuuccaccugucaguuacaguccacacccacugccaggcgcccacugcaagucacccgccagcauccaccuuccccuccagagaaagcccaagacuuggaaaauguguuucacagaaacccaucaaccccguucccaaacuaucuagaaacccaacagagguaggaaccacugccagcaucggaacuggagacaaggaaggugaacgcugaagaaaacaaaacucucagcuguuuuaagaaagaacugggcugggugcaguggcucaugccuguaaucccagcacuuugggaggccgagaaaggaggaucaguuugaguccaggaguucgagaccagccugggcaacauggugaaacccugucuguauaaaaaauuuaaaaauuagccaggugugguggugcaugccuguagucccagcuacucaggaggcugagaugggaggaucacuugagcccaggagguagaggcugcagugauccaugaucacacuacuguacuccagccuggucaacagaacaagacccuaucauaaaaacaaacaaacaaacaaaaaccuagauguugggaaaccaacaagauuagauuccaacugugucacacucagggaagcaguauagccacauuccuccaggccaaaauagaaacugauuuccagaacgugcauuucacucaauuacuuucacugugggggucguccucucucccuaaugggcagcaagauguggcugaacuuacaucaucugaggaaguuuacgucaucucaucccugccugguaaguucaagguuaccaggaagugagauaaaaaucaacuccugacuccugggcgaguguccaaaagcaaucuacauaaaacccuuuggccgcccggaauuccuccugcucagacaugccgggacaugcagagcucugccaacuccagcccccgcgcccccguuuugagccccccgcgccaccccgcuaaggagaacaacaaacucgucccagcaccaaaacccugaagcuccaggccagaaguagggggggguuuccgcugauguggaguuuuacauauuaaaaaagaaaagucaaaagcagacaaaauccgccuuuccacagguggcccuggucuccauggcgacagcucauagcuugguguugaaaggaccacgacccccauggccacaucuggggcagcagucccaccccguugccuggccacggaccccaugccuuaagcaagggggccucauuuuuggcccuaaaacaaagacaugccaucuuaaguccaauuguuuugagacagagucucgcucugucacccaggcuggagugcagcugugcaaucucagcucacugcaaccucugccucccaaguucaagcgauucuccagccucagccucccgaguagcugggacuacaggcacucaucaccaugcccggcuaauuuuuguauuuuuaguagaggcaggguuucaccauguuggccaggcugaucuugaacuccugaucucaggugauccgcccacccuggccuuccaaagugcugggauuacaggcaugagccacugcgccuggccaagacauggcaucuuaaguccaauuuucagggcaggaggcaaaaguggcaucacccuggugggcgaguggggguggggggaaaacacuuuuguuguuggcuaaaaagccugcauuuuaaccaaagggaauauaaauuacucugugcccaaacuagcacuauuuaaaaaaaaaaaaaaagagagagagagaagaaagaaagcaagaaagaaagaaagcaagaaagaaagaaagaaagaaagaaagaaagccagccagccagccauaucccaggguggccccagaaagggccaggcuguugagcacaguucaaggucgaggacgcauugagaggcuuuuaaauuugguaaaagccagucuuggauauaaaaugaauucugaaauuccuucaccaacggacaggaaagcaggugaacauauggccccagccgugguaucgcagcucauggauucaccagaccaagauucucccugggcaucuggaccucccaggcuggccucccuggucacggcagcuguguccccagaugcagggaggaaaaugggagaaaaaaaaauuuucaccacuucccucgaaucaaccggagcuuuuguagagaaggaggaagaggaggugggcagaucagaaucucucuuccagaucggauccccaagcugaagagcuugucuuuuccuggccacaccccagaggguggauguccccucgugggguccccagcaggaugaggucuuaggagaccugagcgucccucaguguuuguggcaauaguugauuuugcccucugacugcuccaggagguccaacaucuccucaaugauggcucucagugcccugcccagcugguccgcguuguacggcuuccccagugggggcacguggacgaaggcugaucgaccgugacucugguacaaagagguguaguagguaaagucgcagagauaucuaagccgcagggcguggcggguaagagagagaccaaaacggggucagaggggcaauccguagaccaaggugacagcacccauccaaauccaagggaagaccuuaccagcaacccacaagauggaacaacacucuccucccuccccagguuggcaaagaugaaaaaaaaucaccagaggugguggcacgugccuguagucccagcuacucaggagguugaggcgggaggauuguuugagcccaggaggucaaggcugcagugagccaugauugcaccacugcacucagccugggugagagagugagauccugucucuuuaaaacacacacacacacacacacacacacacacacacaaacaaaaaaaacuugauaacucccagugcuguggcacauguggggaaaugggcagagugagcuauugcuggugggaaggcacgcugguuguccccguguggaaggcaauuugucaggcuaguaaaauuauaaucacccagacuuuacaaccugguauuuccauuuuuuguuuauugagacagggucucacucugucacccaguuuggagugcaaccuggccuccagcgauccuccuaccccacccuccugaguagcugggacuacaggugugcaccaccaccacuggcuuuuuuuuuuuuuuuuuuugagacagagucugcucuguugcucagguuggagugcaguggcacaaucucagcucagugcaacuucugccuccucggcucaagugauucuccugcuucagccucccgaguagcugggauuacgggcgugggccacaccacgucuggcuaauuuuuguauuuuuaguagagacaggguuucaccaugcuggccaggcuguucugaaacuccugaccuguagugauccgccuaccucagccucccaaagugcugggauuacaggugugagccaccgugccuggcccuauuuccaguuuuuauuuuuauuuauuuauuuuuuugagacggagucauacucugucacccagguuggaguggaguguugagaucuuggcucacuccaaccuucgccucccggguucaagcgauucuccugccucagccucccgaguagcuggaauuacaggugccugccagcacauccggcuaauuuuuauguuuuuaguagagacgggguuucaccauguuggcuaggcaggucuggaacgccugaccucgagugauucgccugccucggccucccaaagugcugggauuacaggcgugagccaccacgccuggccuauuucccguuuuuagaucuacccucaggaaccaucugcacaaggguacaagaaaguacaaacagggaugcuccccaucguauuauguauaaaagcaggaaaacagaaagcaaccuaaagcccacugacagggaguggcuuaguaaacucugguuuauccacaccauggaauccuaugaaucuguuuacaaggaaugugguacagccagaaaaaaauggagaacucgccagaugcauguugaacgcucacaaaugaaaacuaaggaugagaauucucaguaagugugacuuucgccaugugacuccauccacguaaaagcaaagcaaaacaagauaaaaucauaaagcagcaggccaagugauguauauauguacggaaacgugucagucaguaggagcuucaugguuuccgugucugacuuaucagagggaccgcuauggaaaaagagagggaaugagaauuuuucccaauuagacauaugaggauauguucuagaguuaccuaugauuaaaaauuaauuuuauaaagagacugauggaagcuggguaugguggcucacaccuguagucccagcacuuugggaggcugaagugggaggaucccuugacuccaugaguucgagaccagccugggcaacauugcaacaccuugucucuaccaaaaauacaaaaaaauugggcuggguggccgggcgcgguggcucacgccuguaaucccagcacuuuguaaggccaaggcggguggaucaccugaggucaggaguucaagaccagccuggccaacaugcugaaaaccucaucucaacuaaaaauacaaaaauuuucugggcaugguggcaggcaccuguagucccagcuacuugggaggcugaggcaggagaaucacuugaaccugggaggcagagguugcggugagcugagauucugccauugcacuccagccugggcaacaagagcgaaacucuugucuuuaaaaaaaaagaaagaaaauugagcugggugcggaggcucacaccuguaauucuagcaccuugggaggccaaggugggcauauugcuugagcucagaaguucaacaccagccugggcaacauggugaaaccccaucucuacuaaaaauacaaaaauuagcugggugugguggugggugccuguaaucccagcuacucugcaggcugaggcaggagaaucacuugacccgggagauggaggcugcagugcaacaagaucgagccacugcacuccagccugggugacaaagcuagacgcagucucaaaaaaacuaaaauaaaauaaaauuaggccaggcgcgguggcucaugccuguaaucccagcacuuugggaggccgaggcaggcgaaucaccugaggucaggaguucgagaccagccuggccaacaugauaaaacccuaucucuacuaaaaauacaaaaauuagcuggguguggugaugggcaccuguaaucccagcuacucaggaggcugaggcaggagaaucgcuugaacccgggagguggagguugcagcaagccaagauugugccacaauacugcagccuggcuccagccugggcgacagagcaagacucugucucaaaaaaaauaaaaauaaaaaauaaauuagcuggguuugguugugcuaccugggaggcugaggugggaggaucaccuaagcccaaaaagucaaggcugcaaugagcugugauuuugccacugcacucuagccugggauacagaacgagauccugucaaaauaaauaaacaacuaaauaacaauuaguuuucaauuaaaaaagagaaaaaguuagcuuuaaaaagaacucaguggugugcgguggcuuuugccuauaaucccagcacuuugggaggccgaggcacaaggaucacuugagcccaggaauucaagaccugccugggcaauguagcaagauucuaucucuacaaaaaauacaaaaauuagcuggacguggugguguccaucugcagucccagcuacucgggaggcugaggcgggggaucacuuaaucccaggagauggaggcugcagugagcugugauuauacuacuugacuccagccuaugcaacagagcgagauccugucuccaaaaacaaaaauccugaugguaaauccaggcauuccuuccuucagcuacucaacugcauugaccaauagcugccuuugaguuggacaagcgcacagauuagggaaaagugaggaagcuggugcugggaggguauaacuuggucuggggaguuggagaggccuacaagucacaaggaggugacucguguuggaauuaagacuggaaagagggccaggcgcgguggcucaggccuauaaucccagcacuuugggaggcugagguggguggaucacuugaggucgggaguucgagaccacccugguguggccaauauggcaaaaccccgccucuacuaaaaauacaaaaguuagcugggaaugauggcgcacgccuguaaucccagcuacuugggaggcugaggcaggagaaucacuugaacgucagaggcggagguugcagugagccaagaucgcgccaaugcacuccagccugugcuacagagcgagacuccaucucaaaaaaaaaaaaaaaaagacuggaaagagguguucccagaggaagguguucugggcagaggccauaggguguucaaaggcccugaggcuggagugaacuugguguguuugaggagcaggaggaagcugguucaugugucuggagugcaauggauauggggugaguagaggcagagcgggguggagaggcgggccaagggccaggguuggaauuuuauucuaugugcaaugggagccauagggaaggucuaggaaaggaacacaugcauuuauuuauuuagagccaacagggucuugcucuguugcccagacugaagugcaguggcgcuaucacagcucacugcagccuugaacuccaagcucaaggaauccuccugucucagccugcuauuuuuuuuacuuguucagauggggucuccuuauguugcccaggcuggucuugaacuccugggcucaagcgauccuccugccuuggccucccgaagugcuaggauuauaggcaugagccacugcgccuggcccugauuuaaauuuauaaaagaccuuuugcaauagaaucaucucccucaacauucguguucaccugggaccucagaaugugaccuuauuugggccacguuugguggcucaugccuauaaucccagcacuuugagaggcugaggaggguggaucaccugagaucgggaguucgagaccagccugaccaacauggugaaaccccaucucuacuaaaaauacaaaaaauuugcugggucuggugaugcacgccuguaaucccagcuacuugguagccuggagcagaagaauuguuugagccaggaggcggagguugcagugagccgagauggcgccauugcacuccagccugggcaacaagagcaaaacuccaucucaaaaaaaaaagaaugucaccuuauuuggaaagaggaucuuugcagauguaauuaguuaaauuaagaugaggucggcugggcgcaguggcucaugccuguaaucccagcacuuugggaggcagaggugggugcaucaccugaggucgggaguucgagaccagccugaccaacguggagaaacccugucucuaauaaaaguauaaaauuauccgggcgugguggugcaugccuauaaucccagcuacuugggaggcuggggcaggagaaccgcuugaacccaagagguggagguugcagugagcugagaucacgccauugcacuccaggcugggcaacaagagcaaaacuccgucucaaaaaaaaaaaaaaaaaaaaaaaagucauacuggauuaggaugaguccuaaauauaaugacugguguccuaauaagaagaccacacggccacacacaaagggaagaaagugaugugaggauaggggcggggacuggagcgaugugucuacaagccaaggauggccagcagccaccagcugcaggagagaggccugggacagacucacccucagcaccuccagaaggaaccaguccugcuaccaccuugaccuuggacuucugacuuccaaggcuguuagacaauacauuucuguuauaugaaaccacccaguuuguggguauuuguuauagcagcuccaggaaauuaacacagaaacugacugcuuggguugggguggaggcagcagggaggaagacugagauggaggcuggggcaguguccaggugggagaugcugggggccuugguggggaccgugaugguggggagaagugggcagauccaugagucccaggagcagaaccaacggcaccugcuacguacaaauacuuggcucugugccuaguauacacugagugcuugguccaaagaggccaaggucaacacgcuuggcuuguucuacaccaggcucaguggguggaggagggaaauccccacucacucccaccccacagggcccuaccugccggcauccugcgagauggucaccgacacauccaggcccaacguggugacucgcuugcacacagcauccaugucgaugauggagucaaugcuuucaggcccguccuccacgcagcacugggagccggggcaaaagcggcaguuguccagccccuuguagcccuuguuguguccacauuucuccagugugacuguggucgccaugccugacacccccacaugcaccaccagcugcacacagacaggggcaggacuuaacauggccugcccgugggacucagaggggucccccugaggccagggaaaaggcagcauccuuaaugagcucugccugggguuguguuguuucugaccucuugcugcuagaauagacccugcagucacucuuggaaaaagguaugccauguaagacaggcaagaauuugaaacaugaagggcuguucacugcagcuguucuuguuaucaaaaucaaauacugcaaacaaguuaacuagccauccagcggaguuaguucaauaaauaaugagcugcuaugcaaguguuaaaaugccaaugcaguguuuuuguuucuuuguugagauggagucuugcucugucgcccaggcuggagugcaguggcgcgaucucagcucacugcaaccuccccuuccuggguuccagcgauucucuggccuccgccucccaaguagcugggauuacaggcaugcgccaccacaccuggcuaauucuguauuuuuaguagagacaggguuucaccauauuggccaggcugggaucaaacuccugaccuccggugauccacccgccucagcaucccaaagugcucagauuacaggcgugagccaccaugccuggucuuguuuguuuuuuuaagagacuuguucuguugcccaggcuggagugcaguggcauaaaaaucuuggcucacugcagucuuaaauuccugggcucaagcaauccuccugccucagccuucugaguagcugggacuauaagcauguaccaucaugccuaauuuuuaaauuuuuuuguagagaugggaucucacuaugcugcccaggcuggucucaaacuccuagacucaagcaauccuccugccucggccuuccaaagugcugggauuacaggcaugagccacuacccuuggccuggauagcccuuuggguuuuuuuguuuuuuuugagacaggucuugcucugcugcccaggcuggaguacaguggcacaaucuuggcucaccgcaaccuccgccucccggguucaagcgauucuccugccucagccucccgaguagcuggaacuacaggcgcccaccaucacacccggcuaauuuuuuguauuuuuaguagagacaggguuuugccauguugcccaggcugguugcgaacuccugaguauagguuauccaccugccucggccucccaacgugcugggauuacaggcaugagccaccaugcccggccugaaaagcccuuuugaggacaaggcuguauggcauuggucacgugaucugaucaggaccaaagccaccuaaguccuccacaugaagggugccaaccuguaaguccugaugaggaagugccgccccuuggcaccacucaccuguggacugugcuucucccacagggcggggaugagucucuggacuguuugguacucaaccggaaucucguacacaugcagguccacgcugucgccaaggccuagcuuuucuagcuccuggaagagaggagagugggagugucauggccccagaugacagcuauggggauaaugcgcucucuggggggugaaacaaacaggcguucuccagacucauucugcaggauggcaaggguguguguugauuuaguucaaagccccucauuuccuuccccacccucuugccucaaagucucucuguaucucuauggaaggugacaugauucuauggucccugggguuaaaucccaggcuccuuggacucaauccugccugugugaccuugggcaauccacuuaaucucucugagucucaguuuccucaucuguaaaaugggaauaacagaguaucaggcuaggccugauggcucaggccuguaaucccagcacuuugggaggccaaggugggcggaucaccugaggucaggaguucgagaccagucuagccaacauggugucaccccaucucuacuaaaaauacaagaauuagcugggugcaguggcacacaccuguaaucucagcuacuuaggaggcugaggcaggagaaucacuugaacccgggaggcagagguuguagugagccaagaucacguaacugcacuccagccugggcaacaagagcgaaacuccaucucaaaaaaaaaggccaggugcgguggcucaugccuguaaucccagcacuuugggaggccgaggcaggcggaucacgaggucaggagaucgagaccauccuggcuaacacagugaaaccccaucucuacuaaaaauacaaaaaaauuggcugggcguggcggcgugugccuguagucccagcuacuggggaggcugaggcaggagaauggcaugaaccuggaaggcagagcuuucaaugagccaagauugugccacugcacuccagccugggugacagagcaacacuccgucucaaaaaaaaaaaaaaaaaaaaaaaaaguaucgacuuaccucacaggauagcuuucaaaauuaaaugugcucacucacgcuaacaguucuaagcaccaugucuggcauauuuuaaguguucaaaugacauuggcugccauuauccuauuacuguuauuauuuuagaaauggggcugggugcaguggcucaugccuguaaucccagcacuuugagaggcugaggcuggaagaucgcuugaacccaggaguuugagaccagccugggcaacauagugagaccuggccucuacaaaaacuuuaaaaauuagcugggcaugguggugcacaccuguggucccagcuauucaggaggcugagaugggaggauuaccuaagcccaggcgguugagguugcagugagcuaugaucgugccacugcgcuccagccugggcagcagggugagacccugugcccugcaacagagucuuuuauuuauuuuauuuuauuuuauuuugagacagagucucacucugucacccaggcuggaaugcagcggcgccaccucggcucacugcaagcuccgccucccggguucaugccauucuccugccucagccucccgaguagcugggacuacaggcacccaccgccacacccggcuaauuuuuucuaucuuuaguggagacgggguuucacuguguuagccaggauggucucgaucuccugaccucgugaucuaccugccucugccucccaagagucuuuuauuuuuuugagacagagucucauucugucaccgaggcuggagcgcagugcuaugaucucgguucacugcaaccucugccuccuggguucaagugacucucaagccucagccuccccaguagcugggauuacagacaugcgggaucacgcccagcuaauuuuuguauuuuuaguagagaugggguuucaccauguuggccaggcuggucucaaacuccugaccucaagugauucaccugccuuggccucccaaagugcugggauuacaggggugagccacuguguccaauuuguaaaaagaagccucucuaguauucacaaaagccaaaagguagaaauagcacaaaugcccaucaacagauggauaaaugaaauaugguccauccauccgauggaauacgauucagccaugaaaaggaaagaagcacugauccgugguacaauguggaugaacuuugaaaacaugaugcugagugagagaagccagacacaaaaggccacauauuguaugauuccauugauaugaaaugcccagagcaggcaaauccauagagacaggaagcagacgaguggcugccaggggcugagggaggggaauggagaauggcuacugauggggacagggucuccuuuucgggugauggaauguucuggaacuagauagagaugaugguugcgcaacacagugaguguacuuaaugccaugcaauuauauacuuuaaaaugauuaauuuggccagguacaguggcucaugccuguaaucccagugcuuuaggaggccaaggcaggaggauugcuuuagcccaggaguugaagaccagccuggccaauacggcaaaacucgaaaauacaaauuagcuggaugugguggcacaugccugcagucucagcuaauugggaggcuaaggugggaggauugcuugagccagggagggggaggcugcaugcagugagcaaagauugcaccacugcgcuauggccugggcaacggggcaaggccuugucucaaaaaaaaaaaaaaaugaaccaggcccgguggcucaugccuguaauuccaauacuuugggaggcugagguggguggaucaccugaggucgggaguucaagaucaaccuggccaacguggugaaaccccgucucuacuaaaaaauacaaaaauuagccgggcaugguggcaggugccuguaaucccagcuacucaggaggcugaggcaggaguauggcuugaaccugggaggcagagauugcagugagccgagauugugccacugcacuccagccugggugacaagaguagaacucugucucaaggaaaaaaaaaaaagauucaaccuguuuccaaguaacucagcaguaucccagaaaaaguugaauaauagugagagguggcugaguacgguggcucacgccuguaaucucagcacuuugggaggccgaggcgggaggaucaccugaggucaggaguucgagacuacccuggucaacauggaaaaacccugucuuuaugaaaaauacaaaaauuaucugggcgugauggugcgcaccuguacucccagcuacucgggaggcugaggcaugagaauggcuugaaucugggagguggagguugcagugcgagcccagauugugccacugcacucuagccugggcgacagagcaagacucugucucaaaaaaaaaaagacaauuauauuuuucaaaggccccaccauccguuccgucaacaaaccuacacuaauucccaucuucacaccacagaggugacagggcacacaucauguagaccuguuucuuucuuucuuuuuuuuuuuugagauggauuaucaaaaaucauucaguaguaugaucuugucuuacugcaaccucugcuucccggccucaagaguuccuucugccucauccucccgaguacugggauuacaguacucccgaguacugggaaaacacccaacuaauuuuuuuuuuuuuuuuuuuuugagacggagucucgcucugucacccaggcuggcgugccgcaaucuuggcucacugcaagcuccgccucccggguucacgccauucuccugccucagccuccggaguagcugggacuacaggcacccaccagcaugcccggcuaauuuuuuuguauuuuuaguagagacgggguuucaucguguuaaccaggauggucucgaucuccugaccucgugauccgcccaucucggccucccaaagugcugggauuacaggcgugagccaccgcgcccggccaacacccaacuaauuuuuguauuuuuaguagagacaggguuucgucauguuggccaggauggucuucaauuccugagaucaagugaucagcccccccuuggccucucaaagugccgggauuacaggcaugagccacugcacucagccccaugcagaccuguuucuaaucuauuauucacacaccugagaaaucccauagaauuuuuucuuuuagagauggggucuugcuacauugcccaggcuggucuugaacuccuagacucaagcgauccucccacuuuagccuuaguugagacuacaggcauguaccaccacaucuggcuuguuuuuacaucgauuuuaucuucuuuuuuuuuuuuuuuuuugagacggaguuuugcuuuuguugcccaggcuggagugcaauggcgggauuucggcucaucgcaaccuccaccuccuggguucaagugauucuccagccucagccucccaaguagcugggauuacaggcaugcaccacuacgccuggcuaauuuuguacuuuuaguagagacaggguuucuccauguuggucaggcuggucuccaacuuccgaccucaggugauccgccugccucagccucccaaagugcugggauuacaggcaagagccaucaugccuggccugauuuuauccuuuuuuaaaaauugcauugagacaaaguccaacagcacuuaaaaguaaaguuuuguuugguuuuuuugagauggagucucauucugucacccaggcuggagugcaguggcgcgaucugagcucacugcaaccuccaccuucuggguucaagugauucuccugccucagccucccgaguagcugggauuacaggcaccaugccccgcuuauuuuuguauuuuuaguagagacgggguuucaccauguuggccaggauggucuccaucuccugaccucaugauccgcccaccuuggccucccaaaaugcugggauuacagacgugagccacugugcccggccaaaaguaaaguuuuuaaaaagauuuacugcugcuuuuccauucauaggcaguaaaaaagcaauucugagacaggguccagcucuggucacugaggcuggagugcaguggcgccaucagcgcucgcugcagccuugaccuccagggcucaagcgaucuuccuaccucggccucccaaagugcugggaugacaggcaugagccacugugcccagccauugauuuuauccugcaacucuguuugcuccacucagcagucuauuucagagaucugucuacauuacuauacggagaucucagcgcauccuuuucucugcugcauaauacuccaccucagaaacuggucgcuauggauuuaaacauuccccuacauuggaacaucuaaguggcuucuaauuuuccuuacuguaaagccaagcugcagugaacguccucaugcaaacuucucaugcugauggguggggcauaaaugccaaguaggggcauugcugcacugcagaucagucaauacauacuugcuauugagagagaucguuacacugaagccugguuuucccaccucauauucaauacgucccagaggagaaaauuuuaccguuuauaaaugcgucuuccccuaaucuccaagaggagacccacagagcucuuuucucuuaaaaacaaaucaacaggccgggugcaguggcucaugccuguaaucccagcacuuuggaaggucgagauggauagaucauuugaggucaggaguuucagaccagccuggccaacauggugaaaccccgucucuacuaaaaauacacaaaaaaauuagccaggcguggugucgcaugccuguagucccagcuacucgggagggcgaggcaggagaaucgcuugaacuugggagguggagguugcagugagccaagaucacaccacugcacuccagcuagagucucgcugugucucaaaacaaaccaacaaacaaaaaacaaaucagcagccaggcacaguggcucaugccuguaaucccagcuacuggggcggaccacuugaggccaggaguuugaggucagccugggcaacacagugagaccccaucucgaaaaaagaccaaaaagcccccacacaccaaaugacacgaaaagcacagacaauaaaagaaaaauaauugauaaacuggauuucaucaaaauuaaaaacaaaaugaaaauauuuaaaagaaugaguaaucucuguuuggaccaaccuggagggauuucccggcaugacccguggcgagacugugccaccuucugggcaaggaaggaaugggagcggcgauggggacgggagggagacuucuaugcaaaaaacucaucgcaugauuuugacuuuuaaaccauuucaguguuuuacaaaaucaaaaacaauaaaauaaaacaacccauagucccauaucaacagaucugccucuuuucugucuuuucccuaaugggcacaaggugaugucuugagucucaugggauguguuacuuuaaaaaucaacagggaaagcuguauucagaaaaauagggucagggguggguggcucacaccuguaaucccagcgauuugggaggcugaggcaggaggauugcuugaggccaggaguucaagaucagccuggccaacauggcgaaacccugucucuacuaaaaauacaaaaauuagcugagucccagcuacccaggaggcugaggcaugagaaucacuugaacccgggagguggagguugcagugagcugagauugcaccacugcccuccagccuggaugacagagugagauucugucucaaaaacaaaaauaaaaaacaacaaacaaacaaaaaaacaagaaagaaagaaaaccacugucagcauauacacauaccccaagaccugcagucacaagagagguguucauguguguguuugccaagacccaccugauggcagggcucgguggcucacaccuauaaucccagcuucuuugggaggccgagguggaaggaucauuugagcccggaaguucaagaccagccagggcaauauagugagaucccaucucuacaaaaaauaaaauuuaaaaaauuagccaggcaugguggugcaugccuguagucccagcuacuugggaggcugaggcaagaggaucaccggagcccaggaggucgaggcugcagugagcuaugauuguaccacugcgcuccaaccuaggcaacagagcaagaccccaucucaaaacaaaaaaaaaguuucucaccaaagugauagggaaacuuaaggucuguucacauugccugauguaaauuaucacucaauuuuaaauaggguaacggcagggagccaccugccauacaguguaucuggcacuagaaggaaguguguggcugguaaucuggcugaagucuuagccucugaacacgcucuguuccaaaaggguuggaugguucuccuccgggagaaggggggcagggcaccccaagucccacaucacuuugccagcagcacacccggccucaugcaccaucaaagcauacaccgugaaaggacggggcucgggcagacgccccauugucuacaccccaucuaccugacaggaccccgccgcgcagccucgucugaccgauuccccugaccccacgacaaagacccucuuuguucccugguaauauccuuagcaggucugucuagacucacuguggcagcaauugucccgugauguuaccaaguucugugacccggguccuccucacccagcuuuggcaagagacaccccagauggccccgagccccggagcuccccagcccuuaacacccaccugcaccuccucggaagagaaacacagccagugccccaguccacccugagagguaggggagacgggacacacgagacacauggugccucgugcuuggggugcugggggaagcugccaucccaggaaagacaaggggggguccccucuguaccccaccaacucccaccuccugaacacugcgggugggaaacaguuccaccuaugcugugggcaugacuucacccaggggacaaagagaaaggaucagaagagacggagacaggccgggcgcgguggcucaugccuguaaucccagcacuuugggaggccaaggcaggcggaucacgaggucaggaguucgagaccagccugaccaauauggugaaaccccgucucuacugaaaauacaaaaauuagcugggcgugguggcgugcaccuguagucccagcuacuugggaggcugagacgggagaaucacuugaacucgggaggcagagguugcagugagccaagauggcaccacuguacuccagccugggugacagagugagacccugucucaaaaaaaaaaaaaaaaggagagacagagacagagagauggagucagagagaaacagaaauggggagagagagaaggggaaagagacagauucagagagaaagaaacaaggagacagagacacacacagggagagaaacugagacacacggagauuaacaaagauagagaggaagagagagaaaggggaagagauaguaagacccagagagagagagagacagggagacagagagaaacagagaaggaugggcauggagguuuaugccuguaaucccagcacuuugaggggcuaagacaggaggauggcuugagcccaggaguuugagaccagucugggcaacauagccaaaucccaucucuacaaaaaaaaaaaaaaaaaagaaagaaagaaagaaaaaaaaauuagcugggugugguggugcaugccuguagucccagcuaauggggaagcuggggcgggaggaucaccugagcccgggaggucaaggaugaggugagcugagauugcucaccucacucguucaaucgaccauugaacuccacuccagucuggacgacagagugagacccugucucaaaaaaaaaagagagcgagaaagagagaaacggagagagaaagaagggacgaggugggaaggaacagagaaacccagagagagagaggcagaaagagacgagagggagaggaagaaagacacaagagagagaaacagccgggugcgguggcucacaccuguaaucccagcacuuugggaggccgaggugggcgaaucaccugaggucgggaguucaagaccagccugaccaacauggagaaacccugucucuacuaaaaauacaaaauuagcugggcguggugguacaugccuguaaucccagcuacucaggaggcugaggcaggagaauugcuugaaccugggaggcggagguugcggugagcugagauugugccauugcacuacagccugggcaacaagagcgaaacucugucucaaaaaaaaaaaaaaaaaaaaaaaagagagaaacagacacacacagauagagaaggugaaagugacagagagagagacagaagagacagagagaugaagagagacacagauaugaacagauagaagaaaggaaagagacagagagagacccagagggagcaagaggggagagacacagagaaguacuuagggggucccugaaggaugaggagcuuccgaaaaaucggucacggcaggaagcaauugccacccacagugcagaacaaaacacccaucuuuggguggaggugacgccuggcaacaguugccugcauuacaccaacaacacuccagggcacauuuuuuggaggaauggauucaacccauccagcagugacaccuuucuaacaggcaaauccaggacaggaaggaaccaagcagcaacuccaggggcgguucucgcagagguguggcaccuggaagcugcuuguuccugccaacuucuggaacaggcaaaauucaccuacuggcgcaaaaaagucugcagagguuuacaucgggagggcuugggaguacuugggggagaggcuauguggggcuucugugaagaaugcgaggaagaaccagagaauguucgagaucuugaccuggcccuugggggugcacauauguaaaauuucuuuuuuuuuuuugagacagagucucgcuuugucacccaggcuggagugcaguggcacaaucucggcuuacugcaaccucugccuccuggguucaagugauuucuggcuaauuuuuguauuuuuaguagagacaggguuucaccauauuggucaggcuggucuugacuccugaccucaagcgaucugcccgccucagccuuccaaagcgcuaggauuacaggcgugagccgcugugccuggccaaauuucuuuucuuuuuuuuuuuuuuuuuuuugagauagggucuagcucugucaccugggcuagagugcagugauacuaugagggcucacugcagccucuaccuccccaggcuuaggugauccucccauauuagccucccgaguagcugggacuacaggcaugcgccaccacucccggcuguuuguauuuuuuuuuuuuuagagauggggucuugcuauguuggccaggauagucucgaacuccuugccucagccucccaaagugcugggauuacaagcgugagccaucauaucaggccuaaaauuucacuaaugaguguucuggguguauauauguuaaacuuuguuuuguuuuguuuaagugaaacaaucagaucuaagaagguuggcaucuuuuuggcaggcgaaugguggggaaucuuguguccuaaacuuugggaagaaagugaaaaguggggcugggcgcagugacucacgccuguaaucccagcacuuugggaggccgaggcgggcggauccccugaggucaggaguucaagaccagccuggucaacauggcaaaaccucgucuguacuaaaaauacaaaaauuagccgggccugguggugcgcagcuguaaucccagcuacuaagggaggcugaggcaggagaaucgcuugaacccaggaggcggaaguugaagugagcugauaccgugacauugcacuccagucugggcaacaagaacgaaacugugucuccagaaaaaaaagaaagcaaaaaguggaaacugcaggucuggagagaggagaaccaaggagaagggcuauuuccucucuggccacaagauaaaaagcugccauccuucaccauccgagaagccccgaagcucggagggauuuccaaagauuguuuaauugauuuuucuucuauuuagauguagaucagugucuggggcccaggaauucagacacccggcuuuguguccacucagccccgugaaggcuccugucugaaaugugcacaaagccugacacacaagucuucagaaacaugcuguuucuuuuugucuggcucuccggggagcgggugagcaggcagggccucgggcacgcucccaucugcagggucccgggaccccgucccuccaucccguucacgaagugggcaggaaagaaaaaaaaaaaagggaaacagccaaaacuuugaggucugaaguuggggaugagggggugauuaaaaaaugggggguacagcuggggacugccacgcugagguuucaacuuagauuuuucuccaaaucuaggauucuggaaugggaacagagguuacuuuaaaucaggcagcucauaggcuaggauaaacagggguuuggcucuggucucugccgaucugauuuauauaacgagaaaacacuuccgucuuucucucugugcauugcuccccagccugucccuacaaaauacuccaucuggaaaagaaacuagaaagguuuugcagacuggcaucuucuucagggcaccaggaaugacagccccccucggccccuaauaugccaucuuuuccucccccagcugcgaggagaugacagcgaggcucacuguaccccuuccuacaaggucaagauauguuccccugccaccccaccccacauauuccugccugguccuuccugaaccaugaauuaccugccuaaaacauaccagagaauucucacuuuggcuguucagaaaccaaccugagucacgauuugucugagucaauggaaaagauuuuuaaaaaggagggagauccuggccggggguaguggcucacaccuguaaucccagcacuuugggaggccgagguggguggaucaccugaagucaggaguuugagaccagucuggccaucauggugaaaccccaucucuacuaaaaauagaaaaaaguagccaggcgugguagcaggugccuguaaucccagcuacucuggaggcugaggcaggagaaucgcuugaacccagaaggcaagguugcagugagccaagaucgcgccacugcacuccagccugggcaacagagugagauuucgucucaaaaaaaaaaaaaaaaaaaaaagagggagauccuagaguuggauaauuccuagguaaaguagacgccagcaccacauaaacagcuguguccuggaaaccagcuacguuuauauccacaccuggcccuccagacccagaucuguagccgcuggccagggccuggggcacuucugaggcaaugccacucccauuucuuggcugugugaccucggagaacucccuucaucccuccucugggccucaguuuccuauucuguuaagugggcacaagaauaacuacacguacuaugcauggguuguugggaggauucagagcgcugggguacaaacacucaacagaugugugcuccggugguuaccauccaggaagagauguggauccgacaucguuuuuuaagagcuggcugggcguaguggcucacgccuguaauuccagcauuuuaagaggcugaggcaggaggauuacuugaggucaggaguucgagaccagccuggccaacauggugaaaccccgacucuacuaaaaauacaaaaauuagccgggcgugguggcagccaccuauaaucucugccacucuggaggcugaggugggagaaucgcuuaaacccaggaggcgaagguugcagugggcugagauugugccauugcauuccagccugggugacagaguaagauuucgucucaaaaaaaaaaaaaaguuuuuguuaaaaggggaccuucuuggaugccauaacuuucuggggugugcccagcuccaagccugacucccacccuccggaucuaaguuaccugaacugcaauccaacuggcguucacgguguguuccccaaaagggccaaauccugaaaaaacaggaaaagcaauauauuacccaagaguggcccuucccagucugccccuggccuggccgcuacucccaccuggagaagcaagaaaggagcuucagggcgcagcugccaaggacaacauugggggccugguccugaguucugggagcaccuggaggcccgucagagccgccguccugcaccuguccgcucugaagucaaugagucccuuccugucuucaccuccaccugccccucaugcucagccaggggccagagguaucuucugccuccgaaaagguccugauccugucuucacuuccucugguccccuugacucaaccuacaauuauugugucacugucccaaaaugcccugaaucggcaccaaaugaggaaugagcccuccaggcugucuagauuucaccuugucacccuccucccugcuagcucaaacuccaggcccccuuuccaaaacacgacagucgcccaaggcugugcuaagugaucuuccuggcauuaagccuggccacauccccuuucaggcaaggguguuuccuaggcccaguuuccaggagcagggacugaggcacagagaggugaagcuagcugcccaaggucacacagcaagaaggugaaaaagcugggauucaaauccagaucuggggcugggugcgguggcucaugccuguaauuccagcacuuugggaggccaaggcgggcggaucaccugaggucagaaguuugagaccagccuggccaacauggugaaaccccguuucuacuaaaaauacaaaaaauuaaccagauggggugaugcgugcccguaauuccagcuacucaggaggcugaggcaggagaaucgcuugaacccaggaggcgaagguugcagugagccgagaucgcgccguugugcuccagcuugggcaacaagagcaaaacuccgucucaaaaaaaaaaaaauacgguccaucugggccagugaucccacaggauaugaaugcuaugcagagaugcuguagccugggauagcagguaggggcuguggcucaggaggggaccuccuaacucuauccuucuguacagccaaaguuugagucucagcucagccccuuacaaacuggaugaccucugugagccucaguuucccuuucugcaaaauggagacaguaaagauguaaucagcucaugcaaaaagugcuggaauaaauaaccagauaaaggaaggcuggaagggaugggggcagugacccuccucccaauuauacacaccuguuaagcaggugccuuguuucuuccuucuucccugaaucuccuggaucagccucaaucucccuucaacagccacaaaacaccugugugcaccuuugcuggauuucccacucugaccccuccagacagcaggucaaaaugacccccccacuccuugacucugaggccccagcggaaguuggcgccccacguggccccgaggcggagucucagggaggagaaacaguugguuugggggugggggggagucggugacagcaggggcccugacucaccaacaaacagcccuggcacaaaacacaaaaagguuuccgcugaagacagucccugggacagcugggagagcccgagguccccggacccccaccugccccugccuugggagaguagccccccaggagcgcagggcgcggcgagcagugacugggagguucauuugucacugggacacuuccugcccgcaaaucggccuuuguccccuggggccagggguugggggagcgguguggggacaggcuggaccucggaaggggcagggaggaaggguccaguccagcccgcaggccagacagaggaggcaggugccaggagggucaccauccccaccuugggaggaaaggacgccaggggggccugcgcagcgccgggcuuuugcccggccccccaagccccgcgcccgacugcccugacucccgacccugggacccccaaggcuccuccuccuccacuuuccaggaagccugggcugcgcggggcucccgcgggugaugacaccuuccaaaucugagaggacuuccagcaccugccccucucggccccgcagucccggagccgcccccgccucugcccccggccgcugccgcuacagcccccaucagccagcguacccgucacuaccaccgccuuccucggcugcuccauggcgggaucgggcugugccucggaccugcuucuguugcgacuggcgcgacagcugcugccgcugcagccucucggccgcgcgag

SEQ ID NO: 191884 - RNA, 29356 nt, Homo sapiens
cucgcgcggccgagaggcugcagcggcagcagcugucgcgccagucgcaacagaagcagguccgaggcacagcccgaucccgccauggagcagccgaggaaggcggugguagugacggguacgcuggcugaugggggcuguagcggcagcggccgggggcagaggcgggggcggcuccgggacugcggggccgagaggggcaggugcuggaaguccucucagauuuggaaggugucaucacccgcgggagccccgcgcagcccaggcuuccuggaaaguggaggaggaggagccuugggggucccagggucgggagucagggcagucgggcgcggggcuuggggggccgggcaaaagcccggcgcugcgcaggccccccuggcguccuuuccucccaagguggggauggugacccuccuggcaccugccuccucugucuggccugcgggcuggacuggacccuuccucccugccccuuccgagguccagccuguccccacaccgcucccccaaccccuggccccaggggacaaaggccgauuugcgggcaggaagugucccagugacaaaugaaccucccagucacugcucgccgcgcccugcgcuccuggggggcuacucucccaaggcaggggcagguggggguccggggaccucgggcucucccagcugucccagggacugucuucagcggaaaccuuuuuguguuuugugccagggcuguuuguuggugagucagggccccugcugucaccgacucccccccacccccaaaccaacuguuucuccucccugagacuccgccucggggccacguggggcgccaacuuccgcuggggccucagagucaaggagugggggggucauuuugaccugcugucuggaggggucagagugggaaauccagcaaaggugcacacagguguuuuguggcuguugaagggagauugaggcugauccaggagauucagggaagaaggaagaaacaaggcaccugcuuaacagguguguauaauugggaggagggucacugcccccaucccuuccagccuuccuuuaucugguuauuuauuccagcacuuuuugcaugagcugauuacaucuuuacugucuccauuuugcagaaagggaaacugaggcucacagaggucauccaguuuguaaggggcugagcugagacucaaacuuuggcuguacagaaggauagaguuaggagguccccuccugagccacagccccuaccugcuaucccaggcuacagcaucucugcauagcauucauauccugugggaucacuggcccagauggaccguauuuuuuuuuuuuugagacggaguuuugcucuuguugcccaagcuggagcacaacggcgcgaucucggcucacugcaaccuucgccuccuggguucaagcgauucuccugccucagccuccugaguagcuggaauuacgggcacgcaucaccccaucugguuaauuuuuuguauuuuuaguagaaacgggguuucaccauguuggccaggcuggucucaaacuucugaccucaggugauccgcccgccuuggccucccaaagugcuggaauuacaggcaugagccaccgcacccagccccagaucuggauuugaaucccagcuuuuucaccuucuugcugugugaccuugggcagcuagcuucaccucucugugccucagucccugcuccuggaaacugggccuaggaaacacccuugccugaaaggggauguggccaggcuuaaugccaggaagaucacuuagcacagccuugggcgacugucguguuuuggaaagggggccuggaguuugagcuagcagggaggagggugacaaggugaaaucuagacagccuggagggcucauuccucauuuggugccgauucagggcauuuugggacagugacacaauaauuguagguugagucaaggggaccagaggaagugaagacaggaucaggaccuuuucggaggcagaagauaccucuggccccuggcugagcaugaggggcagguggaggugaagacaggaagggacucauugacuucagagcggacaggugcaggacggcggcucugacgggccuccaggugcucccagaacucaggaccaggcccccaauguuguccuuggcagcugcgcccugaagcuccuuucuugcuucuccaggugggaguagcggccaggccaggggcagacugggaagggccacucuuggguaauauauugcuuuuccuguuuuuucaggauuuggcccuuuuggggaacacaccgugaacgccaguuggauugcaguucagguaacuuagauccggagggugggagucaggcuuggagcugggcacaccccagaaaguuauggcauccaagaagguccccuuuuaacaaaaacuuuuuuuuuuuuuugagacgaaaucuuacucugucacccaggcuggaaugcaauggcacaaucucagcccacugcaaccuucgccuccuggguuuaagcgauucucccaccucagccuccagaguggcagagauuauagguggcugccaccacgcccggcuaauuuuuguauuuuuaguagagucgggguuucaccauguuggccaggcuggucucgaacuccugaccucaaguaauccuccugccucagccucuuaaaaugcuggaauuacaggcgugagccacuacgcccagccagcucuuaaaaaacgaugucggauccacaucucuuccuggaugguaaccaccggagcacacaucuguugaguguuuguaccccagcgcucugaauccucccaacaacccaugcauaguacguguaguuauucuugugcccacuuaacagaauaggaaacugaggcccagaggagggaugaagggaguucuccgaggucacacagccaagaaaugggaguggcauugccucagaagugccccaggcccuggccagcggcuacagaucugggucuggagggccagguguggauauaaacguagcugguuuccaggacacagcuguuuauguggugcuggcgucuacuuuaccuaggaauuauccaacucuaggaucucccucuuuuuuuuuuuuuuuuuuuuuugagacgaaaucucacucuguugcccaggcuggagugcaguggcgcgaucuuggcucacugcaaccuugccuucuggguucaagcgauucuccugccucagccuccagaguagcugggauuacaggcaccugcuaccacgccuggcuacuuuuuucuauuuuuaguagagaugggguuucaccaugauggccagacuggucucaaacuccugacuucaggugauccacccaccucggccucccaaagugcugggauuacaggugugagccacuacccccggccaggaucucccuccuuuuuaaaaaucuuuuccauugacucagacaaaucgugacucagguugguuucugaacagccaaagugagaauucucugguauguuuuaggcagguaauucaugguucaggaaggaccaggcaggaauauguggggugggguggcaggggaacauaucuugaccuuguaggaagggguacagugagccucgcugucaucuccucgcagcugggggaggaaaagauggcauauuaggggccgaggggggcugucauuccuggugcccugaagaagaugccagucugcaaaaccuuucuaguuucuuuuccagauggaguauuuuguagggacaggcuggggagcaaugcacagagagaaagacggaaguguuuucucguuauauaaaucagaucggcagagaccagagccaaaccccuguuuauccuagccuaugagcugccugauuuaaaguaaccucuguucccauuccagaauccuagauuuggagaaaaaucuaaguugaaaccucagcguggcaguccccagcuguaccccccauuuuuuaaucacccccucauccccaacuucagaccucaaaguuuuggcuguuucccuuuuuuuuuuuucuuuccugcccacuucgugaacgggauggagggacggggucccgggacccugcagaugggagcgugcccgaggcccugccugcucacccgcuccccggagagccagacaaaaagaaacagcauguuucugaagacuugugugucaggcuuugugcacauuucagacaggagccuucacggggcugaguggacacaaagccgggugucugaauuccugggccccagacacugaucuacaucuaaauagaagaaaaaucaauuaaacaaucuuuggaaaucccuccgagcuucggggcuucucggauggugaaggauggcagcuuuuuaucuuguggccagagaggaaauagcccuucuccuugguucuccucucuccagaccugcaguuuccacuuuuugcuuucuuuuuuuucuggagacacaguuucguucuuguugcccagacuggagugcaaugucacgguaucagcucacuucaacuuccgccuccuggguucaagcgauucuccugccucagccucccuuaguagcugggauuacagcugcgcaccaccaggcccggcuaauuuuuguauuuuuaguacagacgagguuuugccauguugaccaggcuggucuugaacuccugaccucaggggauccgcccgccucggccucccaaagugcugggauuacaggcgugagucacugcgcccagccccacuuuucacuuucuucccaaaguuuaggacacaagauuccccaccauucgccugccaaaaagaugccaaccuucuuagaucugauuguuucacuuaaacaaaacaaaacaaaguuuaacauauauacacccagaacacucauuagugaaauuuuaggccugauaugauggcucacgcuuguaaucccagcacuuugggaggcugaggcaaggaguucgagacuauccuggccaacauagcaagaccccaucucuaaaaaaaaaaaaauacaaacagccgggagugguggcgcaugccuguagucccagcuacucgggaggcuaauaugggaggaucaccuaagccuggggagguagaggcugcagugagcccucauaguaucacugcacucuagcccaggugacagagcuagacccuaucucaaaaaaaaaaaaaaaaaaaagaaaagaaauuuggccaggcacagcggcucacgccuguaauccuagcgcuuuggaaggcugaggcgggcagaucgcuugaggucaggagucaagaccagccugaccaauauggugaaacccugucucuacuaaaaauacaaaaauuagccagaaaucacuugaacccaggaggcagagguugcaguaagccgagauugugccacugcacuccagccugggugacaaagcgagacucugucucaaaaaaaaaaaagaaauuuuacauaugugcacccccaagggccaggucaagaucucgaacauucucugguucuuccucgcauucuucacagaagccccacauagccucucccccaaguacucccaagcccucccgauguaaaccucugcagacuuuuuugcgccaguaggugaauuuugccuguuccagaaguuggcaggaacaagcagcuuccaggugccacaccucugcgagaaccgccccuggaguugcugcuugguuccuuccuguccuggauuugccuguuagaaaggugucacugcuggauggguugaauccauuccuccaaaaaaugugcccuggaguguuguugguguaaugcaggcaacuguugccaggcgucaccuccacccaaagauggguguuuuguucugcacuguggguggcaauugcuuccugccgugaccgauuuuucggaagcuccucauccuucagggacccccuaaguacuucucugugucucuccccucuugcucccucugggucucucucugucucuuuccuuucuucuaucuguucauaucugugucucucuucaucucucugucucuucugucucucucucugucacuuucaccuucucuaucugugugugucuguuucucucuuuuuuuuuuuuuuuuuuuuuuuugagacagaguuucgcucuuguugcccaggcuguagugcaauggcacaaucucagcucaccgcaaccuccgccucccagguucaagcaauucuccugccucagccuccugaguagcugggauuacaggcauguaccaccacgcccagcuaauuuuguauuuuuaguagagacaggguuucuccauguuggucaggcuggucuugaacucccgaccucaggugauucgcccaccucggccucccaaagugcugggauuacaggugugagccaccgcacccggcuguuucucucucuugugucuuucuuccucucccucucgucucuuucugccucucucucucuggguuucucuguuccuucccaccucgucccuucuuucucucuccguuucucucuuucucgcucucuuuuuuuuuugagacagggucucacucugucguccagacuggaguggaguucaauggucgauugaacgagugaggugagcaaucucagcucaccucauccuugaccucccgggcucaggugauccucccgccccagcuuccccauuagcugggacuacaggcaugcaccaccacacccagcuaauuuuuuuuucuuucuuucuuucuuuuuuuuuuuuuuuuuuguagagaugggauuuggcuauguugcccagacuggucucaaacuccugggcucaagccauccuccugucuuagccccucaaagugcugggauuacaggcauaaaccuccaugcccauccuucucuguuucucucugucucccugucucucucucucucugggucuuacuaucucuuccccuuucucucucuuccucucuaucuuuguuaaucuccgugugucucaguuucucucccugugugugucucugucuccuuguuucuuucucucugaaucugucucuuuccccuucucucucuccccauuucuguuucucucugacuccaucucucugucucugucucuccuuuuuuuuuuuuuuuugagacagggucucacucugucacccaggcuggaguacaguggugccaucuuggcucacugcaaccucugccucccgaguucaagugauucucccgucucagccucccaaguagcugggacuacaggugcacgccaccacgcccagcuaauuuuuguauuuucaguagagacgggguuucaccauauuggucaggcuggucucgaacuccugaccucgugauccgccugccuuggccucccaaagugcugggauuacaggcaugagccaccgcgcccggccugucuccgucucuucugauccuuucucuuuguccccugggugaagucaugcccacagcauagguggaacuguuucccacccgcaguguucaggaggugggaguuggugggguacagaggggacccccccuugucuuuccugggauggcagcuucccccagcaccccaagcacgaggcaccaugugucucgugugucccgucuccccuaccucucaggguggacuggggcacuggcuguguuucucuuccgaggaggugcagguggguguuaagggcuggggagcuccggggcucggggccaucuggggugucucuugccaaagcugggugaggaggacccgggucacagaacuugguaacaucacgggacaauugcugccacagugagucuagacagaccugcuaaggauauuaccagggaacaaagagggucuuugucguggggucaggggaaucggucagacgaggcugcgcggcgggguccugucagguagaugggguguagacaauggggcgucugcccgagccccguccuuucacgguguaugcuuugauggugcaugaggccgggugugcugcuggcaaagugaugugggacuuggggugcccugccccccuucucccggaggagaaccauccaacccuuuuggaacagagcguguucagaggcuaagacuucagccagauuaccagccacacacuuccuucuagugccagauacacuguauggcagguggcucccugccguuacccuauuuaaaauugagugauaauuuacaucaggcaaugugaacagaccuuaaguuucccuaucacuuuggugagaaacuuuuuuuuuguuuugagauggggucuugcucuguugccuagguuggagcgcagugguacaaucauagcucacugcagccucgaccuccugggcuccggugauccucuugccucagccucccaaguagcugggacuacaggcaugcaccaccaugccuggcuaauuuuuuaaauuuuauuuuuuguagagaugggaucucacuauauugcccuggcuggucuugaacuuccgggcucaaaugauccuuccaccucggccucccaaagaagcugggauuauaggugugagccaccgagcccugccaucaggugggucuuggcaaacacacacaugaacaccucucuugugacugcaggucuugggguauguguauaugcugacagugguuuucuuucuuucuuguuuuuuuguuuguuuguuguuuuuuauuuuuguuuuugagacagaaucucacucugucauccaggcuggagggcaguggugcaaucucagcucacugcaaccuccaccucccggguucaagugauucucaugccucagccuccuggguagcugggacucagcuaauuuuuguauuuuuaguagagacaggguuucgccauguuggccaggcugaucuugaacuccuggccucaagcaauccuccugccucagccucccaaaucgcugggauuacaggugugagccacccaccccugacccuauuuuucugaauacagcuuucccuguugauuuuuaaaguaacacaucccaugagacucaagacaucaccuugugcccauuagggaaaagacagaaaagaggcagaucuguugauaugggacuauggguuguuuuauuuuauuguuuuugauuuuguaaaacacugaaaugguuuaaaagucaaaaucaugcgaugaguuuuuugcauagaagucucccucccguccccaucgccgcucccauuccuuccuugcccagaagguggcacagucucgccacgggucaugccgggaaaucccuccagguugguccaaacagagauuacucauucuuuuaaauauuuucauuuuguuuuuaauuuugaugaaauccaguuuaucaauuauuuuucuuuuauugucugugcuuuucgugucauuuggugugugggggcuuuuuggucuuuuuucgagauggggucucacuguguugcccaggcugaccucaaacuccuggccucaagugguccgccccaguagcugggauuacaggcaugagccacugugccuggcugcugauuuguuuuuuguuuguugguuuguuuugagacacagcgagacucuagcuggagugcaguggugugaucuuggcucacugcaaccuccaccucccaaguucaagcgauucuccugccucgcccucccgaguagcugggacuacaggcaugcgacaccacgccuggcuaauuuuuuuguguauuuuuaguagagacgggguuucaccauguuggccaggcuggucugaaacuccugaccucaaaugaucuauccaucucgaccuuccaaagugcugggauuacaggcaugagccacugcacccggccuguugauuuguuuuuaagagaaaagagcucugugggucuccucuuggagauuaggggaagacgcauuuauaaacgguaaaauuuucuccucugggacguauugaauaugaggugggaaaaccaggcuucaguguaacgaucucucucaauagcaaguauguauugacugaucugcagugcagcaaugccccuacuuggcauuuaugccccacccaucagcaugagaaguuugcaugaggacguucacugcagcuuggcuuuacaguaaggaaaauuagaagccacuuagauguuccaauguaggggaauguuuaaauccauagcgaccaguuucugagguggaguauuaugcagcagagaaaaggaugcgcugagaucuccguauaguaauguagacagaucucugaaauagacugcugaguggagcaaacagaguugcaggauaaaaucaauggcugggcacaguggcucaugccugucaucccagcacuuugggaggccgagguaggaagaucgcuugagcccuggaggucaaggcugcagcgagcgcugauggcgccacugcacuccagccucagugaccagagcuggacccugucucagaauugcuuuuuuacugccuaugaauggaaaagcagcaguaaaucuuuuuaaaaacuuuacuuuuggccgggcacaguggcucacgucuguaaucccagcauuuugggaggccaaggugggcggaucaugaggucaggagauggagaccauccuggccaacauggugaaaccccgucucuacuaaaaauacaaaaauaagcggggcauggugccuguaaucccagcuacucgggaggcugaggcaggagaaucacuugaacccagaagguggagguugcagugagcucagaucgcgccacugcacuccagccugggugacagaaugagacuccaucucaaaaaaaccaaacaaaacuuuacuuuuaagugcuguuggacuuugucucaaugcaauuuuuaaaaaaggauaaaaucaggccaggcaugauggcucuugccuguaaucccagcacuuugggaggcugaggcaggcggaucaccugaggucggaaguuggagaccagccugaccaacauggagaaacccugucucuacuaaaaguacaaaauuagccaggcguaguggugcaugccuguaaucccagcuacuugggaggcugaggcuggagaaucacuugaacccaggagguggagguugcgaugagccgaaaucccgccauugcacuccagccugggcaacaaaagcaaaacuccgucucaaaaaaaaaaaaaaaaaagaagauaaaaucgauguaaaaacaagccagauguggugguacaugccuguagucucaacuaaggcuaaagugggaggaucgcuugagucuaggaguucaagaccagccugggcaauguagcaagaccccaucucuaaaagaaaaaauucuaugggauuucucaggugugugaauaauagauuagaaacaggucugcauggggcugagugcaguggcucaugccuguaaucccggcacuuugagaggccaagggggggcugaucacuugaucucaggaauugaagaccauccuggccaacaugacgaaacccugucucuacuaaaaauacaaaaauuaguuggguguuggccgggcgcgguggcucacgccuguaaucccagcacuuugggaggccgagaugggcggaucacgaggucaggagaucgagaccauccugguuaacacgaugaaaccccgucucuacuaaaaauacaaaaaaauuagccgggcaugcuggugggugccuguagucccagcuacuccggaggcugaggcaggagaauggcgugaacccgggaggcggagcuugcagugagccaagauugcggcacgccagccugggugacagagcgagacuccgucucaaaaaaaaaaaaaaaaaaaaauuaguuggguguuuucccaguacucgggaguacuguaaucccaguacucgggaggaugaggcagaaggaacucuugaggccgggaagcagagguugcaguaagacaagaucauacuacugaaugauuuuugauaauccaucucaaaaaaaaaaaagaaagaaagaaacaggucuacaugaugugugcccugucaccucuguggugugaagaugggaauuaguguagguuuguugacggaacggaugguggggccuuugaaaaauauaauugucuuuuuuuuuuugagacagagucuugcucugucgcccaggcuagagugcaguggcacaaucugggcucgcacugcaaccuccaccucccagauucaagccauucucaugccucagccucccgaguagcugggaguacaggugcgcaccaucacgcccagauaauuuuuguauuuuucauaaagacaggguuuuuccauguugaccaggguagucucgaacuccugaccucaggugauccucccgccucggccucccaaagugcugagauuacaggcgugagccaccguacucagccaccucucacuauuauucaacuuuuucugggauacugcugaguuacuuggaaacagguugaaucuuuuuuuuuuuuccuugagacagaguucuacucuugucacccaggcuggagugcaguggcacaaucucggcucacugcaaucucugccucccagguucaagccauacuccugccucagccuccugaguagcugggauuacaggcaccugccaccaugcccggcuaauuuuuguauuuuuuaguagagacgggguuucaccacguuggccagguugaucuugaacucccgaccucaggugauccacccaccucagccucccaaaguauuggaauuacaggcaugagccaccgggccugguucauuuuuuuuuuuuuuugagacaaggccuugccccguugcccaggccauagcgcaguggugcaaucuuugcucacugcaugcagccucccccucccuggcucaagcaauccucccaccuuagccucccaauuagcugagacugcaggcaugugccaccacauccagcuaauuuguauuuucgaguuuugccguauuggccaggcuggucuucaacuccugggcuaaagcaauccuccugccuuggccuccuaaagcacugggauuacaggcaugagccacuguaccuggccaaauuaaucauuuuaaaguauauaauugcauggcauuaaguacacucacuguguugcgcaaccaucaucucuaucuaguuccagaacauuccaucacccgaaaaggagacccuguccccaucaguagccauucuccauuccccucccucagccccuggcagccacucgucugcuuccugucucuauggauuugccugcucugggcauuucauaucaauggaaucauacaauauguggccuuuugugucuggcuucucucacucagcaucauguuuucaaaguucauccacauuguaccacggaucagugcuucuuuccuuuucauggcugaaucguauuccaucggauggauggaccauauuucauuuauccaucuguugaugggcauuugugcuauuucuaccuuuuggcuuuugugaauacuagagaggcuucuuuuuacaaauuggacacaguggcucaccccuguaaucccagcacuuugggaggccaaggcaggugaaucacuugaggucaggaguuugagaccagccuggccaacauggugaaaccccaucucuacuaaaaauacaaaaauuagcugggcgugaucccgcaugucuguaaucccagcuacuggggaggcugaggcuugagagucacuugaacccaggaggcagagguugcagugaaccgagaucauagcacugcgcuccagccucggugacagaaugagacucugucucaaaaaaauaaaagacucuugggaggcagaggcagguagaucacgaggucaggagaucgagaccauccuggcuaacacagugaaaccccgucuccacuaaagauagaaaaaauuagccggguguggcggugggugccuguagucccagcuacucgggaggcugaggcaggagaauggcaugaacccgggaggcggagcuugcagugagccgagguggcgccgcugcauuccagccugggugacagagugagacucugucucaaaauaaaauaaaauaaaauaaauaaaagacucuguugcagggcacagggucucacccugcugcccaggcuggagcgcaguggcacgaucauagcucacugcaaccucaaccgccugggcuuagguaauccucccaucucagccuccugaauagcugggaccacaggugugcaccaccaugcccagcuaauuuuuaaaguuuuuguagaggccaggucucacuauguugcccaggcuggucucaaacuccuggguucaagcgaucuuccagccucagccucucaaagugcugggauuacaggcaugagccacugcacccagccccauuucuaaaauaauaacaguaauaggauaauggcagccaaugucauuugaacacuuaaaauaugccagacauggugcuuagaacuguuagcgugagugagcacauuuaauuuugaaagcuauccugugagguaagucgauacuuuuuuuuuuuuuuuuuuuuuuuuugagacggaguguugcucugucacccaggcuggagugcaguggcacaaucuuggcucauugaaagcucugccuuccagguucaugccauucuccugccucagccuccccaguagcugggacuacaggcacacgccgccacgcccagccaauuuuuuuguauuuuuaguagagaugggguuucacuguguuagccaggauggucucgaucuccugaccucgugauccgccugccucggccucccaaagugcugggauuacaggcaugagccaccgcaccuggccuuuuuuuuugagauggaguuucgcucuuguugcccaggcuggagugcaguuacgugaucuuggcucacuacaaccucugccucccggguucaagugauucuccugccucagccuccuaaguagcugagauuacaggugugugccacugcacccagcuaauucuuguauuuuuaguagagauggggugacaccauguuggcuagacuggucucgaacuccugaccucaggugauccgcccaccuuggccucccaaagugcugggauuacaggccugagccaucaggccuagccugauacucuguuauucccauuuuacagaugaggaaacugagacucagagagauuaaguggauugcccaaggucacacaggcaggauugaguccaaggagccugggauuuaaccccagggaccauagaaucaugucaccuuccauagagauacagagagacuuugaggcaagaggguggggaaggaaaugaggggcuuugaacuaaaucaacacacacccuugccauccugcagaaugagucuggagaacgccuguuuguuucaccccccagagagcgcauuauccccauagcugucaucuggggccaugacacucccacucuccucucuuccaggagcuagaaaagcuaggccuuggcgacagcguggaccugcauguguacgagauuccgguugaguaccaaacaguccagagacucauccccgcccugugggagaagcacaguccacaggugaguggugccaaggggcggcacuuccucaucaggacuuacagguuggcacccuucauguggaggacuuagguggcuuugguccugaucagaucacgugaccaaugccauacagccuuguccucaaaagggcuuuucaggccgggcaugguggcucaugccuguaaucccagcacguugggaggccgaggcagguggauaaccuauacucaggaguucgcaaccagccugggcaacauggcaaaacccugucucuacuaaaaauacaaaaaauuagccgggugugauggugggcgccuguaguuccagcuacucgggaggcugaggcaggagaaucgcuugaacccgggaggcggagguugcggugagccaagauugugccacuguacuccagccugggcagcagagcaagaccugucucaaaaaaaacaaaaaaacccaaagggcuauccaggccaaggguaguggcucaugccuguaaucccagcacuuuggaaggccgaggcaggaggauugcuugagucuaggaguuugagaccagccugggcagcauagugagaucccaucucuacaaaaaaauuuaaaaauuaggcaugaugguacaugcuuauagucccagcuacucagaaggcugaggcaggaggauugcuugagcccaggaauuuaagacugcagugagccaagauuuuuaugccacugcacuccagccugggcaacagaacaagucucuuaaaaaaacaaacaagaccaggcaugguggcucacgccuguaaucugagcacuuugggaugcugaggcggguggaucaccggaggucaggaguuugaucccagccuggccaauauggugaaacccugucucuacuaaaaauacagaauuagccaggugugguggcgcaugccuguaaucccagcuacuugggaggcggaggccagagaaucgcuggaacccaggaaggggagguugcagugagcugagaucgcgccacugcacuccagccugggcgacagagcaagacuccaucucaacaaagaaacaaaaacacugcauuggcauuuuaacacuugcauagcagcucauuauuuauugaacuaacuccgcuggauggcuaguuaacuuguuugcaguauuugauuuugauaacaagaacagcugcagugaacagcccuucauguuucaaauucuugccugucuuacauggcauaccuuuuuccaagagugacugcagggucuauucuagcagcaagaggucagaaacaacacaaccccaggcagagcucauuaaggaugcugccuuuucccuggccucagggggaccccucugagucccacgggcaggccauguuaaguccugccccugucugugugcagcugguggugcaugugggggugucaggcauggcgaccacagucacacuggagaaauguggacacaacaagggcuacaaggggcuggacaacugccgcuuuugccccggcucccagugcugcguggaggacgggccugaaagcauugacuccaucaucgacauggaugcugugugcaagcgagucaccacguugggccuggaugugucggugaccaucucgcaggaugccggcagguagggcccuguggggugggagugaguggggauuucccuccuccacccacugagccugguguagaacaagccaagcguguugaccuuggccucuuuggaccaagcacucaguguauacuaggcacagagccaaguauuuguacguagcaggugccguugguucugcuccugggacucauggaucugcccacuucuccccaccaucacgguccccaccaaggcccccagcaucucccaccuggacacugccccagccuccaucucagucuuccucccugcugccuccaccccaacccaagcagucaguuucuguguuaauuuccuggagcugcuauaacaaauacccacaaacugggugguuucauauaacagaaauguauugucuaacagccuuggaagucagaaguccaaggucaaggugguagcaggacugguuccuucuggaggugcugagggugagucugucccaggccucucuccugcagcugguggcugcuggccauccuuggcuuguagacacaucgcuccaguccccgccccuauccucacaucacuuucuucccuuuguguguggccguguggucuucuuauuaggacaccagucauuauauuuaggacucauccuaauccaguaugacuuuuuuuuuuuuuuuuuuuuuuuugagacggaguuuugcucuuguugcccagccuggagugcaauggcgugaucucagcucacugcaaccuccaccucuuggguucaagcgguucuccugccccagccucccaaguagcugggauuauaggcaugcaccaccacgcccggauaauuuuauacuuuuauuagagacaggguuucuccacguuggucaggcuggucucgaacucccgaccucaggugaugcacccaccucugccucccaaagugcugggauuacaggcaugagccacugcgcccagccgaccucaucuuaauuuaacuaauuacaucugcaaagauccucuuuccaaauaaggugacauucuuuuuuuuuugagauggaguuuugcucuuguugcccaggcuggagugcaauggcgccaucucggcucacugcaaccuccgccuccuggcucaaacaauucuucugcuccaggcuaccaaguagcugggauuacaggcgugcaucaccagacccagcaaauuuuuuguauuuuuaguagagaugggguuucaccauguuggucaggcuggucucgaacucccgaucucaggugauccacccuccucagccucucaaagugcugggauuauaggcaugagccaccaaacguggcccaaauaaggucacauucugaggucccaggugaacacgaauguugagggagaugauucuauugcaaaaggucuuuuauaaauuuaaaucagggccaggcgcaguggcucaugccuauaauccuagcacuucgggaggccaaggcaggaggaucgcuugagcccaggaguucaagaccagccugggcaacauaaggagaccccaucugaacaaguaaaaaaaauagcaggcugagacaggaggauuccuugagcuuggaguucaaggcugcagugagcugugauagcgccacugcacuucagucugggcaacagagcaagacccuguuggcucuaaauaaauaaaugcauguguuccuuuccuagaccuucccuauggcucccauugcacauagaauaaaauuccaacccuggcccuuggcccgccucuccaccccgcucugccucuacucaccccauauccauugcacuccagacacaugaaccagcuuccuccugcuccucaaacacaccaaguucacuccagccucagggccuuugaacacccuauggccucugcccagaacaccuuccucugggaacaccucuuuccagucuuuuuuuuuuuuuuuuugagauggagucucgcucuguagcacaggcuggagugcauuggcgcgaucuuggcucacugcaaccuccgccucugacguucaagugauucuccugccucagccucccaaguagcugggauuacaggcgugcgccaucauucccagcuaacuuuuguauuuuuaguagaggcgggguuuugccauauuggccacaccaggguggucucgaacucccgaccucaagugauccacccaccucagccucccaaagugcugggauuauaggccugagccaccgcgccuggcccucuuuccagucuuaauuccaacacgagucaccuccuugugacuuguaggccucuccaacuccccagaccaaguuauacccucccagcaccagcuuccucacuuuucccuaaucugugcgcuuguccaacucaaaggcagcuauuggucaaugcaguugaguagcugaaggaaggaaugccuggauuuaccaucaggauuuuuguuuuuggagacaggaucucgcucuguugcauaggcuggagucaaguaguauaaucacagcucacugcagccuccaucuccugggauuaagugaucccccgccucagccucccgaguagcugggacugcagauggacaccaccacguccagcuaauuuuuguauuuuuuguagagauagaaucuugcuacauugcccaggcaggucuugaauuccugggcucaagugauccuugugccucggccucccaaagugcugggauuauaggcaaaagccaccgcacaccacugaguucuuuuuaaagcuaacuuuuucucuuuuuuaauugaaaacuaauuguuauuuaguuguuuauuuauuuugacaggaucucguucuguaucccaggcuagagugcaguggcaaaaucacagcucauugcagccuugacuuuuugggcuuaggugauccucccaccucagccucccagguagcacaaccaaacccagcuaauuuauuuuuuauuuuuauuuuuuuugagacagagucuugcucugucgcccaggcuggagccaggcugcaguauuguggcacaaucuuggcuugcugcaaccuccaccucccggguucaagcgauucuccugccucagccuccugaguagcugggauuacaggugcccaucaccacacccagcuaauuuuuguauuuuuaguagagauaggguuuuaucauguuggccaggcuggucucgaacuccugaccucaggugauucgccugccucggccucccaaagugcugggauuacaggcaugagccaccgcgccuggccuaauuuuauuuuauuuuaguuuuuuugagacugcgucuagcuuugucacccaggcuggagugcaguggcucgaucuuguugcacugcagccuccaucucccgggucaagugauucuccugccucagccugcagaguagcugggauuacaggcacccaccaccacacccagcuaauuuuuguauuuuuaguagagaugggguuucaccauguugcccaggcugguguugaacuucugagcucaagcaauaugcccaccuuggccucccaaggugcuagaauuacaggugugagccuccgcacccagcucaauuuucuuucuuuuuuuuuaaagacaagaguuucgcucuuguugcccaggcuggagugcaauggcagaaucucagcucaccgcaaccucugccucccagguucaagugauucuccugccucagccucccaaguagcugggacuacaggugccugccaccaugcccagaaaauuuuuguauuuuuaguugagaugagguuuucagcauguuggccaggcuggucuugaacuccugaccucaggugauccacccgccuuggccuuacaaagugcugggauuacaggcgugagccaccgcgcccggccacccagcccaauuuuuuuguauuuuugguagagacaagguguugcaauguugcccaggcuggucucgaacucauggagucaagggauccucccacuucagccucccaaagugcugggacuacaggugugagccaccauacccagcuuccaucagucucuuuauaaaauuaauuuuuaaucauagguaacucuagaacauauccucauaugucuaauugggaaaaauucucauucccucucuuuuuccauagcggucccucugauaagucagacacggaaaccaugaagcuccuacugacugacacguuuccguacauauauacaucacuuggccugcugcuuuaugauuuuaucuuguuuugcuuugcuuuuacguggauggagucacauggcgaaagucacacuuacugagaauucucauccuuaguuuucauuugugagcguucaacaugcaucuggcgaguucuccauuuuuuucuggcuguaccacauuccuuguaaacagauucauaggauuccaugguguggauaaaccagaguuuacuaagccacucccugucagugggcuuuagguugcuuucuguuuuccugcuuuuauacauaauacgauggggagcaucccuguuuguacuuucuuguacccuugugcagaugguuccugaggguagaucuaaaaacgggaaauaggccaggcgugguggcucacgccuguaaucccagcacuuugggaggccgaggcaggcgaaucacucgaggucaggcguuccagaccugccuagccaacauggugaaaccccgucucuacuaaaaacauaaaaauuagccggaugugcuggcaggcaccuguaauuccagcuacucgggaggcugaggcaggagaaucgcuugaacccgggaggcgaagguuggagugagccaagaucucaacacuccacuccaaccugggugacagaguaugacuccgucucaaaaaaauaaauaaauaaaaauaaaaacuggaaauagggccaggcacgguggcucacaccuguaaucccagcacuuugggaggcugagguaggcggaucacuacaggucaggaguuucagaacagccuggccagcauggugaaacccugucucuacuaaaaauacaaaaauuagccagacgugguguggcccacgcccguaaucccagcuacucgggaggcugaagcaggagaaucacuugagccgaggaggcagaaguugcacugagcugagauugugccacugcacuccaaccugagcaacagagcagacucugucucaaaaaaaaaaaaaaaaaaagccaguggugguggugcacaccuguagucccagcuacucaggagggugggguaggaggaucgcuggaggccagguugcacuccaaacugggugacagagugagacccugucucaauaaacaaaaaauggaaauaccagguuguaaagucugggugauuauaauuuuacuagccugacaaauugccuuccacacggggacaaccagcgugccuucccaccagcaauagcucacucugcccauuuccccacaugugccacagcacugggaguuaucaaguuuuuuuuguuuguguguguguguguguguguguguguguguguguuuuaaagagacaggaucucacucucucacccaggcugagugcaguggugcaaucauggcucacugcagccuugaccuccugggcucaaacaauccucccgccucaaccuccugaguagcugggacuacaggcacgugccaccaccucuggugauuuuuuuucaucuuugccaaccuggggagggaggagaguguuguuccaucuuguggguugcugguaaggucuucccuuggauuuggaugggugcugucaccuuggucuacggauugccccucugaccccguuuuggucucucucuuacccgccacgcccugcggcuuagauaucucugcgacuuuaccuacuacaccucuuuguaccagagucacggucgaucagccuucguccacgugcccccacuggggaagccguacaacgcggaccagcugggcagggcacugagagccaucauugaggagauguuggaccuccuggagcagucagagggcaaaaucaacuauugccacaaacacugagggacgcucaggucuccuaagaccucauccugcuggggaccccacgaggggacauccacccucugggguguggccaggaaaagacaagcucuucagcuuggggauccgaucuggaagagagauucugaucugcccaccuccucuuccuccuucucuacaaaagcuccgguugauucgagggaaguggugaaaauuuuuuuuucucccauuuuccucccugcaucuggggacacagcugccgugaccagggaggccagccugggagguccagaugcccagggagaaucuuggucuggugaauccaugagcugcgauaccacggcuggggccauauguucaccugcuuuccuguccguuggugaaggaauuucagaauucauuuuauauccaagacuggcuuuuaccaaauuuaaaagccucucaaugcguccucgaccuugaacugugcucaacagccuggcccuuucuggggccacccugggauauggcuggcuggcuggcuuucuuucuuucuuucuuucuuucuuucuugcuuucuuucuuucuugcuuucuuucuucucucucucucuuuuuuuuuuuuuuuaaauagugcuaguuugggcacagaguaauuuauauucccuuugguuaaaaugcaggcuuuuuagccaacaacaaaaguguuuuccccccacccccacucgcccaccagggugaugccacuuuugccuccugcccugaaaauuggacuuaagaugccaugucuuggccaggcgcaguggcucaugccuguaaucccagcacuuuggaaggccagggugggcggaucaccugagaucaggaguucaagaucagccuggccaacauggugaaacccugccucuacuaaaaauacaaaaauuagccgggcauggugaugagugccuguagucccagcuacucgggaggcugaggcuggagaaucgcuugaacuugggaggcagagguugcagugagcugagauugcacagcugcacuccagccugggugacagagcgagacucugucucaaaacaauuggacuuaagauggcaugucuuuguuuuagggccaaaaaugaggcccccuugcuuaaggcaugggguccguggccaggcaacggggugggacugcugccccagauguggccaugggggucgugguccuuucaacaccaagcuaugagcugucgccauggagaccagggccaccuguggaaaggcggauuuugucugcuuuugacuuuucuuuuuuaauauguaaaacuccacaucagcggaaaccccccccuacuucuggccuggagcuucaggguuuuggugcugggacgaguuuguuguucuccuuagcgggguggcgcggggggcucaaaacgggggcgcgggggcuggaguuggcagagcucugcaugucccggcaugucugagcaggaggaauuccgggcggccaaaggguuuuauguagauugcuuuuggacacucgcccaggagucaggaguugauuuuuaucucacuuccugguaaccuugaacuuaccaggcagggaugagaugacguaaacuuccucagaugauguaaguucagccacaucuugcugcccauuagggagagaggacgacccccacagugaaaguaauugagugaaaugcacguucuggaaaucaguuucuauuuuggccuggaggaauguggcuauacugcuucccugagugugacacaguuggaaucuaaucuuguugguuucccaacaucuagguuuuuguuuguuuguuuguuuuuaugauagggucuuguucuguugaccaggcuggaguacaguagugugaucauggaucacugcagccucuaccuccugggcucaagugauccucccaucucagccuccugaguagcugggacuacaggcaugcaccaccacaccuggcuaauuuuuaaauuuuuuauacagacaggguuucaccauguugcccaggcuggucucgaacuccuggacucaaacugauccuccuuucucggccucccaaagugcugggauuacaggcaugagccacugcacccagcccaguucuuucuuaaaacagcugagaguuuuguuuucuucagcguucaccuuccuugucuccaguuccgaugcuggcagugguuccuaccucuguuggguuucuagauaguuugggaacgggguugauggguuucugugaaacacauuuuccaagucuugggcuuucucuggaggggaagguggaugcuggcgggugacuugcagugggcgccuggcaguggguguggacuguaacugacagguggaaaugaguagggacacuauuguucccuccaugccagcuuuuuuuuuugcuggaaaugcccccuccacaccccugguagcucuguguccugagaaauccagagugugggagacaucacugcaucuguccccccagcuucugugaagggaagcuguggccucuuuugaauguggggaacaacugaagacucaggggucacccagaggucugguggaaagcaacuucagguuucaucuugcucuauuccucaaaggucuggucugugggccucugaggagaaaacaggucuagccaagacagggacaaaauggggaaggggaugugccaggccugaacugagcuaagcaccugccccgggcuccacacuuccaucuuucuuuugucuucauuucaccucuguguuuaaagcacugugugacauagcuccuuagagauauaaccuauugucugcucauugucacgugugugugugucaucuuuguauucuugcagugguuucacauuuccuuacccagucaagccaguaucccauccuuccucauaaugcacaacauuuggcucauuuuauuuuucucauuguuauuuuuuauuuuuauuuuuugagauggauucucacacuguuacucgggcuagagugcaauggcgugaucucggcucacugcaaccuccaccuccuggguuuacacaauucuccugccucagccucccgaguagcugggauuacaggcgcccgucaccacaccuggcuaauuuuuguauuuuuaguagagaugcagcuucaccauguuggccaggcuggucuugaaauccugaccucaggugaucugccugccuuggccucccaaagugcugggauuacaggugugagcuacugcgccuggccaaguuuuuuacaaauauuuuucuuuugguggaacucaucugugcacucucugguguguuuuuccaccuuuguugggucuuggcuuaaaauauccucaugugggcuaggugugguuacucacaccuguaauccuagcacuuugggagguugaggcaggagaaucccuugagccaggaguucaagaccagccugggcaacauagcaagagaucccauaucuaccaaaacauacaagaauuagccagaugugguggugcaugccuguggucccagauacucaggaggcugaggcaggaggaucaccuaugccugggagguugaagccccagugagccaugaucacaccacuguaguccagcccgggugacacagcaagacucugucucaaaaaaaaaaaaaaaaaaaauccucaugcaagaagggaaggaccaagucccauucccucuugccucauuuucagagccugggguaggggcuacagguggcauaggaagggucugcaaggugggugggacuuggcagguguugggaagaggaauagggguggcaagugucaauggugaaaagacaggcugagggguguggugggaaggcugggggagaaaggugagaagugauugggggggcuucccugaugaguccucauggagggugcugaggcagggaacaggggugcagggacagugaucagggcaccugguacccugaccaacuugaugauggcaucucuuuuaagaugcccaagucugcgcacuuuuauuccuuuauucggccccuagcacccccuccccaccccaaagaaggucaguugcaugcguguggggauguagcucaaaaaagaaauaagauggaguggaaaggaaagaaaggaagaagcaggaauucaaggugggugggcugagcuuggggccaccuagcccaccugcuccaaucaagggcuggaacaaaccugaggccacuuggagaggcagggcugggcagggacagggggugggggccgaaaucacagcuuccccaucagagccagaugugugaaggaaaugucccagauggcaguaguuucucggcaaggaggggaauccuggagaugguucaugucugugaucccagugcuuugggaggcugaggugggaggauugcuugagcccgggaguucgagaccagcccugggcaacauggcgagaccccaucucuacagaaauuaaaaaaaaaaauuagccaguuguggugucaagcaccuguagucccagcuacuugggaggcugaguugggaggcuuaucugagcccaggaggugaaggcugcaaugagccaugauuacacuacuguaccccagccugggcaacagagcaagacccugccucaaaauuaagaaaaaaaaaaggggggccaggcgcaguggcuuaugccuguuaucccagcacuuugggaggccaaggcagacugaucgcuugaggccaggaguuugcgaccagccuggccaacauagcaaaaccccaucucuacuaaaaauacaaaaauuagucaagaguggauggugcgugccuguaaucccagcuaccugggaggcugagacaggagaauugcuugaaccugggaggcagagguugcaguggugugagaucacgccacugcauuccagacugggcaacauagcaagacucugucacaaaaaaaaaaaaaaaaaagaauucccugcucugcuuuucugcucguugcuggcauagaaacaucuagaacagaaaguauccacucuggggcagaugggagagcuggaaaaguagauucaagaugccuuuuagucuuggaaguuucuuccaggaagcaagaccagcugguauguuuacaccugcacuccagugcccuggggaggugaccagguggagggggauggcucauggaaaucugucccgcacagcuggcccccuuuuggcugccacugucuagacuguuggccuuugaccucucugccucuuguggcgucugaaccuagacgucccuuuuggagacagcuggacaaagcccuauucuccgcagccccagccucuauccugaggccucugggagcugcgugacggccagcauggggugcugaucauggucaaggaggcaggucuuugccagguugccccaugcagccacccauccucagcauccuaacuugagggggcaggagagggcuuuguuuuuauaauccggauuaaauuucccuucccugggcacaagugccucaugagggcccggggcugcugguugggagggaaagcauccccguuuuugcagugaggaggccggccgagggcugggguuccacuuagacccuuggcagaauggcuguugaggggcaggcgcugcccagugcccacgucuggaaagcuaauucccggguggacgcugaacauaccugcugagagacucuguccccugguuuccaggacaguugucacaagcugaguggggggggacucccaggacuugagggacccagucccaccccaaacugcucccccucccccaaauucccuuucuccuccugcucuuucuccccgcugugccucccccaguuacccacagaagugccugccucuccagcgcucacagaacacacaaaaagggacaggaauuggucacuggguaguggccguggcuccugacgauccagaccagcgucuggcccaagccauucagagguggggucuggggccuggggguuuugugucgugacacuuugucucaaggagauuccacauagggauuugaauuaggcuuucugcuugccaaggccuguggcaucugagccuggcugagggccgggcaagccuccccugagccuuuggaagccgaguucacucucugccugcccaggggagcaccggcuugguucugggggcuccucuaacaucucagguuuuuaucuugucuuaaauuucuuucuaggaaaaaacccuucccugccaaaggugacuguguuuucugccgccgaaggagggcccggucccuccaggcucaguguggcuucucccugacccccgcccuagaacuuuugccagugccuuuucugaaacuccugugucccgggccccccaggcggagaaggauaugccggauucugccuggggcugggcucuaggagaccccaaauuugacaccacagaaagcaaauaaaacacuugaaauacgcauac

SEQ ID NO: 191885 - RNA, 16285 nt, Homo sapiens
ugugcaguguguaguuuuauuuguuuuuauuuccauaacacaagagaggaagcgaagggccagggcccgaggcauccccugcacgguucgaaggcuuucaaccgucccggguuuguuuugaaggcaauuuuggggccgcgcccaaggaaacccugcaggcugucagucccagcaugaacagcuuaaaauaaaaaucucccgucugguugcugcucggagaggcuccaagaaaugcaaaacaaacccgccuggaaaaugcugcccugagaaccagagcgagggcuugaaagaugccuucaacacagacucuucuaggaauccagccaguuuugggacggccguuucacaaaaccaaaaaacaccaaguaacauuucuaaccggagaauugccgguuuuagcaagaaaaaggggcuucaccuaaaagggagggucacaaaacacgaaggggguucccccuggcgccugccucuuccuuucugagcagauccguccgagacuguggagcggaaucgccacccuggcaggagggggcgcagcagccggucugggugggcgcucacuguuugcccgccugucugccaggcuucuucucuggcuggccucugccugugcccgggaucccaccucggccccggccaccaaacacaccuagaggacagagagagggcgcugcagcagagccaggugggugggaccuucgacaggaucccggcgcccugaaacucuaggccaggucaccuaagucuccagccucagcuuccucaugugugagguggugacugagggugcuuggaucuccuccguggggcagagcaucugaggaaggcaggaacuccagggcauccucauuaugggacuagacccagcccccagggaugcgggggggggggacuaggcgacagaggacacuaagucacauuggggguuggggcaggcuuccuaaaggacaaagccagaaggguuuccuggaggaggaggaggagguaggagaggcguggagcagagaccagggcaguaggccaggcugggggcucccuggcggggggggggccuccuaugcgccacaaccacccacagccccucaucuaccugccaggaggaaaacagaaagagggauuucuguguauccagccccagggauggggaaggggaggggacuccccagcaggccugaggccagagauagaccaugaggacaaaugacauuuuccaugaagccccugaggugggagcauguggccacuggggaggugacaggggguucccgggagaugagggccccagggacugaguggacgcuacagcggcaccuccaguaauccugagcaggcugcacgcagggcacgccuguccccacacccucugugugccuggcgccccuucacgccacccucaccacaggccaggccuggacgcagcagguuggucaggccgggacccaacauugaucccucccucucugucucccuuggggaccccagcucuguaagccccguuuagggagccguuucagagaacuuucuagcuggacgaacgcuugaggaaaucaaagcuggagcuucaaacagcaggagagccaaggccagcaagaggagcuggcccuguggcccaugugcugggugccaggggccagaggccagcgcugcaggcagcauagcucaggcccuccacagagcccgcugggaggcucagucgugggccagggaggucuggggacaggaggacugaccccaacaggaacuggaaucacggucuacucugcagaccucaaccccgugaagguggggucagggguccagauucagaggaucuaagaggucagggcucucaccagccaggggccaccaggcccuguggggacagaggccagaggccaacgcuggccugggccaccaaccuccccucucaccaggcaggaccagcugugcuagggugcacagccugguggggguuacugcgaggcugcuaucugcacuccauggcccaguggcuuccugcagagcagccagagaaaaccccccacuucccuagguaggacccgacccacucucucaacaaccuugaccccaacuacugggaaggagccaggccggggaccccagaggccccacccacccugagauccccaaagcucccugccuggaguacuaucccugccccucccucgggcucacuccugaccaccucgugagccugcacagaauuggcgccuggggccuuccgggggcagccaugccgugcugcaagcccccaggcuggcaccugagcccagcacacaggcagugcccauggauggcagaagcaaagcccagguccccccgagaacacagagcuggggacagagaggugaggaagggcaggggcuacagauggccccugggccuaacaaauggaauuuuaugccaauucaucaucuccggugggggcgggcgaccuuggcucuggauagagccacgccagguuccaaguggaguugccagcggccuggacagaugggcaccaccauacccucucagaggggaaacugaggcuuggggaggugacuugaugugcccugaggaccgccaggaggcgcagugagaggagggcugagucccaggucucggggcuccucugccugggccucggcucauggccaaggaccaggaggggggcccgggaggguugggaggcuccgaggcagcgcugcaagggcaaccccaagaaggagggaugccacguguggcugucuucccgccccagguacguccacuggagaggggagacccaccucggccagcgccgcccaugccgcggccuuucugcugcuucugcugcugcaggccuccgcggccgcggcccuuggccaccaccuccuccuugaccaugucgaugaucucgucggggaugcgcagguacuugauggugcugccgcggauguagcacucgggcauccgccagaacuuguccccguccugcggagaaggggagcagguuauuaacuuaccaccgggccgucuggcccagcccugggagcgcgggaggcccugcagauccugcccagccugcaccccguaccaccccugcaagcugcacaguaucagucccgggacauacguggcaaaggguccacccugcaggcaggaucuguccugaccccaggcaauccuucacccaggagcaagggugggugugguaggcgcagcccccauugugcacucacaaggaagacuggcuccuauccucugcccgugggccuggcucaggaguggcugacuggggcucccuccagccugggauggggcucucucugguugggguucuucaccugcagcccaaagcccagagcgggugggggccucccugugcaccagacacagccgaagcccagcuacuccuccuccugccccagccccaccucacuucuggaagccucucuacaugcccugacucauucauucaucuaaguaucuccugacagggccugcgcugggugcagggacaugcgagcaagcuacaggccuaguguggugggugaagaggggcgggaaauggggggacuuggguccugccaggguggcucaagggcggcucccagcgaugccaguuuuaggagagcuaaccaagacuggagaaaugggggccuugcaaagacacagacucaugcugcaaugccuccgaggcccccacugggacagaucgagggauuagcaggggccagggccauuccuaccauaucaguuucccagccccgccccaccgcccagguuccuggacagacccacgcacgacgccuggauggccuuugcccccgaugcccuuuaaagucagaucacaguauguuccagcuuggaacccacccagggcccccuccagccugggggcaaggucuaagaaccucagcagggcucucuagggcccgagauccugccccgcccuggcgguccucucccagcccgacgacacucccuccagauggaacuuucuguuuccggaacacacgccaugggcuugcccccagaacuuugcacgugguuuucccacuucucaucuggcuaacuuugaccccaaaaggccuuaccugcccgaauccccaaguccuccugucagacacucuccuccacaccuggguagguguggccuggccuagcgcugggcggggaggaacagccccuuugggugcucacucucccaggaaccccucgagggcucguggggcggacacaccaugguucuguggggacucagggccugggcaggugacuuggcgcccagcucucccaggcagggcccagaggcuuccucgugcaggaaccugggcagggccugagcucacugcagggaggccccugccuccugcccacagcgcuccagaggucucucagcccggggucucugcauccugcggccugccucugagggagggagggccccacuuagauggggacgaugugaguucccaucgccucuccucccagccacaugugacggcagcaucaccgccuggccacagaggcaggcugcucagggaaagccauccguccacucgaagcuggaggcagaggccaaaccaaccccuggagaccacgcagccucugaaucaacaggcuucucaugucuaggaccuggagguguccacaagaccgcacaugcucacgcacgcaacacgccuggugauuccaauaccggaaguggacagagccccgcuggccgcagaugggaggcacgcgguucugcaccaaggcaccauccgacacagccagacuggacccacccagacgcccuccgacaggcuauggcacgaaacccagcaagcaguuucuagagcuucuagcgcugcugcacagcagccucaccaccuguccccaccccgcccagcccugugcugaugagaggcccagucccggguggggguggcggucagggcaagauacggccacuucaggaagaagcgccuccccccucgagcccuguuguccugucaaggugaccccaggcaggcacuccaagcuccccagcaguuuccucccuauaccauggggggcugucacccacagggagacaagacagauggggucagggaagguuggugggaggaguccaagggagccgcugccuucagcaccaucccuggccuccuccucagugcucugugggucaucccaggggcagggaaggcccgugacaccaggggaaccaucuuccagccccggccgacccagcagcacuccuagccaggcacuuccggucuugggcucuggcugguggcuccugacccaccgggcccuggcgcugcuccugcccaccgugaccugggcaucccggacaucccagggccacacuaccauggcccgcagagugcaggcaacauccaggcuggacuaaaggcagcagaguccgggagucuugggccuccccuggagggggcugccccagccugagccacagggaguccccaguccuagguccuuccaggucagggguggcaccaacagacacacagcaggaaagucucccacagggucaaaguccagggcacacugggagacuugguggccuagcucacccugcccugucccuccugacugaccccuggaaggacgagcaguccuaggcggccucccccacugacuccucccaugaggcccagggagggagggaggaggcugagugugcacccccugcaucccacccccguuggugggugcagcacccacccuggacgugcagaugacuucucgcagguuaauguucauccaguugucgcagcucaccagguguccauuguacgucuccccauuuuucagcuccaccaacuagaagagagacaggcuagagguuggcuguagcccuggagcccugcgccaugggccccucaggagguguagcucugcccugagauggaccaccaccuccgggccucagcccacaguucccagaccccuaaauggccuuccuuacaggcgacaggcucugccuccgcuagacacuucgcuggcaguuagacagucuaucaugacgccaaccuuugugcaauuaaaaaaugauacugggccgggcgcgguggcucacgccuguaaucccagcacuuugggaggccgaggcaggcagaucacgaggucaaaagauugagaccauccugaccaacauggugaaaccccaucucuacuaaaaucauaaaaauuagcugggcaugguggugcaugccuguagucccagcuacucgggagccugaggcaggagaacuguuugaacccaggaggcggagguugcagugaguugagauagggggagguugcagugagcugagaucgcaccacugcacuccagccugagcaacagagugccacuuggucuuaaaaaaacaaaaaacuaagaaacacagaaauguuuaaaggaauaagugagacaauggugaugguggccacugauccaggguggcugggggccaggugggcacagcugggcugguccuggcaggcacccccacaacaccagauauuugggcuucaguguuccacaaaugcuguuuuuuacugcaauaauuacucaucuauuuugguauguuuugagaacaaagauaaguagcagaucauucugaggauaugcugcuguuaggaaaagacugauauuuuuuggugucuuuuaugagacagggucuugcucuguugcccaggcuggagugcaguaucgugaucauggcucacuacagccucaaccuccugggcucaagccauccucccaccucaguuucccuaguagcugagacuauaagcgcacacuaccacaugugguuaauuucuuuuccuuuuguagaaguggggucucacuguugcccagacuggucccaaacuccugggcucaagugauccuccugucuuggccucccggggugcugggauuauaggcauuagccaccacacucaguccaagccugagauuuucuuuugagauggaaguuucucuguuguugcucagacuggagugcaauggugugaucucagcucacugcaacuucugccucccggguucaagugauucuccugccucaaccucccaaguagcugggauuacaggcgccugccaucacgcccagcuaauuuuuuaguagagacggggauuucaccauguuggccaggcuggucuugaacuccugaccucaggugauccacccgccuuggccucccaccagggcugagauuuuuaaaugacucaacuuaggcaucugcccaagagaaaugaacacaggcaaccauacaaaaaugugugcgugaauguucacagugacacuguucgcaauagccaaaaaggggaaagagcccagaugccuaucagcagacaaacacauaaacaaaauguaggccgggcgugagccuguaaucccagcacuuugggaggccgaggcgggcggaucacgaggucaugagaucgagaccauccuggcuaacacagugaaaccccgucucuacuaaaaaaaaaauacaaaaaaaauuagccaggcgugguggcguguaccuguagucccagcuccucaggaggcugaggcaggaaaauggcgugaaaccaggaggcggagcuugcagugagcccagaucacuccaggcugggcgacagagcuagacucccucucaaaaaaaaaaaagugguaaguauccgcuccacggaguaucgucuggcuauaaggaaugaggcacugacacaggccacaggguggaugaaccucaaaaacacguugcugagugacaaccaccaggcucgaaaggccucauggucuccguucgcaugcaugggaaauauccggaauaggcaaccccacagagacggcagcugccucaugcucaucagggacuggggcugggaagugacugcugauggaaaugggcuuuccuuuuguggagacggaaauguuccggccuagauaaagguggugguuacacaaccugugacugcaccaaaugccacuaaauugugcacuuuaacugaaguguuaguauguaauauuauccuuuuuuuuuugagauggagucucgcucugucacccaggcuggagugcaguggcgcgaucucagcucacugcaagcuccgccucccggguucacgccauucuccugccucugccuuccaaguagcugggacugcaggugcccgccaucacgcccggcuaauuuuuuuguauuuuuaguagagacgggguuucaccguguuagccaggauggucucgaucuccugaucugcccgccucggccucccaaagugcugggauuacaggcauagagccaccacgcccggccaauauuaucauuuuuuggagacaggguuucacugucacccagcgaccugcaaccucaaacgccucaggcucaggugauccuccugccuuaggcucccaacuaacuggaacuacaggugcacgccacuacacccagcuaauuuuuauauuuuauggagagacgugguuucuccauguugccuagacuggucucugaacuccugggcugaagccauccucuagccucagccucccaaagugcuggaauuauaggccugagccaccaugcccaaccugaaguucuuuuuauuuuuuuaagugacagggucuugcuauauugcccagguuggauuugaacuccugggcucaagugauccuuccaccucauuaauuuucuuuuucuagagacaagguuucacucugucgcucagacuggagcgcagugguaugaucauagcucacugcagccucaaacuccugggaucagucgauccucuugccucagucuccugaguagcugugacuauaggcacacaccaccucaucuggcuaauuuuaaguuuuucuucuugcccaggcugaucucgaacuccugagcucaagcgauccuccugucuuggccucccaaagugcugggauuacaggcgcgagccacugcaacuggcccauuaaauuuuuaguaaguauguauguauuacucuuacaagcagcagaaaugacaggaguguggacacuccuggggagggagaagagagcaaacugccaugcugguggacaggcaggccaggaagccgucugcucagccaccgccccugugcugaggcuggcccccucucaaacaggcuuucccagaccacugaguacucaccauggggugauucugagccgucuucagcagugacaagggaagcugaaaggcaaauaaagccacaugauuugucuguuugaccagcgccugggagcucuggucuugagucccacccaugacucauagauggugcggugcgguugagggggcacaggagugcgugucaaucaccccccacuggaaaugccauuuccucacucugcccagcccuggaacacacaccugccucucagauuaggaagaaaagccucacacacccucccuacucccguagguggccaccaccugcucuuggugcugaacacucuggucaauuuuuuuuuuuuuuuuuuuuuugagacggagucucgcucugucacccaggcuggagugcaguggcaugaucauggcucacugcaaccuccaccucccguguucaagccucacaagcagcuugccucagccucccaagcagcuggggacaacaggcaugcgucaccacacccagcaaauuuuuguauuuuuaauaaaggcgggguuucaccauguuggccaggcuagucgcaaacuccagaccucaggugauccacccgccucggcuucccaaagugcugggauuacaggcaugagccaccgugccugcccuaaugcuuguauuuuaagcucaaacugguaucucugagaugcauccauguugaugagguuacucugaguauggaguugaggacacuacagcuuggaaacccgaggaacuugcccaguacuauggcgcuaggaggagacagagcuggccugguccugucugucugaagcaagcacaagaccaugccuugcagggcagccccaacuggcccaagacugacacugccaggccccaaugcaggggucaaucccaucagagaaggccacaucugagcugguuuuauuuuuauuuuuuuagaugaagccuugcucuaaaaauacaaaacuuugcugggcacgguggugcgcaucuguagucccagcuacuugggugcugaggcaggaggauugcuugagccugggaagcaagccugucacccaggcuggagugcaguggugugaucuuggcucacugcaacuuccaccucccggguucaagugauccucccgccucagccucccaaauagcugggauuauuaggggugcaccaccaugcccagcuaauuuuuguacuuuuaguagagaugggguuucuccauguuggccaggcuggucuugaacuccugaccucaaaugaucugcuugccugguccucccaaagggcugggguaacagcauugagccaucaccccccgccugaacuggguuuucuuuuuuuuuuuuuuugagacggagucucgcucugucgcccaggcuggaguguaguggugcaaucucggcuuacuacaagcuccgccucccggguucaugccauucuccugccucagccucccgaguagcugggacuacaggcgcccaccaccaugcccggcuaauuuuuuuuuauuuuuauuuuuguauuuuuaguagagacaggguuucaccguguuagccaggauggucucgaucuccugaccccgugauccgccugccuuggccucucaaagugcugggauuacaggcgugagccaccgcacccggcccugaacuggguuuucaaagacaggaagucaccagguaaggugaacuuucaagauuuuuuuuuuugauggugacaggcuuuuacuauauugcccaagcugguuuugaacucuuggccucagggaauccucccaucucaagcucccaaguagcuggaauuauagguaugcaccaccacgccugguuucaagauguuuuuuuccaucauuacugaauuucuuuauuaugucaaauauguaguauuucuauuacugggggggaaaucaacacuuucauuuuggaaacagaaaacucaacccguacgcugggagcugccucggguaacgcagagcugugccugggugcgggguccuauaacaugcccguucuaguacugccaugaggaaggccccagcaccaaggggcccugacaagacagugccucaugggacacaggcuucaccuagcccuguccuggugacuggaauuccagguggcccugaccccagaugccuuugcugggaguccugcccuggccaccacccuaauccacaguguggcugcuuuuccagguggugugaacuugaaggccucucccuguggaggccggaaauggcccucaacccuggccggguggcuccccaaugaaaggaagggguuggggagggaauccuacaucccacagccccuuccugagaagagcugcccaggggagguuggugccagcaggaagccaggcccaagcccacuuccugcaccggcuuccuggaagagccagauaagggggaagaaagggccauguggccccggggcagcugcuaggagaggcaggggaggagggcugcgggcggcugggugugcaucugacugggugccaccagccacagagaaaacacaggagccacagacuggcacacgggucucaugcccaggucgcccuuuacugugaagaagccguggguuuuccucagcaagccuguuuucuuucucuaguccguaacaggaacgggaccuuggaccuccuccuggaucaccagggaaggcgcagaggucaggcuagcccuuaaaggcccaccucucauucugcagaggaggcgccagcgcccacagcagaagugaccugcccagggacauccagcaaggcccuggcaaagcugcccagaggcagguagcuuguagacacaccuuccaugccagugacagacccucuugggccaccaccuggucucagcgaccaauagcacagccugggaggacccacggccuccuugccugucacuugcagucccauccaaaaagcagcagaaagaacaucugagaaacaaagagagcuggugggauggccacggaggcucucgccuguaaucucggcacuuugggaggcugaggcgggcagaucaccugaggucaggaguuccagaccagccuggccaacauggcaaaaccccaccucuacuaaaauacaaaaauuagcugggcguggugguaggcaacuguaaucccagcuacucaggaggcugaggcaggagaaucgcuugaaaccaggaggcagagguugcagugagccaagauugcgccacugcacuccagccugggcaacagagcgagacuguuucaaaaaaaaacaaaaaacaaaaaaacaaaacaaaagaaagacuggcuaggcgccguggcucaugccuguaaucccagcacuuugggaggccaaggugggcggaucacgaggucaggaguucgagaccagccuggccaauauggugaaaccccaucucuacuaaaaauacaaaaauuagccaagcaugguggcgcacaccuguagucccagcuacuugggaggcugaggcagaagaaucgcuugaacccaggaggcagaggcugcagugagcugagauugugccacugcacuccagccugggugacagugacacuucaucucaaaaacaacaacaacaacaacaaaaaacccaaauaggguuggugcagacccacucucacaacacuccucaggcccgcuauagagucaaggcagacaggcucugccacacuggccgccacacccauuccugccaccugaccuuugcuucugcuauugccucugccuggggugaccuuccccaggcugcugaaacgucaccuccuuuggccaggcccuuuuaauggccacccucugccucauggguguuuguuuccaucauaggaugcagccagucuuuaauuaccuuguuuauuaccugugucccucgcuagacuggaacacucaaaguggguguggacuuuguccagggccaagcacaaggccaggcacaugagagggacucgguaaauauuugcugaauaaauacacaagaaaaaugcacacacuacccagggaggcaugcagggaaggcagaacacucgccccaccccacagguaagggaaggaguggcugcgggacagggagcugccugacucccaggcccucccaggcugcaauggccugggccugugaccauauaucuugauuucuccuacauccucaucuccaaacucuguuggagagaggucagaggaagggguggauccucaaaaucuuaaaagaagauacaucaaagugccaggugaggcugggcacaguggcuugugccugcaaucacagcacuuugggagacugaggugggaggaucgcuugagcccaggaguaugagaccagcuugggcaacacaaaagauucugucucuacaaaaaaucuagaaauuagccagguuuagugaugcaugccuguggucccagcuacuugggaggcugaggucaggugggaggaucacgggccagugagguugaggcuguagugauugugccacugcacuccagccuggaugagagugagaucucagcucugaaaaacaaaaaaagucuagagugcaguggcucacgccuguaaucccagcacuuugagaggccgagguggguggaucaccugagcucagggguucaagacuagccuggccaacauagugaaaccugaucucuacugaaaauacaaaaauuauccaggugugguggugcgugccuguaaucacagcuacuugggaggcugagguaggagaaucacucucggagagguggagguugcagugagcugagauuacaccacugcacuucagccugggcgacagaacaagacucugucucaaaaaaauaaauaaaaugaaauagaaaaagaaaaaaagugccaagugugauaggagaggccccacccugguuuauggaaggucacaagaaaauucagaaaagagaauuccuuucucugggcuuucuuggagcaucuggaaucugguucucaggucuagauccacgaggaccuaaacccagugccuccuaauucaggaagcuguccaggacugcccauccccgcugcuaaccuaggccacuccuucuggcccugcccugacgacagggaacuggaaguguguauccugugauggcuuguccauucucggcuacuccuccaggaaacagcuggacagccaggacucuggauguucagaaggugggaaggggcugaaugaaugaguucacacuuugcccacgcaccguucuacauacugggaaucuagucggaagaaaaacgaagauccugcucccacaaaacuuaacacagggauggauccuuccagcucugcccagucuuacaugccaacucugcccucuaaguacaccgcagagagggacaggcucucugaauccuugcacuugaaaucgccuuugcaaaaauuguagcgggaaauuaugacagugaaaagagaucagaccuaaccgacuccauugugcuucuaaccuuuacgccaucuuugcuuauuccuagguauaggccaaacuaaccuugggaagggauuuaguuuauaguuugacucuggaacaaaauugguaauagcccuuucccgaaaagacccucuucuugccuggggaccagucugccuuuguaggacuaacaaauaagcuacaagauuagaaauuaccauuuagguaacuucagccucuggcugcaagagucugaaacuccccaaauugcuccuugggauaacaucacuauuauaaaaucuaagaucagugcuugagauauuuugcagaccccguacuugacggaucagcugacacuacccagaccaguaaucuggcucaaccaguccugcgaucccacccaggaacagaagacagcaagaaaaccucacuucaacacucccgucgaugacuccaucgaccucaggaagcuccaaccaaucagcacuccccacuuccugagccccuacccgccaaauuaucuuucaaaacucggauccccuaaugcucagcggagacugauuugagcaauaauaaaacucuggucuccugcauagcuggcucugugugaaauacucuuucuccacugcaauuccccugucuugauaaaucugucuaggaagacaggcaaggugaacccauugggugguuacacacugaccagccggauuuagggagaguucucacuaauccacaguucugaugcagccaccccugggggacccuccugguuacugaaucucccacugucucacagagucuggaagucacauccccaacaagggccuugguuucucucauugaaaaaagaaggaccagaagcugaugggccaggaaacucccagcucugaauuccuuuuccgaucugcacagugggggacacgggcacuuucuagcccagauccagaacuuccagaaucauaaacaaugggcccugcagagaccugggccgcaauuuuuccuucuuuguauugggaggauguacuuuguccaccccuagcucaaaacgcccccuuccgcuggaaugacaugcuaugugacccaaggagaaacaccacaccccagcaccaggccugcuuuucagccagaaaccaagaggccuaggaggcugugcugcuagcaucuugcaagcucugaaauuccuaaaacuaaguuucacaacucagacuggcccccuacuucccagcacucuaguuuucaaucagggaggucagacugggcccgaagcguaagggaccccuucccugcccaaaaacucucugcugcauuuggcggauccccaccuuuuuuuuuuuuacuucaguuuccccaccugcaaacugggaaaacuaacuaaggcgaggccacuguacuguggauacaaguccgugcaacccuaaaucccagacacgaacgugauagagccaccugcagucuccggccucaguuucccagccucgugccggggggcgggacucgaggcucggaccuuacguucgccccgcgccaaccaagcccacagcgcccgcccgcagggaucccaacgacugcuguucccgccucccggugagaccccgcaguugcccugcccucaccauggugccggcggggaccgggcucgccggccacuuccgccgccgccgcugcacacgcucccggcggucgucgccgcgccgcgcgccacuaagcugaaagaaaguggcagagacgcaagccagucagcaccgggcucgaagggcggucaaccaauccacgcggaguagggcggg

SEQ ID NO: 191886 - RNA, 1870 nt, Homo sapiens
aggagccgccgccaguggagggccgggcgcugcggccgcggccggggcgggcgcagggccgagcggacgggggggcgcgggccccccgggaggccgcggccacucccccccgggccggcgcggcgggggaggcggaggauggaaacacccuucuacggcgaugaggcgcugagcggccugggcggcggcgccaguggcagcggcggcagcuucgcguccccgggccgcuuguuccccggggcgcccccgacggccgcggccggcagcaugaugaagaaggacgcgcugacgcugagccugagugagcagguggcggcagcgcucaagccugcggccgcgccgccuccuaccccccugcgcgccgacggcgcccccagcgcggcaccccccgacggccugcucgccucucccgaccuggggcugcugaagcuggccucccccgagcucgagcgccucaucauccaguccaacgggcuggucaccaccacgccgacgagcucacaguuccucuaccccaagguggcggccagcgaggagcaggaguucgccgagggcuucgucaaggcccuggaggauuuacacaagcagaaccagcucggcgcgggcgcggccgcugccgccgccgccgccgccgccggggggcccucgggcacggccacgggcuccgcgccccccggcgagcuggccccggcggcggccgcgcccgaagcgccugucuacgcgaaccugagcagcuacgcgggcggcgccgggggcgcggggggcgccgcgacggucgccuucgcugccgaaccugugcccuucccgccgccgccacccccaggcgcguuggggccgccgcgccuggcugcgcucaaggacgagccacagacggugcccgacgugccgagcuucggcgagagcccgccguugucgcccaucgacauggacacgcaggagcgcaucaaggcggagcgcaagcggcugcgcaaccgcaucgccgccuccaagugccgcaagcgcaagcuggagcgcaucucgcgccuggaagagaaagugaagacccucaagagucagaacacggagcuggcguccacggcgagccugcugcgcgagcagguggcgcagcucaagcagaaaguccucagccacgucaacagcggcugccagcugcugccccagcaccaggugcccgcguacugaguccgcgcgcggggcgcaugcgcggccacccuccccaaggggcgggcucgcgggggggugucgugggcgccccggacuuggagagggugcggcccuggggacccccccuccccgagugugcccaggaacucagagagggcgcggcccccggggauuccccccccccgagggugcccaggacucgacaagcuggacccccugcucccgggggggcgagcgcaugacccccccgcccucgcgcugccucuuucccccgcgcggccgccccguguugcacaaacccgcgcgucucggcugccccuuuguacaccgcgccgcggaagggggcuccgagggggcgcagccucaaacccugccuuuccuuuacuuuuacuuuuuuuuuuuuuucuuuggaagagagaagaacagaguguucgauucugcccuauuuauguuucuacucgggaacaaacguugguuguguguguguguguuuucuuguguugguuuuuuaaagaaaugggaagaagaaaaaaaaauucuccgccccuuuccucgaucucgcuccccccuucgguucuuucgaccgguccccccucccuuuuuuguucuguuuuguuuuguuuugcuacgaguccacauuccuguuuguaauccuugguucgcccgguuuucuguuuucaguaaagucucguuacgccagcucggc

SEQ ID NO: 191887 - RNA, 3511 nt, Homo sapiens
gucggcgcggcgaaagcagagcggcgcgccgguuccuugguuccugagggcgauggcgcgggguggcuggcgccggcuacgccgccuguuauccgcggggcagcuucuauuccagggccgcgcgcugcucgucacuaacacgcugggcugcggcgcgcucauggcggccggugauggcgugcgccaguccugggagauccgcgcccggcccggccagguuuucgacccacggcgcuccggugaggacgccacgcugcuuaguccuucaccccgggcgaccuuugaucccgacacccgacugcgggccgugaccccugacccguggccucagucccccgcaggacccuugcccugaccgcgccucuccccgggugucugucuccccgcagcucugggucuccaucaccucccaacccccggaggucucugcccacuacccaggagccucuggagccgcgccuccugguggggcuuguaguggaagaaugcacgggugggcucuuccgguuuucccggugaggcugaggcuccgggauggcauugggcuuacccaggccuuagccagggagggagagagggaauggacugaggaacuugccggcccgacccagcccccugacuuacacucuuauagcgagcauguuugcggugggcugcagcaugggucccuuccugcacuacugguacuugucgcuggaccgccuauucccugcgucuggccuccgaggcuucccaaauguccucaagaagguccucguggaucagcugguagccucuccauugcugggcgucugguacuucuuggguaaggagccuccuaagccuaggcuuugccucucauaggucgggagggguggagccagcuuuguguuaagaaggaugcagaggugcauuuccaauuugcccccuguuugggucgcccuggacuaggagccaggucacagcggggacaggacggacucggccgaugugaacgcuggcgaguguaggagggacgaggacuguaucuguuggggcugcccugggcgggagguugagagcauuucccaaagaaggggaccacacucaguugagacaugaagagggaaccagcgggcagagggaacagcuaaugcaaaggcucugaggccugaaggaagagaaauugaggcuagacuuaauggggugcaaccgugccagcccuaggcucgguaaagacagcgguauuaauagaggagucucucauucuccaccucccagcccggcuuccuggucugugauggaaaaguaacacaacucccucaacuucagggugucuccauuggggcacguguuuauauguuuauaaccucucuuucucucacugggacugacuugcucuguuuugucucuacaccagcuacccuaauucucuguccaucccaucugaaagucccugucccucugcccggggugggcggcgugggcucucaggggcccaaccccgcccccuccaucgucagcccaucuugucgucucaacaguacuuccuggccucuaacacucucauuucuugguuugcuucccaggccuuggcugccuggagggucagacagugggugagagcugccaggagcugcgggagaaguucugggaauucuacaaggugggagcacccgccccuugcacauguccggccccgcccccugauggccgcuccgcccccgcccagcucuggccccgccccucaucccccgccucuccccgcaggcagacuggugcguguggccugcugcgcaguucgugaacuuccucuucgugcccccccaauuucgagucaccuacaucaacggccugacgcugggcugggacacguaccuguccuacuugaaguaccgggugaguguggagggcauaccaggcacccaggggacuccccagggggcuacacgugugagcuccaaguggcaguguagccagccacccuggagggugggagucuccugugcuccugacaacccacacccaacagugggcuggcggagagcuccucacuagcaguuaagacccagccguggcugagcgccguggcucaugccuguaaucccagcacuuugggaggccgaagcggguggaucgccugaaauuggaguuagagagcagacugggcaauauggugaaaccccuucucuacuaaaaauacaaaaaauuacugguacgcaccuguaauuccaguuacuugagaggcugaggcaggagaauugcuugaacccaggaggcagaggcugcagugagccaagaucaugccacugcacuccagccuaggugacagagcgagacuccguuucaaaaaaaaaagacccaugccgggcgcgguggcucacgccuguaaucccagcacuuugggaggccgaggcaggcggaucacgaggucaggagaucgagaccguccuggcuaacauggugaaacccugucucuacuaaaaauacaaaaaaaaaauuagccgggcgugguggcgggcgccuguagucucagcuacuccggaagcugagaccggagaauggccugaacccgggcagcgaagcuugcagugagccgagaucgcgccacugcacuccagccugggcgacaguucgagacuccgucucaaacaaacaaaaagacccaacccuucucugcugucugaugugaccucagcccggucccugccaagucuguugagcagggcugaccucuggcccaagggcagguagagggacagggagggaugagccaggcuucugaccagaugccuugucuuguguggacagagcccaguuccucugacacccccaggcuguguggcccuggacacccgagcagacugaacugucugcuuccuggaccagaugcaagacugucuccuggcggaccacccccucugacagaaggggaaugggcuccugcagcaagcucgggucuugagccacgucccagcaccacuucagcuccggagcauugggcugagccgcccuuuccaagcucacuucugggacugaguuuccucaaccggaacacacccaugaagauggaugaucauccccuagcccuucucagcaggaaccucaugcgaccugugaccaagaugucccauccucagcacagggcccacucugccaaccagucucaagcaccagccccucaacacugccauccaccuggcucugggccaagccaccaauccagagcucccucagguccugggacuaaggcggggacaugacugauccccucagagcaggcucaggccuggagucggcccccaaaaguuucacauagggccaggcagccucuguguuucuuucccugguccugaacuguggaaaugccauuaaacucucucuauaauguaacugaaacugcuggcugggcgcaguggcucccaccuguaaucucagcccuucccgaggcugagguggaaggauugcucgaggccagguguucgagaccagccugggcaacauagcaagacccugucucuauuuauauugaaaaauaaaaauaacaaaagaa

SEQ ID NO: 191888 - RNA, 4349 nt, Homo sapiens
gcuuauuaaacuaguuuuacuuuagcaccauucuuaguggagcaggauucuugaucaugggguggaauuuuguguaucugggcuucaugggaugcauaaaauuuuccaguugguaaguagcaggugccgagggucuggaucagaaaaaaaggcaggcagccggguucccacucgccuuccaugagcucuccgcagcucaccggccaucacuugaagcaaacacuccugagggagcugguugaggaagggcagacauccggcuucuugcccuggaggugaaggccaugaguugggguccuggaaggagacccuacccccaccaccugaaucccacugcuccccucccagcuuaccugguacaacuggcagacaaggguaaggagcugggucugaucuuccaaggguuucugcacaaagcaagacaggggucgcauauucccagcagcuaccccaacccaugcacccugguuccagcccagaaagggcugcacauauucccaagucuggcccccgccucccgccucgcaaaucaguggcacaucuuucccaauggggguggcuagggauguuuaauacuucgaauuaauacauacuuuuuuugccugauggacuccuacucaccuuucaaaaccccagcaucaaugcccucuuucccuaugcaaagcuaucaaguuuugcucuuguugcccaggcuggagugcaguggcaugaucucagcucacugcaaccuccgccuggguuccuuuaucucuggucccucugucuuguccaucccugacuccaugggacuaugagugucaagcugagggcuaaaaagauucuuaccccauugacggugacccagggcacauacucgugugguggcuggagagcaucuguccgcugggcguuggcgugcaugagcugcaugccgcggucccccauugcacacuccaugauagugucuggcgacagcccuggggcguagagcugcaggcacuggguggguggggagcaggggguugccucagcuuccuccccguuaucucaacggucccgcccaccagcccugagccaagccuguuucgucacugagaagaggguacaguuggcuucacagugaugcgacaaagcccacaaacagcaggugcucaauacaugcuugaguggaggccccuaaggcagggcuugggcugcuccugccuccuagcucccuugguuucaucccuaagaccagacccacugccucugacccccauaguaucucacuuuacucaggaccuccacacaggcugaucccucugccaggaacacccuucauccuccuuccacagugucuccucagugcccucuccuugccacucucucagcccugaucuaacccugcaggacuagggugucacuaggugaggccucuugggugacccggauguuugaugaaugaauaaaugauuggagccaaugagucacuucucugggagucauucuucacaaucccccggggaaguagguggggucuguccuaucaucuccacaucccaucaucugugucucugcacauuccugcucauccuuccaugcccagcucagaaaugccuccuccaguaaguccucugugaucacucaugcuccuaagagaccugcauucauuccccugauucagagauggaggcuucaagaggggaggcuggggccgggcgugguggcuuacaccuguaauccuuugggaggcugggacaggcggauaacuugaggucaggaguuugagaccagccuggccaacauggugaacacugucucuacuaaaaauacaaaaauuagccgggcaugguggugcacaccuguagucccagcuacuggggaagcugaggcaggaggaucacuuaaacugaggagacagugguugcagucagccaagauugcaccacugcacuccagccugggcgacagagcaaaacccugucucaaaaaaaaaaaaaaaaaaaaaaaaaaaaaaagggcugggugcgguggcucacgccuguaaucccagcacuuugggaggccaaggcaggcggaucacaaggucaggaguucaagacaagccugaccaacauggugaaacccugucucuacuaaaaacacaaaaauuagcugggcaugguggcacacaacuguaaucccagcuacucaggaggcugaggcuggagaaucacuugaacccuggagguggagguugcagugagcugggauugcgccacugcauuccagccugggcgacagagcgagacucugucucaagaaaaaauaaaaaaauaaauaaaauaaagaaggguaguuguuuuccugggcugcacagacagcaguggucagggcuaggacuugaauuugggucugccuggaugcagggaagguuaccacccaugucccccuccuuggguggagugaggggcgucacucacuaguggcagacuucucuccauguccucaaacucuuccaugcagacaauggucaggaaggcuagcuccaugucaaguucauccaacacgcaggccugggguuuggagagggggcaggagagggcaugaagagggccuaggguacccugacacccucucguaauaaucaccaguacccacccaggagauagggaauaaagaugugauuaaaugggagcacacgaggcagaagacagagcuggcauccucguauuugccuccuguacgugggacaguuuucccccaccccaguguggggcccuggggccgcucaccuccaccuuguugaauuugcacuccucuucuccaugcuggcacuugaacucccaccugccacugacauuuuguuccugcaaggcagcagggugagagccugcugguaggcuggguccccugcuccccugcccacgugccucaguuuccccagcgcccacacaccugugcguuuccguagggcaccagcgugacauugaggaucuccaugaccaacagccauguugggaagagcucccggaucaggaaggcucggcagccaccgcacagugcuucauaguagagggucacauugacaagcggugcauuggacuucuucaggggcccccgcagguauagauugccugucuguggauuaggaaggcgugggaggcagguguagcccugggcaguuccccacuucucucaaccccacuugguagucuuguagaaagggggcugugauacgcaauucaucuugcacgccuuccagaacuugccagguggaaucuugacuuugagacuuuuuuuuuuuuuuuugagauggagucucacugucgcuaggcuggugugcugcggcacgaucucggcucacugcaacacccgacucccugguucaagcaauuguccugccucagccuccugaguagcugggauuauaggcacaugccaccacacccagcuaauuuuuguauuuuuaguagagacaggguuucuccauguaggccagaauggucucgaacuccugaccucgugaucugccugccucagacuuccaaaguguugggauuacaggcaugagccaccgccuccggccuuggcccaugcucauuucuugucacuucaccuggagaccuugccucugagcugagcaagggauccacgugaacccuuuccaaguccgacugaauagaggcggcaccuaauaggugcugacuuccggcuucagcugagggguggcggguggcccaugucgcuggagcggugagcaagucgcucagccucuagggcaucugccuaauaggucccaaagacacgcgagcccugcccuggcuggaaugaaugcaucaaggguagcagcaagaaugcaugccggcggcccuuggccagcugcugaacuugugcccugggccacaaaaggagaccccagcuccugccccaaaaguacacaguaggcgcucauugaacccuugggcgggacuaggcggguggaggcagcugcgccucucagaugcgggaugcgaaagcgaaacggcacggagggaguguggccgcagcgccgggaacugaacaggguuuuuccaggaacccggcagggacagcguccccucggggcccuggucuuccccugugaagucuggggagaaagaaggagccgcgugccccgacagggcgccuguucccuccagccugcccgcccugucgccgucccuaccuuguaguuaacugguggcccauucccaaagaagucuaacgcuugcagaggggacgccugcaccgccgccguggggacguccagcagcagcagcagcgguggcaggaacagcagaaguggcgacagggucaucgcagcaggggcaaagguguggcgacugcagcggcugccugggaaauaagcgccuuuaaccaggcggcggucc

SEQ ID NO: 191889 - RNA, 4349 nt, Homo sapiens
ggaccgccgccugguuaaaggcgcuuauuucccaggcagccgcugcagucgccacaccuuugccccugcugcgaugacccugucgccacuucugcuguuccugccaccgcugcugcugcugcuggacguccccacggcggcggugcaggcguccccucugcaagcguuagacuucuuugggaaugggccaccaguuaacuacaagguagggacggcgacagggcgggcaggcuggagggaacaggcgcccugucggggcacgcggcuccuucuuucuccccagacuucacaggggaagaccagggccccgaggggacgcugucccugccggguuccuggaaaaacccuguucaguucccggcgcugcggccacacucccuccgugccguuucgcuuucgcaucccgcaucugagaggcgcagcugccuccacccgccuagucccgcccaaggguucaaugagcgccuacuguguacuuuuggggcaggagcuggggucuccuuuuguggcccagggcacaaguucagcagcuggccaagggccgccggcaugcauucuugcugcuacccuugaugcauucauuccagccagggcagggcucgcgugucuuugggaccuauuaggcagaugcccuagaggcugagcgacuugcucaccgcuccagcgacaugggccacccgccaccccucagcugaagccggaagucagcaccuauuaggugccgccucuauucagucggacuuggaaaggguucacguggaucccuugcucagcucagaggcaaggucuccaggugaagugacaagaaaugagcaugggccaaggccggaggcgguggcucaugccuguaaucccaacacuuuggaagucugaggcaggcagaucacgaggucaggaguucgagaccauucuggccuacauggagaaacccugucucuacuaaaaauacaaaaauuagcugggugugguggcaugugccuauaaucccagcuacucaggaggcugaggcaggacaauugcuugaaccagggagucggguguugcagugagccgagaucgugccgcagcacaccagccuagcgacagugagacuccaucucaaaaaaaaaaaaaaaagucucaaagucaagauuccaccuggcaaguucuggaaggcgugcaagaugaauugcguaucacagcccccuuucuacaagacuaccaagugggguugagagaaguggggaacugcccagggcuacaccugccucccacgccuuccuaauccacagacaggcaaucuauaccugcgggggccccugaagaaguccaaugcaccgcuugucaaugugacccucuacuaugaagcacugugcgguggcugccgagccuuccugauccgggagcucuucccaacauggcuguuggucauggagauccucaaugucacgcuggugcccuacggaaacgcacaggugugugggcgcuggggaaacugaggcacgugggcaggggagcaggggacccagccuaccagcaggcucucacccugcugccuugcaggaacaaaaugucaguggcaggugggaguucaagugccagcauggagaagaggagugcaaauucaacaagguggaggugagcggccccagggccccacacuggggugggggaaaacugucccacguacaggaggcaaauacgaggaugccagcucugucuucugccucgugugcucccauuuaaucacaucuuuauucccuaucuccuggguggguacuggugauuauuacgagagggugucaggguacccuaggcccucuucaugcccucuccugcccccucuccaaaccccaggccugcguguuggaugaacuugacauggagcuagccuuccugaccauugucugcauggaagaguuugaggacauggagagaagucugccacuagugagugacgccccucacuccacccaaggagggggacaugggugguaaccuucccugcauccaggcagacccaaauucaaguccuagcccugaccacugcugucugugcagcccaggaaaacaacuacccuucuuuauuuuauuuauuuuuuuauuuuuucuugagacagagucucgcucugucgcccaggcuggaaugcaguggcgcaaucccagcucacugcaaccuccaccuccaggguucaagugauucuccagccucagccuccugaguagcugggauuacaguugugugccaccaugcccagcuaauuuuuguguuuuuaguagagacaggguuucaccauguuggucaggcuugucuugaacuccugaccuugugauccgccugccuuggccucccaaagugcugggauuacaggcgugagccaccgcacccagcccuuuuuuuuuuuuuuuuuuuuuuuuuuuuuuugagacaggguuuugcucugucgcccaggcuggagugcaguggugcaaucuuggcugacugcaaccacugucuccucaguuuaagugauccuccugccucagcuuccccaguagcugggacuacaggugugcaccaccaugcccggcuaauuuuuguauuuuuaguagagacaguguucaccauguuggccaggcuggucucaaacuccugaccucaaguuauccgccugucccagccucccaaaggauuacagguguaagccaccacgcccggccccagccuccccucuugaagccuccaucucugaaucaggggaaugaaugcaggucucuuaggagcaugagugaucacagaggacuuacuggaggaggcauuucugagcugggcauggaaggaugagcaggaaugugcagagacacagaugaugggauguggagaugauaggacagaccccaccuacuuccccgggggauugugaagaaugacucccagagaagugacucauuggcuccaaucauuuauucauucaucaaacauccgggucacccaagaggccucaccuagugacacccuaguccugcaggguuagaucagggcugagagaguggcaaggagagggcacugaggagacacuguggaaggaggaugaaggguguuccuggcagagggaucagccuguguggagguccugaguaaagugagauacuaugggggucagaggcagugggucuggucuuagggaugaaaccaagggagcuaggaggcaggagcagcccaagcccugccuuaggggccuccacucaagcauguauugagcaccugcuguuugugggcuuugucgcaucacugugaagccaacuguacccucuucucagugacgaaacaggcuuggcucagggcuggugggcgggaccguugagauaacggggaggaagcugaggcaacccccugcuccccacccacccagugccugcagcucuacgccccagggcugucgccagacacuaucauggagugugcaaugggggaccgcggcaugcagcucaugcacgccaacgcccagcggacagaugcucuccagccaccacacgaguaugugcccugggucaccgucaaugggguaagaaucuuuuuagcccucagcuugacacucauagucccauggagucagggauggacaagacagagggaccagagauaaaggaacccaggcggagguugcagugagcugagaucaugccacugcacuccagccugggcaacaagagcaaaacuugauagcuuugcauagggaaagagggcauugaugcugggguuuugaaaggugaguaggaguccaucaggcaaaaaaaguauguauuaauucgaaguauuaaacaucccuagccacccccauugggaaagaugugccacugauuugcgaggcgggaggcgggggccagacuugggaauaugugcagcccuuucugggcuggaaccagggugcauggguugggguagcugcugggaauaugcgaccccugucuugcuuugugcagaaacccuuggaagaucagacccagcuccuuacccuugucugccaguuguaccagguaagcugggaggggagcagugggauucaggugguggggguagggucuccuuccaggaccccaacucauggccuucaccuccagggcaagaagccggaugucugcccuuccucaaccagcucccucaggaguguuugcuucaagugauggccggugagcugcggagagcucauggaaggcgagugggaacccggcugccugccuuuuuuucugauccagacccucggcaccugcuacuuaccaacuggaaaauuuuaugcaucccaugaagcccagauacacaaaauuccaccccaugaucaagaauccugcuccacuaagaauggugcuaaaguaaaacuaguuuaauaagc

SEQ ID NO: 191890 - RNA, 10971 nt, Homo sapiens
ugccucaccgcagccuugccgccaccuuuauugggcacucagcccugaggcucuacacacacgcgccgggggaugggaggggauggggugucacucggggcagggacccucuggcgggaggacggguggcuggugauaagagcauggccccggggcccggcgccuuggcccccggaacgcucugugacccucgcagcugaccuggccuaagggcgugcagagucgugaccuggaccacccgugggugaacuggcuccccaaguucugggcucacuugggggcauugaagggcacggcccgcugguucaugggguugucaggagagcggagccacuccuucuugagcagcuguuucagcugcgacagccgcauguugggguucucuuguuugagccgcggcagcugggcuuccucaaaggcugugaaggcugcccgcaugcgucuuucugggugccggucggccgccuccuccgccacgcuggggguggacaugagcgucagggggccuugggcgcagccuugccccgaaaagcccggccccgcccccagguagccccgcccccgaugaccagcuccaccccugggaaagccccaggccccgccccguuaccugagcacugcaauggcguccucgauggugcgcgccuccacgcugcccuccuccagcacgcggcgguucacguucuccuccagcggcaccuccagauggcucuuggcuuucucggcugggcgggugggugggugacagagacagagagagauaagcaaagaugcacaguuccaaggagaugagauagagacuggcaagagaagcuaggggcgggaggaaggcgggagagaugaggggggauggaaucgcgacuucagcugauaagcccucuugggacaggucccacccucccggcgcccaguucucugccuuacuuuccggcagcccugcaaacaagaggaccccgcggggcacaagcccugagguugucugcucacggccaggccuaccaggaggcggccuacccacccacccugcaccacguggagccccggcagcuucucugggggccaggagggggcuaauggacucaagguccacugccucugcagugggcaaaagugcagcuccagagcgggaugccgcccgaccuguguccggggccucccugagcugauggucucggcgcagcguguccucgaucugggcccgggugaccuugcuggacguggccacccgcggcgccuugccgcccuugagcuuggaguccuccuccuccaguaggcgcugcgucuccuucuuacguuccagcuggucgaggcgccgcuucuccuucuccuccugcgggggcggcgugcauggucaggcagaagaccccacacccccgcgccacccacuagccugggguucgaguuuucaucucagccaacgaggauuuaggcucugugcugggugcaggggacauaccaggaacaagauaggucccggugcugcccugggcgggggaugugaggccaacaggggaaccuuggacagggcggguggguggcucuugaagaagugacgcuccuaggugcgaagagcgccggccaagggggagagcuggggaacaggagcguccuuagcagcagggcuaccagugcaaaggcgccgaggcaggagccauuuguuguaacaggaacagcuuggaggcuggagugggagugaagcgggagggggaagaggccgggagggagacggcugggccaugcggagccucugggggccagggagggguucauguuggauucuaagagccgugggaggccuggacccguuucaggcuagggcaggggcucugcccuuaugagucgggcagcacuguccacguuucccugccgugggucacugaggcugaaacugauuccacaucggccgcccagggaagcccugaugcuggcuggaugagggacaucugggcuacgggacuugcccuugcccuggccugcacggaccccagggggccgagcaagcccacgguuuauaugcagugcugcuggaagcucagggcaguacucugcccacugccuggcacuccugcagggcccuggucucggacaccccugccugcccccucacugccugagacuccaccaucugacucucacaccuucagccuucccagggacgauccccacaccugcagugucccccugggacacuaccacugcaucuccagauagauuugacagaagggaaugucgcagaauagggguggacgcaccuaaggacacugccagggccugacccccacccccaccagcacagcaggaaaguggagggggcgguuaaagucaaggcuguuggagugcacaaacugggcucccauugcugugcugaggagccuuaguuucccccucggucagaggcaacgucccgaggcuccccgaccgaugcgugucacacacacauucugccucagacaggguccuuuuuuuuuuuuuuucugagacagucucucucagucgcccaggcuggagugcaguggugcgaucucggcucacugcaaccucugccucccgaguucaagcaauucucaugccucagccucccaaauagcugggacugcaggugcccaccaccacgccuggcuaaucuuuuguaauuuuaguagagacgggguuucaccauguugcccaggcuggucucgaacuccugaccucaagugaucugccugccuuggccucccaaagugcugggauuacaggugugagccacugugccuggccaaugcaugauguuugaagugaggagagguaucacuggugggggacugaccaggagggguaugagggaaacucacgggggcugagaauauucuagagagcagggguugacaaacuauagccaacuagccaacugccuucuuugguaaagguuuuuuguguuuuuuucguucguuuguuuuuucgagacggaaccuugcucugucgcccaggauggagugcaguggcgccaucucggcucacugcaagcuccuccucccggguucaugccauucuccugccucagccuccugaguagcugggacuacaggugccugccaccaugcccggcugauuuuuuguauuuuuaguagagaugggguuucaccguguuagccaggauggucucgaucuccugaccuugugaucugcccaccucggccucccaaagugcugggauuacaggaaugaguuaccgcgcccggcccuuuuuuuuuuuuuuuuagguggaaucuugcacugucgcccaggcuggaguacaauggugcaaccucugccucccagguucaaccgauucuccugccucagccuccggaauagcugggauuacgcacacccgccaccacgcccggcuaauauuuuguauuuuuaguagaaaugggguuucacuauguuggccaggcuggucucgaacgccugaccuuguaauccaccugccuugaccucccaaaguguugggauuacaggugugagccaccaugcccggccccuuugguaaaguuuuaugggcaugcagccacaccuauuugcuaaccuacugucagugguggccuucaugcucaaugauagggucuaguggcuuccugucuggcccuaagugaagucuaagcuauucaccaccuggccccaauugccuguccaacccccuccauaccuugucccggaugcaugcaauacaggugugcucagagguacaugcuuucugacccacacuccuaggacaggcaugcuuugcugucccuuaaucaaaucucuuaacaggccagaggcgguggcucacgcauguaauuccagcacuuugggaggccgaggugggcggaucacuugagguaaggaguuggagaccagccuggccaacauggugaaaccccaucucuacuaaaaauacaaaaauuauccaggcauggugccaugccuguaaucccagcuacuugggaggcugaagcaaaagaaucgcuuggaccuaggaggcggagguugcagugaacugagaucacgccacuguacuccagccugggcaacagagacugucuaaaaaaaaaaaaaaaaaggccaggugcgguggcucacaccuguaaucccagcacuuugggaggccgagguggaaggaucacuuggggccaggaguuuuagaccagccugaccaacauggugaaaccccaucucuacuaaaaaugcaaaaauuagccuggcaugguggcgcacaccuguaaucccagcuacucgggaggcugaggcaggagaguuguuugaacuugggaggcagagguugcagugagccgaggucgcgccacugcacuccagccugugcgacagagugaaacucugccucaaaaaaaaaaagccucuuaacaaaggagaaggugccagucuggcuccagcucuuccucauagccacgugaucugggcuuucugccuucucugccucaauuuccucauccagaggauggggccaaccccaguggccaagacgcaggccacagggaggauuaagccaaugaucuugacacuaugggcggaaaggucucuggauucugucuggauacuggaucuuuuuguuuuauuuuauuauuuuuuugagauggacucuugcuuugucacccagacuggagugcaguggcgcgaucccggcucacugcaaccuccaccucccagguacaagugauucuugugccucagccuccugaguugcugggacuacaggugcgcgccaccacgcccagcuaauuuuuuuauuuuuagcagagaugggguuucaccauguuggccaggauggucucgaacuccugaccucaggugauccgccugccucggccucccaaaguccugggaugacaggcgugagccaccgcacccggauggauacugcaucuuugacagacauuguuuuuccuuuugaguuuucaacuuuccuauagugucaaaauuuugaugaucccccaacccccaaacuauaaauaucuccauggacccagugcagcaggguggguagggguggggcuggaagaaagccagggacauugaaugugugcuaaaaacaaggcaggaucuaccccuucacagaaagacaaugggaggccaggugcaguggcucaugccuguaaucccagcacuuugggaggcugaggugggaggacuguuugagcccaggaguuugagaccaacuugggcaacacagugagaugacccccacccccuacacaaaauacaaacaauagcugggcgugguggugcacgccuauagucccagcuacuugggaggcugaggcaggaggcuugcuugaguucgggaagucaagacugcauugagcugugauccugccacuguacuccagucugggugacagagcaagaccgucuuuaaaaaaacaaaaaaaagaugacggguaaaacaggugggaauguccagauuccccccaagaacugggcauguugucaggauagcagccccuaagcugggggguugccuagagggccagugucucagcuacccaggguguggaaaccaggagcuguggcuagcaugggucacuggcgccaccuacugggccaagcaggucagcaucagcccuaaaccacaacccagacaccaaugaagcauggugcuuggcccugggcuuuuugauucaucuugagucacagucucauucuguugcccaggcuggaguacaguagcacgauuauagcuuacugcagcccugaacucccaggcucaagugauccucucaccucagccucccaaguagcugggaccacaggcacacacuaccaugcauggcuaauuuguacauguuuuguggagauggggucuugcuauguugcccaggcuggccuggagcuccuggccucaagcaauccucucaccucagccucccaaaguacugagauuacaggcaugagcuaccacgccaaacgacggcuuuuaaaaaauaaacaccugggccgggcacauuggcucaggacugugaucucagcauuuugggaggccaaggcaggcggaucaccugagguugggaguucgagaccagccugaccaaccuggagaaaccccaucucuacuaaaaaugcaaaauuagcugggcaugguggcacaugcccguaauuccagcuacucaggaggcugaggcaggagaaucacuugaacccaggaggcaaagguugcggugaacugagaucgcgccauugcacuccagccugggcaacagagggagacucugucucaacaacaacaacaaaaauaaaauaaacaccuagaagaaccuguggaccugggucaacagguuggaaaugggggccugaucacagcguuucucagccucagcacugcugacaucuggggcuggcucauucuuugcugugggggcguccugugcauucuagagugucagcaucucuggucuccaccuucuauaugccagcaacacccccucuccccgaguuaugacaaccaaacacaucuccagguguugccaagcguccucaggggcagaguagcuccacggugagaaugaccaucuagcccaacccugacauuacucaaaggagagaaacauccacagagagcaaugacagccucacuguccacagacaagcaagacugugccaccccagggccuuuccacacaccauuuccucugccucccuccccucugccaucuccagugccuccuggcauuuugcuuuuuguuuuccgagacagugucucacucuguugcccagguuggagugcaacggcacaaucucagcucauugcaaccuccgccuccuggguucaagcaauucuccugccucagccucccgaguagcugggauuacaggagccugccaccaugccuggcuaauuuuuguauuuugaguagagucaggguuucaccauuuuggccaggcuggucuugagcuccugaccucaggugauaugccuaccucggccucccaaagugcugggauuacagguaugaggcacucugcccagccucuuuuuuuuuuuuuuuuuuuuuugagauggaaucucgcucuguugcccaugcuggagugcagcggggagaccucggcucacugcaaccugcgccucccaguugaagcaauucugcuucagccuccagaguagcugggacuguaagugugcgccaccacgcaguuaauuuuuguauuuuuaguagagacaggguuucaucauguuggccaggcugaucuugaacuccugaccccaggugaucugccugccucggccucccaaaguacugggaugacaggcgugagcgacagcgccuggucccuccuggccuuucagaccaaagcucagagggcccucucgcuauucacccacauugacauaaugaccacuggccuuggccacaaggcaugcgggccgcggggacucggagugcacgcaccuugcgcugcuccuuccucaugacguguuugucgucguccuuccaguaggcauccuccagcuccuucugcuucuuggcaucagcggccgccuuggccucugcccuacgugcccgggccgcugccgacuugguguucucacccuggaacuucuugggcaucccucagcaggcugcgggaagaggauggggaugggggagcaggggccggaggggacaucggcacucagcacccccagaaucacacuugggcagccaugacccucuuggggccucuguggccuucucuguauaaaacaagggcuuuggacuuagcgcucuccuuguaaaaguuuauuaaggcaaaauucacaucaugacaccaaaugagcucauuuaggccaggucugguggcucacacccguaaucccagcacuuugggaggccgaggcgggcggaucacuugcggucagaaguucgagacuagccuggccaacacggcaaaaccccaucuccacuaaaaauacaaaaauuagcugggcaugguggugugcacccguauucccagccagucaggaggcugaggcaggagaaucgcucgaacccgggagguggagguugaagugagccaagaucgugccacugcacuccagccugggcgacagagugagacuccgucucaaugaaaggaaaaagaaucaauuuaaagguggacaauuccggccaggcacaguggcucacgccuguaauccuagcacuuugggaggccaaggugggcggaucaccugaggucaggaguucaaaaccagucuagucaacauggugaaaccccgugucaacuaaaaauaaauaaaaauugcugggugugguggcggacaccuuuaaucccagcuacucaggaggcugaggcaggaaagccgcuugaaccugggaggcagagguugcagugagccgagaucgugcaacugcacuccagccuaggcggcagagugagacucacucucaaaaaaaaccaaaaagcugggugugguggcacaugccuauaaucccagcuacucgggaggcugaggcaggagaaucacuugaacccgggaggcggagguugcaaugagcugagaucacaccacugcacuccagccuaggcgacagagcgagacuccaucucaaaaaaaaaaaaagguguacaauucaguguuuaaguauauucacagcguugugcaaauaccaccucugucuaguuccagaacacuugcaccccccaaaagaggccacaucaccaucagcagucacucccuauuccucuuccccuagccccugguaaccaucaaucugcuuucugucucuguggcuuucccuguucuggacauuucaguccauaucaauggaaucacaggccgggugcgaucacucacguuuguaauccccgugcuuugggaggcugaggcaggaggauugcuugaggccaggaguucaagaccagccugggcaacauagcaagaguccgucucuacaaaauaaaaaauaauuaggcacaguggcuugugccuguaguuccagcuacuuaggaggcugagguggaaggaucgccugagcguaggaggcugaggccacagugagcuaugauugugccacugcacuccagccugggcaacagaacaagacccugucucuuaaaagaaaaaaaaaaaaaggaaacaaggaaacaaggcaccaauacauacaugauacaaugugguugaaccucaacaacacaauacuaagugaaagaagccagacacaaaaggccacacagugugagaguacauuuauuuauuuauuuuggagacagggucucacucugucgcccaggcuggagugcaguggcgaaaucucggcuuacugcagccuugaccuccugggcucaagugauccucccaccugagccuccuaaguagcugggacuauaggugcaggccaccaugccuagcuuuuuuuuuuuuuuuuuaaggcagggucugacuauguugcccaggcuggccuugaacuccugggcucaagugauccucccgccucggccuuccaaagugcugggauuacaggccugagccacugcgccuggcccuucguuccuuuuuauggcugaauauuccuccacugcauggauacgccacauuuuguuuauccauuguccacagcuagacauuugggcuguuuccacguuggggcuuuuuuuuguuuugagacggaguuuugcucuuucacccaggcuggaaugcaguggcacaaucucggcucacugcaaccuccacccacccgguucaagcaauucuccuguuucagccucccaagcagcuaggauuacaggcaccugccaccacgcccggcuaauuuuuguauuuuuauagagaugggguuucaccauguuggcaugugccaccaugccuaucugauuuuuguauuuuuaguagagacgggguuucacuauguuggccaggcuggucucaaacucuugaccucaagugauccgcuugccucggccucucaaagugccuggauuacaggugugagccacagugccuggcaauuucugcuguuuaagccacccagucugugguauuaguuaugacagcccaagcuggaaauacagacacuuuucucuguguaguaaacacucacucacuugcacacgucauucaauaaauauguacugggcaccuaauacgugugcgaugcuggggaaagagguggcacaaaugagcuuucugccugcaugggacucccagagaagagccaacacaugcaaucagaguccuaauaaggacacgcagggcgccggggaagcccggagagggcuucugacccagccugggucaaagggcuuccuaaaggagacaucuaaggaaaagucugaaugagugggggagagcgcagccugcacgcgggaugcaggagguaggcuggaaaagggggcgauuuguauuccagggagaugggaagguguggagggcguuagagccgggaagcccaaucuaugggucacacaagcccucugggguuagugaggagguggacuccccagauggcaggagcugggagcccaggcgguacccagggaguggcucaggcugggcgaggggcacacuuagaagcgaaucaagacccauggggauuaagaccccacggaugugaagguaaaauaacagaauacaaaauucaacaaugccuccucuaagcagcccucccggcuaucccuuuugaagucccccaccacuaaucccccuacaagaggccgggggaguccgcgcccaacucugucccucucgagaccagaagcugccuaggggcaguccggggccagguggccucgaacaugcugucgcgucgggcuucaaucgucuagucuggaaaugggcaucgcccccaacuaggugcgguucagacuggacgccagaagugcuccugccucccagcaccccuccuccagccuucccaggggauggucccaggccaagcagcccccgccccgcgccucugcuccccgaacccggguuccgcccgcgccgcagacgcuccuaccuucuuaccccagcgccggcccggucgcgccucc

SEQ ID NO: 191891 - RNA, 23202 nt, Homo sapiens
gcugucagcgcugagcacagcgcccagggagagggacagacagccggcugcaugggacagcggaacccagagugagaggggagguggcaggacagacagacagcaggggcggacgcagagacagacagcggggacagggaggccgacacggacaucgacagcccauagauuccuaacccagggagccccggccccucucgccgcuucccaccccagacggagcggggacaggcugccgagcauccucccacccgcccuccccguccugccuccucggccccugccagcuucccccgcuugagcacgcagggcguccgaggacgcgcugggccuccgcacccgcccucauggaggccguggagaccggggaacggcccaccuucggagccugggacuacggggucuuugcccucaugcuccugguguccacuggcaucgggcugugggucgggcuggcucggggcgggcagcgcagcgcugaggacuucuucaccgggggccggcgccuggcggcccugcccgugggccugucgcugucugccagcuucaugucggccgugcaggugcugggcgugccgucggaggccuaucgcuauggccucaaguuccucuggaugugccugggccagcuucugaacucgguccucaccgcccugcucuucaugcccgucuucuaccgccugggccucaccagcaccuacgagguaccggacagaggcccggggguaggaccugccccacuggcagugcugggaccccgugugggggaggcgcuggggcuuugggccgcuguacaggaggacgcggauggcaccucggugcuuuaacggaaggggccccuaggcagacacguggggaggguucuaggaagaggccccaggcgcccggcgaggggcaggaaggaggaagagagagccuggcguccugcuccuucgguggaagcgcgcgcggggcggggcccggcucgaccagguguguccucacggguggacacacaccugccccccaccugcccgggcgugcagacccacgugugcgcgcuagaggggacugcugacggcuccgggguucgaaaccuggcuucacugcuuucuuguaucuugggcaaggggcgugccucucuguuuggguuucccagcuguccaaugggcgaauuacaggaccucccuccaggggagaggguaaagcgauuaaaaucgugaccggggcccggugcgguggcucacgccuguaaucccagcacuuugggaggccaaagcaugcagaucaccugaggucaggaguucaagaccagccuggccaacauggcgaaaccccgucucuacuaaaaauacaaaaauuagccggaugugguggugggcaccuguaaucccagcuacuugggaggcuaagacaggagaauugcuugaacccgggagguugcagugagccgauaucgcgucacugcacuccagccugggcgacagagcgagacucuugucucaaaggaaaaaaaaauauuguggcagggcgcaguggcucacgccuguaaucccagcacuuugggaggccgagguggguggaucacgaggucaggaguucaagaccagccuggcuaacauggugaaaccccgucuuuacuaaaaauacaaaaauuagccgggcauggucgcgcgcgccuguaaucccagcuacucaggaggcugaggcagaagaauugcuugaaccugggaggcggagguugcagugagccgagaucgugccagugcacccuagccugggcgacagagcgagacuccguccccccucccccccaaaaaaaucgugacagguauauccuaggcggccaacaccauuggcccggggcacugucuacacugugcgcuugcgggccacgucggugucugcugagcgguggcugcuccaggagcccgcgcccgucaggcgcaagugggagggcgcgugcacacgcauggaccaguccuccagguccacgggguacgcacaggcacgggauggcaccugugcacgggugugugcgugcggcggggcccccacgugcaagaaucuggcgggcgcgguuggcuuccggagggaggggcccaccuagagagcagaccagggacccgagaggccucggcuccuggguaaggacuguccaggugaccucgagucccuccuugcaguaccuggagaugcgcuucagccgcgcagugcggcucugcgggacuuugcaguacauuguagccacggugaguggccucggccccgcccuccgcucagggccccgagagcgucagccuucacuagcccggcccccaccauucaagaccccgcccagaccccgccccccaugcucccguucugaccccgcccccaucaguccccucccacaccacagccggccugaccccgccugcacucuggaagacccggccuaucugccccgcccauauucugggaccacccuucugccuccucuccccauccccaacucgcccagacgcccucccugcucacccgccccacacucugucuacagaugcuguacaccggcaucguaaucuacgcaccggcccucauccugaaccaaggugugacucugggagauuagggaagcaugucugggaagagaaagggagggagaggagaacccaagacuaaguuugcgccccgcccaggggccuaacagggggaccucuuuuugcauagugaccgggcuggacaucugggcgucgcuccuguccaccggaauuaucugcaccuucuacacggcuguggugaguggcccugggaacucacuccauacgggggaucgggcccacugugucucuuguggggagacucugggcuugccccuuucuccugaggaagccucugucccagcugggacccaguguccucaucuuuauagugaaaaaugaucugaaaagcuuauugcugagaaucuagagguaugguagcuucaggcauggcuggauccaggcuuccaccucuucuggcuuccaguccagcaggaagugagcuccugcuucauccuggggcuggcugaggucccagggagggcuaccuuuggcuggcucaggucugaccuugauggcgauauuaucaucguagugauaauaauaguaauggcggccgggcgcgguggcucacgucuguaaucccagcacuuugggaagcagaggcaggcggaucaccuaaggucaggaguucgagaccagccuggccaacaugaugaaaccccgucucuacuaagaauacaaaaauuaccugggcgcaguggcacgcgccuguaauccuagccucucaggaggcugaggcaggagaaucgcuugaacccgggagguggagguugcggugcguggagauugcgccauugcacuccagccugggcgacagagcaagacuccaucucaaaaaaauauaauaauaauaauaauaauaguaauggcagcaaucacucacugacacucguauaugucaagucauauuccaaaucuuuuucacuuauuaacuuguuuaauucuacugggcacaguggcucauaccuguaaucccagcacuuugagaggccaagguaggaggaucacuugaggccagggguucgagaccagccuaggcaacauagugagacccccccccgcccccaucucuacaaaaaaaauuuuuuuuaaauuagucgggcaugguggcaccugcuguagcuccagcuacuccggaggcugaggcaggaggaucacuugagccuaagaguuccagucugcagugagcugugaucacaccacugcacuccagccugggcaaaagacagaaaccuuuucuuuaaaaauaaaauaacuaacuuaauucuuacaacaacacaguaagaagguauuauuauuaaucccacuuuagagaggaggagacugaggcauagaagggcaucaguccuaggcaccacugaaggccaggucccccaucuaaccgccccucucccucucucugucccaugcugcagggcggcaugaaggcuguggucuggacugauguguuccaggucguggugaugcuaaguggcuucuggguuguccuggcacgcggugucaugcuugugggcgggccccgccaggugcucacgcuggcccagaaccacucccggaucaaccucauggagugagugaaaaugcagaggauacuccagcaggauggggcugggaccagugcgguggcucaugccuguaaucccagcacuuugggaggccgaggcgggcagaucacuugagcucaggaguucaagaccagccugggcaacauggugaaaacccaucucuacaaaaauacaaaaauuagcugggcgugguggugcaccuguggucccagguaguugagaggcugaggcuggaggauugcuugagcccgguagguggaggcugcagcaagcugagaucacacuacugcacuccagccuggaugacagagcuagacccugucucaaaaaaaaaaaaaaaaagaggcugggugcagugguucaugccuguaaucccagcacuuugggaggccaaggcggggggaucaccugaggucaggaauuugagaccagcaugaccgacaucgagaaaccccaucucuacuaaaaaauacaaaauuaggcugggcgcgguggcucacgccuguaaucccagcacuuugggaggccaaggauggcagaucaugaggucaagagauugagaccauccuggccaacuugaugaaaguccgucuuuacuaaaaauacaaaaauuagcugggcaugcuggcaggcgccuguaaucccagcuacucaggaggcugaggcaggagaauugcuugaacccaggaggcagagguugcagugagccgagauggcaucacugcacucccgccuggugacagagagagacuccguccccccccuaaaaaaaaaaaaaauuagcagggcgugguggcgcaugccuguaauuccagcuacucggggaggcugaggcaggagaaucgcuugaacccaggaggcggaggcugcggugagccgagaucacaccauugcacuccagccugggcaacaagagcgaaacuccaucuuuaaaaaaaaaaaaagaggauggggcugggcucccuuugugccgugggaugguagaaaucagccaaugccuccugcuccaggaggcccucgcugcucucuucuccuccccucagaccagauugggggcuaaagccucucugaacucucagcugggcaaagaaagguuuuuaagugcguggauagaugauucaguaaacaaauacgugaauuuucaaucuggcaaaugccuaugcauaugucaaacccacuccauuuauuauuuauuuauuuuuaauuuaauuaauuuuuuuuuuuuugagauggagucucgcucugucacccaggcuggagugcaauggcacgaucucagcucacugcaaccuccgccuccuggguugaagugauucuccugccucagccucccaaguagcugggauuagaggcacccgccauuauucccagcuaauuuuuguauuuuuauagagaugggguuucaccauguuggccaggcuggccuugaacugugaccucaggugauccauccgccuuggccucccaaagugcugggauuacaggcaugagccacugcgccuggccaacaaaacccacuccaaauguccccuauaagguccagaagcgcugucuggggcccuugggagggugaagucagcgugacaucuccacguggcuaacuugcccuguccccacccagcuuuaacccugacccgaggagccgcuauacauucuggacuuuugugguggguggcacguugguguggcucuccauguauggcgugaaccaggcgcaggugcagcgcuacguggcuugccgcacagagaagcaggccaagcugugaguguuucggggagcaaggucgggguuucugggacaugcugccccccuccaccagccugaggcuauccccuaagccugaggcugccucuucccccagggcccugcucaucaaccaggucggccuguuccugaucguguccagcgcugccugcuguggcaucgucauguuuguguucuacacugacugcgacccucuccuccuggggcgcaucucugccccagaccaggugagucccacccaggcuccugguuggcucugcacucccucacuagcuuggugggauugaggucgaagagcauuccuagcagagggaauggccugugcaaaggccaagaaguaggaaagagcugagaggaggccaggugcggcggcucaugccuguaucccagcacuuugggaggcugaggcggguggaucaccugaggucaggaguuugagaccagucuggcuaacauggugaaacccugucucuacuaaaaauauaaaaauuagcuggacgugguggcacgcaccuguagucccggcuacucaggaggcugaggcaggagaaucucuugaacccgggaggcggagguugcgaugaagggagaucgcaccacuacacuccaccuuggaugacagagugagacucugucucaaaaaaauaaaauaaaauaaaauaaagaguucagaggaggaucugcaaggaaugggaaaggugagucugggaggcaauggaccgcccucaguaggugugagcagacaagggccacauucagaucuagaguuccagagaguuccaaagauccccugggagaugcucaggaggagaugaaaccaugacccaggccgggcauguuggcucacgccuguaaucccagcacuuuuggaggccgagacaggcagaucacuugagguuagaaguucgaaaccaaccuggccaacauggugaaaccccccuccacuaaaaauacaaaaauuaccuaggccuggugaugcaugccuguaaucccagcuacucgggaggcugaggcaggagaauagcuugaacccgggagguggagguugcagugagcagagaucgcgccauugcacuccagccugggugacagagagagacuccaucucaaaaaaaaaaaaaacaaaaaaaaaaaaccaaaacaaggcugggcgcgguggcuuacgccuauaaucucagcacuuuuggaggcugaggcagggguaucaccugaggucaugaguugaagaccauccugaccaacauggaaaaaccccgucccuacugaaaaauacaaaauuagccgggugugguggugcaugccuguaaucccagcuacucgggaggcugaggcaggagaauagcuuaaaccugggaggcggagguugcggugagcugagauggcgccauugcacuccagccugggcaacaagagagaaacuccgucucaaacaaaaauaaaaacaaaacaaaacaaacccacaaaaacaaaaacaaaaacuguaauccagcgggaacuaaucauguuggugauaauaauaaugacagcucuggucucccaugucccaagcguccacucugugccucaugcuguucccuucaccagcaguuaguucuccaucuaaucuuucuucugagaaaggcagggcagucacggcuccaacuuuacagaugaggaaauugaggcucggggggaagucacugccugaggucaaugggcaagucggggggcggugccaggacccaugccuaggucacaccccaaguagaguucugaccaugggguucagaguuagcagaggguacgggggaccaccccaucugcaguccucccuggaggucagauccgggacugcuggacuguguaacuucagggagggacuguacucucugccucacagucuucaucaauaaaaugaggaugacacgggucccugcuucacagggaucccagggcucagaacacaguggggcucagggacaauucucagguucaugcaguugaucaacaaaugcacauuauagccugaggaacauagggagaccccaucuuuacacaauuuuuuuuuuuuugagccagagucucacucuguugcccaggcuggagugcaguggcgcaaccucagcucacugcaaccucuggcucccaggaucaagccauucucuugccucagcccccgaguagcugggaugacaggcaugcgccaccaugcccagcuaauuuuuuuguauuuuuuguaggggugggguuuugccauguuggccaggcuggucucaaacuccugaccucaggugauccaccugccucagccucugaaugugcugggauuacaggcaugagccacugugcccggccuuucuuucuuuucuuucuuuuuuuuuuuuuuugagacagaguuuggcucuguugugcaggcuggagugcaacggcgcgaucuccgcucgcugcaaccucuaccucucagauucaggcaauuccucugccucagccucccaaguagcugggacuccaggugccaaccaccacacccagcuaauuuauguauuuuggguagagaugagguuucaccauguuggccaggcuggucuugaacuucugagcucaagugauccacccgccucggccucccgaaguguugggauuacacgcgugagucacccugcccggccagaccccuaucuuuacacaaaaauuuaaaaaaauuagccaggcaugguggcgcacaccuguggucucagcuacugggggacugaagcaggaagaucgcuugagcccaggaguucuaggcugcagugagccacauucaugggacugcacucccgccugggcaacagagcaagaucuuuucucaaaacaaaacaaaacaaaacaaaaccacagacaaaaacuaaaugcauauuaaaugccgacucugagcccuguccgucuugggugcuggggacgugcagcaucaggacagauagaugccccgguccucggggugcagcugucugggaggcugacccccaguucuccccaguacaugccucugcuggugcuggacaucuucgaagaucugccuggaguccccgggcuuuuccuggccugugcuuacaguggcacccucaggugagcaccccugcuuguucauggagcauuauuucagccccugggagccuccuuauccuggccugccaucccucuggggcauggaauguucuggaccuguccaucagucccaguuccugcuugaucccuagaagacagcucagguaggcgcuggcagagagcaugcccugggcacagggaccccaacugcaaggguuuaccuucuuaucaccugucagggccacgccugacucuccucucuucuucuuccuucuuuccuuccuuccuccccagacaaauauuuguugaacaucuacuauguggcagguacuguuuuuuuuuguuuuuuuuccggauggagucuugcucugucacccaggcuggagugcaguggugccaucucggcucacugcaaccuccaccuccuggguucaagcaauucuccugccucagccucccaaguagcugggauuacagguccacgccaccacagccggcuaauuuuuguauuuuuaguagagacgggguuucgccauguuggccaggcuggucuugaacuccugaccucaggugaucugcaugcuuuggccucgcaaagugcugagauugcaggcaugagccaacgugcucagcccagguacuguuguucuaaacccuggggcacagccaugaccaagcaguccccugcuucugccuuccaaggccacacacucaggugguuuccacucuuccgggacuucuggucacaugcccucacugucccuuuugcaaaucucccacaugugacugcagucccucuggaaccagaacccaccugucugucccaccugcccuuggucacagguguccuugcuccuguagggaugucucaggucuucggggaggggaggggcaaauaucuccuucaccuuugcaggacuggguuacccccaccguugcccucaggcugggugaggucuggcaggccagaugguguggacggucucuccauauggccugaggaccccccgcugccuuccucacacagcacagcauccaccagcaucaaugcuauggcugcagucacuguagaagaccucaucaaaccucggcugcggagccuggcacccaggaaacucgugauuaucuccaaggggcucugugaguuucagggagaccugggugggaggccagggcagucccuccccguugaccgugccauccucauccacuacagcacucaucuacggaucggccugucucaccguggcagcccuguccucacugcucggaggagguguccuucaggugagaccccaccugcccccugcccuggucuccugagaggugggggcaccuuucccucuuucccauuaaacugaggcucagagaggucacaugugucaguggcagaacucacuucuauguuuuuuuuuuuuuugagauggggucucacuguguugucccagguuggugagcagaggcccgaucauagcucacugcaaccuccagcuccuggguucaagccauccuuccaccucaaucucccaaguagcuggaguuacaggugugugccaccaugccuggcuaauuuuuuucuuuuuucuuuuuuuuuuuuuuuugagguggagugucacucuguugcccaggcuggagugcaguggcaugaucucagcucgcugcaaccuccacccccuggguucaaggaauucugccucagccuccagaguagcugggauuacaggugcaugccaccaugcccgucuaauauuuuuguauuuuuuuuucuugagacggagucucgcucuguugcccaggcuggagugcaguggcaccaucuuggcucacugcaagcucagccuccuggguucacgccauucuccugccucagccucccgaguagcugggacuacaagcgcccgccaccacgccugacuaauuuuuuguauuuuuaguagagaugggguuucaccguguuagccaggauggucucgaucuccugaccucgugauccgcccuccucggccucccaaagugcugggauuacaggcgugagccaccgcgcccagcuuauauuuuuguauuuuuauuagagaugggacuucaccauguuggccagucuggucucgaacuccugaccucaagugauccacccgccucugccucccaaaguguugggauuacaggugugagccaccacgccuggccuggcuaauuuuaaaacuuguuuuuagagacagggucucgcuucgugccuaggcuugucuugaacuccuggccucaagcaaccacccgccucagccuuccaagucgcugagauuaagaacuaaguucuauuugaugccagaggccaucaggggacuuuuuugcagcuggcuggcuuggggugggggaauugggaagggggagguggcgacagaaagggccucccuauggagguugcagugagccaagaucgcgccacugcacuccaaccuggacagcaaagugagacucugucuaaaaaaaaaaaagaagaagaaagggucucccuggcuugagggugggacugccacccccaagagauaaucagugucuuugccuccaacccaagggagauaggcaggaacaagggggggggguccucuccccuuuagggaaacugagacacagaggaguccuugagacccacauuggaguuccugaggucucgcuuucccagcggguaaacugaggcccagagcggugggagggcuccgcccucagccccacuuccaccuacucucccagggcuccuucaccgucaugggagucaucagcggcccccugcugggagccuucaucuugggaauguuccugccggccugcaacacaccggugagugggggcggggcaaggggcggggaggggcggggccggacaggccccuccccuucccugacgccggcucugcccccagggcguccucgcgggacuaggcgcgggcuuggcgcugucgcuguggguggccuugggcgccacgcuguacccacccagcgagcagaccaugaggguccugccaucgucggcugcccgcugcguggcucucucagucaacgccucuggccuccuggacccggcucuccucccugcuaacgacuccagcagggcccccaggugagcagacuugaggguagggggguacccgagcccuggauggugugaucuugaagggaaacuuacuugcccugcacucuguguaagaagccugauuaguaaaaugcauuccugggggagggaacgguaggugcaaaggcccugaggccacaaucggguuagucccaguccaacugcacugagguuagggugcauuuaaugggaggagagaugggugggagauauggugcagccagaggaagcuaguacuuuuuuuguuuuguuuuucugagacagagccucgcucugugguccaggcuggaaugcaggggugcaaucucagcuuacugcagcuucaaccucucaggcucaagcaauccucccagcuugagggaggcccagaauuugguuugguucuauuuuuuauugagauaaauuagccauuuaaaaguggcauuuaggccaggcaggcacaguggcucacaccuguaaucccagcacuuugggaggcugaggcagguggaucaccugaggucaggaguucaagaccagcuugaucaacauggggaaacccccgucucuacuaaaaauacaaaacuuagccaagcgugguggcaggugccuguaaucccagcuacucgggaggcugagacaggagaaucgcuugaacccaggagguggagguugcagugagcugagaucgcaccacuguauuccagccugggcaacaaaaaugaaacuccaacucaaauaaauaaauuaaaguggcauuuaguauauuugugcaaccaucaccacuaucuaagucaagaacguuuccucuuuuuuuuuucuaauuuuguauuuuuaguacagaugggguuucaccauguuggccaggcugaucuugaacuccugaccucaggugauccgcccaccucagccucccaaaaugcugggauuacaggugugagccacugugccuggccccaaaaacauuuucuauuuuuuuuuuuuuuuggagcagggucuugcucuguugcccaggcuggaguccaguggcacgaucauagcucacugcugccucaaccuccugggcucaaggaaucuuccuaccucagccccccuaguugcugggaccacaggugcacaccaucauguccugcuuguuuuuauuuuuauuuuuuguagagacagggucuggcuauguugcccaggcuggucuggaauuccugggcucaagcgaucugcccaccucagccuugcaaagugccaggaugacaggugugggcacccagccaaccaagaacauuuucuguuuuguuuauuuauuuauuuauuuauuuugguuuuuuggguggguuuuuuugcuuuuuguuuauuugauuuuuuggagacagggucucacucuaacacccaggcuggagugcaauggcacaaucacagcucacugcaccauugaccuccagacuccgaugauccuccugccucagccucccaaguagcugggacuauaggcauguaucaccaugcugggcuaaauuuuuuguauuuuuuauagagacgaguuuuugccauguugcccaggcuggucucaaaguauugggcucaagugaucugccugccucugacucccaaagugcugggauuacaggugugaggcacuguuccuggucauaagaacauuuuuaucaccccagaaagaagcccuguccccaucagcagucacuucccacuucccccucuccccagcuccuggcaagcacgaauccacuuucuguuucuaugaauuugccuguucugggcauuucauguaaauggaaucauaaaauaugugaucuuuugugucuuagcauaauacauauauauuuuuugagacgggguuucacuuugucgcccaggcuggagugcaguggcgugaucccagcucacugcaaccucugccucccagguucaagcaauucuccugucucggccuccugaguagcuggggucacaggcauaugccaccacgcuuggguaauuuuuguauuuuuaguaaagaugggguuucaccauauugaucaggcuggucuugaacuccugaccucaggagauccacacaucuuggccuuucaaaguacugggauuacagcagaguacaguggagccacugcacuccagucuggguaacagagugagacuccaccaaaaacaaacaaaaccaaaaacauuugugaacaaguuuugguauggacauauguuuuaauuucucuagguauauaccuaugaguggaauugcuggaucauaugguaauucuuuaacuuuuuuuuuuuuuuuuuagauggagucuugcucugucgcccaggcuggagugcaguggugugaucuccacucacugcaaccuccgccuccuggguucaagcgauucucccgcuucagccucccgaguagcugggacuacaggcauaugccaccacgccuggcuaauuuuuauauuuuuaguagagaagggguuucaccauguuggucaggguggucucaaaccccugaccucagaugauccgccugccuuggccucccaggguguuaggauuacaggccugagccaccacgcccggccuauguuuaacuuuuugaggaacuaccagacuguuuuccacagcggccacaucauuuuacauuccgaccagcaacauaugaggauucuaacuucuccacguccucgccaauacucauuauucuccauccuagugggugugaagugauaccucacugugguuuugauuugcauuucccugaugaauaaugauguugagcaucuuucuuuucauuggccauuugugcaucuucuuuggagaaaugucuauucaaacccuuugcccauccagccuggguaacauagaaagacccuaucucuauaaaaauaaaaaugaaaaaauuagcugggcaugguggugcacacuuguagucccagcuccuugggaggcugaggcaaagaggaucgcuugagccuggggggccaaggcugcagugaagcaugaucccaccacugcacuccauccuaggcaacagagcaagacccugccucaaauuaaaaaacaaacaaacaaaaaaacacccuuugcccauuuuuaaauugggugauuugucuuuuuauuguugaguuauaauuuacauauuuuuauaucuuuauguauucuggguacaagccccugaucagauguauaauuugcaugugauauuuucucccauucuguagguugucuucauucucucgauagaauccuuugaugcacagaaguuuuuaauucuuuuuuuuggugggcggauggagucuaacucugucacccaggcuggagugcaguggugcgauuucagcucacugcaaccuccaccucccagguucaagggauucucccaccucagccucgugaguagcugugacuacaggugcacaccacuaugccaggcuaauuuuuauauuuuuaguagagaugggguuucaccauguuagccagccugguuucaacuccugaccucagccugccucagccucccaaagugcuaggauuacaggcaugagccaacaugccuggccagaaguuuuuaauuuuuuuuuuuuuuuuuugagauggagucucgcucuguugcccaggcuggagugcaauggugugaucucggcucacugcaagcuccaccucccggguucaugccauucuccugccucagccucucgaguagcugggacuacuggcacccgccaucaggccuggcuaauuuuuuauuauuuuuuuauuuuuaguagagacaggguuucaccauguuagccaggauggucucgaucuccugaccucgugauccacccgccuuggccucccaaagugcuaggauuacaggugugagccaccacgcccagccaguuuuuaauuuuugaugaaguccaauugauuuauuuuuuucuuugguggcuuuugcuuuuggcgucauaucuaagaaacaauugcagucacgaagauucccaccuauguuuucuucugagaguuuaauuugguuugauuuugagggugacagggagccacagagggugacgggcagcagcaggugaucugaguuacauuuuaguaaugugcccuuuggcuguguguggaggacgucuaggguggggaugggauaccuggagggaaggaacauuggcuacugcacagaucugggcagacaguaauggaggucugugcuaggccauggcaguugggggaaggaagcagggggugagguuggaacagcuuuugagugcaggcaggggauaaaagaggagguucaagucugucucucccaaccugcagcucaggaauggacgccagccgacccgccuuagcugacagcuucuaugccaucuccuaucucuauuacggugcccugggcacgcugaccacugugcugugcggagcccucaucagcugccugacagguagguaaacagagcauguggccucagaggucaucccauucaucucucugccucaaggcuccacccagcagggaggggagaaaggacgcucccauuggccaaacugccacugugugcuguacacauuuguaccuuauuauuauuauuauuauuauuauuauuaucaucaucaucaucaucaucaucaucauuuuugagauagagucucacucugucacccaggcuggagugcaguggugugaucucaguucauugcaaccuccaccucccagauucaagcgauucucaugucacagccucccgaguagcugggauuacaagugugugccgccaugcuuggcuaauuuugcauuuuuaguagagacggaguuucgccaugugucucgaacuccugggcucaagugauccgcccaccucggccucgcaaaguucugggauuauaggugugagccacugcaccugggcuguaccuauuuuuuuaaaaggaaaaaaaaaguuugugaggaaaaaagaaguguguguguauauauacacauacauacacacuuuuauguguauauauacauaaaagaaauuaugaauauauauaaaaauuaugacuauauauauacauaaaagaaaguguauauauauauaguuucuuuuaaagggacggggucgacugggcguaguggcucaugccuguuaucccagcacuuugggaggccgaggcggguggaucaccugaggucaggaguucaagaccagcccggccaacauggugaaaccccgucucuacuaaaaauacaaaaaaauuagcugggcaugguggcaggcgccuguaaugccagcuacuugggaggcugagguaagggaaucgcuugauccugggagauggagguugcagugagccaagauugcgucacugcacuccagccugggcaagagagugagacuccaucuaaaagaaagaaagaaagaaggaaggaaggaaggaaggaaggaaggaaagagaaagagagagagagagaaggagagaaagagagagagaaagaaaagagacaggucucacuguuacccagacuggagugcaguggcacaaucauggcucacugcaaccuugaacuccugagcugaaagcaauccucccaccucauccucccgaguagcugagacuacaggugcgcgccaacgugcccggcucacauuuacacccuuuaaagcuauguugcuuucuugacaacccugcaccucucagagcuugcccuauuuugcagaggcagaaacggaggcauugccugcaacuccucuccccaacaagauuaaguccucaguagaggauauggguuggggcgggcggcgcuaucccuggugcugaaauaucuucuaaagcugccggugacuccgcacuuguuagggaauucuaaauuccacggaaaaguagaaggagacaaagaggggaaagucaguagugauaacaguaccugcucacacuucuugagucucagacuucacagucaucaggccuuuaucgaguccuccucugugcuggacgcuauuuuaggcacuggggaugcagcagugaauggaaccgugugcuggacccucccagccauccauuaaugucuuuguuuuguuuuguuuuguuuuuuugagauggaguuucacucuggucgcccaggcuggagugcaauggugcgauguuggcucacugcaaccucugacucccggguucaagcaauucucuuaccucagccucccgaguagcugggauuacaagcgcccacccccacgccuggcuaauuuuuguauuuuuaguagaaaugggguuucgccauguuggccagacuagucucgaacuccugacgucaagugauccccugccuuggucuuccaaagugcugggacuacaggcgugagccaccgugcccaaccuccaaugauguuuuuguuuuguuuuguuuuguuuuguuuuagaaacagggucucacucugucaccaagcuggagugcaguggcacaaugacggcucacugcagccucgaccucuugggcucaagcaauccuccugccucagccucccaaguagcugagacuagaggcacacaccaccaugccuggcuaauuuuuuaauauuuuguagagauggguucuugcuauguugccuaggcuggucuccaacuacugggcaacucuaagcaauccuauugccuuagacucccaaagugcaauuaugagccaccauaccuggccucacugauguuuuauuacaacuucacuguguagaugaggaaacugaggcucagaggcuugccagggucccuuagugggacuggagccuguuagacuucauagaccagggaucuccuuucuccuucccaggaccuggucuccaacccccaugaccccuucacugaaugccuggauuucuccauuucuccccgccucucaggccccaccaagcgcagcacccuggccccgggauuguuguggugggaccucgcacggcagacagcaucaguggcccccaaggaagaaguggccauccuggaugacaacuuggucaaggucagucuuaggcuggguucccagaucuagaggcagccaagugacuuuaggacgugaccacagcucaggggagggacaugguauaucagcaccuuucuccaucgcucauuaucuccagucaaaagacucuauugggagcugauucauccucaacaguuuuuaucucccuucacaaggacugaacagaguuuaauacuauuccuuuuuguuuguuuguuuuuugagacagagucucgcucuguugcccaggcuggagugcaguggugcaaucucggcucacugcaaccuccacaucccgaguucaagcgauucuccugccucagccuccugaguaguugcuacuacaggcgcaugccaccgcacccagcuaauuuuuauguuuuuaguagagaugggguuucaccauguugcccaggcuggucucgaacuccugaccucaaaugauccacccaccuuagacccccaaagugcugggaugacaggcaugagccaccgagcccagccucaucuucaaguuuuuguuaucucccuucauaaggacugaacaaaguugaauacuauuccuuuuugucguuaucuguuuuuacagugacuuccaaucuuuggcaggugaaacuggugugcuguuaggguauugauguaaagucucuucuuaaaauaaaauuacuuaauucaaaagugagucaacuuggggaaaaaaucuuacauaagaaacacaacagaugguaaaccgauuuuggcuaaaaccgcgugguugcuuugugaauucccagaguuuggaaaaugcugucccugggggaccugaucccaugccuaccccuguuuuggaaucccuguuccauucucucauuuauugagcaccugcuguguacccaguccugcucugggcuauggucuaagacccccaccccacccucaucuagcaggggcaggugaaaacuaaaaagagaaacauguagggucugucucaguaugugauaagcauucaaaagauaauacaaccagaugcugucaggccgggcacgguagcucacgccuguaaucccagcacuuugggagguugagguggaucgcuugaggccaggaguucaagaccagccugucgaacauggcaaaacccugucucuacuaaaaauacaaaaauuagccgggcaugguggcgugugccuguaaucccagcuacucaguggaaugaggcagaagaauugaacaauugaacccgggagguagagguuguagugagcugagaucgcgccacugcauuccagccugggugacagagcaagacuucgucaaaaagauaggaaagcaggaagggagggagggagggaaaagaaggaaggaaaggaaagagccaggcgugauggcucaccccuguaaucccagcacuuugggagacuuaggcaggugcaucaccugaggucaggaguucgagaccacccuggccaacauggugaaaccccaucucuacuaaaaauacaaaaaauuagccgggugugguggugcaugccuauaauuccagcuauucggaaggcugaggcaggagaaucgauugaacucaggagguggagguugcagagagcagagauugugccauugcacuccagccugggcaacaacagccagacacugucagaaagaaagaaaagacagagagagagagagagagagagagagagagagagagagagagagagcaagcuaaaaagaaaaacguguagggucucagcaugauaaauauucaaaggauaauaaaaccggaugcugugauggggagcaacuuuagccagggaagucagggguggccucuugggagaggugacauugauugacccugaguuaggagaagaggaaccagccacagacaggaacagcuuugacugagaaggggauugggaggggagggguuugccugaagguguuuaaagcucccuccagcugcccuagagaaguguuuaucuuuucuuucuuuccucuuuucuuuuccuuucucuucuuuucuuuuuuuucuuucucucucuuuuuuuguucuuuauuauuuuauuuuucuuuuuuguugucuuuguuuuauuuguguguuuuuuuucuuuuuugucuuuuuuuuuuuuccuuuuuuugagauagggacucacucuauugcccaggcuggaguguaguggcaugaccauggcucacugcagccccaaccuccaugguccgagaaauucucccaucuuucaaccuccugaguagcugggauuauaggcaugcaccaccgagucugguuaauuuuuuuauuuuugguagagaugggguuuugccauauuggccaggcuggucuuaaacuccugggcucaagugaucugcccaccuuggccucccaaagugcuaggauuacaggggugagccaccgugcccggccagaaauauuuauuuucuugaaggugaacaggcagagaagcagagaaaggagggaggaacuauagcaggcaucugagaaagcguugauggccugggcuguaggugacaugugaguggggaagagaagcgcauggaaauuuuggaggcagagcgggcaggacuggcccgugcacugagcaaggggauaguaugcaauucugugcacgccccgucccgccaggucaucaguagcccaucugggagaugagcugacacggaacaggguggggacagggucucugauggggucucuuuuucccacuuuuccccaggguccugaagaacuccccacuggaaacaagaagcccccuggcuuccugcccaccaaugaggaucgucuguuuuucuuggggcagaaggagcuggagggggcuggcucuuggacccccuguguuggacaugaugguggucgagaccagcaggagacaaaccucugaggacagggccagccgcgggacugacacccugggauggaaccucaggaugggccaaacccagacaacgggcccauggccuugggcucugauuggcuggauugccuuguaugcaaaugaguucaggacuacaauacccuacccuauggggaggcccugccuccgggaggucauuuuuuaaauccagccccuugcuucaaccguccccaguauuagacgcugcagcccugacggcuccccccaaauaaggcuggguuuuucucucucucuuuuuuuuuuuuuuuuuuuuuugagacagggucaugcucugucacccaggcuggagugcaguggugugaucucggcucacugcaaccucugccucccaggcucaagugauucuccugccucagccucuugaguagcugggauuguaggugcccaccaccaugcccagccaacuuuuuguauuuuuaguagagacaggguuucaccauguuggucaggcuggucucgaacuccugaccucaagugauccaccugccucggccucccaaagugcuggguuacaggcguaagcuaccaugcccagccuaccguuuuucucaaucuauaauagaaagccaccacgcccagguaauuuuuguaauuuuguauuuuuguagagacgggguuuugccauguuggccaggcuggucucaaacuccugaucucaggugauccuccugccuuggccucccaaagggcugggauuacaggggugagccaccgcgccccaccucuuucuuauuuucuuccugggauuggggaggggaugauucagaccccacauggccuccaaccuuggcccacacaccugccauggcucccaucauccugagcaugcuagcguccccuccucaccugacaauggaggcucucgaauuggguuguguccccccaaaauuuaugucuacccagaaccucagaacaugagcuuacuuggaaauagggucuuugcagguguaacugguuaaauuaaaagagguauuacuggaggaggauggaugaauccagugacugguuccucauaugaaguagagaagagaugcagagaaacacauggggaagaugccacgugaagacagaggcagugguuggaucaaugcaucuacgagucggagaacccaaggauugccagcaacaaccagaaaucaggaggggggcaugagaugcauuauuucuuagagccuuuagagggaacauggcccuacugacaccuugaugucagacuucuggcugcuagaacugucagagaauaaauuucuguuguuugaugcca

SEQ ID NO: 191892 - RNA, 3394 nt, Homo sapiens
accggggcguuccugaguuuauuuggggcacacccggacgagggcccugcaccuagaagaagguguugggccucuugguggugaagcguggcuugugcugacggcgcaggacccgguggggcagcgggaacuugaucuuggaguccugugaggaagggaggcauguugaggggguuggaagccucuuaacaccccauccuguggggccaccaagguguagccgccccccacugggcuccugcgucagagcaggcacuucccuccaggggagucccccagggcacucacguggaacugcuugacagccggccggcggcacuugcuggccgcgaucuccuccaccuucaugaucugaauggagugggcucgggcgcggugccgggcacccaugucucggucuguggaaaggagcggggccagggugacgguguugccugggcucugggcauucagcaaaccuccugagugccugcccaaugaccugacacauccuguuggucacagcaacugccugagggcucggggcucacgggaagguggugguggggaagcgagauagcccaaggccugggucccugcagucacuggccacuagaguuguggaaccuccaaauucacuuugaggggcacggccacagccccccaaaggcgacaagauccgcuugcuguuugcaccucuguuuaaaccaccgcuauaagaaacagugauucuuggguuuaggugcaaucagggaggugugggggucucacagacccuggcaggugagccagggaaaaggugccagcucccaacacuaggcagggguucaauucgguucucagugggucccagaaaacaguggugauguggaucccagucuaaacaaggugcagacccaaaaagggaguuuccagaugugaugugauuuacaaccgagccuggcagggcucucagaaaagcgccaucuggggccuggggcauccuuuugucuuccugugccccgccaccaguccugagacucuccugcacugggaaccucuggcacuugcccugccucagugugagggagucaaggagggucuaaaaagcuggaggcgggacaggcagcuuacagcacugggugacagcgccugcgguggucaggucccgguauucccgguacauguugugggugccgcuccgggagucauagcgcagccagaucccgaaguucuucacccgcaggggggacuucucaaacaccugccaaggagaggccacagggagaugugagagcagcaagccgaugugcccuagccccauccucacugaacccucugccucuaaagcacaccccaggcuccaggccuacucuauggccagacucuugugccucaguuucccagccccaccuaccuucaggcauccucagggagcgugagguaagggaacuucccauggcaacagccugaaguccaggcuucugccacggacaccaacccagccccagaugcaguuccugaacucaagucuccuggaaccugucugggccaaccuagcuaccacccacugaccagauagccaucaccucuccucacuuaacagacagggcccagggaagacagcaccaaccaaggugucccaccaugccacccacccgcucccugggucccuggcuuucuaaucagggaaauggcacauaagcucugcuccagucccgugacccaggcagaaacacaacccggggcucugaugucugaugugaugggauuacaggcguugagcuaccgcacccguucgaugucugauuaauucuugagaugcacgaugucccaagaggcgcaaauccacuccagaccccacguagccccggccucuccauaccugcccacaguagacaaucuccccugaagacuucuucaucuucuuuaacugagauacaaaguaccagaagcgggacuuggcgacgacaugauuaggcgcaaagauucgcaugcgguagaggggcggcguguggcauuugggggugggcaggcagcgacccacuaccuuguacucucguagcugaaaggaaacaggagugaggguaaggccagcacccagaggcaacuguggagauccaccucacucccuuuccuacaucuagugaccacagauucgggaagcaggaggcagggccacccuagggccuccauguggauucuuggugacuguaggucacacucccgaccacaacuuuauacacaaaaugaacugaggagagggaggucuccagggaggauuaauugaguugccugccucuccuuugccugggcuaaggguuucagaccaggaaagcuguggcuuagacccacagccuccuuucuucaugcugcaguccugaauugcuuugcagucgccgucaaacagccacucugcaccucaaaacauccagccaacaucuucuuucacccugaggcccagugaccagcaugggaucucacagcccauuccaggcagaacuaggacaagaccucaggucucuccccagcccugggaucccugcacuguugccacgcgagcugcggcugccuccguuuucccaacugcaauccaaacguuuggcccagggaagacucccgguuuacagaugcagaggugagaaucuuuggucaaguccaggcucugugauauggcacaaagaaaccaccucugaaacugacucgccagcuuuucacuaguuaucaaugaaaaauagucacaaauuaucgcaguuccuacuuuuacugugaaccugacccaccggccucggcacacguucaggaagggaacaauggggcccgccccuuugacagcaaggaaaccgaagcuggagaucuggacauaauacacccacuccaugggaguccagguucuccuaucucugcgccauagagccguuugauucuauccaguauguaccacagcguuaagccucacgcuccccguuucggcucacuguuagcaauuuucaucugcuucucacagccauuccggcagaaagaaaacacacuauugcucuaccgccacguccacguugcagaaaggaaaacagaaacuuggcggcucgacgaggugccggggcuagggccucuaugcugcgcgacuuauuccuucccccgggaagaagacccggaguccuugggcccccgcgaucccugagcuggcccaggucacgcaucgcucucuccacgcggcucccacgauggccgccauguugggugcaacaagagaaggcggcgcgcggccaaggggggcccaaacagaagcgcgcggcaccaacccggcccacgccacuuaugcaggccccugauggggcccgugccccaucccuuggcccccugccgcgccgcgcccgccuuaccgugcccgaggccuucauggcgugcucuccgcguucgccgccacccgcaaaag

SEQ ID NO: 191893 - RNA, 11931 nt, Homo sapiens
ggaggcgucggggcugcgccguacaacuuccggcuguaaagauggcggcuuccuagugagucggcggcugauuuagaaggagguucaggcuacggugagccgaagguggguggugaaagcguguggggcccguuccuaggggcccagcucccuuugccccaagagauccagcuccucgccuuuccuggggcuuccgccuuuauuucugguuucuccugcaguguagccuccauccuucuugcugccgcuaaagccuuguuuuucuuagagguguggggacugcaaggcgcucaaagaccaucuugggaagcccgugccuauuucccagauagacaaacugcuccauucgcguccuguuucucuccaaggggaaccacaguacuaauauuuugcuucucccucaugcagacacccgcuagggacgaggguguccuagagguuauuauucccuuauucaccaagacauuuucaguuuuagguaacagaaaacccuacucaaucuggcuuaaggaagaaaaggaaguugguggcuuauagauugggucuaacaggagcuggguccagguggucagaauucgaucugcaguuuucucgguggagaccauuucgcuuuuuaccgaggcaaaaggggccccucacagcucucaacuuuauucuaccagcucugcaacucuaaugagagucucuuuuccuugaugacacugcuagaaguugcagagcugccacucaauggccugauuugggucaugugcccaucccugagccauuuucaguggccagagagcugggaugugcucacuggccgaguaggggcauggggcuagcacuacguuaaaaaaaaaaagaggaaaaaagaggggggacuguuaucuuaugucggaguggcugcucggcugagagguguaaaaggcagccauucugcagcugaggaaagugacucccuaagaggagugacucaucaucaguaagcggcucaucgccccucuuccuucuuaguaaccaaucuuuuuuuuuuuuuuuuuuuugagacggaguuucgcucuuuuugcccaggauggagugcaguggcgggaucucggcucaccgcagccuccccucccggguucaagcgauucuccugccucagccucccgaguagcugggauuauccgcaugcgccaccacgcccggcuaauuuuguauuuuuaguugagacgggguuucuccauguuggucaggcuggucucgaacuuccaaccucaggugauccaccugccucggccucccaaagugcugggauuacaggcaugagccaccgugcccgaccguaaccaaauguuuuuaaaacuccaaggggaggauucuggcuuccccuguccguguuccaucuagccacacaggagccauggaaguggcagagcccagcagccccacugaagaggaggaggaggaagaggagcacucggcagagccucggccccgcacucgcuccaauccugaaggggcugaggaccgggcaguaggggcacaggccagcgugggcagccgcagcgagggugagggugaggccgccagugcugaugaugggagccucaacacuucaggagccggcccuaaguccuggcaggugcccccgccagccccugagguccaaauucggacaccaagggucaacuguccagagaaagugguaaguagaggggguggccuggggcucugagaugcuagggaaccuagcaucuugucuuuugggauuaacacugcaaacauucccuuuguauucguuaccuguggcugccacaagucaccguggacuugguagcuuucaacaagagaaauuuauucucucacaguucuuggggccagaagucaggugucgccagggccauggccccucaggaggcucuaagggagggaauucuuucuugccucuucauuuugucugucuuuuuuuuuuuuuuuuuuugagauggaguuucgcucuuguugcccaggcuggagugcaauggcacgaucuuggcucacugcaaccucugccucccggguucaagcaauucuccugccucagccucccgagcagcugggauuacaagugcccaccacaacgcccggcuaauuuuuauauuuuuaguagagacaggguuucaccacauuggccaggcuggucucgaacucuugaccuugggugauccgccugccuuggccucccaaagugcugggauuauaggcaugagccacucugccugacccuuucuugccuuuucuagccucucguggcuccuggcauuccuuggauuguggcugcaucacucuagucuuugcccaauuuuuuuuuuuuguuuuuuugagauggagucuugcucugucacccaggcuggagugcaguggugugaucucagcucacugcaaccuccgccuccuggguucaugccauucucccgccucagccuccugaguagcuacaggcgcccgccaccaugcccggcuaauuuuuuguauuuuuaguagagaugggguuucuuucuuucuuuuuuuuuuuuuugagaaggagucucacucuguugcccaggcuggagugcagugcaguggcgcuaucucggcucacugcaagcucugccucccggguucaugccauucuccugcuucagccucccgaguagcugggacuacaggcgcccgcuacuacgccuggcuaauuuuuuguauuuuuuaguagagacaggguuucaccguguuagccaggauggucucgaucucuugaccucgugauccaccugccucggccucccaaagugcugggauuacaggcgugagccaccgcacccagccacugagaugagguuucaccguguuagccaggauggucuccaucuccugaccuuguguuccacccaccucagccucccaaagugcugggauuacagguguuagccaccgcgccuggcugucuuugccuaauucuguccaguccucauauccucauaaagccuuucucacugugucucugugucuucuccgcuucugucuccuauaaggacacuugucaucaaaacaggaucuuaucucaagacccuuacuuuaauuacaucugcagagacccugauuccaaauaaggucacauucuuuuuuuuuuuuuuuuuuuugagacggagucccgcucugucaccaggcuggugugcaguggcgugaucucagcucacugcaaccuccggcucccugguucaaaugauucuccugccucagccucccaaguagcugggauugcaggcacucaccgccacacccaacaaauuuuuuuuuuuuugagacggagucucgcucugucgcccaggcuggaguggaguggcacaaccucggcucacugcaagcuccgccuccuggguucacuccauucuccugccucagccucccaaguagcugggacuacaggcgcccgccaccacgccuggcuaauuuuuuuguauuuuuuuaguagagaccagguuucacccuguuagccaggauggucucgaucuccugaccucgugauccucccgucucggccucccaaagugcugggauuccaggcaugagccaccacgccuggccucuuuuuuuuuuuuuuugagacagaguuucacucugucacccaggcuggagugcaguggcucaaucagggcucacugcaaccuccaccucccggguucaagcaauucucuugguuuagccuccugaguagcugggauuacagguaggugccaccacaccuggccaauuuuuuguauuuuuagcagagaugggguuucaccauguuggccaggcuggucucaaacuccugaccugaagugauccacccaccuugcccucccuaagugcugggauuacaggugugagccacugugccaggccaaauaaggucacauucucagguucuggguggacaugucuuuugggagccacaguucgauccacuauauccucauuucuguguuucugugucacacauucucuggcucauuuauuuacuuaucuacuuggacucccaguucagugcccauucuucuaagccauugcuuuucaaaguagauggcuuggcugaggauuagaggucaccauacugccuuuucagacaaggcagcuugaagagggccagugaguggugugggggccaacguuaaggucagaggacgcucaccacccuccaacuaccuugcagauuaucugccuggaccugucagaggaaaugucacugccaaagcuggagucguucaacggguaagagggacauuuuagggcuugaacaugcagccauggcagggaggguccagcccaaaagauacggggcucucacucugaaacucacaccagcuuggucuggcuucaggcuuggcaguaucagagauuagcaagagccaggugcaguggcucaugccuguaaucccagugacucgggaggcugagauaggaggaucacuugaggcuagggguucgagacuagucugggcaacauggaccccaucucuaaaaaaauaaaauauauauauguauguguauguauguauguauuuauuuauuuuugagacagggugucgcucucuugccuaggcuggagugcaauggcaugagcucagcucacugcaaccccugccuccuggguucaagccauucuugugccucauccucccgaguaccugagauuauaggcaugcaccaccaugcccguuuaauuuuuguauuuuuaguagagacagaguuuugccauguuggccaggcuggucucaaaacuccugaucugaagucaucugccugccuugaccucccaaagugcugggauuacaggcaugagcacccagccucuaaauguauuuuuaaaaaauuagcgagcaugguggcgugcuccuagagucccagcuacuugggagggcaagcugggaggaucacuugaucccaagaguuugaggcugcagugagcuaugauuuugccaccacacuccagccugggcgacagagcgagacccugucccuuuuuuuuguuuuuuuuuugagacggagucucgcucugucgcccaaucuggagugcaguggugcgaucuccgcucacugcaagcuccgccucccggguucaugccauucuccugccucagccuccgaguagcugggacuacaggugccugccaccacgccuggcuaauuuuuuuguauuuuuaguagagaugggguuucaccguguuagccaggauggucucaaaucuccugaccucaugauccgccugccucggccucccaaagugcugggauuacaggugugagccaccgcgcccagccgacccugucucuuuaaaaaaaggaaaaaagaagccgggcuugguggcucauaccuguaaucccauuacuuugggaggccaaggugggcggaucacgaggucuggaguucgagaccagccuggccgacauagugaaacccccaccuccacuaaaaauacaaaaauuagcugggcacgguggugcgugccuguaaucccagcuacucgggaggcugaggcaggagaaucguuugaaucugggagauggagguugcggugagccaagaucgcgccauugcacuccagccugggcaacaagaacgaaacuccaucucaaaaaaaguaaaauaaaauaaaaaaagaguagcaaggacaacugguaauguuaaggcuauggcccauugaggcuccauucauagcaaugaguuggagacgccaagaagcaaagugacuugcucaagggcucagaguaauggggcagagccaggauucggacccaggccuggcuggcccugaagcccuugucuggagucaugugcugccugcagcuguaucuggaguggggggcaguuuggguugcaggaccuggauggggcuugaggaccuccuuggagauguugaaggugacaccuucuuccccucaguggcauucacaacugcccauggcugagcaaaguuccugcaaugacucuaggggaaacuugagccccaugcugcgcagagggacccauuuggagagggcaggagcuccgaugucagccagacuggguuuguggcugagcuccgccacaccccugcaguaugaccuauaccuccagggccuuaucaugcaggguuuucagaggaggguggcugaaggaaguuuuuuuuuguuuguuuuguuuuuuuuuuuuuuuuugagacagagucucacucugucgcccaggcuggacugcaguggcgcgaucucagcucacugcaaccuccgccuucuggguucaagcaauucucugacucagccuccugaguagcugggauuacaggcacucgccaccacgccuggcuaauuuuuuuguauuuuuaguagagaugggguuucaccaucuugaccaggcugguguugaacuccugaccucgugauccaccugccucagccucccaaaguacuggaauuacaggcgugagccacugugcccggcccugagggaaccuuaauuccccuguacucucugccuccccagcuccaaaaccaacgcccucaaugucucccagaagaugauugagauguucgugcggacaaaacacaagaucgacaaaagccacgaguuugcacuggugguggugaacgaugacacggccugggugaggcugcggcaggcgcugggugcccugggguccccuggggcccggggagcaucgcacugaggccucugcuucccugcagcugucuggccugaccuccgacccccgcgagcucuguagcugccucuaugaucuggagacggccuccuguuccaccuucaguauccuuccuggcagagauguccccaugaagggggcugucuccuucugucauccuuggggcccaggaaagucuaagucaugacucuggcuggcugagguucagaucucagaucugccaaggcugggaaagucaccccucugagccucaguuuccccaucuguacuguggaaggcacaaaguugccuaccccauggagaugcuguaacaauacagaagcaaaaguaccugauuugguccgggcauggugguccaugccuauaaucccagcgacuugcgaggcugaggcacaagaaucacuugaguccgggaggcggagguugcagugagcugagaucuugccacuguacuccagccugggagacagagugagacuccgucuuuuuuaaaaaaaaaaaagaaagaaauaccugauuuguauucaggagguccaaaauucaugcacaaggggaucaccucacacaggacugggcauacagucagugcucaauaaauggcagugugugacagaagugucaccauuguuccuacagccacuugaaccugggcgcaggacauuuuaugguaauuuggacauaaaaggcucauguguggcccaaaacugaaauagaauaggacucucguaaguuaaaaaaggaauaaauggugagaguuuuuuccaggaggacaagacaccccuggcucuuuucauuuugaggagaguggccccagccaugcaggaaaggggaccuuuuuuuauuuuugcuccuguugcucuuguugcccuggcugagugcagugaugcgaucuuggcucauugcaacuuccaccucccagcuucaagcgauucuccugccuuagccucccaaguagcugggauuacaggugugcaccaccacaccuggcuaauuuugaauguuuuguagagauggggucuugcuauguugcccaggcuggucuugaauuccugggcucaagugaucagcccaccccagccucccaaagugcugagauuacaggcaugagccaccauacccggccccauucuguuuuaaaacauaaauuagauuccaucccaucccaucucugcuccaaaaccucccauggcucccuguggaucuuauuuauuauuauauuuuuuuuugagauggagucucgcucuuguugcccaggcuggagugcaguggcacgaucuuggcucaccgcaaucuccaccucccgaguucaagcaauuuuccugucuuagccucccaaguagcugggauuacagacaugugccaucaggcccagcuaauuuuguauuuuuaguagagacaggguuucaccguguuggccaggcuggccucgaacuccugaccucagaugguccacccgccuuggccucccaaagugcuaugauugcaggcgugugccaccaugccuggcauaccaagagucuuaaagucauccgguaccagcauccuauuuugugauccaugcugaggggaauuugugugucagagagggcaagugacuuggccagggucacauggugcgucccuaggggugccgggucuccucugguaucgggaucggggaagccaccuguuucccgcucacucgugcucuacuagccuucuccuuagcacccccaccagaucuggaaggacuuuucagccucauguaaguccccuguggggaaauucuuauucaccuucaaagagaagggucacuucugggaaaaagcuccaaacggcacagaaguaaucuagggagccuuaaagccuccucccuuccuaccucgccccgagcaauuccucauuuaugugugucuugggagcaugggggcugguggagaugcacaugcugcuaggcagcuccagcugacggcagugaugggggauguucaggacacugaggguggccgggcccaguggcucaggccuguaaucucagcacuuugggaggccgaggcgggcagaucaccugaggucaggaguuugagaccagccugcccaacauggugaaaccgcgucucuacuaaaaauacaaaaauuagcuggccaccuguaaucccagcuacuugagaggccgaggcaggagaaucgcuugaaccugggagguagagguugcagugagccgagaucucaccauugcacuuagagggguggggcugggaacaugcucagggcagagggaaccgcuuaugggaugccucacaggcagcagugaacuugggagacaucaguggggccucaccugcccggugagcaucuggggucucucucagggugauaagaggggcagacccccacaggcugcucugacugcucccuccucccggguaugcagccagcagaaaacugagcuuccggucacagagaacgugcagacgauucccccgccauaugugguccgcaccauccuugucuacagccguccaccuugccagccccaguucuccuugacggagcccaugaaggugggugaggccugggagagggaggggugccugcagccaugaggauggugguuagacaccaggagggacuuccaaccacagaggcuggggugccuagagguaaguucccagagucugaggcagaaaugggggagcuauagucauggggcacggggugacccaagccccagaggcugguguucuuuacuuccccugcagaaaauguuccagugcccauauuucuucuuugacguuguuuacauccacaauggcacugaggagaaggaggaggagaugaguuggaaggugagaggcugcagcaggugugaguagcaggcggguguggacaggaugucuuggaacacaccugcacugggucugggggucucuaccuccauuugauaccccuggaacccugguugggguaggucauggcauuggucauugaacagccguuucccaguugucugcugugacugaugggguggcagccauugggacgaugguccaggcaacauguugaguccugccucccccaucuccaacguucccugcguuccuuucuuucuugcuugcuugcuugcuuuucuuucuucuucuuuuuuuuuuuuuuuuugagacagagucucccucugucucccaggcuggaguguaguggcaugaucucggcucacugcaaccucugccucccggguucaagcaauucuccugugucagccucccgaguagcugggguuacagguaccugccaucauaccagguuaauuuuuguauuuuuaguagagacgggguuucaccauguuggccagacuggucuugaacuccugaucucaggugaucugccugcuucagccucccaaagcgcugggauuacaggugugagccaccacgacccgcucccucuucccuuucuuccugccuuugaccucgcugcacccucagccuggagcauccaucccucuuggacuccccaggcccugcugggccuucacaucccagaccugaauuagcugugggaccucgaguggacuacuuacuucucugagccucaguuuacccaacuaugaacagggaauugagaccagcuccuccuuauaucucaguacccaaaucaaaaguccccccucuagccaggcguggugguguacgccuguggucccagcugcucgggaggcugagacaggaggcucgcuagagcucgaaagguggagauuguagugagcugugaugaagccacugcacuccagccugggugacagggcggagacccugugucaaaaaauaaaaauacggccaggugugguggcucacaccuguaaucccagcacuuugggaagccgaggcgggugacucacuugaguugggaguucggaccagccugaccaacauggagaaacccugucucuacuaaaaauacaaaauuaaccaggcgugguggcacauaccuauaaucccaucuacucaggaggcugaggcaggagaaucgcuugaacccgggaggcagagguugcggugagccgagaucgugccguugcacuccagccugggaacaacagcgaaacccugucucaaaaaaaaaauuaaaaaaauaaaauaaguaaaauaaaaagucccuccucuugagaagcccucccuguuuuucaagaaggaucaaagugggggccaggagaaugugucuguaucugacugugugccuccacacuggggacucuuuuuuuuuuuugaggcggagucucgcucugucgcccaggcuggagagcaguggugugaucucggcucacugccagcuccgccucccggguuugcgccauucuccugccucagccucccgaguagcuaggacuacaggugccugccaccacgcccggcuaauuuuuuguauuuuuuaguagagacgggguuucacuguguuagccaggauggucuugaucuccugaccuugugaucugcccgccucagccucccaaagugcugggauuacaggcgugagccaccgcgcccggcccacacuggggacucuuugggggccaugacugggaccucuucagauccuuaacacuggguccauggcggggaauguuugcugaaugugugaaugguuucugcuuggcaaacuccucuucacccuuuagaacccaccccagauguccccucuucugagaagcccuccagggauaugaagggccuguugggguaaccucugccugaacagcccuucacugacccccgccuccccggcaggauauguuugccuucaugggcagccuggauaccaaggguaccagcuacaaguaugagguggcacuggcugggccagcccuggaguugcacaacugcauggcgaaacuguuggcccacccccugcagcggccuugccagagccaugcuuccuacagccugcuggaggaggaggaugaagccauugagguugaggccacugucugaaccaucccuguacaucugcaccuucuugugcaaggaaguccuuggccuaaagccuugguucucaaacuggguuccuugggaccuccgggguggggggguuccaggaggcacguaggguaccuugcaggguccuaggagggaaacccaggauuccaggagggaucccaggaacugugggcacccauuuucugugucucccagcccauuuccacuccuaguuugucauggauaauuuuuguucuucccugugugauuuuugccaucaaaauaaaaauuugagacucguuaaccgaaguccacgccaa

SEQ ID NO: 191894 - RNA, 2630 nt, Homo sapiens
auggcaucuacuucguaugacuauugcagagugcccauggaagacggggauaagcgcuguaagcuucugcuggggauaggaauucuggugcuccugaucaucgugauucugggggugcccuugauuaucuucaccaucaaggccaacagcgaggccugccgggacggccuucgggcagugauggagugucgcaaugucacccaucuccugcaacaagagcugaccgaggcccagaagggcuuucaggauguggaggcccaggccgccaccugcaaccacacugugguaagcuccucaacuccuuuggauggccuaguacuaggcggugggagggacaagaaucucuccccagaaaucugacccagggugggucuccagggagaugcaggggagguccugaaacugcuccugggcccccacaucaagggaccuagguuccccuaccaggguuugugggccccuaacccaguccagggcacugguguaggggcaggguguuaaaacucuccagaucccccaaaucggggaccucaguaucccccugggacuuaggugaauuuauaaauucuuuccagggcacuggugucgggggccuugaaacuccucgugggcaccaguccugggggaguagaaaucccuauucaggguugaagggggaccucaccagacccugaaaaagggggcuuuugaaauuuucacuucaucccuaagaaacugaaauauucaccuggguccugauaugggggaucuugaaacucucgcugggcaugucacuugggcggggaaaucccacugcauucuggauuugguagggcccucuaacuuuucuugggccauugcucaggcaaucuggaaauguccacuaaacuuugguuaucgauagccuccaaguuuccacgugggguggccucaaaacucccauuuugaggacccacaugcuuauggguggcccugggagagugugugguuguggcuguucuuuaagguuggagaccauggugcagagaggguuggaagaaaaccugaaagggguuugcauuuaagccccucuguccccaggaccuagggaggaggcccaggucccaggggcagcagccaaacuccccaggccaaaaccccagauucuaacucuucuuagauggcccuaauggcuucccuggaugcagagaaggcccaaggacaaaagaaaguggaggagcuugagggugagaaagggagaagggagagggccggggaggggugagucagguauggaagagggggugggggcagggagaccagggcuggagguugggguaagggggagguucugucccagaguggagcagggccccagcauggccacaugcugacccgcccccuguuucuguccucccacccuaccaggagagaucacuacauuaaaccauaagcuucaggacgcgucugcagagguggagcgacugaggucagagauagccuucccccgcuacccuccaccugccacauuccucucacccccacaucccuagcccaagacccaggaucuccuuugcucccaaaauccccauugccccaagggauaaaguuugagucccacaaaaggauaacuuagccccuagggucacagagccauggguggccgcuguccauucccuccccggugacuuggauuggggcggugcggggggaacucccgggggcggugggcuuacagggagggcggcaggagccaggacgagcagaugccugauuugccaucuguaccgcagaagagaaaaccaggucuuaagcgugagaaucgcggacaagaaguacuaccccagcucccaggacuccagcuccgcugcggcgccccagcugcugauugugcugcugggccucagcgcucugcugcagugagaucccaggaagcuggucagugaggagggggcggccccgggagggagaagaaagcuggggaagcggggcggggaagcagaggcuccgaagucuagagagagaggcugcaggggaagggacugggcgcagaggugaggggccuuggggaaggagggagaauccagugagaaggaugcccuggaucggggacgggcugauagcuguauggggcggggcuaucaaugggggcgggucuaucgauggaggggaggggcuuauggauggguggggcgggucuagcgaugggggcggggcuuggggccgggcuuggagcggggccagugucugcugccuccagucugcccugagucccucuucugguccuuuaggcacaucuuggaagguccguccugcucggcuuuucgcuugaacauucccuugaucucaucaguucugagcgggucauggggcaacacgguuagcggggagagcacgggguagccggagaagggccucuggagcaggucuggaggggccauggggaaguccuggguguggggacacagucggguugacccagggcugucucccuccagagccucccuccggacaaugaguccccccucuugucucccacccugagauugggcauggggugcgguguggggggcaugugcugccuguuguuauggguuuuuuuugcgggggggguugcuuuuuucuggggucuuugagcuccaaaaaauaaacacuuccuuugagggagagca

SEQ ID NO: 191895 - RNA, 27455 nt, Homo sapiens
gaaaaccaaccaggaacauuuauuaaaaaacuaagcaaguuauccccaagagggugaagcaccgcuggcugguucugacauucgauucaggcugaaggcacggcaacuccuccagcccuugcugggaaauguccuacccaggccacgggcagugccccagugcagcuggguccccuaaaagcccccaaacacaugaucccaccaaaggcuugaacagagcaacuucaucaagcaggcagggaccacaccugagacacaagggcaaggagguaaagcacaggggaccgggagugggccagggacacccagcccccgucuccaacuggcgcccccuccaggggggcuaacauguggcguggggccaccaggaccugugcuugccccugguggcggaagagcuacccucccucuugggugguggggggauguugucugcacacagcucagacgaccgaggguacaggaagaaucaaacucagucaaccauucuucaacccaacugggagucugugaggccuggcacacaggugcucaauaaacacuuguggcaugaagaagugaaggaaccgaucuuguucaucucugugccccagcacucggcauguagcccaugaucgaaaaugcagacugaacaacugucacacucuuuuguaucacuagugcccggcacacagucagugcucuucaggugugugggaaagaagccaaugagugagaaguucccacaccgucuagcagugaggaaaaaaagaaaaaaguaaaaaguaccuuguuuacucccauucccaucccauagcucagcucccugcacacagcaggugcucaguaaguguaccgaaucaggaacuuaucuuugugacaugagugccaggcacacaguaggugaccaauaugugcuugaauaaauggauagaagcaucuuauuuaucucaauauucccagagccugggcugggcacaguggcucaugccuguaacccuagcacuuuggguggccaaggcgggcagaucacuugaggucaggaguucgagaccagccuggccaacauggugaaaccccgucucuacuaaaaauacaaaaacuagccagaugugauggcacgcaccuauagucccagcuacuugggaggccgagaaacaagaauugcuggacgcugggaggcgcaggcugcagugagccgucacaccacugcacuccagccugggugacagagacagacucuacucuuaaaaaaaaaaaaaaaaaaaucccagagccuggaauggcacccaacacacaguaggcacucaauaaauccuugaaugaauuuuaaaaaugaauguguaucacuagugccugauucuuaaucugaucaguaacugcuugaugacugaaucaaucgcugauggagggaacaauuaugccucauucacugccguaacaugggaaccuugcauacagcaggugcuuaauaaaugcugggcacaugaacagaugaagagggcuugguuccucccaauuccccagggccaagcccuguugcuggcaugcaguaggcacuccauuaaugcugccugugugcacgugauugcuuagcaagagcuggcuggacaccaccccacacgagagcccucuguggccugccaagggguccagagguggaccugauguccucaguaagcacguggagccugggccaccgauggcugcuuuggcuuucuggcugcuaccccucagaguucaucccgggcagcacuguccaguggggacuggagcacguccgaguucuuggccucacggcucagugccugcugcucccgcaucuucugggacuuggcgcggucccagucggucuugacgugcucauuguuccauacgacugaggucucggugucacucacauagccaucgucuccuguguagugugugggguagaugagcagcggcuccacagagaaggcaugcagguugcggagggagaagugggccuuguacucggaccuggggggaggaggaggggagugaggggcagcaauggcuucaggggacgggacagcuggaggaaaaauugggggugaagaagucagcggggacagauuaaaacguaagugugcaggggauacaaauggagacagaucugcgagggggcaaacggagggagaaguaggcaaaagaagagacaucuucucggaggccgugagucucacauccccauucucccaggacagacccaccgugaaaccccagcccagcagccgccugccccucucacacuggguguuugucgaacaugacgggcaggaacucguccacaggcagcaucuuggagagcggcucagcagccagcaguuugcgggcgccuugcagggagaucacguaggccaggguccaguaggaauagucggccuccaccagguuccucacgcgaggcacagccuucucggggugcuccaccugcauccgcuuccggcccacauagcuggggugcaagaucgggccugucacucuccucccgcccuccggagggagcuugcccagaaagccagggaucuaguuaccccgucagguccugggaugggagcaggcucagcauguuugcagagcucugugacuggauggagugaaugcaggagcccaggggucuggcggucaugggggagaagagugaguuuuuccaaagggcgugagggagccauggaggaucuggagcuggggagagcaggaucacgcagacguucucugaggcugaagcugcucugaguucagaggacaguggggguggaggugggcgaggugcccugaugggggggcagucaggaauggaggggugcaguuacuauucacauggggcaguguucccagaaugcagauuagggcacugcacauggaagggaaaaaagagauggaggaagggagaggacaaaccagcccacuuacagaagagaaggacggcuccagugcuggaaacauguugguggcacucccauccaggggcuugucuaagaccaggcgcccuggccacgcccccacacucuucggccacaccuccagcucugaccacacccccaugcucuucagccacgcccacaggcugcccggucaaauuuuagccacauccaccuccacaggccucagucaagucucuaagccuugaccaagccugcaggcuuccggccaggucccuugaguucugggugauccuuccaacgcccuucccuauaggcuacagcccugacagugccuucaggcccaggaaccacgugagcccuccugcuacgcuuccaaggguuggccacgccugccacccugaccacacccagacauacaggcucuaggcucagcugcagcgcuguggccacgcccguaggauucagcuccacuccgccucccagccccaccucuaagcccuggccauguaccuaggcuccaguuccaccccaccuucaagccccgccucuaagccaugacccauccccaggucccagcuccacccugcccccacccccaccucuaaguccuggccuugccccaggccccagcuucaccccauccucagacccccacucacaugaggucccaguccaggcccucccgcuccacaucccgcaugagguucaucagacgucucuugaagaagaucucaaaacgcaggucauccucaaacacaagcgauuucugcagcccccgguccaccaccugagggaggaagccccgccacaucacagggaggccaaggccaggccugacccuaaagcacagagcuuugcuuugagaagguuugaaagacccguagagaagccagugcaucucccugccucuccuagcuccagggacaucuggacauccaaaccucugcccucugccguccauaauggaucucagaagagaaaggccucccagccccucaaaugcccacgccucaugcaccucccgccuugcagccgcacacccccauuuggcuucacauucgauaacaaguuuuucuuuucuuuuucuuuuuuuuuuuuuuugagacggagucucgcccugucgcccaggcuggagugcaguggaacgaucucaacugcaaccuccgccucccagguucaaguaauucugccucagccuccugagcagcugggauuacaggcaugugccacuacgcccggauuuuauuuuucuuuuuuugagauggagugucacucuugucgcccaggcuggagugcaauggcaugauuucagcccacugcaaccucugccuccuggguucaagugauucuccugccucagucucccaaguagagggauuacaggugcccaccaccacacccagauaauuuuuguauuuuuaguagagucuagguuucaccauguuggccaggcuggucuugaacuccugaccuaaggugauccgccugccucggccucccaaagugcugagauuacaggcaugagccaccacgcccagccauuuuucuuuuuucugagacacgguuuugcucugcuguccagucugcagugcaguggcacgaucuuggcugacugcagccuuaacuccugggcucaagccacucucccacuuuagccucccaaauaguugggaccacaggugugcgccaccaugcccggcccugauggcccaaguucgaagccuagucagacacccuccuccaaucacagccucucccucugaggguggaugaggaugccugggcuggugagugcccccagcagcacugggcaggugcugguuuaaaguggcucuguggccaugacuucuaguacuaaacaucaagcacagagaccaggcugggaguaaugaggauuuguuuacaggucccaggccccagacaccaccugcugcucaaaagggcucaccccuacccccaggcucaguuuccacauuugcgcaauggaaggauggcagguacaccugggggugauacagcugguguggcgcaucauucacuaaagagaggccaugggucccauggcugaggcuggaugccuagccggggcuuuggggaacucuuucaaccccuuucccguccaaaucuccgaugagaucuagagucauaacucuggccccgcccaucacucaggacacaccuccuuccagauguuguaguggcucaggaagcagcccagcucacccuuggugaggggccggccgugguaggggucccgguagccaggcagcaucuggauccccagcgccuccaccuggcugguguucauggcucuggagaggaggaggagagggucacgaagaagguucacccugccugccauucugccauccccggccauuccaccacccccugcggcguugagcagcugguccaccucuuguagcacuggcaccccuuccgggcacauggggccucacucaccugcacaugguauacacucgcgggcaaaccugcucuccuccucuccuggggucugacugacuuaccccuccacaguccccaccagucuacacuggcagcaugcaaaccuacccauuccccugggucaggacucacuugccuuccauggucuacaacugugaggaucugccccuuccccagggucccauucacuuccccuucaggacgcccacugacgaggucuacaucuguuuggacaccacgcccgcccccaucugaaucacuugccgucuaccagcgaggucuacacccacauccacgugcggacccgcccccccacccccaggccucggacucacuugccguccacggccuccaccagccggcacucgaucuccugugccugcagcgcccgcagcaugcgcucccgccgguccugccgccgccucagguugaucaugaagaccugcagcccggagaguccccagccagaucagccccugcaaacaagggcccuccagcccccgccccgccuccagggaaggcccagcucaccucgucgaagcccaucuuguccggugucuuggugggagccgagaugaagcgggagggcucugcgggcgggugcuucacuguggggcacagacguugaggagucgcugggguaaggagccuccagccucucuccaacacgcuuuccccacccacuccauggcucccagucagacuggcucggcccacaaagucgaccuggcuccgcccacaucagcgcugcccucuaggagccccucccaugucauuugaacccugcacagcagcccaaagcccuggccacaccccaggccccagcuucaccccgcccccaguccugccucucagcccuggccacaccccaggccccagcuucaccgcgcccaaggccccgcuacucaacccuggacucgccccaggucccagccucacccugcccuuagccccgccucuaagcccuggccacaccccaggcuacagcuucaaccugccccccagccgcaccacucagcccuggccacgccccaggccccagcuucaccccacagccucccccagccuugccucuaagcccuggccaugccccaggcuccaacuucacccugcacccccccagccccaccuuuaaacccuggccaugcaacagcuucgcuccgacccccagccccgcuucuaaguccuggucacaccccaggccccagcuucacccugcucccagccccgacucucagccguggccacgcccugggcuccagcuucacuccgcccccaacccugccucuaagcccuggccacgccccaugcuccagcuucacucuaccccccagccccaccucuaugccccugccaacccaaagaacccccauuccuaccucagggccuuugcacaugcuggaucccugcuugaaauacccuuccuuucccugcucuguaacguuacuucucagcuaugaugcccugggcaugggggucacccuccccacucccaccucccuaggcugagccaggcaccuccucugggccccagcagcaccuggacuugcaccaccaaagcucgcauccuugcugcccuaacccccuggcccugugccugucuguugugagcccuuugggaaggacaccagguaugucugcucacacugggccccuagugcccaacacaggggcuuggcacacagcaggcacucaguaauugcuuguagaaugaaccaagaaaugauggcaugcuguauauucuugauuggccugggccucagcuuuccucaucuauaaaaugggccaauaagccacugagagguuucacaaagagaugucaugagaucaugcacuaugucauggggugaacugugucuccccagugccaaccaccaguaccccaggauaugauccuauuuggacacaggguuguguacagaggucaucgaguuaaaaugaggucauuagggugggcccuaauccacauggcuugugugcuuuuaaaaggggaaaucuguagcuccuugggaggcugaggcagaaggauugcccaggaguucaaggcugcagcgagcuaugauggugacacugcacuccagccugggugacagagacuccaucuccaaaaaaagcaaaaaagaaggccgggcacagugguucaugccuguaaucccagcacuuugggaggcugaggugggcagaucaugaggucaggaguucgagaccagccuggccaacauacugaaacccuguccccacuaaaaauacaaaaaacuagcugggcgcaguggcucaugccuguaaucccagcacuuugggaggccgaggcagguggcucacaaggucaggagaucgaggccauccagguuaacacagugaaaccccaucuccaauaaaaauacaaaaaauuagccggaugugguagcaggcgccuguagucccagcuacucgggaggcugaggcaggagaauggcgugaacccaggaagcggagcuugcagugagccgagaucgggccacugcacuccagccugggagacagagcgagacuccgucucaaaaaaaacaaacaaacaaaaaauaauaaaaauaaaaauacaaaaaauuagccaggcgugguggcaagcgccuguuaaacucagcuacuugggaagguggggcagaaucacuugaaccugggaggcggagguugcagugagccaagaucgcaccauugcacuccagcccaggcgacagugcaagacuccaucucaaaaaaauaaaaaccaaaaaaaccaaaaaccuaaauuaacaaauuagcugagcaugguaguggcaugcaccuguggucucagcuacuuaggaggcugagguggaaggaucgcuugagucaaggagguugaggcugcagugagcugugauuuugccacugcauuccagccuggguaacagcgagacucugucucaaaaaaaggaaaugacaacacaaauauaugugagaacuuaaacugggaaaacucugguagccacagagacgcuucucaggcccguuucugaugggaguuggugauaaauggagacccaccacccccaacuguagccgggugggaccuggacaccuaaguaugccacucuuggguguuguggggggccugccccagugauugugcagucuccaggugucaccucaaaaagacucaaaagucucccccaggccaggcgcagugacacacgccuguaaucccagcauucugggaggccgaggcagguggaucaccugaggacaggaguucgaggccagccuggcuaacauggugaaaccccgucucuacuaaaaauacaaaauuugccaggugugguggcagguaccuguaaucccaacuacucgggaggcugaggcaggggaaucgcuugaacccaggaggcggagguuucaagugagcccagaaugcgccacugcauuccagccugggugacaaagugagacaccgucucaaaaaaaaaaaaaaagucuccccaaaacacaaagggcagggugcuauuccaucuugagccaccagggggagccgcagauagacucguucagaaaucgguaaggcuggggaaacugagccccgggacagaggccucaccccucccacccagucuccaucuacgcaguggugggaauggcaguggcuuuggcagggcuuucugcgcccagugcagggcgaggcccacauuagcaauggcugagaugggagcaucaucccuagacaaccucaauuacagcucagcccugcgugcuccuccaguuuuagagggacggcugcugguuucauaguucauggauuuuuuuaaaguuuuauuuauuuauuuauugauacagggucuggcucugcugcccaggcuggagugcagugaagcaaucuuggcucacugcagcuucgaccuccugggcucaagggauccucucgccucagccucccgaguagcugggaccacaggugugugccaucacgccuggcuaauuuuuguuauuuuuuuuugguaaagacaagguuucaccauguugcccacgauauucucaaacuacuggguuccagggauccgcccaccuuggccucccaaagagcugggauaauuauuuuuuauuauuauuauuuuugagacagacuuacucuauugcccaggcuguagugcaguggcacgauuauggcucacugcggccuccaacuccugggcucaaaggauucucccaccucagccuccugaguagcuagaauacaggcaugugccaccaugucggacuaauuaaaaaaaaauuuuuuuuuuugagacggaguuucacucuguugccaggcugaagugcaguggcacgaucucggcucacugcaaccuccgccucccagguucaagugauucuccugccucagccucccaaguagcugggacuauaggcauucgcuaccacacccagcuaauuuuuuuuguauuuuuaguagagacaggguuucaccauguuggucaguauggucuccaucuuuugaccuugugauccgcccgucucguccucccgaaguguuaggauuacaggcaugagccaccgcacccggccaaaauuuuuuuuaauauagagauggggucucacuauguugcccaggcugaucuugaacuccuaggcucaagcaauccucuuacuuuggccucccaaagugcuggaauuacagguuugagucaccaugccuggccuauacaugcaguucuuuagugaaaacuugcuguccucucaguuuucauguccucuauagcuccugacuguccucagggggaaggucccuuccucagccuggucucugaggccauccacccuggcccuggauaccagccccaggggaucacugaccuugccuguuccccagguucacgucccuuccagccucccggccuuugcccacacuaccaccuccugcugcaauccccuuuauggugaacuccuacucaaccugccccuuaaugccaccuccuccaggaagcccacccgacaaccccaagcaugcuguguacagcuaccugcaaaccagcacucugugagagcagacacaacccuccaccucguucacacgugccguugcacccagcaccccccacagggacuugcaucugccuggcacucagucagugcucaugggacggauuugagacaucagugaaagggaggcaaccuggcaccucccagggcggugugcaggcagacucacccaugaccuccagcugcacaugcaugaagcucucggccucauccuggagggugcugugggcgcgcaauggcacuggcaagaauccguacuccuccuuguugcacacauacaucugaaccucugcagugggcagggaagcaacagacaaauguaaaaacaggcgaggcccaguggcucaugccuuccaucccacggcuucaggaggccaacgcaggaggaucgcuugaggucaggugucugagaccagccugggcaacagagcaagaccuuauaucuacaaacaacuuuuuuuuuuuuuuaagacagagucucacucucccaggcuggagugcaguggcacuaccuuggcucacugcaaccuccgccucccggguucaagugauucuccugccucagccucccuaguagcugagacuacaggcacaugccaccaugccuggcuaauuuuuuguauuuguagagacgggguuucaucauguuagccaggauggucucgaucuccugaccucgcgauccaccugucuuggccuccugaagugcugggauuacagguaugagccaccacgcccggcucuacaaauaauuuuaaaauuagcugggaauggugguaccugccuauggucccagcuccucgggaggcuguggcaggaggaucacuugagcccaggagacuugaggcugccaugagcuaugauggcacacugcacuccagcuuaggcaacagggcaaggcccugucucaaaaacaaacccaaaaaaaaaacaguaaaaaugcauguugaggcacaaaaaggaaaguuugacaaaaugugaguuaaguuacuuccuucuacaucuauccuuuucuggaugguuuaaauuuugaugaguguguaucuuuuuuuuugagacagagucucguucugucgcccaggcuggaguucaguggugccaccucggcucacugcaaccuccgccucugggguucaagcaauucuccugccucagccucccaaguagcugggauuacaggcacccgccaccacacccagcuaauuucuguauuuuuuuuuaguagaggugggguuucaccacguuggccaggcuggucucgaaauccugaccucaagugauccacugagcccagccaaguguguaucuuuuuuagacuaaaaaacucaaugaugcucuuuuaauuuaauuuauuuauuuuuuuugagacagagucucgcucugucgcccaggcuggauugcaguggugugaucuccguucacugccuccuggguucaaacaauucuugugccucagccucccaaguagcugggacuacaggcacccaccaccaugcccagccaauuuuuguauuuuuagcagagacggguuucaccauguuggccaggcuggccucaaacucuugaccucaugugauccacccaccucacccucccaaagugcugggauuacaggcaugagccacuacacccggccucuuuuaauuuuaauuggucaauuucuucuauaaagggccaggugguaaguauuuuaggcuugugugccagacgguuucuaucucaaugacucuguucugccuguggcacuugaaagcagcuacagacgacacuuaaaugaaugggcuuggcuggguacugaugacacuuuauugaugggcaaugaaaucugaauuucauacaguuuucaugugucacaauauucuucuucuuuugauucuuuuccccagugauuuaaaaauguaaaaauuggccgggugugguggcucaugcccguaaucccagcauuuugugaggcugaggcgggugaaucaccugaggucaggaguucgagaccagccuggccaacaggcaaaaccccaucucuacuaaaaauacaaaaauuagccaggcgugguggugcacaccuguagucccagcuacuagggaggcuaaggcaggagaaucaauugaaccugggagguggagguugcagugagcugagaucaugccacuguacuccagccugggcaacggagggagacccugugucaaauaaauaaauaaauaauaaaaauguaaaaauuguuggccaggcaccguagcucacguuuguauuccuagcgcuuugggaggcugaggugggaaggaucacuuaaggccaggaguucaagucuagucugggcaacauagcaagaccccaucucuacaaaaacauuuuuuuuuucaauuagcugggcauguaggcaggugccuauagccccagccagucuggaggcugagaugagaggauugcuugagcccaggagguugaggcugcagugagcuacgaucacaccacugcacuccaggcugggugacagaguaagacugugucucuaaaaaaauaaaaauaaaauauaaaaguuguuguuagcuuguggccauauaaaaguaauuaguggggccaggcgcgguggcucacgccuguaaucccagcacucugggaggccgaggugggcagaucacaaggucaagagaucaagaccauccuggcuaacacagugaaaccccgucucuacuaaaaauacaaaaauuagccgggccugguggcuggugccuguagucccagcuacgcggaaagcugaggcaggagaauggcgugaacccaggaggcggagcuuacagugagccaagaucgggccacugcacuccagccugggcgacagagcgagacuccgucucaaaaaaaaaaaaaaaaaaaaaguaauuagugggccagguuuggccugcaggucaguuugccaaccucugguuuccaguaaacaacaagucaacaugaggcugugcugucucuuuaaauauuuguuuucccaauuaaacaauuaauauaugcucaacuguagaaaauuaggagaauggcccaggugcaguggcucccuccuguaaucccggcacuuugggaggccgaggugggcggaucaccuggggucaggaguuugagaccagccuggccaaccuggggaaacccugucucuacuauaaauauaaaaaugagccagacaugguggcguaugccuguaaucccagcuacuugggaggcugaggcaggagaaucucuugaaccaggaggcagagguugcagugagccgagaucgcaccacugcacucuagccuaggugacagagcaagacucuacuucaaaaaaaaaaaacaaaagaaaauugggagaauauagaaaaguaugaagauugaaauaacauuugggguugaucauggaaaauuguguaacggguucaauguauauuauuuggggauggaugcccuaaaaucucuugacucaccacuucacaaucuaugcacgugacaaaauuacacuugugcuccauaaauuuacacaaauuaaaaaauaauaguaacaugcaaucaauagguauuuuuuucuugagaaggauucuuacuuuguugcccaggcuggagugcaguggcaugaucucggcucacugcaacuuccgccucccauauucaagugauccucccgccucagccuccccaguagcaccaccacguccggcuaauuuuuguauuuuuaguagagaugggguuucaccauguuggccaggcuggucucaaacuccugaccucaaaugauccacccgccuuagccugccaaauuguugggauuacaggcauaagccacucugccugaccaaccaauagaucuuaaagagcuagggaaugaagcuaaccagcaaagccagggcuggagagaaacgggguccuggagacauuaucugaacaccuagauacagcugcaccugaagucagcccugcgcugcauuguuuggguucugugaaucuucaguguguucugaacuggcuuagugcaaaacccaaagaaccaggcagaugccccugcgauggcagaccccucauguacguaccugccugcuugcaggagaaggcaaagacgaugaugucgucaaaggaccagguguagucagggugagguggguagaaggccagguuccuggacgccgccuuccgcaggucgaucaggaaggucgagugcaccaugggaacugcaaagcagccccggcggucucgcuugcggauagggauguaggcaggugugcgcuuguaguagcccuguggggagagagcgagaguuccgcguaggggucuugaaaggugaggauggagacccgugauagugggcggcaugaaacaggaccagacagacagccaggcacagcagugugcgccuguggucccaggaccccagacucaagcccagugugggaccuguggccaggcauggccaauaagaaagagccuuguauuuucccagcuucaguaaugaguucagagguaguguggagaggagacuagcaauggcccaaucagaauggaugauggcuagacgcugcugggaucacucucaagcugucugagaaugaacccacccaaaggauggagaaagacaguuauccaaacaccuggaucaagccaugccugaagucccauccugacaccaccacuugcuagcugugugacuuuaggcaagucacuuccucucuguguuucuguuuccaccucuggaauagcauggugggggacaaucaaggacccucuauucuucccuccugucuggccucagagggcuguuuaaagauuaccauaaugaguuuuuguuuuguuuuguuuuugagaccaagucucacuccgucacccaggcuggagugcaguggcgugaucucggcucacugcaacuuccgccuccuggguucaagugauucucaugcuucagccucccgagcagcugggaggacaggcaugugccaccauacccggcuaauuucuguaauuuuuuuuuuuuuuaguagagaugggguuucaccauguugcccaggauggucucaaacuccugagcucaggcaacccgccugccgcagucucccaaagugcugggguuacaggugugagccaccgugcccagcuuccaugaugauuuuuguaaaacacacaccacgagguugugugacaguaaguuacacucuagccacggcaccccccugcucagcccaguccccacaguccccaggcccucacucuaccugggaagucauuccacaccagaaguuggaguacgcagcccgggaauccagcaugggggcgaccaccgucuuguucucagcgaugagcaggcucagugugucaggguugaggaucagguuguccgcaucuacaaacugcagaacaccccacaaagcaucagcaugggcugccaggucaggcuaccauucagaacagcuggggcaaaggccagugcccugggggucuggcaaagaccucuggaagcacccccuacaccggaugaaaugaagcagggaccccguuuugggggccugcaggauccccuggaucauggaaauaaagcaaaggucuucaguuccuucaaagaaaauucuaggcacugagauagcccugagaaauaaaugaacaaccaaugagcaagaagguagcaaaaccuuuuuuuuuuugagacggagucucgcucugucacccaggcuggagugcagugguauggucucagcucgcugcaaccuccgccuccuggguucaagcgauucuccugucucagccucccgaguagcugcgacuacagccgugcaccaucacacccggguaacuuuuuguauuuuuaauagagacaggguaccaucauguuggccaggcugguuuuaaacuccugaccucaugugauucguccaccucggccucucaaagugcugggauuacaggcaugagccaccaugccuggccuacuauuuuacuuuuucuucauuuuuuauuuuuuaaagggauagcaucuugcugugucacucaggcugaagugcaaugguguaaucguagcccacugcagccuggaguuucugggcucaagugauccucucaucucagccucucaaguagcugagcguacaggcacacgucaccaugccuagauaauguuuucauuuuuauuuuuauguuuguagagauaggaucccucuacauugccuagggugguuuugaacuccugggcucaaagcgauccuccccauggccuacaauaguucugagauuacaggucugagccacugcaccuagacuaaaauuaaauauauauauauaaaaucacacauagaaaaugauuagguccggacguucccccucuaccaggauguaaagacacagaagucaugauauaucacagaacuaccagaagguuuuuuguuuuuguuuuuguuuuuuugagauggcgucuccuguugcauaggcuggagugcagcggcgugaucucggcucacugcaaccuccaccucccauguucaagcaauucucccugagucucccaaguagcugggauuacagacacaugccaccacgucaggcuaauuuuuguauuuuuugguagagaugggguuucaccagguuggccaggcuggucucgaacucuugauuucaagugauacgccugccucggccucccaaagugcugggauuacaggugugagccauugugcccggucuggauuuuuuuucuuuuacugcugguccacagagaugcuuucuguuacccaggcaguaucguuuagaauauuuggauuaacugccaugaacaacaacaaaaacuagaauuccaguauccccuggcaacgugagaauaccauuuccacauggcaaccuucaguugcagaggggagguggcugggucuuaggacaagcccuguggucauguuacacaccccauccggucccucuggauguuugaaucugugaccuuugaauauuaaugcagaacaaacagccagaucacuguggcaguuccucaaaaagcuaaacauagaauuacuacaugauccaggaauuccauuccuagguaugaaccaagagaauugaaagaaaggacucaaacagcuucuuuguuuguuuguuuguuuuugagacagagucuugcucagucacccaggcugaagugcaguggugugaucucggcucacugcaaccuccaccuccuagguucagaugauucuccugccucagccuccugaguagcugggauuaaauacaggcgcgcaccaccaugcccagauaauucaaacaggucuuuguacgcucauguucaugucagaaucccaacagccaggccgggugcaguggcucacaccuguaauccuagcacuuugggaugccaaggcaggcagaucacaugaggucaagaguccaagaccagccugggcaacacggugaaaccccgucucuacuaaaaauaaaaauaaauaaaaauaauuagccgggcauggugacacaugccuguaauuucagcuacucgggagacuaacgcaggagaaucgcuugaacccaggagauggagguugcagugagccgagaucgugccacugcacugcaaaccugcgcgacagagcaacacucugucucaaaaaaaaagucucaacagccaaaaaagguggaagugacugaaguguguccaucaacggaugaggagaucaacauaacgugguccacccagacaacggaauaagagucagccauacaaaggaaggaagcacugauccaggcuguaaugaacccugaaaacucaaugcugagugagagaaaccagacacgaaacgccauauagugugacauuccauugacaaauccguagacaggaagcagauuaguggcugccagagccuaggggagaggaauggggaguuggggagugacugcugaugggaauaggguuuucuuucuggggaaugaaaauguucuagaauuagagguggugguugcaaaacaaauaaauauauaugugaacugacuucaauuaaaacaaacaagaaagaggagaaagugaaucucuccaggagauacaauuaaaauuuagaugcuggccaggggcgguggcucacgccugcaauccuagcacuuugggaggcugaggcaggugaucacuugaggucaggaguucaagaccagccuggccaacauggcgaaaccccaucuccacuaaaaauacaaaaacuuagccaggcaugguggcgggcaccuguaaucccagguacuccggaggcugaggcaggaaaauugcuugaacccagaaggcagagguugcagugagccgagauggcgccacugcacucuagccugggugacaaaaugagacuccaucucaaaaaaaaaaaaaaaaaaaaaguagauguuuuucuuucuuguuucauauguauaucuauauuauacacacacacacguauauauguuuauauacauauauagauauauauacauauacacguauauauguauauauguauacacacacgcacacacauacacacacacauacacauauacgaagcuuaagaaagggucucgcucugucacccaagcuggaguacagugacacaaucauggcugauugcagccuccuacuccugggcucaagcaauccucccaccucagccucccaauuagcugggacuacagacacaaaccaguacaccuggcuaauuuuuuuuuuuuguuaguuuuuguagagauggggggggucucacuauguugcccaggcugguuuugaacuccugaccucaaaugauccucccacauuggccuccugaagcacugggauuacaggcgugagacacacccagcucguauauuuuuauuuauuuuuuuuaccugcaaguaacauccauagcuuuuguaaaaagagagagaaagggggaccuucaaacaaucauuuuaaaacauuagacaaacuauuucacauuccaauauggguuccaaaguccccaguuacaaaaauauaauuuugugaccaggcgcaguggcucacaccgguaaucccaguaguacuuugggaggacgagguggguggaucaccugaagucaggaguucgagaucagccuggucagcauagugaaacccugucucuacaaaaauacaaaaaaaauuagucgggccaggcgcgcuggcucacgccuguaaucccagcacuuugggaggccaagccggguggaucacgaggucaggagaucgagaccaugcuggccaacacggugaaacccugucucuacuaaaaauacaaaaaauuagccggguguuguggcgggcgccuguagucccagcuauucaggaggcugaggcaggaaaauggcaugaaccugggaggcagagcuugcagugagcugagaucgcaccacugcacuccagccugggcgacagagugagacuccgucacaaaaaaaaaaauagccgggcaugguggcaagcaucuguagucccagcuacuugggaggccgaagcaggagagucacuugaccccaggagguggaggcugcagugagccaagaucgcgccacugcacuccagccugggcgacagagugagacacugucucaaaaaaaaaaaaaaaaaaaaagaaacacgaaaauauuauuuugugucaaaagccacuuugaguuuugaaccagcacuuugaguuccaccccgguuugcugagggaaaaaaaagcuaaagccaggcaaccucaaaccacaaaagcaaaauccuagaggcaggacaaggcagcuuugugucagaaggcucuggaaggcuccagauccaccucucugccuccuugccaguucugacaccccaccaggcaagauguccccuccgucagccuguuuccucaccuauaaaauggucugauaaggcaccaagcgaaaggguccccucaggagcuccauccguccucccuagauguggcacuguccccguuccucucucccuggcaccuucacauccagugucaaagcagaaccugucuccuucaccucgugacgcauccugaacccccugccuuucuccacggcccccaccccaugcaggccuguccaucaaucgcugauacccugcuugggccucuacuccagcuuccugcuaguguguggcuuuuuuuuuuugagacauagucucacucugucgcccaggcuggagcgcaguggugcaaucucagcucacugcaaccucugccucccggguucaagacauucuccugccucagccucccaaguagcugggguuacaggcgcgcaucaccaugccaagcuaauguuuauauuuugguagaaacaggguuucaccauguugaccaggcuggucucaaacuccugaagucaaacaauccacuugccucagccacucaaaguacugaauuuagaggcaugagccaccgcgccugguccacagaggcuucugaaaaucucaaaucagaacacagaccuccccugcucacacacccuccauggcuccccauuccccuccaaguagacaccaagugccuccacuggccuguguaguuggaccucuagccaccacugcaucguaaucacuuugcucacuugacucuuugcuuuuucuuuucugcuuuuuguuuguuuguuuuaagagaugggcuggaugugguggcucacaccuauaaucccagcacuuugggaggccgaggcagcuggaucaccugaggucaggacuuuagagaccagccuggccaacauggcgaaaccccgucucuacuaaaauuacaaaaauuagccaggcaugauggcgggggccuguaaucccagcuacccaggaggcugaggcagaagaauugcuugaacccaggaggaggaggcugcagugagccgagauugugccacugcacuccaaccugggcaacagagacucugucucaaaaaacaagaaaaaagaaaaucaggagaauauagaaaaguaugaaggcugaaauaacauuugggguugaucauagaaaacuguguaauggguucaauguauauuauuuaggggauggacgccccaaaaucucugacuucaccacuucacaaucuaugcauguaacagaauuacacuugugcuccauaaguuuauacaaauuaaaaaauaauaguaauauucaaccuauaagucuguuuuuuuuuuuuuuuuuuuuuuuuugagacagagucucauacuguggcccagguuggagugcaguggcgugaucuuggcucgagaaaaaaauaaaaagacucaacuguucccuuccccaugagacaauguccccacaggaggaggaagugcaagucaggccucagcaauucaauguggccaccaccccccagccccugaccccuuccuccugcuucuuggaagugacccaaagguuuggccauuacauaugauggugauaaaaacagacgugacacggccaggcacgguggcccaugccuguaaucccagcacuuugggaggccgaggcaggaagaucacuugagcccagggguuggagaccagccugggcaacauagcaagaccccgucucuacaaaaauauuuuuuauuuguuauuuuuuaaaaauauuuauuuauguauuuauuuaugagauggagucucacugugucgcccagugacuggagugcaguggcacgaucucggcucacugcaaccucugccuccuagguucaagaaauccuccugccucagccucccagguagccgggauuacaggcaccugccaccacgcccggcuaauuuuuguauuuuuaguagagauggagucucaccauauugaccaggcuggucucgaccuccugaccucaagugauccacccgccuuggccuccuaaagugcugggauuauaggcaugagccaccaugccuggcuuccacaaaaauaaaaauaaaaaauuagccgggcgugguggugggugccuguggucccagcuacucaggaggcuguggcacgggaaucgcuugaacccaggaggcagagguugcagugagccgauauugcggcacuucacuccagccugggcaccagagugagucucugucucaaaaaaauaaaaaaauaaaaauggacuugacccaaguguccaaacacaggggacaacuggggacagaaaagcccauucauuccuagugcugaggaucaaaugaaucccagcuccuccuccacugaccaaccauaucaccucaagcaacucaucuccccucucuaagccucaguuuacccuucugcaaaacaacauuaaggaugguccuggcauccugcugcuccgccuucccuggggauacccagaccugccugugauccauauccggccggcugagaaacuuaccaggauguaaucagcccacaugucucgagcugauuucagggcugccuggcgcaacuucaugacaugcucguagcgugagucagaccaguguuucgggccuuccucguccggguaggaccuauggggaggcagcugugauguggacaucacaaggcacuaucaaagcccagcgagggccugagcugccuucgggguacucagagagagcuuccuggaggaggggacguguaagcugaucugagggaugggaaaaaguaaacgacgaggaaagagaaguggggagaauguuccuggccggagguacagccugugcaaaggccuggagggaagaaagcccgaggcacacuggagggaaggaaggaaggaagcucagugggguccagugcaguggcccacgccugcgaucccagcacuuugggaggcagaggugggaggaucgcuugaggccagcacuuugagaccagccugggcaacacagugagacccuaucucuacaaaaaauacaaaaacauuagcuaggcaugguuacaugugccuguagucccagcuacucaggaggcugaggcgggaggauggcuugagcccaggaguuaaaggcugcaguaagcuguguucacuccacugcacuccagccugggugagggagugagacccugucucaaaaaaaaaacaaaaacccagaaaggaacugggugggggcagggaguccaugcugcccagggcuuuagggaguagauaaacagcaaagccagugcugggaccaagacugagucagugagccagggaacaaagcagugggcguccccagaagaaaaagggagugaaagaauucuagguacagggaacggcuugggcaaaggucugagaagaggauuauggccuauuuguaaagcugagggaggcucagaguagcuuaaugcugccuggcugggcuggaggcagggacugagggccuguaauuguucuggggcaauggggagccauagagggugugugagcagaggcaaagcccaaucagacuaggagcaggggaaagaugcucaccugggcuccucugcuggccgccacuccacggaaugguacaaacucuucacggccaccagccacucccgcagcacaguugacguguuauccauguugugguccguagccacccugcagggagaggggacaggcagcguacuuggggagacugaggcaggaccaggcagcagugaggcaagucaaggaccaccauccccaacuggccucccaccagcuauguaucccuggacaggacacuucucccuuuccuuuguuuuuuuuugagacagagucucgcucuguugcccaggcuggagugcaguggcgcgaucucggcucacugcaagcuccgccucccggguucacgccuucuccugucucagccucccaaguagcugggacuacaggcgcccgccaccacacccggcuaauuuuuuuguauuuuuaguagagacgggguuucaccauguuggccaggcuggucucgaucuccugaccucgugauccgcccaccuuggccucccaaagugcuggacuuaacaagcgugagccaccgcgcccggcccauuucucccuuuccaugucaguuuccucaucuguaacaugggggugggaacaggacccaguuuacugggaaguggaaggauuaaacaagcugauuuuggaaagacccauuagugauuggcuguuuuauuacugagcaucuaagaucuugcaaaccacauucacuaacaaauaugugucacuuaauuuuuuuuuucuuuugagacagagucuugcucugucacccaggcuagagugcaguggcacaaucuugguucacugcaaucuccgccuaccagguccaagcaauucuccugccucagccucccgaguagcugggauuacaggugcccaccaccaugcccagcuaauuuuugcauuuuuaguagagaugggguuucgccauguuggccaggcugcucucgaacuccugaccucaggugauccaccugccucagccucccaaagugcugggaugacaggaaugagccaccgcacacggcaauuuuuguaauguauagaucaggccaggcacgguggcucacgccugucaucccagcacuuugagaggccgaggcggguguaucaccugaggucaggaguuugagaccagccuggccaacauggcgaaaccccaucucuacuaaaaauacaaaaauuaggccgggcaugguggcucacgcuuguaauuccagcacuuugggaggccgaggcgggugaaucacuugaggccaggaguuugagccuagccuggccaacauggugaaaucccaucucuacuaaaaacacaaaaaauuagcugggugugguggcgggcaccuguaaucccagcuacucaggaggccgaggcaggagaaucgcuugaaccugggaggaggagguugcagugagccgagaucgugccacugcacuccagccucagcaacgagagcgagacucagucucaaaaaauaaauaaauaaaaaauauuaaaaaaugaaauguauauaucagaaaccagcugggugcaauggcucacgccuguaaucccaauauguugggaggccgaggugggcaggucacuugagcucgggaguucgagaccagccuggccaauagggcaaaaccccaucucuagaaaaaauacaaaaauuagcugggcgcaguggcauacgccuguagucccaguuacucaagaagcugaggcaggagaaucacuugagcccaggagggggaaguugcagugagcuaggauugcaccacugcacucccgccugggcgacagauguaaaacccuguaucaaaaaaaaaaguauaucucagcagggcgcuguggcucaugccuguaaucccagcacuuagggaggccgaggcaggcagaucaugaggucaggagaucaacacaagccuggccacaauggugaaacccugacucuauuaaaaauacaaaaauuagccaggcaugguggugcgcaccuguaaucccaagcuacucgggaggcugaggcaggagaaucacuugaacccggaggcggagguugcaaugagcugagaucgugucacuguacuccagccugggcgacagagcaagauuccgucugagagaaaaaaaaaaguauaucucaaaguauaucucauaaaucccuuacccugccuucaucuucuccugugagccacaccacuucagugggcugcagucaauuauucauucaacaaacauuuguuaaguaccaauuguguauuuggauuauccagacugagaaaucagguggaaggaaaagcgacauuugggaguuuaguuugaccguagugccaaaagcuaauucugcccaauaaauuaaguugacaauaacaccagcaaugacaguaaucaugauaauaaaaucacugagagccaagcccaugccagacccaagggcuccacauccauuaacuggauaaucuucagagacaaacccaaaaagagaauuauauuaauacgcucauuuucuuuucuuuuucuuuuuuuagaggcaggucuuacucuguagcccaggcuggagugcaguggugcaaucauaggucacugcagccucgaacuccugggcucaagcgauucuccugcgucagccuccugaauagcugggacuacaggcacacaccaccgcaccuggcuaauuuuuguauuuuuuuucuagagacgggguuuugccauguuggcaaggcuggugucgaacuccugagcucaagugacccgcuuaccuuggccucccaaauugcuaggauuacugcgugagccacugcacccggacccauuuuccauuugagaaaacugaggcagggagugagaagucaccagucaaagguuucuucagagcucugccccauucccuaccaagaaagcauccacuuccuccugggccaucugguccuggacuccacccacgccggucugagggcagggguuugacuggggccuggagccaggcugaguucaagcuuaagggcagcagccggcacagaaaggcuugcuguuagauguggccucuggcaacgccccagugggggcucugggcuccguccuuuggagguguacgugccccagagggaguuagagccccaguuagugaggccggagcugcccuaguaggguccagcaggcagaagcggugcccagcccaccccaaaggagccagcaggaggaacucggucccgcuuguguuguggggagggcugugucuggccccaugggaggacagcaggcagggggcacgcguggacccgucccgaugggggcagcgggcaggggcaugcguagaaccgucccgauggggguagcgagcaggaagcacgcgcggacccgcccagaagaggacagcgggcaggggcucgcguggacccaccccuauggggacagcaagcaggggcucgcgugacccgccugauggggacagcgggcucgacucaccauagcgccgugcgcucccgcgggugccgcagccgcucgagugcgcccagcguggugggcaacgcgugggccgcguuucgcgccaacagcgcgaugagcacgcgcggcgccugcaggggcgacuccgggcuccagcgcuccucggggaaguaggcgucggcgcccggcggggcccccggcggcaguggcgccagcagcagaagcagcagcgccaggagcggcugcccgcgccgccggcccgcgcguggggccgccgccaucgcgccacgcgu

SEQ ID NO: 191896 - RNA, 18467 nt, Homo sapiens
agaggggcgggagcucuggcucagguaaaaacucuuucuucggcucgcgagcugagaggagcagguagaggggcagaggcgggacugucgucugggggugagugucggcagcccccggaggaucuggcggaccccagugguggggguuuggggguggggaaguuguggcucuggagaagccccugccggucuccaccgcgcauacccugcagaugugggaacauucgggagccccgagucucgagaacccgguugcccucacccauccguaauugucuccggcguucccaaggccagcucggaccugggucggggaggaagccucccccacagcuggcgacccgggaccccggcgccccucccagauugggcgggaucagacccccgaggcggaugccgcuuagucagacuuggcuguuacuguuaccuguguuguugagauuauuggccccuugguugggaguaucugggcaagccagcgcugggguccccgguuggguuugggaacugcaggugacccccagucucucccugcgguuccggugcugcaggcccugccagguggcugggcggcauuccaggggcccuggcugcguggcauggacacauugcugaaccggccucaguuuccccuccgugagguggaacaaugaaccagcugggaugaggaugcccgaagcguuuagucaaaggaaauuuuugugaugagguguacugcuggccacugggggcccuugcgugacuggcguuaggucucugagccucaguuucccuguguguuaagggggggucucauggcaugggaccuuggcgaggaugaguugaguggauaggagcuguggccacucagugggugcccagggacagucagcugucaucauaauuauauuaauuaugucuguagccacuguucagauucacuccuguuccaagaaucccgaccaucuuuuccucugggucagauuuaaacuuuuuguuuguuuguuuuauuuguagaggugggggacucacuuugucacccaggcuggaguacaguggcuccaugcacuguauucacugcagccucaaccuccugggcucaagugauccucccaccucagccucccgaguagcugggacuacaggugcacaccacaggcagcuaauuuuaaaauuuuuuuguguguggagacggggucucacuauguuguccaggcuggucucaaacuccugggcccaagcaauccuccugccuuggcaucugaaagugcugggauuucaggcaugagccacuaugcccagcucugauuuuuuuaaauggacacuucucaagaggaaacugaggucgccccucaacuugggcgggggacuccugcaguccagaucugggauucagggcccaugggaagccaccuggccgucuaggucuggggccagcccugggggccaucacuuccucccacuggccuguucucaaggugacaccaggcagggcuggugucaggaggaagagguguggcccccaggucaggcagcugggcccccauauggccuaggugagcaguuggguguuugcucaguccagccuggacacccucccucacucucaccccuaggguguggcauuuccuggcaggugcucugggugugggagaaccaaaagggggccuuggugcuucucuguuccaggccagaguucaggaauccagacaagccaggucagcccaggaggagcaaguaagggcucacugagugacauuuccuccugccaccagccucugaggcccagagcaagcaggaauuugcucacucccccaaccccaugagccagggaggaugccuauuguggacccucuuccuggugggaaucuggcuugccuugauugcuccucaugauggugaggucacuaccaacguggcaaacuaaaggaaaucucaucagcugggaguuaaagacaggaacuaggcucccacccaaccuuucuuagguggauuucuaggccucucugugccucaauuuuccuauccauaaaaauggagcuaaugcagcccuacuucucagcacacauauagaguuuagauggacagaugguggccaggcugcacacaggaccuggcauauugauccuaguccuaauuaugcagcucauuauguuaucauuuauagcauguaucuuugcacacagaaauaauaucaugaauauuucugagcucuaaguacaagacuuggagaagagcucugaccagccugaagguguggggguccaggaaguccccagaggaggggcccaggagaccucaguucccccaucacuccuggauugugggaagggucugagguugaacugcgaugcacggccuggcuucccagccuguuuccccaucuauggagugagcccaaagaugcccuuugagacuccacugggccagggcugguguuauucaggggccccuuuccagucucacauaggugccccaggcaguuccugcaaugggguagggcuggcauggaugacauacaauuagucauccaugacagagccucgggaccuagaaacccgggacaccaaagucuaaagugcaugugucaccgugcccaaccccaccccuuuuuccauacccaggcacucccuggugcagauauugaguauauauugacagagaacucacuaguacacaugguuucacuaaagcaggguccggccauugugaacuuaaaggauuuacugggcuauuucuucuucuuuucuuccccuucuguuugcaaaagcaacuccugcuccuuguaaaaagggaccagccuaucauuacugggaaacccaaacugguaagaacuggugaggaaccacccacaggggcuggcagaucaggguucaaaucccaccaacccgcccuggccucagucggcugugugaccuugggcagaguugcacccucucugcacagaucguccaccuggacccuaggcuccccucuggaaggcucagugagacuccucggguuccuccacaggccaggggcucacacccucuccugcaagcguccccaacuuccacccuggaguuucuucaccccuagagguugcacuccucuggaaaauuguccuguuugccacuucucuguccccuguuagugguguaucagcguccugggcacacgaguguuucucuccaucaucuuggcuguguccucggaaccuagacccagauguggcauacgcuaggugcucagcacuugcucagagcagucacaacucugcaggugauaagggugguggcagcugcuauuaaaucucauuguggcugggcgugguggcuaacaccuguauuuccagcacuuugggagaccgaggcggguggaucaccugaggucaggaguuugagaccagccuaggugacguggugaaaccccaucucuacuaaaaauacaaaaauuagcugggcaugguaacgcacaccuguaaucccagcuucucuggaggcugagacaggagaaucgcuugaacccuggaggcagagguugcagugagccaagauagcaccacugcacuccagccugggcaacagagugcggcucugucucaaaaaaaaaaaaaucuaauuguggcugggugcaguggcucacaacuguaaucccugcacuuugggaggcugaggugggaggaucacuugagcccaggaguuggagaccagccugggcaacauagcgagacccaucucuacaaaaaugaaauuagccagggguggugaugcaugccuguggucccagcuacucaggaggcugaggcaagaggaucaguugagcccuggaguuggaggcugcagugagcuaugaucgugccacugcaccacuccagccugggugacagagcaagauccugucucaagaaaagaaaaaaaaaaucucauuguuggcgcuucacauaugugccacuuggagaaaaggccacugcuuggagcuaccacuugacccucuagccuuucccaggacucaaauccguauguagucaaacgggauucuuccagaagcuucucucacccuccaccucuugccuugccuuuuggcggccucagaauguuccacaccuccauccaaaucccaauuuaggaugggugagaauuggagaaacagcggccacagcaaugcugauagucagguggugguucugccaccauuccagcuuuuuuuuuuuuuuuuuuuuugagauggagucucauuuacccgggcuggagugcaguggcgcaaucucggcucccuguaaccuccaccuccuggguucaagcgauucuccugccucaggcuccugaguagcugggauuacaggcgcccuccacuauaccuagcuaauuuuuuguauuuuuaguagaaaugggguuucaccauguuggccaggcuggucucgaacuccugaccucaugauucgcccgccucugccucccaaagugcugggauuacaggugugagccaccgagcccggcugaccaucccagcuuugcagaggaggaugcuaaggucuggguggccccagcuacucggcccaggucccauggaaggucaguagcugggucagaaggcccuuccucaacggcugucggggguccccauggcugcuucaaaggcaucagcucacagaccaguccucccagcugcaggcaaggcagagacugagagccagcgaccaggcugguuagggguauccaggccgguuagggguauccaggccugggagucccugaagagcaauccagaaguagcccuaucugggccucaguuuccucaucuggaaagugggaguuucacagggagaauuaccuuaaugcuauggagaccucugagucagugucaggacaucccccgcccccugugccacuccccaucaccuguggucuccaaauagucuugggagugaggggggcagaucuagccccaggugguaccagcaggguccuugaugacuuucacaugccccacaucucuugcagacagugacaagaacaggguugagacugggcgcaguggcucacuccuguaaucccagcacuuugggaggccgaggcgggcagaucacuugaggucaggaguucgagaccagccuggccaacgcgcugaaaccccgucuuuacuaaauauacaaaaauuagcugggugugguggcgcacacuuguaaucucagcuacuugggaggcugaggcaggaggaucgcuugaaaccaggaggcggaaguugcagugagccaagaucacaccacugcacuucagccugggggacacagcaagcgagacucugucuccagaauaaaaccaaagaaacagggaugagggcgacagaggugccuggagccacuugcaccuggggcaagggcccagccuugacugcccccugggaguggcagaggacauggggccagggugcagcugccaaugccuacgauucugcugagcagacaacccuucugcauauuuaguggucauuaauuuucaaugagucauuaauacuuaguaucaccugugcauugaagcaugaauauucagugaccaugaauauuugguaucugaagacuguuuguggcuuguuaauauuccucaugauacuauuaggccgggcgagguggcucaugccuguaaucccagcacuuugggaggcugagguggguggaucaccugagauuaggaguuugaaaccagccuggccaacauggugaaacucugucucuacuaaaaauacaaaaauuagccggguguggugguacaugccuguaaucccugcuacucaggaggcugaggcaggagaaucacuugaacccaggagggugcaaccuccagguugcagugagcugagaucguggcgcugcacuucagccugggcgacagaggcucuaucuaaaauauauauauguauauauauauauuccucaugauaauauucaaguaucauguaugugacuugcaacuuuaaaaaaaauucaguauauuugggcacaacuugcaacuuuucauuauugcuuugcaacuauuuuguauauuacgaauaguaggcaccuccucuguaguuaauggauuguuaauguucaguacuucacuaacaugcagcacuuuuuuuguuuguuuguuuguuuuguuuuugagacagggucuugcucuguuccccaggcuggaguacuguggcgagaucauggcucacugcagccuugaccuccugggcucaagcgauccucccaccucagccucccaaguagccaggacuacaggcgcacaccaccaugcccggcuaauuuuuguauuuuuuguagagaugggguuuugccaucuugcccaaacucuugggcucaagugauccuuccuucucagccucucaaacagcugggauuacagguacaagccaccauacccagcuguuuuuuguuuuuuuguuuugagacaggaucuugcucuguugcccaggcuggagugcaguggugcuaucauagcucacugcagccuugaacuccugggcucaagcgauucuccugccucagcuucccaaguagcugggacuacaggugcacgccaccacaccuggcuaauuuuuacacuuuuuguagagacagagucucaccauguugcccaggcuggucuugaacucuugggcucaagugauccucccaccucagccuccugaguagcugggacuauaggcacucaccaccaccacaccaggcuaauuaaaaaaauuuuuuuuggcugggcaugguggcucacgccuguaaucccaacacuuugggaggcugaggugggcggaucacuugaggucaggaguuugagacuagccugcccaacauggugaaaccccgucucuacuaaaaauaccaaaaguagccaggcgugguggcacaugccuguagucccagcuauucaggaggcugaggcaggauaaucgcuugaaccugggaagcggggguugcagugagcugagaucaugccauugcacuccagccugggugaccuagcaagauucugucuccaaaaaaaaaaaaaaaucauuguagagacagggucuugcuguguuacccaggcuggucuugagcaccuaagcucaagugauccuccugccucagccuccuaaagcacugggauuacaggugacuuaucuugacugaaucacgggugcccaaggcuuacuagucucccaagcuauaaaucugucuucugaggcagaacgugugcggcaggggacuguggcugcugccucguggagugggggcgaggcugcagugagauaggaggugauggcuaucguacuuuuucccuucugcaacaaacuagguagcauccugugggagcacaguugcaggagauaagaugcccagcccuggggcuucaggcuggcugggcagauggacaggagagaagcgaagagauuucccaugucugaugguggugaaugcuacagacaucagcagugcuggggcuagguguuuuagccuggaggucgaagccucucggaggugacauuucaggggaagccuaaauaugaagacuacggaaagagcuggaaaggaaggggguccuagguggaggcaguggcaggugcaaaggcccugaggcagggcugagcuugggugguuuuuguuuguuuugagacagggucucgcuuugccaccaggcuggaagugugaucacagcucccugcagccuccacuuccagggcucaagugauccucccaccucagccucccgaguagcugggacuaaaggcauacaccaccauacucagcuaauuuuuuuacuuuuuuuuuuaauuuuuagcacagacaggucucccuuuuuugcccaggcuggucuugaacuccuaggcucaagcaacccucuugcuucagccuccuaaagugcaaggauuauaggcaugagcuacugcauccagccugagccuggguguuaaaggauuuuuuuuuuuuuugagacagaaucuggcuauauugcccaggcuggcgugcaguggcacgaucucggcucacugcaaccuccaccuccuggauucaagugauucuccugccucagccuccugaguagcugggauuacaggcgugugccaccacaccuggcuaauuuuuguauuuuuaguagagacagaguuucaccauguuggccaggcuggucucaaacuccugaccucaggugaucugcccuccuugaccucccaaaguaccgggauuacagacgugggccacagcucccggccauguuuaaggaggcuggugcagcuggagcagaugagugagggcagagauugugugggaaagauggcagcagagaggacccacauccugcagccacaccccaggcgguggcuucugggucuuggcaggggaaauaaauggcuuuucugugcauuugaggaaguggguucuggaggauggcaaaaucgcacuggcacgugaagugcaaacagcuccaggcaggaccgacuggucuggcagcgggcggccaggcgaggguccccaagagucagccuggaugucacugcuggacacugguggcaccgugucuggcuuggggugaaguuuuuucacccaccuugaacaggagugcaggguaggcgcuguaacaugcagggaacauaugacaauugccuguuggcaccaggcauggugacuggugccuguggucgcagcuacucaagaggcuaaggcaggaggaucacuugagcccaggagcuggaggcugcagugagcuaugaucgccacugcacuccagccuggacaacagagcaagugagauccuaucacuaaaaaaaaaaaaaaaaaauuuuuaauuagcuggcaagguggcuuaugucuguaaucccagcgcuuugggaagccaaggcaagaggauugcuugaggccaggaauucaagaccagccuggacaacauagugagacccugucucuuaaaacacagcacacacaaucaauaccuguugggccuuccuggcuuauaggccauggugugccaacagcucucaccuggauaccagacugagccucccacugcccagagguuccucauucugcuccuucugguccuucuuuuuccacccccuaacaucuggacaucugggcugugaucgaaacauugaugacuuucuucaucuuauuuuccuuuuuuuuuucuuuucuuucuuucuuuuuuuucuuuuuuuuuuuuuuuuugagacagagucuuguucuaucgcccaggcuggaguacaauggcuugaucuuggcucacugccaccuccgccucccagauucaagugauucuacugucucagccuccugaguagcugggauuacagacacgcaccaccacacccggguaauuuuuguauuuuuaguagagaugggguuuugccauguuggccaggcugaucucgaacuccugagcucaagugauugccucggcuucccaaagugcugagauuacaggcgugagccaccgugcccagcuuuuuuuuuuuuuuuuuuuuuugagacauagucuugcucuguugcccaggcuggagugcaguggugugaucuuggcucacugcaaccuccgccuccuggguucaagcgauuuuccuuccucagccuccugaguagcugggauuacaggcaugagccaugagccaccacgcccugcuaauuuuuguaucuaauauuuuguauuuaguagagacggggguuucaccauguuggccaggcuggucucgaacuccugaccucaggugauccaccacuuuggccucccaaagugcugggaugacagcugugagccacugcacccagcccuucaccuuauuuucuaaaccugcauacucuccuauaccccagcagccagccucugucuaggccaccaaacucuuccaccuagauguuacccaaucuccccccacccagccuccugaguagcugggacuacagguguacaccaccacacucagcuaauuuuguuucauuuuuuuauuuagcagagacagggucucccuuaguugcccugcccugacugaaaugucccuaaucccuuagugaccacagggauuuuuuuuuuuuuuuuuaaugacagucucucucuguugcccaggcuggaguggugugauuauagcucacugcagccucaaacuccuggggucaggcaauccucccaccucaaccucccgcauagcuaggacuacaaguaugcaucaucacgccggcuaacuuuuguauuuuggguagagaugggguuucaccauguugcccaggcuggucucaaacuccuaagcucaagcgauccuccuaccucagccucccagagugcugggauuauaggccugagccaccuugcccagcccacaggggacuucuuaaaggcauaaaucaaucugaucccuccccugcucauagacccuccauggcuccucauugcuucucacaggaaacauaagacauucuuucuggcgugcccauucuauucuuguacccuagcagggucccauaacuccaccaucaccuccuuucucucgcccugucccaaccacgucagccuccucgcucugccaccagcacccuaaauuuguauccaucucagggccuuugcacaugcuccacucugucuggaaugcccuuccccacagucugcucaagugaauucccaucauccuucaggaccucccugauccuagguugcucagguccccuguggaccugccucaguaacaauuaguauggcugucacuaauuguuaguaucauuuacaauuuuuuuuuuugagacagcaucuugcucuguugcccaggcuggagugcaguggugugaucauagcucacugcagccuugaacuccugggcucaggugguccucccaccucagccucccaaguaacugagaccucaagcacaugcuaccacagccugcuaauuuuuuguuuuguuuuguuuugagacagagucuuucucugucauccaggcuggagugcaauggugugaucauagcucacugcagccuccaccuccuggguucaagugauuuuccugccucagccucccgaguaguugggacuacaggcacccaucaccaugccuggcuaauuuuuguauuuucuuuuuuuuuuuuuuguagagaguggguuuccccauguuggccaggcugcuguugaacuccugaccucaaguaauccaccugccuuggcuuccuaaaguguugggauuaugggugugagccacugcgcccagccuaauuuuuguguuuuuuguagagacgggguuucaccaugcugcccaagcuguucuacuuauuguuauauugagggcagggcuggcuuggucacagcuguauccccagcaucuagcauacaguaggugcucaguuaacacucuagggcugaugagcacugugacaguuaacaggauuggacucaugcacguucacggauauucaccugucugugccccagguggccgagaguuggccagguucucuuugagggauguuuggugccauccaugacgcagucccuugugacagauucugggaggcccugagguguuggaagggagucucccagugaccccgaguugagggacguaugagaugggcauacugcacccaucaaaguucuggguuccggcuggggacgguggcucaugccuguaaucccagcacuuuggaaggcuaaggugggcagaucaugaggucaggagaucgagaccauccuggccaacacggugaaaccuugucucuccuaaaaauacaaaaauuaacugggcgugguggcgcgugccuguagucccagcuacucugaaagaugaggcaggaggaucgcucguaugcaggaggcggagguugaagugagccgagauugugccacuguauuccagccugggcaacuccaucucaagaaaaaaaaaaaaaaaaaaaaguccuggguucugauacugcuccaugcuguaagugggaauagcuggggaaucaagguagccaggaugguggacucauggucacugaggcggucaccacacagcuaauaugcaucaagcccuuuugcagucagggagcaguggccccaguguguguguguguguguguguguguguguguguauuggagcaggaaccucagcacccccauguccuaauaaggaaacuaagacuucacacagaaaggcagggcacagugacucaugccugucaucccagcccuuugggaggccgaggcagguggaucacuugaggucaggaguucaagaccagccuggccaacaugguaaaaccccgucucuacuaaaaauacaaaaaaauuagccaggcaugguggcucacaccuguaaucccagcuacucaggaggcugaggcaggaggaucgcuugaacccaugagguggaggcugcaguaagcggaaauuacaccacugcacuccagccugggcaacagaacaagagagagagagagagagagacgcugucucaaaaaaaaaaaacaaaauuaaaaaauuuaaaaaauuaauccccagcagggagggccagggcaccugucagagccaacagggguuggagugcuuugaaaugggucuugcaagggguggaggaguuaaguggggggugaauuucaauauuuugccaaccugagcaacuguacaggugcaaccagauguugggggccacaggaaaagcgcuuugcucauggcgaguguucagugaguuuuguuuuccacaggagccgcccaggaggcuccucaggccgaccccagacccuggcuggccaggaugaaguaucuccggcaccggcggcccaaugccacccucauucuggccaucggcgcuuucacccuccuccucuucagucugcuagugucaccacccaccugcaagguccaggagcagccaccggcgauccccgaggcccuggccuggcccacuccacccacccgcccagccccggccccgugccaugccaacaccucuauggucacccacccggacuucgccacgcagccgcagcacguucagaacuuccuccuguacagacacugccgccacuuuccccugcugcaggacgugccccccucuaagugcgcgcagccggucuuccugcugcuggugaucaaguccuccccuagcaacuaugugcgccgcgagcugcugcggcgcacguggggccgcgagcgcaagguacgggguuugcagcugcgccuccucuuccuggugggcacagccuccaacccgcacgaggcccgcaaggucaaccggcugcuggagcuggaggcacagacucacggagacauccugcagugggacuuccacgacuccuucuucaaccucacgcucaagcaggugcgcuggacuggggucaccugaucggggccaccuguccuucuuguccaaauuaccacccacuccugagggacccaggggaccagaaguccucgucaguccaucacagcccauucugccccucugcuguccucaccagccucguggagacccaaaauggucuucuucuaggagaggcuagggggaagggcagaggagcuagguuacuagcacagagcucaagccugaugaugcggauucgaauccaagcucugccucuuacuugguguucgaccuuggaggaguucauucaccucucugugccucacuuuucucaccuggaaaaugggaugugaaugagucccacccaccucuaagggcuacugugagguuuacaggagauggaguuuauaaggcacccagaccagugcuggauguccaacucaacuuggcaaugacgggggacacaucuccuuguuuauuuuuauguuuauuuauuuuuuuuuaauggagucuugcucuguugcccagccuggagugcaguggugcgaucugggcuugcugcaaccaccuccugguuuccggcgauccuacugccucagccucccaaguagcugggauuacaggcacucaccaugcccagcuaauuuuuguauuuugaguagagacgggguuucacccuguuggccaggguaaucucgaacuccugaccucaggugaucuucccgccucggccucccaaagugcugggauuacaggcgugagccacugcgcccggccaacaucuccuuguuuauuuguuccgguucugucuccccaugaggcugggggccuugucuguuucacucacugcugugucccuaaugccuagaauagauucaggugcacagcaugugcucagucaagaccuuuuugauggacaagaacccaugagagguagcuaggcuugguggcucaugccuguaaucccagcacuuugggaagcugaggagggaggaucgcuugagcccaagaguuugaggccagccugagccacauagcgagaccucaucuuuuucaaaaaaaauuuaauuaauuaauuuuuauguuuuuuuaauuaauuuuuuuuuuuuggauggagucuggcucugucccccaggcuggagugcaguggugcaaucucggcucacugcaaccuccaccucccagguucaagugauucuccugccucagccuccugaguagcugggaauacaggugcaugccacuaugcccagcuaauuuuuuuguacuuuuagcagagaugggguuucaccauguuggccaggcuggucucaaacuccugaccucaagugauccuccugccuuggccucccaaagugcugggauuacagguaugagccaccacgcacagccucgucucuauuuuuuuaaaaaaagaagccaugagaggugagaaaauccugcccaucugcagaugaggaaauggaggggcucuaagaaccccuccuagguccucgaguagagcaagacaaguagagacaacauuuucaaggaggaacagggaacucugcagguuccugcucauaggagguacagacaggccuggguucaaguccucugguagcuguuucucugcgggugaccucacugcaguuuucucuggagagccucuguucccucaucuguaaauaagauagaggaccacuucugccuccuaagggugcauucaggauucaagguaggguaagcaccaagcacagcgcccggcaacaaacagauacccagccuguguagguuacuguaggggaaacugaggcugaggcggguaggggccauggccucuuaacaugcuguguucugaaaacacaaaaguggcuaggcacaguggcucaugccuauaaucccagcacuuugggaggcugaggugggcggaucacuugagaccaggaguucgagaccagcuucuugggaggcuaaggcagcaggaucgcuugaacccuggaggcggagguuggagugaguuaagauugugccacugcacuccagccugggugacagagugagacucugucucaaaaacaaaaacaaaaaacccuuuaaaagugugugauaaacaucagcuugacaaauaugaacccagcacccgugaagcacuggcacuaugcugggugcugagggagauggcaugaacagaaaagagagacacaggcccaaggagggaaguccaguguuuggugggagagggggauguuaacaaucacacaggucaggcacgguggcucacaccuguaaucccagcacuuugggaggcugaggcagguggaucaccugaggucaggaguucaagaccagccugaccaacauggugaaacccugucucuacuaaauacaaaaaauuagccaggugugguggugcaugccuguaaucccagcuacuugggaggcugaggcagaagaauugcuugaaccugaaaggcggagguugcagugagccgagauugcaccacuccacuccagccugggcaacaaaagcgaaaacuccaucuccaaaaaaauaauaauaauaauaauaaaauaaaaaucacacaaaggccaggagugguggcucauugcuuguaaugucagcauuuugggaggcugaggugggaggauccuuugaggucuggagucugagaccagccugcguagcauagcaagaucccaucucuuaaaaaaaaaaaaauuauuagccaggaguaaguagcggcaugugucuguaguaccagcuacuugggaggcugagguggaaggaucaccugagcccgggaauuugaggcugcaaugaacuaugaucauagcgcuacacucuagccugggcaauagagcaagacccugucucagaaacaaacaaaauucauacaaaugauuauuuaacaacagggcuuggccaggcagaguuggaaggaauagcaauacauguaaauguaacaauuuuccagcauuucuuggugcuucauggagcauggucuccauggauuccccaacacuccuagaggcacaugauaaggccuguuuggagaguugaaaccaaggcacagagaggguuucccaaguaaccccacagggcagggccuuaacccaggcuggauuguggacacuuccuuuccugggcuuagugggcuggaguggcuaauagagacccaaggccaauuucuccagcccucaagcaagcaugcccuguccacccugccugcagguccuguucuuacaguggcaggagacaaggugcgccaacgccagcuucgugcucaacggggaugaugacgucuuugcacacacagacaacauggucuucuaccugcaggaccaugacccuggccgccaccucuucguggggcaacugauccaaaacgugggccccauccgggcuuuuuggagcaaguacuaugugccagagguggugacucagaaugagcgguacccacccuauugugggggugguggcuucuugcugucccgcuucacggccgcugcccugcgccgugcugcccaugucuuggacaucuuccccauugaugaugucuuccuggguaugugucuggagcuugagggacugaagccugccucccacagcggcauccgcacgucuggcgugcgggcuccaucgcaacgccuguccuccuuugaccccugcuucuaccgagaccugcugcuggugcaccgcuuccuaccuuaugagaugcugcucaugugggaugcgcugaaccagcccaaccucaccugcggcaaucagacacagaucuacugagucagcaucaggguccccagccucugggcuccuguuuccauaggaaggggcgacaccuuccucccaggaagcugagaccuuuguggucugagcauaagggagugccagggaagguuugagguuugaugagugaauauucuggcuggcgaacuccuacacauccuucaaaacccaccugguacuguuccagcaucuucccuggauggcuggaggaacuccagaaaauauccaucuucuuuuuguggcugcuaauggcagaagugccugugcuagaguuccaacuguggaugcauccgucccguuugagucaaagucuuacuucccugcucucaccuacucacagacgggaugcuaagcagugcaccugcagugguuuaauggcagauaagcuccgucugcaguuccaggccagccagaaacuccuguguccacauagagcugacgugagaaauaucuuucagcccaggagagagggguccugaucuuaacccuuuccugggucucagacaacucagaagguuggggggauaccagagaggugguggaauaggaccgcccccuccuuacuugugggaucaaaugcuguaaugguggaggugugggcagaggagggaggcaaguguccuuugaaaguugugagagcucagaguuucugggguccucauuaggagcccccaucccuguguuccccaagaauucagagaacagcacuggggcuggaaugaucuuuaaugggcccaaggccaacaggcauaugccucacuacugccuggagaagggagagauucagguccuccagcagccucccucacccaguauguuuuacagauuacggggggaccgggugagccagugacccccuguagcccccagcuucaggccucagugucugccagucaagcuucacaggcauugugauggggcagccuuggggaauauaaaauuuugugaagacuuggagaucuuuuuuuuuuuuuaagcaaauuuacaaguuucaacagacaaguccacauucaucccuaaaagucucauuuuccaguagaaaauauacacugguaaaaacggggcauggggccguggcucagggcuguaauucuagcacauugggagaccaaagugggaggaucacuugagcccaggaguucuggauccugucucugcacaaaauaaaaaauuacucaggcgugguggugcucacaugccuguagucccagcuauacuugggaggcugaggcgagaggaucgcuugagcccaggaguuggaggcugcagugaaccaugauugcgccacuguacuccacugggcggcaauaagaagacaaaaacauaaaacaggacaugugugaggcaaaagcugcaggaauuucuaucaggcagaucugaccucaucccacccacccccugcucagauacccuucauagcuccuuauugcuuucagcucauaaccccacau

SEQ ID NO: 191897 - RNA, 19864 nt, Homo sapiens
agaagaaggggagaggagguugugugggacaaggugcuccugacagaaggugccaggguggggguggugggccuggggcauccuagccugugauggagaugggcacugggcaagggauugggcgcacacauaggggagccccagccuucccacauucuccauugcugcccaaggcccaggcagcuccugguugcuggcuuggaggaugagugguuuucuaacugaaaccaagccccuggcaacguccuaaugauucaggcugggccuuucuggacuuuaaucaguuucucugucuuucucaaucuaagugcuuaccggguaacuggaggccacuugguugcugguuuuggcugggccuuucuggacuuuaccccucagccccuguuuauccaucccuguuuacucuuacuguucuaucuccagcacugcccgucucugccucucuccacugucccuggagcucccugggcccuucccugggccucaggaccucacucaccaccccaucugcccugcaggaugccacagcugagccuguccucgcugggccuuuggccaauggcagcauccccguggcugcuccugcugcugguuggggccuccuggcuccuggcccgcauccuggccuggaccuauaccuucuaugacaacugcugccgccuccgguguuucccgcaacccccgaaacggaauugguucuugggucaccugggccuggugaguguggcagcaggacgggucuggggucucaggguggauggacuuccugagggguaagaaugaggcucaggugagagggggugggcuggggucugggguggcagagaagcaggggaggcgucuuacucauuccucugcuuacucauuucugugaggugccaacccaagcccuucucaccucccuguucucccacucuuggccuguguugaauccuuuuccugccugucuuuccacauuaaugcaccucugcggggcucuugggcaggggguugggugcacagaaaggugaaccccuggcguucccacauucuccauugcuggacucgaggccuccuguacccacuguucaggguccucucccuaccuggccuauuuccucuuaugaggguauaggugggccagaggagaggugugggcugucucucaccuccaccacauccggaggcaccuuccucuuaucuuguuccuccccaguaagaugucccaaugggguccuguugccaaacccacauaaaaguuggccacucacuuccccuuucagaagccuucccugaccuuucuccucccccagaccuugcccucugacuuagaccugcucuccccuuugcggaacguggucucaaucugcucauugcaaauggcaggauugauggguguguccacaggugaagugggagggugcacaggaugcacuagcacagagccuggugcagaagcuucucccaggugggagccacugucaugauggacaguuagagucaccucugcuccccuagugacugcugagaagggaagguccccugugugcagaaccuucuccaugggaggaacuggaaccuguguggcugguggaggaaccagccagggcaugaagggauguggggaccagccuuagggacauguccugaguccacacugcuccccacaaaccuccccugugaggaccuccucauaugcccaccucugggcugaaaugacucccagaacaaggaaauuuuuccucucaagcuaagugggccucugugaguggacagugugucuuuuccuucugccuugggaugcgcucuugggacuuggggguggccccaagagagauagagcaggaggaauguagacagauagauagguaauaggauagauggauggauggaugcacagauagggugaauagauggcuggcuggcuggauaaguagguggguagauagacagauagauagauagauaacaggauagauggauggauggacagauggaugcauggauaagauggauggauggauggauggauggauggauggauggauaauacauacauaaaguaguagauaagauggauacauuagguggauagauagguagaguggauauguaggauggauagauuagauggauggauagauagcuagaugauugauagauaauaggauaaauggaugaguggaugaauguacagauaagauggauggauggauggauggaugggcagauagauauauagauagaaaaguuagauaggaugaauagauuagauagauaaaugaauagauagauagguagguagauagauaauaggcuagauggaugaauggaugcacagauaggauagaugaauggauagauagacagauauauaagauagaauggauggauuagauagauggauagauacauagaaacauagguagauagauagauuagauagauagauagauagacagauagauacauacauacauacauauauagauacauagauagguagauauguagagauauauauagguaaauagauagauagauagauagauagauagauagauagauagauagauagauagacagacaggcagacagacagauagauagauagaagagggaguuuauuucgggaauuggcucacaggauuauagaagcugagaugcgucauggacugcugucugcaggcuggauaaacagacacugguuguguaacugaguccaaaggccugagacgguggaguucugguguccaagggcaggagaagauggaugugccagccccacaacagagcaaauuagccuuuccucugcauuuuugugcuaccugggcucucaacagauugaaugagcucugcccacacuggggagggugauucuuccuuccucaguuuaccaaauugaaugccagucucuucuggaaacacccucacagacggaugaucaacuaucugggcauccuuuagcccagucaaguggacaccuagaauuaaccaugacaggaggugacggccccugccuugcuugcaggucacccccacggagcagggcaugaggguccugacucagcugguggccaccuacccccagggcuuuaaggucuggaugggccccaucuuccccgucauccguuuuugccaccccaacaucauccggucugucaucaacgccucagguaccaccuggaauacuugguggugggugcuauggugcauuugaggccugcaagucccucuauccccaagccguguguggccccugcaguacucuggucucuccuuuccuucucucucagccaucuucaucuuucuuucauguauucacuaauucccaucucagcaucuccucucuccauugccaucugacccccuguccugguguucugggcugcccuggggccccaagagaccucaacccaaggcccuguccuggaggaacccccaagcuuaaggagguggauguggacagagacauccccaacuucauggggucaagaaagggccagagggagauggaugacagcccagagaagagcaaguucucugcuggggcaggcuggaagccuuccuggaggaagaguuacuggagccaugucuggaacaaugaguagggauguuugaaaggagagugcagggugaugcaauugggcaucguuaguguucaaggccccuugccaggucuagcgucaccuugccugucacaaagguuagaacaaugaggacuuguggcugguggaggaucuggacuguuauuucugugauguccaucucuggugugggucaaguccuuuuaccccauccuguaguuugucugcccuaaguucauugcuuuucugcucuaggcccugggaaucuccaaaaggagacuccagccuaguuuggggcccucuccuugaccccugugcuucccuucuuggacaggccaggcugagcagggaaacaggcagcauccuacagagaccauggcucuggccucaaaaugcugagugacucugggcugguucccagcugucucugguuacugaggucucuuucaguugugagugguggaaauccaaccugguguagucuaagcaaagaaagagaaucuauugauuuuaaaguccagggaggauggccuucaggcauggcuggauccaggucucacacaguguuacuuccucucuuggcuuuagcuuucuccacgccacuuuuggcuugucuuccuuucuuggcuuuagcuuuuuccacgccacuuuugcuuucaagacagucuuucccucaugacgucaacaaugaguccuagaagcucaauucucaugggaaagcccacauuucccccagaguucccagaaaaggcccaugauuuacuucuccuggccuggaucaccagaucaauuuuucacccagucccuguguuucugauugccuagucucggcaggccugggccuucuagagcuacuguuuugggggcacaaagaaguuugaugguuaaggaaucaggccaugggugcagauagacccagucucaggccucagguuugccauggucugggacuaugggcaaauuacuuuaucauuuagagccucagucucuucaucuggaaaaugggaugaaugagagcccagggaacaugguguguggauccacauggggaaagagcuuuucugucuguguaacugaaggacuggagaguccugcauggaggaugugaggaggaagcccagugggggcucagcacugagagggagaugagaugcugcuugaaauucucagggagagggcuuccaccucuucccugcagauccuucucucucgcagccuaggagagcaugaauuggguccugugucuuucucuccagauucacagcucggaggaaggucuccuauacacacaaagccuggcaugcaccuucggugauaugugcugcugguggguggggcccuggcacgcaaucguccgcaucuuccaccccaccuacaucaagccugugcucuuugcuccagguagacacugcacuggccacuccagguagacacugcacuggccacgccuugcccacagcuggggucucugugcugccuccagcgggucgcgugcccaugugcagacaggaggggcugugguggagaugccacugcuuccaucuccccuggacuuccaucugucugaccucuguuccuguuugcucaugucugggaagugucucuaugguggcuguuauauggucaagucugcuguacggcuacgucuugucaccuguauauuuacaccuggguccugguuacaccugaaauauguuauacccgguuacaucugguauaucauuccaacugaggucauguagagcuggucauguguggaguucauguguggccaaggacauuuggggcaugugaggggcuguuuuguucuugucgcaggugcuguuugacacugccguuuucuccugcuggucacaucugggccauguuuggggguugugugaggucugggacccagggucccuaagugaacugucugagacauuauuugagucuugucugaggcauguguuguaguauguuugggucauacgugaggaacagucugggucacguguuggcuaugucugggucguuaaagguaccauauuuauauucaaccuggagccuguauguggaacacgcuuuuaaggucauguuagaccaucucaugugcauguuagagcauaccaucucauguuaggaauugucauguauuuuguggccaugucaggacuugugaacacaugucagugucaugucucaugucuagguccaugucagaagaugccaugugagaauaugucagagagugcugggacagacaggguguccuaaguccuugugaaggcauucuguagagugcugagcguguucaggguuugcagaacauguuggaucauguaggaggcaugucaaggcaugcuggagcccugacauagcuccuacgugccauguuaggcagugucauugcugugcugugcugccguagccuggucuggucuucccuccccucccccauccugccuucuuccucuccccuugacccucuucuugcuauguggggcuuggagggaagaagugcaaaccucuugcugggagccuccccccacccccaaaguuccuccuucaccugccuccauggccccugauuguccucauuuaugucagcugccauuguaccaaaggacaaggucuucuacagcuuccugaagcccuggcugggugaguaucuguaggugaacaggguugggaacaaccuggggggccaggggagggagaugcccuugcccauggcccuuggcugcccugccaggggaugggcuccugcugagugcuggugaaaaguggagccgccaccgucggaugcugacgccugccuuccauuucaacauccugaagcccuauaugaagauuuucaaugagagugugaacaucaugcaugugaguuauuugaagccaaggucccagcugcagccuuugguuggggggaaccacagacagaucuagucuggaauuuuggcucugcugggugccucugggccauugucuuccucucugagcuuugguuuccucaucuguaaaaucccuacuuaaaagaaggucaaggugauguaguggagucaugucucuggcgcauaguaggugcccagaaggugucuguuucuauguucgcgucacccgaacccuguaaacucaagaggguaaugacaacaauugcauaauagcuguugcugauaagaaacaaccugaaaacucauugguuuaaaccaauaaagguuuaugaauccugauaagucugugggacaguucguggauucuucuggauguggauggaagggaucagucaugguacaugagcagccuggggucagguaggcagccuugcugguguuggcugaguucucucacauguuuggguuuuggcuggcuucagaccgauacagauggccucagcuuagaccccuggauguuccuccaucugauucucucccuccagaaggagucccaugguuuacaauacagauaggguuccagggaauaagaugaggcuuagcuucauuaguuaucaccucaucauuuuuaccacauuguauuuugacaucaaaagccaauaguccaacacggaaucaauggcaggggguaaaauaggcucugucuauuauugggaguugcugaaaaagcacauugcaaaggguguggauauggggagaagggaagaauuggggcgaagguuuugugaaguguuuagaauuuuuuaacuuuaaaauugauguuaagcuaguuacuguuucauaaauuauucuggaagaacaagaaacuccugggucagagacaaaggauaguuuuacuacucaugacacagagagcagcauguguugcuuguuagauugcacuucuucuccaagccucucaaaucccaugggcugacacaagugggcuucuauaaaugccugcugacaucauauauugcauuacagggaaggggcauuaggcuuaggaaucuguuuuuauagcaagcagaagcagcauauccagggggugucccuuauccucaaaguuauuuucugcaaacacaacucugagaaauuuuucaaguuaagaacaucagcguguugcauuugugacaugcccagaaagggugcucaggacucauggaggacuaccucuacaaaccuaggauauuuuuauaaucaauuuauaacugcagaugaggaaacccaacauuuauugagaacucacaauaugccagaaaaaaugccaugugcccauuccaugauacgaguauauauugucuaauuugauuuuaacaacucugcaaaggagagauuauguauuucugccccaugguagaugaugaaacugcaggucugagagauuagggagcuaacccaaguucacccagcuaaugagugagcuuggcaugguggagcagaguuucuaacaugaauuauauggcuccaaagcacaucaucuuaacuguuccugaauaucugacaggugggauauaggggaggguaaugaguugacuaauggcacacagagcacagaggacagagcuggaacuugaaccuaggucuccugacucccaaucuugggucuucaucucuuaauaguaacagcuuuugcuugcaccauaaccuggugcucccggguaaagggucccuggggagaagaugaagaggcuuauucuggggcgugcauauugauuguugggguuggagagcugcucaagggagcaagggaccugccccagcucuguccccuucucuggcuaggccaaguggcagcuccuggccucagaggguagugcccgucuggacauguuugagcacaucagccucaugaccuuggacagucugcagaaaugugucuucagcuuugacagccauugccaggaguaaguucuugcccagggucugggauccugggccguggacacaaaguugguagguggggggcuggggaggacugagcagggaaaucagacaaaccuucuuggaggaguuguuauaccugaucguugaaggacugguaugaauuuuaucuugagguuuccagggacucauuaaaaggguuugaacugguggguguggucaaagugggucucucucagggacugacuguaauguagcacuaaauggaguuaacacugaugcaaagaagcuaggguggaagcuggaccauggaccaguuggaagaggauaaagucugagcuuuguggacagcuucaggaaggagaaggggcaagacuguauacugggagggagagagggaauaggagcauaaugugcaaacuauccucugggugccuagcugcauggaggcaucucacagagaugggaugcagggagagauaagagagccuggagagucgauuucaugcugauccccauccugcaucugaggggccaucuguuccuggauaccccguuuacugauaggagguagcuccuagcugcuggugggaggugauccuggggcuucagguguauuaaauuguugccucccuuucugcccuuauccugcaggaagcccagugaauauauugccgccaucuuggagcucagugcccuugugacaaaaagacaccagcagauccuccuguacauagacuuccuguauuaucucaccccugaugggcagcguuuccgcagggccugccgccuggugcacgacuucacagaugccgucauccaggagcggcgccgcacccucccuagccaggguguugaugacuuccuccaagccaaggccaaauccaagacuuuggacuucauugauguacuccugcugagcaaggugggccucucugggaucugaauucaagaaguagaagggagcuucaugugaaaugucagaugaaagaauuugaacuugacccagagggcacuggggagccauggaaggugauugaggaagggagggacaggucagagauagguuuuggagauagcucuguggacuagcaccuaccaggggacugcuaaaugaaauugugaugagucugagauuuacucuauuuauaaguuaauaagcuaauuggccaccuuuuaaucuauauaucuacaucuauaccuaugucugggucuauguuuauguuuuugccuaugucuuucuguaucuuugucucugaguuugugucucucucuaugacuaugacuaugucuaugucuuugucuuuuucauuggccauaucuguaugucuuugucugcaucugugucuucaucuuuguuuauguuuaugccuuugugcucucccucccucccugccuucuuuuucuuucuuucuuucuuucuuucuuucuuucuuucuuucuuucuuucuuucuuucuuucuuucuuucuuucuuucuuuuccuuccuuccaucuuucuuucuuucuuuuucuuucguucuuucuuucuuucuuucuuucucucucuucucuuucuuucuuucuuucuuucuuucuuucuuucuuucuuucuuucuuucuuucuuucuuuuucucucucucucuuuccuuuuuuugacggagucucgcucuaucacccaggcugcagugcaauggcaugauuuuggcucacugguaaccccugccucccggguucaagugauucuccuaccucagccucccgaguagcuaggacuacaggggcacgccaccaugccuggcuaacuuuugcauuuuuaguagagacgagguuucaccauguuggccaggcuggucuugaacuccugacuucaugauccauccaccuuggccucccaaaguacugggauuacaggcgugagccacugugccccaccuugucaugucuuuucuaugucuguguuuaugucuuuuucuauaucuauauuuucguucuugucuaugucuaugugucugugucuaugucuuuuucuuuucucuguguuugugucuuugucucaguguaugucuauguccauguuuuuuugucugugucuaugauuaugucuaugucaaugcuauaucuauaucuuugucuuuuuuuuuuuuugagauggagucucgcugugucacccaggcuggagugcaguggugcgaucucggcuuacugcaaccuccgccuccuggguucaaaugauucuccugccucagccucccaacuagcugggauuagaggcaccuggcuaauuuuuuguauuuuuaguacagacggagcuucacuauuuuuagucucaaacuccugagcucgugaucugccugucucagccucccaaagugcugggauuacaggugugagccacugcacccggccauauuuuugucuuugaauuugccugugccugugucuguuuuugucuguccauguuuaugucuaugaguauuugugucugugucuauguccaugucuauguuuauguguauuugugugucuguguuugugucuaagucuaugacuuuuuccauguguuucugugucuaugucugugugucuaugucuuugucuauguguaugucuguugugacagaggcauuaaaucucuggaucagagcagcucaugucuugcuuacggcaauacuaucagccagaguaggauuguggcacugacucuccauucccaagucaaauuccuccaagggcaaugcgauguuuuccccuguacgugcagcagacuuuguacccuaggaaaggcacccuauauuaugagucucagcacauuuucuauagagagagagagagaggaagaaagagagagggcaccagcuuugugagagauuaugugcuuuguucuggaugccauauuccauagacuuacaacucaaaugucuccagggagauaagauucauuuaccacuguagaaugugggcaaauaucuuugaagcaauacuuaaucucuaauuuccaagacaaauugccauuuaauuauccuguaacccagguugccagugauuuuuuucucagaaaguuuucaucaagcagaaacaugaaagcauucaugggucauugagucuucccauuagggaccaaagaaaaggcaaggaagccagggaggaagcccaugggguuggggcucuggccauggugaccaagaagggucuaggagagcaagaugggcuuggguuucucgaaagaggaugaaucuucagagacugucucagauuagacucaagagcccucagagguacugugacuuuuuaugggggugggggugggggguuauugccuucucuccaggaugaagaugggaagaaguuguccgaugaggacauaagagcagaagcugacaccuuuauguuugagggugagggccccaguguggggcuagaguggggacuuggauaucuccauuccaggaacaggguggguggaccccucgcacuucccaucccccuucccccauccucccugagguccucaaugcaagguugcuguacacccucgggugcugaagcagcccagagacccaagccugccuugcugccccccaggccaugacaccacagccaguggucucuccuggguccuguaccaccuugcaaagcacccggaauaccaggagcgcugucggcaggaggugcaagagcuucugaaggaccgugagccuaaagagauugaauggugagugcaggugcuggugcccuguuccugagccugucucauuggcucuguuccccagguagggaggggagaagggguuguuuuuguugauucugccacuauugcuuagugggaauaggagcagaggaccacaggcaggacuuaguacccauccugacugucugggcaaagguuauaggcccuuaggacagaaagaccugggcuucugagagaauuguugaugauaugugaggacagauaacgccacuuagcauguguucagcaaaugaacuuccccuccacucucuuccuuuucuccaagaaauauuuuuuugaaugucuucacuuguugaauguuugcucuucuguucccuaauuccuacccuuccauccaguccagggauuuauaagggagaccuggggguaaaauucauccauucuuguccagaacaccugcaucauucauccauccaguccucguucagcaaauacucucauacugcauuccaacccccacaucugugcacagcaucuuucugugcucuggagaccugggaaggacccaaccagggaucuauuuuccaggugcucccagccuggugggggaacugucccugggcaggacagucccagcccacgugggcagggaugggguuuacaguaagggaagcaggacuagggggguauagaaagugucucaguugaaagccugaauaaugaucaguagauaauuggguacaguuggggagcagugcuguaggucaagaagaccaccuggggucuucgggggaggaagagagagaggagagagagagagagagagagagagagagagagagagagagagagagagagcagggucaggacagaaaggaggagaaggggagaaagagggagagacugacuuguggugagaugauaaaacuggagaugguagcaggggcuggcuguggaagccuuggggaaaauguuaauggcuucaguuuuagcccaagggcaauagggagccaugagaaguguuugaacagggagggacaagucacaucuggguaccaggaagaucuuucuagggcuaguguggaggguguacuggagaggaccagcuauagaaugagagcgcaguggggacauucugaggcucaagccaggccaggggcuggaggaaggagaggaagcauuggaguggacgggugucuuggacucaguguccucccguccaugccuuugcccagcacagcaguccugggaagggaagaaacauuuuuaugcuucuaaaauaaagaauauuuuugcaauuuuauuuuuuaaaacacauuuuuauugaugcauaauagaugcacauaguuuugaaauacaugugauaaucuaauacauucauauaauugauaaagaucaaaucaguguacuugggauauccauugccugaaauauuugucuuuucuuuaugcuagaaacauaacuaacauaagcaaacuacuuucuaauguacaguacauauuguaaacuacagugaaccuacugaucuaucaagugcuagguuuuauuucuccuaucaaaacucaaauucguacccauuaaucaacuucuccuuauccuucccuccccucugccaaucuaucuucuuuuuucaugagauccacuuuuucagcucccacacgugagugagaacaugcgauauuugucuuucuguuuuuggcuuauuuacuuaccacaaugaccuccaguuccauccauguugccacaaaugacaaaauuucagucuuuuaaauggcugaauaguauuccauuguguauacacacuacauuuucuuuauacauucaucuauugauagacacuuaaguugauuccauauuuucguuguugugaauagugcugcaauaaauacagaaguacagaugucucuuccauauauuuauuuucuuucuuugggauagaaauuucuucucuuucuuuucaguaguggaauuucuggguuauauggcaguucuaguuuuaguuucuugaggaaccucugugcuguucucugcaguggcugcacuaauuuauauucccaccaacagugugugugaguuccccuuucuccauauccucaccagcaucuaucauugccugucuuuuugauaaaagccauuuuaacugggaugagaugauaucucauugugguuuugauuugcauuucucugacuguuagugacauugagcauuuuuccaucuaccuauuggccauuuguauguuuuauuuuaagaaaugucuauucagaucuuuugcccauuuuaaaaucagauauuugguuacuuuuccuauugaguuguuugagcugcuuauguauucugguuauuaaucgcuugucagaugaguaguuugugaguauuuucugccauucuguggguugauucuucgcuuuguugauuguuuccuuugcugugcagaagcuuuuuugcuugauauaaucucauuucucuauuggcucugcuuuugaggucuuacauagaaagucuuugcccagacccaugucccggaguauaaaaccaagauuucaagcaaaauuaugcguguaguuuaaaaaaaauggucgaaagacuuuaugacaaaaaugaaguuccuuauuaagcuccaccuuagcggugacuacagucaacaguucucuguguauucuucuagaaaauggcuaucccgaugcccacauuuauaugaacucacacugugacuuuuauuuauaugaacacuuacugugcuuuucuuuguaagugaaaguccauaaaauagacacgggucugcauauuaucucugagaucuuuugcuuuucucaaaauauacauuuuggaaaaugaguuuguuuuuaaauuuguucuuugucuuuaauugacaaguuuuaauuauauauguuuagaggcacaguaugauguugugauauauguauacaaccugaaauuauuaaaucaagguaaugaacaaauccaucacuucauguguuuaucauuuuuguguugagaacauuugaaguuuacuuucuuagcaauuucaacuaauacaauacauuguucacuaaaggcaccaggcugggcagcagaucucaaaaacuuauuccuguugucuaacugaagcuucuacccuuugaccaacauuucacccuucucugucccucccccaccccuggccucugguaaccaccauucuauuccuauuucuaugagcucaacuauuuuaggucccaagauaaguaagaucauguguguuugucucuucugcaccuggcuuacuucacuuagcaugaguuccuccagguucuuccauguuguggcaaaugagauaauuuuuucuuuuuuaaaggcuaaaugggauuccauuguguauauauauauauauauacaccacauggaaaaacaacauuaaauuacaaaaugaaugauaaaaaagaguucuucuuguaccaaaugagacauuacagauaagacuaggguuuuccuugacaauccugccaccugaccuaauccuuucucauucuccaaagguguuucuagagccauagauuuguuuaucuaucuaucuaucuaucuaucuaucuaucuaucuaucuaucuaucuaucuauuucuaucaucuaucaauguaucuaucauugaucuaucuaucaucuaucaauguaucuaucaucuaucucuauuaucugucuaucuaucuaucaucuauguaucucuguaucuaucaucuauguaacuaugucuccaucaucuauuaucuaucucucuacuuauuuaucuaccuauuaucuauguaucuaucuauaucaucuauuuaucuaucuaucuaucuaucuaucuaucuaucuaucuaucauccauccauccaugaucuaucucuccaccaucuaugaaucauucauuuuuauaaauauauauccauaugcuucuugcuguuuuacauguacauauguauauauuugucacuuuuuuucacucaacagggugccuuaaugcuaucuuuuucugagugcuguauauuuuauuccauauuuuauucagcucauuucuauguugaagaggacauuaaacauuuucaauuauagucaauauuuccaauuugccuuccagagugucuguacugauuuaccuucuagccugcaguauguggugagacuagugaucccuauuuccuucuuuuguguaacuguauaguauuccauuguguggcuguuuaucuaaacauuuucccauuaauguauauuuggcuugucuccaaacuuuugcuaaacuggacaugaagcugucagcacgugugcacagugaccauuccuuacaugcauaggcaucucugcaggacaaauucucugaagugcaauugcugaaucaaagaccauuugcacuguauaaucauuauuuuuuugagacaguuucacucuuguugcccaggcuggagugcaauggugugaucucagcuuacugcagucucugccucccagauucaagcaauucugccucagccuccugaguagcugggauuacaggugcccccccaccaugccuggguaauuuuuuuuguagagaugggguuucaccauguuggccaggcuggucucgaacuccuaaccucaggugaucugccugccucggucucccaaagugcugggauuacaggcaugagccaccauacaauaugacugcaaauccuuuacuauuagcugaguuuuauggcacaaacuuucccauaacuuuaccaauaguacuauuguauuauugaauuuuaaaucuuggccaauuuucauauuucuucuuuugauggacauuuaaaaaaaguaagagugaggcugaacaucuuuugcacguguugauguuauuugcuuucuuuuuauggaacugguauucuuauuauuuuuccucuuuuucuuuggacccuuuaaaaguauuuacuuuuaagaauguguauuaagauugauuuuuuucugccuaguguugcaaaauauugccuuuuaacuuuuggaggguacuuuugauuaauuuuuaugacguuaaguagguccacauuuuucuuucacagcuguaaaauccaucaacuucccaggauuuuguuuagggugggugggggccccuuuaccaaaugugaaguuuucucuuauucucaugucuuuuucugagcucuuuaugcuguuccaugggucuauuuucuuguuucugcaacagugucacacuguuuuuauuccugcgacuuuguaacaauucuuuuaaaaaguuuauuucguuacagggagaaaaggucucacuugcaaacagagagaagcuggagaguugugucuuugcucccuugauaaggauuggggcugggguguuuccuuagggacgaccuggcccagcugcccuuccugaccaugugcauuaaggagagccugaggcugcaucccccagucccugccgucucucgcugcugcacccaagacauugugcucccagacggccgggucauccccaaaggugccacagccucagggggaggagccuccuggguaggaagaggggccccucaggcagggagcauuguccugacugcccccuucucucccacaggcauuaucugccucaucaguguuuuuggaacccaucacaacccagccguguggccggacccugaggugcgggccccccgucucuguuuuuguccauuccaaggcuccuagaggagggggcaggguuuugaucaggagaauccaacaucaccucccuccaagacacacaccacugucucuccaaggcuggcggacugggagaccccacccggcaacccuucuuggucucgccuccaggucuaugaccccuuucgcuuugacccaaagaacaucaaggagaggucaccucuggcuuuuauucccuucucagcagggcccagguaagagcggccuguguuugaggcggggacggggagauaggugcaggggucugggcaugacaguggggaaaagggggacauuguagacgguccgaguuccagcucuccuucccucaccuccucuggaguuuaugggaaaaggcccacagaguaggauuggguugguccuagaaggaucccuagugagcucagagcucccuccuaccccaccuuggucuaggcugggggguuggagcucggcuaggcucgcaggauaugcaagcccacauggggauccaggcacggauacccccuucucuguuccucaaacugcucuaggugggguugggugucccaggccagguuaccggcuugauggggccaggauggggcaccugggugcagucagaguuuccaccucccuccccaaggaacugcaucgggcaggcguucgcgauggcggagaugaaggugguccuggggcucacgcugcugcgcuuccgcguccugccugaccacaccgagccccgcaggaagccggagcugguccugcgcgcagagggcggacuuuggcugcggguggagccccugagcugaguucugcagagacccacucugaccccacuaaaaugaccccugauucaucaaaagugaggccuagaauuacccuaagacccuguuccacaguccuguauuccauccuagauaucuacucaaaauaauugagacaaguguucaaacagaaagacgcuugugcgugaauguucauggcagcccuauucacaguagccaaacgaugaaaacaaccccaagcuauauauuaccagaugaaaggauaaacaaaauaugguccauccauacaauggaguauuacacagccauaaaaaggaaugaagcagugauccccacuacacuguggaugaaccuugaaugcaugauacugaaugaaagacaucagaugcaaaaggucacauaguguacuguccuuuuauaugaaauuuccagaacaggccaaucugaagagauguauaguggauugguggcuuucagcagcuguggggaggugggacugaggagcgacugcuaaucaggaugggguuuccuccugggauggugaaaauguuccggaccuagauagugaugaagguagcacgacacugugagugcacuaaaugcuauugaauuggacacuuuagaaugguugaaauagugauuuuuaugugaauucuaccuaaacaugcuauuacagcucauauauacuuuuuccaucuggauucuucacaaaagaauauguugugagcaucuuuccaugauauuaaaucaucuuaggaaacauuauuuuguguucuucaaaaugugcauguuaaguauucaaaucagucuuaaauuuuuaaaaauauguaauuuuagaaaauaauuuaaaagguuuuguuucaguuuguaagauuucuuuucuggcacuuuaauggcuugagguaucauuaucaguuacaaauugaguuauucuucaucaaaugacuuuuggaguagagauuuuauuuuuauagcaauagaugcacagauauuccuguaagauacaggugugguuagacacuuuucuagaacaggcaugcccugcaaacuccacagacacugacuguuuuuguccuauuaagaaguagaccacugagaagggagaaggugacauuuuagcuuucccagguaaaagugguuuucauccucacaccaauuuuauggacuggacguuaacucucuugcucaaggucacucugaguggaagaguggggauaaaucugguucguuuggcaucagaggccaugacuuuuccuaccacagaaguaauuuucaaaguaagucucugcccuaggcacaucagaucaccuggggaccacuccagagugaguagacaagacuuugacaggggugccuaauuuuuuuuuuuuuuugagauggagucucgcucuguugccca

SEQ ID NO: 191898 - RNA, 37492 nt, Homo sapiens
auuccugacagcaccucccggaccggacauaacgguccccgcgcggcuccccgaaccggaaguggaggugagcugucgcgggcggcgcccggccuugcucaacgcccagcaguccccaccgucgcugccgccgccaccgcccucggccgcugccgaggccuccugcagccaucauguccgccagcgccgucuacgugcuggaccugaagggcaagguacugagggcuccccacccucccuguugccaggcaaccggcaggggccuccgcccgcggggacccacccuguugcuagguaaccggcuuaugagccccauccuggugugaggcagagaggccgguagaccucaccugagagccccauccuguuucuggguaaccgggcgggggucuuaaguggguaauccccgcccuguugcuacguaacgcggugggcugcagccaccgcguugccagguaacugacugcaccgcccucugcuccccggcgccggggccgggggcucgggccucgguggaggacccagaagcggggccgcagccggccucggagccaggcagggcguccaggggcugcgcgacccuuggccggggguggcgaggcguggcggggacugggugcucucgagccagucccgccuucucagggcguuacagcuucuguuuaucgugcacuuucucucaguaggaauuucuccacguucauugugauagugaguuacaaggauuaggugaggugaguggugaucacgagugccguuuuauagagggagaaacugaggcauggagaggugaagcaaccugaccaaggucacaauggucacagagaaguagcaagucuaggaguccgauccagaaucauucguuuauucagcugauaucuggggagcaccuacuaaugccgggcaggguacuaagccuggggucgauuuguguuuagcaaaaaacagucccuuuuuuuuuguuuuguuuuugagauagugucaugcucagucguccagucuggaguguaguggugcaaucuccacucacugcaaccuccgccucccggguucaagcaauuuuccugccucagccucccaaguagcugggauuacaggcaccugccacuacgccgagcuaaauuuuguauuuuuaguagaggcaggguuucaccauguugaccaggcuggucucgaacucuugaccucgagugauccaccugucuuagccucccaaagugcugggauuacaggugugagucaugugccagggcucaacaaucuguguucuuacgguguucacaggcugguaggggagauggauacccaucuccaaaaacacaaauaaaugucaauugcagugguguugaggggcgaguguguuauacagacagucagccucagcccgaggaugagagaggguuucccugaggaggggugacaaauggaccagagacaccagggagcuggacauaaacuagaacccaggcaucuuccccagaggaucugagaaaacuuuaagaagggauuguccccaccuuuuagaaaugguccucugccuucuccuaaguccaucccaggugcaaggcagguggcugccuggccuguugcauguggaagcaacaagaaccgguccaacaaugugaagcccaacauugaucagugagagaaacaaacaugggugucagguccuaggugaggcgggcaggggugagcccuaaagcagcugagagugaagaggugaaauggcugccccuucccgccccaccccacccccagcacuuuccugaagucccuugagugggugccugcucuggaagccacccaaagucaacaacuggugagacccagugcugggcuucccucccccgccuucuuggaaggagggaagacacccgucuuagagcacgccaggggcuggguggugcgguggaaugaguccugguggaaugagucuugcuuccacccuggccacugccuccccagaggugccagugggcugccugucuuggcuugcuuauuccuucagcaaacauuucaugagcaccuagcaugcacccugcccuaugccgggcauaggguguccauuggcgccauggcugugguguuaggggugagcucaaaacccaucccugcugcucagcugugugaccugggacaggcaccuucuccugucugagccucacuuuccucacuggucaaaagaggcuuuuauggaguuauugugcagauuugcugagcagaugcaugagacaggcucagcaccacccaugguccauguuagcucucccaggccucucggucuagcaggggagucaccuagaagcagagacauuaccacacaguuggauccaggcagccacaggggcaggaacaaggucccaaguccugcaguugcucaaccucaucuuuagccaguggaagggggaggugguuaugaaaggcucccugaagagggcgacgcuggaaguagguuuggaaggcacgaucauguggaaaagagguguugcaaggggcagccugcuggggcugccaagccagaaguccuggcuaaugcugagaugggagagagggaccaaggggaccacuucaguuccaaccaggagccaccgugaggagaccguagcccagagaggcaugaucagaccugccuuucagaaagcuccccaaggcagccgugggcuuccuucccuuccucugcaaccaugaugcccuuucuuauuccacgacccacggaccuccuguuuccaaagucagccucgugagccgacugcauuuaaucaacaauaaagcacacugagaaauucauggccacgugucuggucaccgaggacaccagcguggccacacugggcugggaggaagcuguccuaguaggaagcuucuccgcuuuaucuaacuggcuucucagcagcuucugacaccacuaaccaccuccucuucagugcucccuuccgcuuccaggaggcugcgcucugggggguuuccuccuguuucuugcacugccuacuuuccuccuuuucugcccuccccagggcuguggagcggcucaggccuacgcgugccuccccaugcugucacucuucccaggugggcuuugacucauguccaugggccagugacucucaauuuuguucacagcauuucucuggagaucuaguggccucugagacaccagagaggucccgccgccaccauaaauucagcauucuucuaaaugcacucccuguaccugcucucuuuccauuucagugaugccaucacccauucagccaucugcacaagagaccuggacguuauccucgccuccuuugucuccucaccccuguuuucacuccacaaauguuuacugagcaccuacuaugguccaggccccuuucugggugcuggaaaacagcugugaaugagacaggaguaguugcuguucucaggggaugucagacaguaaaggaggauagaaauaaauguuuaaugcaccaggugauagggauaaagcaggggucaggguucagagggaugggacaugaucucagccagagcaagcagggaggauuucuuuuuuuuuuuuuuuuuuuuuuuuuuuugagauggaguuacguucugucagccaagcuggagugcaauggcacaaucucggcucacugcaaccucugccucccagguucaagugauucuccugccucagccucccaaguagcugggacuacaggcaugcaccaccacgccuggcuaauuuuguauuuuuaguagagacaggguuucaccauauuggucaggcuggucucaaacuccugacuucagaugauccgccugccucagccucccaaagugcugggauuacaggcgugagccaccgcgcccagcugggaggacuuccuagaggagguguuauuugagcugaggcuugagaaaugagaagagccaggucagggcaaaggcccgaggugggaacagauguggaucacucagagaccagcuaaggggccaggcuggagcagagugaaccagggcagcgcaggcagagaggcgucagaggggcugugaggagccagaccacgcugguccuugggagccauggggacgggcuugggcuuuguucucagugccggggaggcugggguaaguggcaguucagcagugggggagagaccccgucuggcuucuguguaggaagagcccugucacccuuugugaggaaggaccuggggggucaagagugacagcagggggaggggcuguucccucaacacgucaucaccugccucccuccaaucaguuccacaggccacgaagcagacacuaggaaaggaaggugccaccccgcaccacccccagucucgccuugagagaauaaaggcagcgugugaugaaaugccaaguucugaggcaggugguucccaggauggucagcgccgcaauggccuucucagcauguugcugaguccugcagcuggcuguccugcaggccccaagagcugcagcugcuccaggcagcaucuccaaccgcagccaugcccaggcuagcaaaacuuccgaccuccuuuuuauucuuuaaugagguauaauuuacauuaauaaccugcacuuaucuaaaguguacaauuugaugagcucagucaugugggaagccauaaccacacauuccaucgcccccgaaagcuucuucacaccccuuugcugucuagccccaucccuaggcacccaccgauguguuuuucaucaccauuuucuaggauuuuauacacgugcagucaugcaggaugagcucucguuugucugguuucucucagccagcacagugauucugaugcgccuguguaucgggaguccgaucccuuccguugcugaggcaugcuucucauggugugcacggauacaguuuguuucuaguucaccugcugaaggacauuggcauuguuucuagucugggucuguuucaauuaaagcugcuguuaagauucucgugcuaguguuugugcagacaugugguuucauuucucuuggguaaauaccagagagaggaaugacuggaucguaugguaacucuggguuucacuuuuugagaaacugccagacuacaccaaaguaguugucccauuuuccauuccuaucagcaguggacagggguucuggaugcuguauauccugacccacaggcuaugaaagagagagaccaggaagagggcuucucccuucaggccaccuguggacuucaguaaauacgaaccuucagcgggagugggcgcccugacacaggcgggagagcaaggugcguuggcccggcaaaggcucugagaaggucugcauugagagcuugugaggcauugcuuaaccugaugucucugggugauucaguccuggaccuuugcugcagaguucgccucuacccucacccugcgaagaacugcaguggccccugugggcauucacacugggagaugcucuucuccaggaauucccugggggauggagaucagaacggccucaaguccugcucuuuugcggauaguggccaugaccggaguccccagagcgaagcaggguggugcaucucacccccugccccaagcccccagauuguagaacugaaaaugcaagcaucuuuucucuuccuuccccaccccaggugcucaucugccggaacuaccguggcgacguggacaugucagagguggagcacuucaugcccauccugauggagaaggaggaggaggggaugcugucgcccauccuggcccacggggggguccguuucauguggaucaaacacaacaaccuguaucguaucccuuugcugggggugcucccaggggacuccuguguggguguuggugugugugcauauccacacgccugcaagcagggcugguuugugcacagcgcaagcauuggacacagccaugcccuccuggagcucccugcugccugcggagacaggcagacaaugcacgaugacaugugugauggguguggggagaggagcaggugugacuugaaccucuucagcccaggggcccaggaagggaaaugacacccuggaggaagccugcagggaggccuggcuucugccagcuggaggggugggcaggcacuaggcgugggugaaggcucugcagggaagagccucauuccaacagcugcacucgggguggcuggagagggggcguguagggcagcgaggcuggaguggucagcggggucuggggucucaaagaacaucaucugaaaugugacaggaagucucuggaggcuuuuagaugugugucuucuggagguuucuggcugcugaguggggcaagacuguggggacaggagaggacauggguagguggggaguaggcuggggccaucgugcaggugggaggggaaguggccuggaccacggagggguggugggguacagccccgcccagaucucagagccccccacccuuccuguccuugggcccauggggagacuuggccaagccaguuucuauccaggaggucuaacuggccaccccacagcuuugggcagacccgcaagcccaucucaguacccacacuacugcggaagggccugcuuugccacucacagcccguuugagccccagcuccagcagccaugggggaucccucaccuucccacaguucagugggaacaacgaccccucacugcaggaccauucgggucaguugaacugacuugugcauauugcucccagcaggcaugggcucugugcccuuuccuguguucuuggagacacuuggggccuugccaguacaguguggccaacgggccagaauauccgcugggagcccuuuggaaaugcagaaucccaggcuccacccagcccugccccgucagaaucugcauuguaggaagauuuguuccugguggccggugugcacauucccaugugggccgugcuggcccagggcucccuguggugugccucuguguagauuucaccuggcucuggaaggcccugagaauagcucugaagaugaucuuagguggcuuuuuuuuuuuuuuugagacagagucucgcucugucgcccaggcuggagugcaguggcgccaucugggcucacugcaagcuccgccucccggguucgcgcuauucuccugccucagccucccgaguagcugggacuacaggcgcccgccaccacgcccagcuaauuuuuuuguauuuuuuuaguagagacaggguuucaccauguuagccaggauggucucgaucuccugaccucgugauccgcccgccucagccucccaaaaugcugggauuacagucgugagccaccgugcccggccuagguggcuuuuaacccagggaacugacaguccucugaagccgcccagguauugggagagggagagguggcuguggucugagcucagcaggagccaucagaucaguuucugguugggcccccacauuucacaccugggcaucuagggaagagacagggagggcucaccccucuggcuuaguggacaucguuucacccccagccgggacagugcucagcaaggccguggcugagaggcacccaugagaaggugagaggcccccacugccccugcuuauaaagcaucuggggagggcacauugccaggcagcaggagggaggccagcacucguuugacugggccagcgucccuuuccugggccccugugcugugcuggggugaggcgggaagggagaggauacagcccccacccucccuccuagagcucacuccugggcagacgagccaggcagcacagaugugccaugaacagggauguccagggugcagugcaugggccuacagaggaagaaccagccuucucuggcggcccggggacccauuagggaaaaaggaauaggaagcgcccagcacacacugacccugggaggcaggggcuggcuccuguggcagaagggaacaucugugccagacaucucaccuacauugccuuggugaguucauucacaggccuccauuacacaggagagaaauaucaagguuucucuagaaagguuuauuucaugggccaaggcuuguguuuccaaagccaggaagggcugaagccagaauuggcccuggcugcuugccacagagucuggccgggggacccuggaccucagcagggucaugaugaggucagcuuuggaggagcagggccaguguguccugcuuucugcuccuggaaugagccucacucccucccugcucaaggcagcccuucacccagccgccgggacaggugcccugugccaccugccaucccugugauucuccaucucagugagugcucccuggggccugggagcgcaucuggcuggugacuccugugucccaggucuagcuuggaccaggagcuuuguagcccaccaugggccaaguaaacggcugggaguggggauagggaaggcucugaggguugugaggguuagggggucccuccaugaaccaggaucuuccaggcagcagccccagccucugaaugcuccuuaacuguggccgccaugcagugguugccacauccaagaagaacgcgugcgugucgcuggucuuuucuuuccucuauaagguggugcaggugagucucgcucggaggggccgugggcuuggguggagguugucuuggcucugcuuguggaccuccccauaccuggccacccuacagagagcuguggcauccccagggagcacuggggcuggaagcccaggaagugggaaaggggagucccaacuccccacgccuguggaauucuauagcucacguugcuccccuaccguggggaagaaaggaaagugaacaggaaaagguagggcucagagcaggggugcccugacccuggaagggacaagcaggggucagcgagcuuuggaaggauguggggugaccagcuggauggggcuggaauaaccagcagagcugcagagcugagcccaccucagaaucucccagggggcucucaaggcacagaugccugacgcccaccuuggagagagcugacacgccaggcccaggcugccagugagacacagauagcagccagggugaaggcgccaggacagguguauguguggugcagcuagggaggccagcgugcguguggcagaguaugaggcugaggucagcugggaagagggcggauuauacaggaguguggauuucauuccacuucugaugaaagguaguggagggcuuuaagcaggagacugacaagacgugguuugaucuaaagcagccucucuggcugcugagcagaaggaggacuugaggccagugaggaggcugcugcuggcuucccggagaggaugggccuggccgaggugggcuguggggcucacgaaaguggggaacaggacccaggaggccugugcugggccugggaaagcuuucaucccucacugaugcugccugugcagaauguuggggaacaggggcaagccugggcggugagggcuuggggaaggagccgagggucaccugggaaggccccacgugcaggccaagggcugccuucacuggaccggugaugcugucacaggcagggcugggccuggcugugcugccugugguuuccaagcagaggccgggugaucacaguccugaagcgcgcaggggucagcagaucagagaaugggggaugcgggaaggggaagguccucacccaaggguugggcugugccuuucuguuuuagugacgcuccuuccuucagcauuugugccugcaaaagugcuucuaacagccccucuucuuuggcgucccuuccuuaaccuucugagcuuuccauugaaauggggaagaugcaucaagcuuuccacugaaauggggaagauggcagcucaucagguccuugccugagucacuccagacucagaaagggaugacaguuacagucgcucaggaggggcugccugucugcgggugucugggcagggaagagaaugggaacgcagagcuucugaaggccucgggacaucugcaguggcuccagccuggccccaccccacagccagccacugcuguccugccccauaaccuggguccagggcccuguagcacaccaccgagccugggaaguaggcuguugguaggacuuagcgggcaaaugaaugugugcaagcguucauucauuccucauccguccgcucaaugaucugccucccauuccucccucccuccccaaccgccacagguguuuuccgaguacuucaaggagcuggaggaggagagcauccgggacaacuuuguuaucaucuacgagcugcuggacgagcucauggacuucggcuacccccagaccaccgacagcaagauccugcaggagugagugggcagggguggggccuggggccaggccugggcggugucaugacaucgacgucaucagguguggaaacagaaggggcaaauuuguguucauguugucccccaccugccucccaccuccagcaguauucggguuuuuacuaaguugcucuuagugguuuuaauucguuuccuccucuacgcccccacauaaccgugcuuuuccugcuccucaucuuuacucuccauccacacagaugccuucaguaccuugcuacuaaggagucaccucccuuguuuuuacugucauaaaaugagacugugaucgaaaucuccccucuuuggaauccugcccuucagauaagaagcaaugugaauuaagugcuuccugggggccgggccccagcacuucacauucacucgauucacagccuccccguauaccgucuccccauuuuacaggggacaagcaagcagacucccagagaagccuguguuccuaaccgcugcaccuccugcuccuucagcaggauggggucaccagguuacacuccgaggcgucaguuccauccacgugcucagcagggacgggaagcagcucacacccacuucuuguuuuccuucccaacauggucuucuuggucccccaaaaugagcacuucagccucuauaacuugaguguauuggcuuuuggaaauugugaagauuuuucuguaugaagcagccccaggugaaccagaggcugccuuuucuggagcugcugaaauccaagggcuauuuucaagucggucagaaccugcccuguaccccccacccaacccugccgaaaugucaaggccagaagcuguggcguuggugcggguaccaccuccuucacucugagcguguggccccacagguacaucacucaggaaggccacaagcuggaaacaggggccccgcggccaccagccaccgucaccaacgcgguguccuggcgguccgaaggcaucaaguaucggaagaaugagguguucuuggacgucaucgagucugucaaccucuugguaggccucuuuucuuuccuucuucuguaggguuuuaucucuuccacgauagaaauaaacacagcauuuuaaaacuggcaaagccccgagagccguucugugugguaacagauagcaggauucaguuugggccacucauugaaaugugaguuugucuuaucuuuuuuuuuugagacggaaucucauucugucgcccaggcuagaguguggugacacgaucucggcucacugcaaccuccgccucccagguucaggcgauucuccugccucagccucccguguagccgggauuauaggcacccgccaccacgcucggcuaaagcuuguuuucuuuauuagcauuuaugcugacugagaauccauacaugcacauuauuuuuaaaaauuagaagcaggguaugagguuagaaagugaagggcucuuaucagucaccaugcacagaaaaaaaaaaaagaaacuaaagggcuccuauaaucagaaagauuaggauuuauucaccgucacccucucgggccucauucuguagacagacagaaacaaguauauugauuuuucuauaaaccugagaucauaagaugugguucuccugcagcuuguuuuuuugguggugguuguuguuuggguuuugauuuugcguucaguguuacuguuuuguauauuuuuuucuuuugguuuuuuaauuaugaggaaaguugacguuuugaaaaugaauuuuagcgcuuguacagauuuguguacccaucaccacacccaggacacagaaccucaaaaccuccucauguugccccuuuguagcuccaugcuccccucuuccccauuuccuggccaccauugaacuguucuccaucacuggagucuucaucguguugugauugucacacgaguggcaucauaugucaccgcagcugucuuucugagauugucguaugaauggcgucauacagucaugagcucucgagucuggcugcuuuaacucauucuaauucuuugcgauucauccaaauccaauuguuuugcauaucaaaagucuguucccuuuuauauuuauuuauauuuauuuucuguucugaaccacagaaggacauuugggugguuuuccaaucuuuggcaauugucaauagaguugcuagaaacaugucguguccagguuuauguguggacauaaguuuucaucucucuaggguaaauacccaggagugggauggcugggucacacgguaaguguauguuuaccuuuauaagaaacugccaaaccauugcuguuuugcauucucgccagcaacagaugaggguugugaugaccccacauccuuugucaguaguuuuauuuuugucauccuaauagguauguaguaguaugucagcacaguuuuguguuuuguuuuuguuuuuguuuuugagacacagucucgcucuugucgcccaggcuggagugcaauggcacuaucuccauucacugcaaccucugccucccaggcuuaagcgauucuccugccucagccucccgaguagcugggauuacaggcacccaccaccaggccuggcucauuuuuguauuuuuacuagagacgggguuucaccauguuggccaggcuggucucgaacuccugaccucagaugauccacccgccucugccucccaaagugcugggauuacaggugugagcuaccacgccuggccuauuccauuuucuuaauggcuaauaauguugagcauugcuuuacauguuucuuugucaucuguauauccucuuuggagaaaugucucugugcaucuuuuuagcauuuuuaaauuggguuauuuucauauaguugagccuugauaguucuuuguguguuccagauagaaguccucugucagauaggugauuugcaaguauuuucccccagucuguagcuuaucuuuuuauucucuuagcaguguuuuuuuuuuuucgacagagucucacuuuguagcccaggcuguaguacaaguggcaugcuuggcucagugcaaccuccaccuccgggcuucaagugcuucuccagccucagccucccaaguagcugggauuacagacgcaugccaccaugcccggcuaauuuuuguauuuuuagucgagacaggguuucacuauguuggucagggugguaucgaacuccugaccucaggugaucugccuuccucggccucccuaaguguugggauuacaggcgucggccaccaugcccagcccccaauacuauauugaauaggaguggugagagagggcaucuuugucuugugccaguuuucagggggaacgcuuucagcuuuugcccauucaguaugauguuggcuauggauuugucauagauggcucuuauuauuuuagguauguuccuucaaaaccuaguuaguuggcugggcaugguagcucccgcucuacuaaaaauaggaaaauuagccgggcguggugaugcgcgccuguaaucccagcuacucggguggcugaggugggaggaucacuugagccccagagguagagguugcagugaguccagauugugccaccgcacuccagccugggcgacagagcaagacccuguuucaaaaaaaaacaaaaaacaaaaccaaaaaacuccaguuuguugagaguuuuuaacaugaagagauguugaauuuuaucaaaagccuuuucugcaccuauugagaugaucauguaguuucugucuuuaguucuauuuaugugaugaaucauguuuauugauuugcauguauugaaccaaccuugcaucccagggauaaaagccuucuugauuguggcggauuagcuuuuugauguacugcuggauucaguuuacuaguauuuuguugaggauuuuugcaucaauguucaucaaggauauuggccugaaguuuucuuuuuuuguuguaucucugccagguuuugguaucaggaugaugcuggccucauagaaugaguaggggaggagucccuccuccuccguuuuuuuggaaucauuucaguaggaaugguaccagcucuucuuuguacgucugauagaauucagcugugaguccgucugguccagguuuuuuuugguuguuaggcuauuuauuacugaugcaauuuuggagcucauuauuggucuguucagggauucaguuucucccugguuccaucuuggaaggguauauguguccgggagauuauccauuucuucuagauuuucuaguuagugugcauagaaguguuaauaauagucucuaaggguuauuuguaguucuguggggucaaugguaauauccccuuugucauuucuaauuguguuuauuuggguuuucucucuuuucuuaauagucuagcuagcagccuaucuaucuuauucauucuuuuaaaacaccagcuccuggcuuacuugauguuuugaaugguguuuuugugucucagucuucuagaguucagcugugacuuugguuauuucuugucuucugcuagcuuuggaguuggaggcuuuugcuucgugaguucuuuuaguugugauguuagguuguuaauuugagaucuuucuaacuuuuugaugugggcauguagugcuguaaauuucucuuaacacugcccuagccgugucccagagauucuggucuguuguaucuuuguucuuauuuguuucaaauaauuucuugacuucugccuuaauuucauuauuuacccaaaaguaauuugggagcagguuguuuaauuuccauguaauuguauggguuugagugauuuucuuaguuuugaauucuauuuuuauugauuuguggucugagagaguggcugguaugcuuuugguucuuuugcaucugcugaggauuauuuuauguccaauuguguggugguuuuuagaguauguaccauguacagaugagauauauucucucguuuuuggguggagaguucuguagauaucuaucagguccaguugauccagugcugaguuaagguccuggauaucuuugauaauuuucugccccagugaucugucuaauacugucagugggguguugaaaucucccacuguuauugugugggagucuaagucucuuuguaggucucuaagaacuugcuuuaugaaucugagugcugcuguuggcugcauauuuauuuagguuaguuagaucuuguugaauugaauaccuuaccauuaugcaaugcacuucuuugucuuuuuuugaucuuuguuggcuuaaagucuguuuugucugaaauuaagauugcaacucugcuuuugucuguuuucuauuugcuugguagauuuuucuccauuucuucauuuugagucuguggguguuauugcaucugagaugggucuuuuuuuuuucuuuugagacagagucuugcuguguugcccaggcuggagugcaguggcgcaaucucggcucacugcaaccucugucccccagguucaagcaauucuccugccucagccucccaaauaguugggauuacaggcacgcgccaccacgccuggcgguuuucuauuuuuaguagagacgagguuucaccauguuggccaggcuggucucgaacuccugaccucaagugauccacucgccucggccucccaaagugcugggauauuacaggcaugagccacugcacccagccaagaauggugucuuaaagggagcauaucauuuggucuuauuucuuuauccagcucuugccacucuaugccuuuuaauuggggcauuuagcccauuuacauucaagguuaguauugauaugcauguauuugauccugucauuguguuguuagcuguuuauuaugcugacuuguuugugugguugcuuuauaguguuacuugucuguguacuuaaauguguuuuuguaguggcuaguaauggccuuuucuuuccuuuuucuuuuuuuuuuuuuugagacaaagucucacuggguagcccaggcuggagugccauggcgugaucuuggcucacugcaaccucugccucccagguucaagugauucuccugccucagccucccgaguagcugggacuacaggcguaugccaccaugcccagcuaauuuuuuuuugguauuuuuaguagagacagaguuucaccauguuagccaggauggucucgaucuccugaccugaccucgugauccaccugccuuggccucccaaagugcugggauuacaggcgugagccacugcacccggccuuuuuuuuuuuuugagauggagucuugcccugucacccaggcuggagugcaauggcaugaucucugcucacugcaaccucugccucccuggcucaagcaauucuccugccuuagccucccgaguagcugggauuacagguacccaccaccaugaccggcuaauuuuuguauuuuuaguagauauggaguuacaccauguuggccagacuggugucgaacuccacaccucaggugauucgccugccucagccucccaaagugcugggauuacaggcaugagccaccacacccggccuucuuuucauauuuaguacuucuuucaggagcucuuguacagcaggucugcugguaaacaaauucccucagcauuugcuugucugaaaggaucuuuuuuauucuucuuuuuuuuugagacagggucucauucuguugcucaggcuggagugcaguggcaugaucauggcucacugcaaccucuaccucccuggcacaagcuauucucuggccucagccuaccaauuggcugggacuauaggcagguaccaccacacccggcuaauguauauguuuuugguagagaugggguuuugccauguuucccaggcuagucucagacuccuggauucaggcacuccacccaccucggccuccuaaagugcugggauuacagguugagccaccacacccaaguugaaaacgaucucauuucuccuuugcugaugaagcuuagguuggccagaugugaaauucuggauuggaauuucuuuaaaaauguuuaauauauuggccaggagugguggcuuacaccuguaaucccagcacuuugggaggcuaaggcgggggcgggggggggggagaggggggaggggggaggggaggggaucaccugaggucaggaauucaagaccagccuggccaacauggugaaaccuggucucuacugaaaauauaaaaauuagcagcacgugguggugcaugccuguagucccagcugcuugggaggcugaggcaggagaauugcuugaaccugggaggcggagguugcagugaccugcugagaucccaccacugcacuccagccugggccacagaaugagauuccaucucaaaaaaaaaaaaaaaaaaaaaaaaaaaaagaauguuuaauauaggccuccaaucucuucuggcuuguaggguuucugcugagaggcccacugcuagucugaugggcuucccuuuguaggugaccugcuaugucucucuagcuucuuucauuuugacccuggacaaucugaugauuauguguuuuggggaugaucuugugaaguauuuugcagggguucucugcauucccugauuuugaauauuggccucucuagcuagacuggggaaguucucauggauaguauccugaaauacguuuuccaaguugcuuccauuuuccccaucucuuucagggacaccaaugaguuguagauuugcucucuuuuuuaaucccauauuucuuggaggcuuuguucauuccuuuucguuauuuuuucucuauucucaucugacugucuuauuucagaaagccagucuucaagcucugagauucuuuccucagcuuggucuguacuacuguuaauacuugugauuacauuauuaaauucuuauacuguguuuuucagcuguaucaggucaguuacaucauuuucuauccuggcuguuuugucugccagcucauauauuguuuuauuauaauucuuagccuccuuagauuggguuucaauguuccuaaucucaaugaucuuuguuccuauccauauucugaagucuauuucugucauuucagccaucucagccuaguuaagaacucuugcuuugggaggccaaggugggcggaucacaaggucaggagauugagaccauccuggugaacacagugaaaccccaucucuacuaaaaauacaaaaaauuagccgggugugguggcgggcgccuguagucccagcuacuugggaggcugaggcaggagaauggcgugaacccaggaggcggagcuugcagugagccgagauugcaccacugcccuccagccugggcgacagagcgaaacuccgucucaaaaaaaaaaaaaagaacucuugcuggagaacuacugcaguuuggaggaaagaggacacucugguuauuugaguugucaagaguccuugugcucguucuuucucauuuuugugggcugauauuccuuuagucuuugaaguugcuguccuuugaauggguuucuuuuuccuuuauccuauuugaugacccuggggguuugauuguguauaagguggguucaguuggauggcuucauuauuggaagauuuuaggggaccaaggcucagcuuaggacuccugaacugcaugcucuaacucuggaggacugguauccagcccuggcuuugaucucuggcuccuucagguuaagaaccugcucugcuagaggggccaagcugcucccagacagcuggucacaacacuccaauggguggugccaggcaaagcacuucauaggguaguggcagcaggaucuguucuuguuugcaugugccagcggcagcacagcggggugcacgcuuaucggcugugacagagugcuaguggaugucagggagccagccucugggagggcauuuguagcagcagcaguaguggcaguauggcuggggugggggcaggggccacgcuggcaacugugcaccuguucauuggugccgaugaugggguuagcaugggggcacuggugggugcaggacugugugugcccuuugugcauguucacacuggcagcaguggcugcucagggcuagggguagguccucuguuuucucugccuaguuuccugugggaggcccagcauagguggggaacugggagggguggggcuggcgggcucuaugcugccaacacucugacaacaacgguggugggagaggagaaugaggggcuggggugcacuuaugcuggcaacaguggcacagcagggugcacacacaggcaugcuguuggggaagggugggcuagguccacccacgcacacaccaccagcaaaacaauauugagggugccugugggcaagaaccugcaggcaaaacugcacaggggaggcugcagugggagcggggcucaggugggcuaguguguccauggggccgcugugcaggaguauuccccguucagguacagucugccagugcaggagcucugaugccgcccccaagagguaccuggggauugcacugcaagcaggcuuggccaggcuggggccccaggagaggccagcagacugaggguugcucaggucagaccagccccaucugaugggcaagacuacccuggagaguucaggucugacaguuccccuacggcuaaagucuccuaugagagcaagucaagccuaggggauggguguccuggcugugcuccaccacauaugcuucugcaucaaacccccuggccuggcuuaggcuggaguucugccccgccugagguaggaggcagaacucgacuuaggaggugaggcuuggacaccagaccaaauugaggcuagcuaaaagaggucagggcagaagcgccuccccauaagacccaccccacagugugcuaugucaguuugccauugccguggcaacacuuggaaguuacuacccuuuuucauggcaaugacccaacaaccuagaagcuaccacccacauucuagaaauuucuuuauaaacugccccuuaauuugcauauaauuaaaagucaguauaaaugugacugcagagcugccucugagcugccgcucugggcgcacugcccaugggguagccccgcuccauagggagcagugccucugcugccgugcacauggcugcuuuaguaaaaguucuguuuaucaccaccagcucgcccuugaguucuuuccuggcugaaaccaagaacccucccgggcugucucaguuuuggggcucgccugcccugcaucacuaccacuucuuuaagcagcuuccccugccaacgcagcuggccguggcagucgagggguccuuccugccgggauuccagaggccauggcaagaguggguugccccuugcuaguucaauucacccccuccacaggagucacugggagccaggaaugauuccuggugcacaguagcccugugcaggguucccagccuccuccucugccuuccauccagccucuaugucuucccuccguucacucucagggccuucccacugaagaucuaggagucuaggagugcaccugucugcacagugucccugucucuuagugggagauguuucuccuggcugcgucuaguuggccaucuuggagcaggagcaaaaucuaggcagucuuuaaacagcuucaaauuaggguucucacaaaccccucuuuggguaagcaagguauagagggaagggacccagagcuuccuugcccucucuggacacaccacccuccaggaaccuccacguguucagcucucuggaagcuucuuuuaucucuuuugcuuuacgucuucccucacugagacuuccagcacaguguugaauaugaguggugagagcugacauucuugcuuuguuccugaucuuagagggagaccauuaagucuuuugccaccaacuaggauguuagcuguagguuuauuauagguguucuuuuucaccuugaggaaguucccuuuuauugcuaguuugcuaacaguuuuuuuuuuuuuuuaaucaugcguggguguuguauuuucuucaguucuuuuucugcaucaauugauguaaucacaugaguuuucuucuuuugguuguuaauaugguguauuccacugacugcuuucugauuauugaaccaguguugcauuccuggaauaaaaucccauuggucauaguguauuauagguugaguaucccuuauacaaaugcuugggagcagaaguguuuuggauuucagauuucuuuggauuuuggaauauuugcauaugcaucaugagauaucuuagggcugggacccagguccaaacgugaaauucauuuuuguuuuuuuguuuuuuuuuuuuuuuugagauggaauuucgcucuuguugcccaggcuggagugcaauggcacaaucucagcucacugcaaccucucccuccuggguucaagcgauucuccugccucagucucccaaguagcugggauuacaggcaccugccaccaugcccggcuaauuuuuguauuuuuaguagaaacgggguuucaccauguuggccaggcuggucucgaacuccugaccucaggugauccaccugccucagccuuccaaagugcugggggaauucaggugugagccacugcaccuggcuucauuuauguuuuauauacaccuuaugcacguagucugaagguaauuuuacuuuucccuuggagaugcugaauaaacugcauugugcaccugcauuuugacugcaaccugucacaugaaguuggguauggaaucuucuacuuuugacaucaugucagggcucaaaaaguuuuggauuuuggagcauuuuggauuugggauuuuugaauuaggaaugcuuaaccuguauucuuuuuauguauugcuggauuuccuuugcugguauuuuguuggagauuuuuggaucuacacucauaagagauacugguuuguaauuuucucuuuuuuguaauguuuuugucugguuuugguaucaagguaauggaggaaguguuuuuuccucuuccguuuucuggaagacauuuuauagaauccauguuaauucuuuaaacauuuguuagaauucaccacugaaacuauccgagccuggagauuuauuuuacaaaaugcuuuuaacuauuaauuucaaaaaaaaguguuuucuugagucagggcuucgaucuguugcccaggcuggagggcaguagcgugaacacagcucacuacacuuugacuccagugaucaucuugcucaagugaucaucccgccucagccucccaaguagcugggacugcagccgugugccaccaugcccggcuuuugggguuuuuuuguuuuuuguguuuuuuuugagacagagucuugcucugucacccaggcuggagugcaguggcgcgauuacagcucaccgcaaccucugccucccagguucaagcgauucuccagccucagccucccauguaguugagauuacaggcauguaccaccacaccuggguaauuuuuguauuuuugguagagacaggauuucaccuuguuggcugggcuggucacaaauuccugaccucaagugaucugcucaccccggccucccaaaaugcugggauuacaggcaugagccacugcgcccagcccuaaaaagguuuuuuuaaaagccauucuuguagaggaggucuacuggcuacacauucccuuggcuuuccuuuaagaaugucucuauauuuuaccuuuaucccuaaaggcuauuuucacuggauauggacuucugaauugacgguuuuuguuuagcacuuuaauauguuauaccacuuccuucuggcauccaucauuucuggugagaaauccacagucccccaaaucuuuauuccccuauaggugauguauuauuguccucuggcugcuuuccagauuuuucuuugccuuuaguuucagcaguuagaugaggugugcacaucuuuguguuucuacuguuugggauuuguucagcuucuuggaucuguaaguuuaugucuuucaucaaauugggaaguuaucaaucauuguuuccuaaaauaugguuuuuuguuuuuuuguuuuguuuuguuuuuugagacagaguuucauucuuguugcccagucuggagugcaauggcacaaucuuggcucacugcaaccucugccucccagguucaagcuguuauaaguaaaauguuuauucagaaacagaaugcuuguuccucgguaccacaaggaaaaaucagcauucaaacaaaaaguuuucucagcaaggcaaauuuacuuucugcagaaagggugcuccucgcagauggaacaauggcgagagcacacccgaacaaaggaggaaagccguuuuuaucccuuaugcagcuugucccugcugcuguguccuaucuccauuggcuggagccagaccucacaaucuaagcuaaaccugacuggcuaauaacuuaaaacuuuccuaaauagauaaaggcaagggagaacaaaggaaaaagaggaaguugacucauucccuuauaucuaacaucccuuacaucuaaaaacaaauaucuugguuaaaguacaaggacacagaauguacucauucccuuauaucuaacauccuuuaugucuaaaacaaauauuucgguuaaaguacaaggacauagaauguacauuauuucuaacacuuaugauuuauucuuuagugagaagggaaacuuugaagaggaacuuuuuuacuuucuacaaagcaauucuccugucucagccucccgaguagcugggauuacaggcauucaccaccacacuuggcuaauuuuguauuuuuaguagagacaggguuucuccaugucgaucaggcuggucucaagcucccaaccucaggugauccaccugccucagccucccaaagugcugggauuacaggcaugagccaccgcacccagcccucagauauguuuuugucauuuuacucuuccuucaggacuccagugacaugaaagaccuuugguuauuauaucaugugucccugaggcugcuuauuuuauucuaucuuuucuucucucuguuagauuggauaauuuacauugaacugccuuuaaguucacagguccuuuggcccuuuccuguuuaucuccauucuguuauuauuauuauuacuauuauuauuauuauuuuuuuuuuuuuugagauagguucccacucugucauccaggcuggagagccauggagcaagcauggcucacuguagccccaaccuccugggcucaagcgauccuucugcuucagccuccugaguagcugggacuacaggugugcaccaccaagccuggcuaauuuuuaaaaaaaaauuuuuguagagaugagggucucucuguguugcccuggcugaucuagaacuccuggggcaagugaucuucccaccucagccucccaaagugcugggauuacaggcaugagccacuguaccuggccuccauucugcuauuaaguccauugagcaaguuguuuauuucaguuacuauauuuuuaaaaauuuuccauuugauucuucucuuuuuguuuguuuuuguuuuuguuuuuguuuugagacagggucuuacucuguugcccaggcuggaguauaguggugcaguuauagcucacugcagccucaaccucguguguucaagugaucuucccaucugagugugcugaguagcugagaccacaggcacgcaccaccaugccuggcuaauuuuuuuuuauuuuuuauuuuguagagaccaggacuugcuguguugcccaggcuagucucgaacuccugguugauucuucuuuaucaucuguuucuuugcugagacuuucuauuuuaacauuuguugcaagcauuugcaauuuuaaaaauagcuguuuaaagucuucaucagauaaucccaacaucugugaaguguugacagugguugauuggguuuuccaggcaaguugacauuuucgugguuguuuguaugcugaguaauuuuggauugcauccuggacuuuuugagcauuauguggugauacucuaggucuuauuuaagcuauaugggaaauauugauauuuuuguuuuagccaacagccaaucuuacuuucaggccacaaguuccaauccccaaccuguaggccaugagcaucacgucaguuuuuaaagcccccgugccauuuccuggucagaucuccugggcgugcacugcccaguggucauucugggacccgagugguuaguucaguucucaaacucuuucguaagucaaacuaugguauaugcacaggauucacagaugcucgauucuagagaguucuggagacauaaaccacuucauggggugacuuuccugagcuucuggcucugugcugucuaccugguacuuuucugauuccuugcgguuuacuguuguacacgucugccauugggcccacuucccagcccacauggagagaggacagagagagaaaaggacaacgguugccccacccccucggaacaguagcuggcaccacagggccuggggcaugaggaacaggggagauggggggcuucuguguuuuccaggagagucaggaguuccucuucuggccccagagccaggccuggaggcucugcugagcucucgugugcucuguggugcacacuucugcuuccagauugcugcugcacuuucucguggggggcggugggaacacucugcauucguggcucuucccugguccaccugcugcugucuucagucuuccggcagcugccaagccuccugcccagguuucagagcuguagucaguggcaggggaaggggcgccagccgaccugccucaccagccgcuugcuuucuuuuguguucacgcuggccucaucccugcgguguggguggacuguaugggcucagccaauccagucaugcaggucacucaggucccguuucugacggccacuggcagugcagcauugagcacgcuugcucagccccagacgugugcacuugggugucuccgugaccugggccaggauuucuggaggacugaggcugcagacauggaauugccaaggagagugcugcccagaaagacugucucgcgcacuccgugcagaccucuucgcuuucuuacuuuccgggacgggacaguggccucgcuaaccacauuccccucuccccuggggacucuugucugauuguuuauugagccgaaaacaggguccaucugggugcuguggggugcaaaggcaagucccagggggcagcuuagagagagucgagcaggaaagcgcuagggcugcggggguccccgccacagugcgcugcugcauguggcuccgcccggaaggaucccacuccuccaaacaggucagcacaagggcagcugucaggaugccaccuuccuaaguggcuugcagagcugguggcugggucaacauuugccuccagaugcgaucaucugagugcagccugguacuuacacagccgggcccugagcaagcaucccuucagcacccgcccugggaagggcaccggcucugcguggcuggucacaccucagcugagaagguucugauugcugcccgcagggccgagaucagccucgugggcugggcagcuuuucagcuccacucccugggccugcucucgcggcauucacgaccucauguguucaguuacagcuggcugccagggccagucccaacucccugagggggaggcagcacccaaggggaauuaggggccgucacaguggaguggagggcccuccgagaaagaggcaggcaaaaucccaaugcucgggcuccuggagccccggccagugagggucccgagcuccugagccuccgcuugcccacugagcaccuccugccacacacgcuguuucuggugcuggacacggcagcgcgcagccccacguggcuucccccagcagggagagagagagagagacaagcaggcagacgcagggaagcuguugugcaccaugggaucagggagccgcuugcgagaugaggacaggacagcacgaggaggugaggcuggggaaggugacagaaccggagcccuuggggccauguccgguucccugccccucccagggcugucauuugcuuggcaccucaguuuucccaauucccucagaggcggcaagcuggugaggggcuuuuguuugucuacccagugcuuuuuggacaucaugcauaagacugcacagacucuccugccacucugcagacaggaaaugcaggcccugcacauguuagccuggcuggagccagcaucugggcccagguauccaagucgguggccuuuggcccacuugcuggugugagcauggccucgugcagcauagcagugugcagugguggccagggcugcagccccagcgauucuucugccagucacucugugcccucagcacggggccucugaucugugccuguuuccucaccucuaaaauggaugcaagaagagaugcuccagcaucuuggcucacgcaggacaggcuagggggugcaggaccgucgccccgguguggauuuucaguugcacuuucagaugcaucucggcaugcgcaguggguuacagccccucaggucaucuccccacagucccugccccagagguugucgaggcguguguggagcaaugccuggcgcaguggaaaugcugucaguguuagccacugugacuggauuuaaguugauuauuuuggaucaaguguuaucacacuucaggguggcccugagaagcaagaaggggucaggacucaggaagcaccaucucucauaagcccuggggggugaggggccaguggccucccugggaggccaagaggagaaacagcuuucaagaaaagcaagucuggccugguucaagagaccccagcccagcccagcccaucggcugagcagggaccacaggguccuggcccagguccagccgagcucauggacucucaaagcugacucagcguggggaccagcugccgggccggcccggagcauucagggggcuccugggagggagggacugguaccugauagagaacccucagagggggcuccaggcacgcaucaucaggucccaguguggccugaggccuagagggcaggacccacaguguccaccucauguccacagggccucggcaugaaggcuggaggggugagccuggggacccucagccaggcguggguugguguggguuagggguagaccuuagccacagcugggacucucccagcucaggggaugcccaggagagggaugggcuuggaggugagaagggcguugagagugggguggccagagggucacaugaugugguaggaggcaguggcuggugaguuggggaccuccccucacgcccacaccgccacccccaggucagcgccaacggcaauguccugcgcagcgagaucgugggcuccaucaagaugcgagucuuccucucgggcaugcccgagcugcgccugggccucaacgacaagguccucuuugacaacacgggccgugaguacccuugccaagggcccugcccaugaggauggccucaccaggcacacacauuacagccuagggcaggguugggccaggcggaggaacgagcugguuucaagcacuugguugagcagcacuucacacugcuugagacagcuguguagaguauucauccuucccuggacauagaaggugcaggggagugaagauccuccaguccagcugggaggcccccgucacccggccucacacgccagguccugcacccugcccugcucugccuggggcacuggggccuaggcuaaggccuugcucucucccucccaggccagguuucuccccucaccuugggcccuaggugugggccgugugaaggccacgcauggugauucucgcucccgccgccuggccucuaacacuucccacagcagggcgggggcagaggggcccagggccugguuuugugaacugugccucccacucagcugucacaggccacuggaagagggugcaguggcugggcaugcccccguuccuagcccggugagggcuucucgggcaucagucuaucagggcagcuccccgccuggggcugggcagggccccacccacauagcccucagugagguggcaaaccaagguaggacccaggaccccguggaugccagggccugagcccuuggggagccccgagccaucccccagccaaguccacugaucaaucauucagugaacguguccugagcagguccccuggcugggcccugggauggccgcuggggacucagcaugaaccagacccaccagcccugccccuggggaccccaggggugugaggagugauggggcaguugucuugggacccagcccccuugguguuuguggcccaggcugcucucagugcguggacugggggcccugcucugccgggguggguugcaggugguaggaguacugcugagauagugacccggagggcccagaucuguccuacccucaccccugaccccaggcggcaaaagcaaauccguggagcuggaggaugugaaguuccaccagugugugcggcuaucacgcuucgagaaugaccgcaccaucuccuucaucccacccgacggcgaguucgagcucauguccuaccgucucaacacccacgugagugcgccacccuggggcugggcugucggcagacuccuccuccccuucaccuccaggaggugaagcccaggcaggcgccagggccagccccaccccacgcuccaugagcugccuggcucugcagagauggagucugaggacuugggacuccgagcuuucugaggggcacagaccccuuuggccaccaccaccccuuucccaggcagcccccagagcaggcccuggucauguuuucugcauuugccccaaggccuccccgguagcucccggcuaccucggccugucugcccuggcccucccugacgcuggcuguacgcucccugcagggcucugggcccacaccugggcagauggucccuugcccugggccuugguuuccccucugaaaugggccuuugucaaacaaggccaggugugagcacccucuuugcccuccuuggcaggucaagccuuugauauggaucgagucggugaucgagaagcacucccacagccgcaucgaguacaugaucaaggugcgugggccgaggccacccacugagggccuucuggugucucuggcccgucccaggagccuaaccgagggcugggggugccguagggcugccauccgugcacccucacuguggccucagaugcaggagugaccugacacugaggggacaccgccuggggccugcuccuagauggugccacuuguggggaggggccuguagccaggcauccaggacacucccagagguguugcccccagguggagcaccucugccccucagcgacccuguccagcgcagccuggcccugggacauagacauuguccuaggagggcagggcagagggagggaugaggagccuuggaagcugagcagacaggaggaugaagaugaaacuccugaaauuaggucuugggagagucucgagggcaggagaagggguggguagugccuggagaaguggggccaggggcggggcuagggaggaucccccgggccaggcugaggggcauguguccuggagaggcuggccagcucaccuuggccuccauaaccccgggccgcauuggccuggccugcaggccaaaagccaguucaagcggcggucaacagccaacaacguggagauccacauucccgugcccaaugaugccgacucacccaaguucaagacgacgguggggagcguuaaguggguccccgagaacagcgagaucgugugguccaucaaguccuucccggugagcacucuguccagacauccacgugcccccugcgccugucucugcaaggcagccugggugccucaggacccccugcaccucaagauggggugacaguggccacugugucuuccacaccuggggcuucugaaaggguggacggagagcugaggacuggagugggaggaagcagaggcugacucggccccugggccccuuucugccuuccucuuguuugugaaccagccucugucuucaccucagggcagugcccucucccucccucucugugaugccccugaguacugaugugagauggggcuccuguccaugcaggcccugaaggagccccguccacacuggcagguccaaggcccuuucugugcaggcucagccuugccugccaucaaggggaacggcugccuguaggccggagcagcacagccuccagagcuccgcaccagccgcccauguccugggccagcucugcaucggcguggcuucccugacaacauguuaaggauucugaggagcugagucugggcuugccggguguacacagugcacagagaggcuaggcccaggcauggcucuggagcugagccggguggcacugaccugcuccaccaggggggcucagggcaggcgcugcuuuccauguucuccccucucucuccaucugcaucccagggggacuuggggacagccccagcugaguuaagcuggaaaugcugcaauucaagugccuugaauuucaugaugguacuuucccucccagccucagucuaaucacaugacauaaaauacagaaaguagaggaaggagagagaaaagccaguuaccccaccaccuaauacucccgucagccuuuccgcgugucuccucaccuuucuuucugcguauuuugcuuuuccucauuaugugcaaguagagccagcucagugccugcccuuccacguggcgcugcggcagagcguuuuccuucugguauugacugucuucuuggcggucaccuuugggagcuguggauauuccauggagggguggugaccaucccggauaguuggauuagcuccucuuuuccugcaauuccacuguugaaaauaguguuuaucauuuaaaacacacugggagaauacuucaucaaauaaacagcauggugagcuguagacgggggaggaagggacagggcuaagggccgagacacaggcuggcguggacugugcuuguguagauuuuacuucgaagccaugcacaggcacaccucauuuuauugugcuucccagauacugcauuuuuauuuuuguuuuaguuuuuaaacaaauggaagguuuguggcaacccugcguugagcaagucuguugaugucauuauuccaacagcauguggucucuguguugucacuuuuuagcaauaaaguauguuuuaacuaagguauguacauucuccuagacauaauacuguugcacauucagacuacaguauacgguaaccuuuuuuuuuuuuuugagacggagucucgcucugucgccuaggcuggagugcaguggcacaaucucggcucacugcaaccugugccucccagguucaagugauucuccugccucagcguccugagcagcugggauuacaggcaugugucaccacgccuggcuaauuuuuguauuuuuaauagagacgggguuucaccauguuggccaagcuggugacgaacuccugaccuugugauccgccugacucagccucccaaagugcugagauuacaggugugggccaccgugcccggcugguaaacguaacuuuuacaugcacugggaaaccaaaaaaugugugugacuugccuaacugugcuaugugcuuuauggcaguggucuggaaccaaaccugcacugugugaagguacaccugucagugcuucccaugcauagaaaacaaaauuaaaucacaauggaaaaaagguaauuccuaaaaaccaaaagcaaaauuaauucaucagcguaucaaguugaugacaaccacagagacacgucacuucaaauaacacacccuaaggacaaaaggaacugcaaaaaauaaauuuuaagaaauacagagagggccaggcgcuguggcucacgccuguaaucccagcacuuucggaggcugaggcgggcggaucacaaggucaggagaucaagaccauccuggcuaacauggugaaaccccgucucuacuaaaaauacaaaaaauuagccgggugugguggugggugccuguagucccagcuacucgggaggcugaggugggagaauggugugaacucgggaggcggagcuugcagugagccaagauugcaccacugcacuccagccugggcaacagagcaagacucugucucaaaaaaaaaaaaaaaaaaaaaaacacagagagagauuagaaauacagauuagauagauagauagauauccuucccccuuucuuagauugcuccauacuaaaaguuuuuuuuuuuuuagguuaguuuuuuuuguuucugagaugaagucucacucuguugcccaggcuggagugcagaggcacgaucucggcuuacugcagaggcaugaucucggcuugcugcaacuccaccucccggguucaagcgauucuccugccucagccucccaaguagcuaagauuacaggcacaugccaccacacccagcuaauuuguguauuuuuaguagaaacaggguuucgcuauuguugcucaggcuggucucaggugaucugccugcuucggccucccaaagcacugggaugacaggcgugagccaccaugccuggccuauugugaauaaugcugcugugaacgagugcacaaauaccucuucaagauccagcuuccauuuguuuuggguguauccccagaaguggaauugcuggaucauauggugauucuauuuucaacuuuuuguggaagugccauaguguaggcuauuugcuuuuaaaccuagaguguuucucaguccugucccuacugcugucuguuaccagguuagggaauuugauaugugcccauggguggccauggcacaugacacuguccaccuggauggagaucugggccgggccuugcguccaggccuucuccuggcucucucugcaucuccuauagcaccugcuucacagaaguugcugccauguuacuucaugcguggguaccugugacuauuguguugucccuguggcuuaugggacggcagccucuaggauuguggccuguccuccugugcaccuuucucccuugugaugauggcagcccuguccucuuuugucugccuuuggcagcacgccugucaaugccuguucuuccuacccggggagcccuucucacugugccuuuguggcgucgaguggguuuuggugugugagccggcgccagccuacagcucucaucgagagcagaauuaaacccacucggcucaacgugacgacacaggcugggugugcaggccuccaucgccccuggcgucugcuucccugcauuuucuuuguuuguguuuuccauuuggucuuugcuaagguucagauuuggggucuggcugaguguuuggggcacaggcuagucaccgagcggguuuguucccucgcugccugcuuuaccaguugcugaugucgcaucuuccccccgucauccuccuggagucuguacucagcacaugucaccaagucaggcagaguccucacucucacgcugcccugguggcaguaggcagagaugaaccacucggcccugccccaggugcacggggaccgccccugcugugaggcagaaacagcccuaggcggcaguagcucccacggaaccucggccugagcccuggggagcagagacuguggggucccaggcacagccagagcugagaucgugcccccgacugcucagggcgagaccaggcgcugggggugaccaggcugcaaccuguugcuccucaaggcagagagagggugaaggucacagccaggacucggguuccagucagagccacagccacccccugcucacccucaggagcaggacccagggcugaaucgucacucagugcaugcuccuugguuucuuccuuuugucgccucucccuggucaugguucucaccuggacacucucuuuucuuucacaugcuguucugagacugggcguguggccccuguccccagcagcccuccccugccacggucauuacacacucuuccuucccauggccggucugucuaguucaccagccuuggaggaaagugcauuaggggagcugggcggggggugcugggccacugcagaccacacuggcaggggcuuggugacuggggcuggcagcuuggugagcucagcucugggcgccuggguauccucauggggcagcugggcaccccagagcaggggcuguccuuaccagccuggggcagcacagggccgagcuuuggcuccccagcacaggggcucaugcuccccucccuggacuggggugaguggucagucucugcccaucgccacuagggccagagcuguuggcuaagcuggggcagggccuaggccugagcgccucccccgucugcuccccagggcggcaaggaguaccugaugcgggcccacuucggccugccuaguguggaggccgaagacaaggagggcaagcccccgaucagugucaaguucgagaucccuuacuucacuaccuccggcauccagguacguaaggcccaggcggccggggcccagaacagggacagaggccgcaggugacagauaucaaugcagccagcuugggaaagggugucagucagcugcaaucaggacccugcugugcugugggccucugccuccccacagacagggugaggccaggcugccucugcucagcccugaccccugagcucaaagcucacucauucugccccaaacuagcauuugaggcucugccguccacucaugccccaugggaccucuuuucccuggcacccccucaaaagcccacagagggaggagaggcucccagagagccaggggccuucuggccgggccccccaagcaggcugcugaggccgugucugcaagccacauccuggcugcucaccacuuccagaggcggcucugcccucccacacauuugcaugguccagacaaaucccuuucaccccccugaggccugugcucauccugucgucauggccuccccugccagccccaggcugccccagcaggaaagauuaaggggggaccaacagggcgggagccugcggugcucagggcccugcuaccugugccccaggugcgcuaccugaagaucauugagaagaguggguaccaggcccugcccugggugcguuauaucacgcagaauggaggugagugaggcccuacccguggggugggguuguacugagggguccucuguggcugcccccaggguggagccaucgggucgggucccgaaagcagggagggugcagagcccagcaugacgccucccuccugucuccuagauuaccagcuccggacccagugaggggcugucgcagccaacaccccggccucggggcuccugguggcagcaccaggggacacaccugccaaacccaccagauggaggggcccucccuggucucuggccacccucccagccucugcccagggaccccugccuuccccaggccaucugcucugccgucgacacucgucucagaagccccuuucccagaagaggcuggucuucaagaagucucguuucuuugccccugaagucaguuucaggggaaggaugugaaauuuuuccguguagagguuacagccuuuuaugcuguugagcucccagguaccaaaaagcuuggccaacgcuugccagccagccagcugcagguggcaucugccacgaaggaagcgccagccucgccaggccagcaggggcgucguuuuguugccauuuuguugaacguuauggguuuauggguguuccuggaacuugucuuugugcauucguugcuguuuguguuacccucacuguccccaugucccacccacguccuacggcacucaggaagcacuuggugaggacgagcccucacccuucuugucuuccuucccggcagcgcccgcagcgggccauuuacacgucgaggcuggcaccuggcgcgcucgggggccacuguagcgucugccugcucccuggacucgcaggccucgccuguggcgccuucccagggccagccugggucacgagaugcugucacucagccagaucaguauugacccaccaggggaggugggguuuggugagagacgccagccucagacuuuuucccacugaggguccagagagcggggccacgugucacccacgucugcgcuuggucacccguccuccccacccuguguguguuuaugucauaguuacauuaaauuccauucauugaauacuc

SEQ ID NO: 191899 - RNA, 110355 nt, Homo sapiens
auugagaaacuguuuuucuuacagaaguggcaguguagaauaaauaacgcgagggacagagagugugagguaccaagaggcuaaagaagcugggagguuugccuuuaaaaggagacaaaaaucccagggaagcugcaagcggaagggagugggguggcccggaggcggaggacucaacuuacagaggugaagucugcaaagcccgaggcagaggccuuagaagguuuagcugcagaggaggggacaaaugggucuuuuccacuaaacggguccccaaaccccuuuuuacuuuggaacgggucgccgcugucagccccgaguggcuggaauggaucgggggccucgggaaagucugcggaaccaagcuggcuuacagguguacuuuuaccuggaaaguuuaggagaaaaaaaaaaggagaaagaaagaaauaugaguuacucacccggacagagcagaaugcuggugggcacaagcccggggcgcuucucugagaaaagcuuguaacuuggcuaacaggcuggacggggguacccuggggaaucccaguuuuaaucagcuuuaucccaggggcuuaacggguugugaacaacacaggaaaaacacuucagaugacucccauacacaacgcacacagagcagcuaaaacuugaguuguccuagaauaguuugcaugcagguacguuucaaacagauucauuuuagcauggcaacacauuuauuaacauacuaauuuaaaaaaucauggcugagcagaaaaauacacugcaagcuucuaacaguaaaaaaaaaaaaaggcagaggggagaguuacuugcaaaugaaaaggaggaauuaguuucacaacgugguaugguuauucgguguguuaguuauaagggucugcacacagcucugccaugcugagguuuaaguucuuuuuuuuuuuuuuuuuuuuuuuuuuuucagagacagagucuugcucugucaccugggcugaaaugcaguggugcaaucauggcuuauugcggccuuggccuccagggcucaagcgauccucccaccucagccuccuacaggcaugagccaccaugcguggcuaauuuuuguauuuuuaguagagaugggauuuugccauguugcccaggcuagccucaaacuccugcccucaagucaucugcccgccucagccucccaaagugcugggauuacaggcaugagccacugcaccuggccuuaaguucuuuuuuagcccccacuucugucccucugguguugguggcuccaaggggcagcguuuaucugggccuuucugggcuucugccaagcagggaacuccaggaugcccggucccagcaagguauaucuugacagggaggugagagagaaguguucagaaauggaggaaaaugacacugugugggggacauggccugaggaugguagcuuuucccagugcauccugccaauguaccagaacauuccaccaagaagcagaggccuguuaagaucugcuuggugacgggaggucccaccugacgggccuuccagcaucugcaguuugcaggccagccgggcugacuccaugcuccugacaccccucuaucugcccaacggagucccugggcauucaacgugguccacgcagcaccccagacuggaagcucaauaauaugcaacacgauuccggcguguuaacucuggaaguuucgaagcuaauguuuagaaaaaaccaggaacugccugucccuccaggguugaccuuggaucucuggcugcaccuccagagagcacccuggcucccagccacaccugccccgcccaccaccugagccugggacaccugccuuccucauccgguagaacgagcccacacaggccagccucggucccucuccaugcccagaucuaaagccuuucccucuguucccccagcagaucagccaucccaggccucauuuuugaggccccagguguccuugugggcuccggggcuacagcccccaucugccaccuuuagcucugggccucggcaagggaaagugccuccucccagcuggccuccguuuccuuaucugugaaguggaaaugagaaggagggcgccaaacaaggugacauuccugggguccaggagucuccucccacucaguguccugcaccgccgugcccagcauaggccagugagaaccuggcccguagcccccccuugccuguagcccuacuucuggaaauggaaauucacuuuucucucaaccggcaguucugggccagcauaaggacugcugcuuucuuuuugcauauucaaggaaaaacagucuuccuucccacgguuugcacagaaggacucggagacaaacuccccugcagcccacccuugcggccugccuguccgccucugcccgucccacaggguuccaccggggucgccguugcauccuuagcugaccucuggccaccagcugcgggagauccuuccagacuccuugucugugugaguccaucuaagaggcuccuccucaggguuggagggcgagcuguccugggcucuauuaggacucacauggaugagaaagaggggaggucgaggccugguaucagucuccuccuguggccucaaaucaauucacugucagacccaaggcccaguuagcagagggggcccugcaaucuggaaggggccuaucuuugccaaaacuugugggcaagccaugcuggagacccuucccuagaggggcagugcccagcccacgcgggcaggacaggaauguggccccucuccuuccgacagcgccugcccucucagggcaguccccacacccgagcuuucuaggugucucccuuuuucuauccccagaugucccucccaccuucagcucuacugcggccuccuccuaccccgaccuccccggggcugcagagagcagggugaucuggcccagcccgcagaccccgggcugguuccgcuggccuugaggaacugccucacacccccaccuugagacggccucccaugcagggccacuccuggucccaggcaugagccaaugguaagccaaggccucgcugccaggucucccggaguugccccguucccucuccuaagggacgggcaggcagcucuggcgggcgggggucaagugaggccugcccagccuccugugagccccaggcuguccacuggagcagaaggggcucccuagggcuccugagcaggauggagggugggcgagggccccucaccuccacccucccgucccuagaagccucaucucccuaucggccgcccaccagcucggcucccuucccugugagccaaacccacccagcaaaguggccucaacacaggugggccccagcacccugcccagacugcuugagggcuucucccgcuuggggaugacaccccagucuuguccagguggcaccuccuuccccaggaacccccaaacccagggcuucuuuccuggcuaugccuugucccucugccuggaaggcacucccaacuggaaugccaucacaggcaguggccuucucagggaagaaauggcagccccuuccccaucaugccuguguucagcucugcagccaagcccuggggcugggaguggcccuggaagacgguguggggcauggcggccaccccccucagccuguuucuuaauccaaacaaagggcuguguccccccaacaauuguucauacguucaaguccuaaccccugugccuuagaauauaaccauacuugaagauagcauauuuaaagggguaacugaguuaaaacgaagucaaaggaucaaugacugucuucacugaaagaacuuaggacacagaucuacacacagaacagcaaugugaagaugcaccaggccaaggagaggucucagaagaaaccaaccccacuggcgccuugaucuuggacuuugagccucuagaacugcgggacaauccaugucugcuguuuaggcugagauagagcaagugugagcagggagccaccaaagccaccggcaggggcacccugggggacagugugacaguguccugcaccccagccuguggguuugcaggggauagggacagugaccucagccagucccucgagccccugccugcuucugcccagcuucucccuccacgggaaagcccccccucccccagggucccucaccacucugcuucccguggcacuggccucuggcacggcugagggucagcucugugaaaagcgggcccagcauaccacaaaugccagccaauacugccccaugucccuggugcccuccagcccagggcucggcacacagugggcuucaggagguccuggugaaccaggugccaccuguuacagauuccacgggucuccagggaccuggggcccuuuggagcaacacccuggggagcgagaagggaauaaaggcaucugcccuuccugguuugcaggaaacagcaauguuacugugcaugcuuggguauuugauuuuuccucgaauaccuaugugauauggaucaaauagcaagauucuagcagaggaaacaguuaaguguuuccaggggagaagcucaaagucccaggacacgguguagcccccugggacgggcagcaaguccaggguggacacugcuugauuucucgaagccguuccugcagggagugaucaccugaggcagauuugcaagaauguggagggagguguaaagggaggacgccccagccaggcccccaagagcgacugccacgguacagaagguucaaauaaaucagucauuuuugagcugcuuuucuucuucuuuucaaugaagaucuuccucccuugguuugggggguuuaaaaaaaagaaauugguuuuugggaggagcgguuaagaauucugccugcuaccauuucaagcugagguuucugaugcgcaaagagauguucagagagaugaaaagcuucguucacaccaagaacugccugugccugguuuugcucuguugccgaaaccguuguuauuuagaaaucaugacuaugguaauaugaaaccagggcacaucaacugcuggccucuuguuuucagaaggaacaucaacaacaacaacgguuuuuuucucaguuguuaguguuugugcuuugguaagagaggagauuuuggaccugacacgugugaggucagccgagugcccgguccagcucucgaccuugcuaaugaccagacgcuuugagcaaagaaagcccccggcaucacuguagggccacggcccucagcccaaacuucccacuuuugcucagcgauuuauuuuuagcggcuguauuuuucaaaccuucuaggucuaguuccugcuuuuauguaaccacuucugcuaacuccuuaaucguuuuuuccgauuuugugagguauagcuuaucucaaacgugacaaaguaacuuuaaucugccuccaggcccugaagcaaaagcugccacgcgcacccacgccaggguuuuauacuuuuuuauggcuccagaaaacaugaguaaggagagagcuuuacugacgcgcauuucagaaaaggggauggaaaucaugaaaacaaaacccaaaaaaguggguauagaaacaucugggaaugauggcaucaaaccaggugccaggcaucauccuggcaccugguucgaugccaucaauccuagauauuugcagcgggaacuaccggggaccacagcagacggcagugaauaaagacaaaugaaauuaaagacccucuugggugugcugacugccuaccgcagggagacuucauuaacagggggcaagggauacaagacugaagaaaacacaaaauagaacuuauuuucaaaccacagcaguuucaacaguuacccaagcgguguaccgaaaccacacacaggacugacuuuagcaaaaacaauaugaaccaaaugguuuaccacaguaugugcuguuaaaaaaaaaaaaaaaaaaaaaaaaaaaaacuugguggccggcuccacccugauagaaauuucuuuaauucuccuauuucucaagcuucuucucgaggcugcgcacgccccuagcacccgggaucggggcugugauggggcuggcucugcugcacuagcguucuuggucagcaaaguuuuucaagguucugacuuuucuaucuugcuuugcaggaagcccuccgcuuaaaagcauccucaagagcugggugcaaagcaaaaaaaaaaaaaaaaaaacccaaaaaacaacaaacaaacaaaaaauugaauagaaauauacaauugcaaaccauaaaaacggugaaugcuauaaaaaccuuggaaaggaaacucucuugguuuaaauuuuuugcuuaggaggagcauaaaagguucaggugagguauggucucaaucaauccgauuaauaaaaauauuaguaauaaacaugagagugagagagagagagaguguguguguguguguguguguuugauccuggcuagguucuguuuauacaguucaguucagugcuguacuuggaaaaugcaguucugcagaugagagauacauacaaaaacaaaaagaaaacaaaaaaauacaaaacaaggguuuguggucagggaagcugcccaccuucgcuauuauccuauacaacacagaacgaucacacaacucucacucauccuacacaacuguggacacacauacacaaccaucauugauccuacacaaugggacacacacacacaagcaucacugauccuacacaacaguggacgcacacauacaaccaucauugauccuacacaacaggggacacacaugcacaagcaucauugauccuacacaacaggagauggcuacacaacugucauucauccugcacaauauggacacucacacaacucccauucauccuacacaacagaggaugcccacacaauugucauucauccugcagaacacagacacccacacaacugucauucacccuacacaacaggugaucccacacaucucucguucauccugcacaacaugcacacccacacaacuguuauucauuccacacaacagguggugcccacacaaccaucauucacccuacacaacacaggcacccaccugucauucacccuacacaacaggcgaucucacaaaaccaucauucacccuacauaacacagacacccaccuaacugucauucacccuacacaacaggugaucccacaaaaccaucauucacccuacacaacacagacaccuaugcaacugucauucacccuacacaacaggugaucccacacaaccacaacugucauucauccuacacaacacagaugcccauacaacugccagguuucugagagucacgcugccuaggagagcaguggcccgggcggggcaccacuccagcagagcucauccaaggccacugacaugucuuauuccacccuccccauccugccagaaaaaaagcuuagcugcggggagaggggagaaagaaaacaguauagguucuaaaauucaucacugcucggggacuugucuugaaagagugcuuuuccccaacacacgucaacgucuuccucuggcucccaucuaagacacaugaggggaguuuguuuuuuacaaugugacacacgggaccacguaagggaccugcaggcugggaguccugcaggcaccagccccgcgcgcacucugccuuagaucaaagcugugucaagcagcacagccccgggagauaagaaucugaggucccugcgaucgcagcguugagauuuuccacuaaaaauauuuaccgaauuuugagaaaaucugcuucaugcauugaagggaacaggaugagguuugguucugaacuguugagaaaagcugaacaaauauuuacuacgagccacugcuggccgcuguguuuuccugcccugugaggugugugaggugggcagggggcuguugaacccaauggcuguggccucaucuugccauuaaaagaagaaaguggggaaaaggugcugugccuugggguccucaaaaggcaaauaucauuugaagugagaaauaacaauuuucuagaggucaccacaaaaggcucccaugacauuuacauaaaaccugccaggcaagggcugcaccagcccuggaagaaaaaaaaguguguguguguguguguguguguguguguguagggugggguaugugauuuggaaaugaauuuacaaaucacaagccagucuucaugacaaaaauaauacagacuggcaggugucacaauucuggcuucuuugaaaauucgcauuuguucucuggcgggcaccuuugacauacccugcgugaacaccccugggugucagccccauccucuggggggauuuccagggagagaugcuaucuaugcaugagccaggcacggggagcccugacagggcaagggggcccagcuuuguuccucccuacggagugugccaaugucgcagacgccaccucugcaaaggguaggaaggcgccuugcccacauguaacaagaucccugagaacgccgugcagcgagucugaaagcugguuaggggucgugcaugaaaggacccaaaagagccccugggaggggagcaagugaggcgcagagcccaccaggagcucccauggugggggacacuuuugcucucuuuauggccagauuccccauugcccgagugcaugugauauuuugcaguuagcaguggcaggcaaggggcgcgcugacucagggcuuugaauaggagagaugaaagaugaggggccauguucaccccgccagaaaagcagggaggcggugcccagagcugcacccagagcccccuucugaggcgucugccccagcccucaccucccucaggugccaagcaagggguugagguguccuggaggcagguacacccgauguccccagggcgauggcucccgucuguucacaccuauacucagaugcuggggugggagcccagccacucuaggccugcaccccacccugcagccccccaggccucagcauuugcaccccacugaacaccagaugauaaucgagucacacgacacucccuggauccgccucuggguacagugugcccaggaaggcaaaugcuucuauuuucaaacucaguggucuuuacagaacagaaagugcuccaaacggcaaucugccugcagucaguuuaaacauacaaggcugacauuccucccucucagagugggaccguuccuuggcaccgucagcaggucccacccagcccuaagacagaccuuccagagggcucagacggaagcucugaagcuuccuugaacacagcagugcugggggauggggggcgugggcaggaaagagggacuccaccugguuggccguuuuaggcuccuugggacccccuccccauccuggcuggcaggcaagugccagaauuuuccaggccccuugagaugguggaaccacuugucccauuguagaauuucacauguacccaccggauuaucucucugagaucaucgugggaacgaaauugaaguaguuaaguucaaggcugaggugcuaaccgcaggguucaaauggagaugccauuuuuaaaguggaucuugugcaaucaacaaaagguuuugggacccacaugggcacaugauggggagaggucacugagcccugguuucgauguuggccuggcauuucagagaagugggagagcuggcagcacuuaggaccucagggcuuccucgguggcugcauccuguguggcacccccggcagggaggucaagaacucacggccacccuggguggaugccacacacagguacgggaggggcuuguuugcaaggggaagaaugacuuuugucuucuucuuuuguugagagagcugcucaaaucaaacaggacagccgcugguuaaacuuagguaaaagcuguucguuagugcaacuguggggagggggcgaaaagacaugcucaucaccaucaccuaugcggcuuuguuuaggaggugaaaaggucauuagcaguaauaaaauaaucauuaaauuggggagagguuaaaggugacuggcugguuagcgguagaacugcgcuggcuggugucaccgggcgcugcaggcaggaaccgcaacgcagggccgcgcuggcaggaaguggcaaggguggggccggucgcaggaucccacuaucgcagcagggcugaggcccaaucacugacacccacacagccguuuccugcacuuaaaaaaaaaaucuguuucucucuuugcaaaucaacaacuuuuaccuagaaacucuucagcggugagcucugacugaucuugaucuccgguccguugcagaaaauauaccauuguuuaccugggggaggugugugccacggcuaacuuuaaccuaacucuaacugacagguuucggcagccugccgggucugugcugcaucugccugaaagaaaccaguuucuucugcccaaaacagacaccugcugguuauuuaauaccuugauacaccuuucuugaaaagaccuccaggcaagaagaacuuagugcccacaccaaagcuccaugcaugccccaggagauggcccuuggugguccccagagugcacuuucuggcuuagauggagacagaacugaguauguggccuugagggcagauggccaacugugggcuacucagcuguacgcugugaccggaacucucccucgaggaaccucugcagguucccagguggagggguccaccugugacuguccaggucaacaccugucugcccgugcacccacacugcaugccagccacaccaaaugucaauuucaccucaauugaccuuuaaacaaaauaagacaagcagcucccacggaauuugaaaacugcagccucuagaacacaagagauggcaccaaagccacacgugacucagacccaaacucacauuugguccuguaugagcgaugacccacagaggacgcuggagcccucuuugaaguucaacucccugcacgcuuuuuuuaacggaaaagauuuccacuaaacugugaccucacagggagaaaagggcccaauuaaugacucccagaaugugugcagccaccucagcugcccagccugucuuuccuggaaaaggugcccauauggcagaagccugcgucccggucccugugccgcaggguggggaugggggcuacagaccacauacagcacgucaccgugcaaggcgcuucacccacacacccaccugcuaggccugagugggucccauggucaggcaggaaaacugaggcucagggagguuaagugacccacccggggccucccuuuccuccaauguccagaaaccagccugaucaagcaguccccuggauucuagcagaauuggcugcccagaggacagaaggaagcggccucaguucuccuguccuggccucacacaucagccauuuccuggcacagaggccuagcaggguucuagaaaccucugggugcccugggauggacaaacccuggaugggagcaugggacaucagacauguuccaugugccaggcggagagaugacagaaaagcuuguuccuucauugugauuuccaugagugcaggugucaacgcugugugcauguuuaagacugcccacuggacagccuauggguccuucagacuuuuugucagucugucuaucuccaccagcucaaggcucgaccgccaggcucacagggggucgcauuucaccuuccuccucacucagccacgcugggacccacgcaucucgcgcaaagccccagcaucugggaagcccugggguggccaggggaaggcggccgucacugugugcuggccguguggucucccugagcagaaaaagccugggguagcaagaaaggcagaaaggcuuuuuuugguuuguuuguuuguuuuaagaaaacauaaaguccagcaguuugaaaacguuggacuuuaugcuuaaaaaaaaaaaaaaaaauucacagauuagcuucacuaucuucugucuuaaagaagccaagaaaacaagagaucugccuugugucuuccuggcgaacuuucugagcacgacuucacccgacacucaucugcugaccgcucuugcccauaaccagaggccuccugggcugcacgugggucugugccguguggccaggaaccgggaagggaauuguacagagcccggcucugauucccuugaccagagagcaaggguagggcaagcaucuuccuuugcaauuccccaaagagccaaacacuucuccccaacaugugacucaccaaaggucaaccacugggucaacucaguguuuggacuguuagagguuaguacggaaucacagcacaaauaaugcugcaagcucaaacggcaaccaccacacggucuguaccuaccacccagcagcgaguacaaugcagaauuuuucuguucagccauugcuucuggguaaaagaaucaaaugagaaauauuuaggccuccacacagaucugcaguugcuccggacuuaaaaugcugcgcgugcauuggcuguuuuagagaauguucugaagcucauggcuugguucucguuacuccugucuuggggcaggaggcaggucacuggguguagaccuggcccugcugccaccuugcugugugaccuuggggagcccccaugaccucccuccccgccuuuccucuuccaggaaaugggcauggccuggccugucucccucacgggucuugcugggaccuagugagauaagaacuguucaagcacuuccuaagggcccaucaauguuaauauauuucugcagagcaccgaguggcacagcaaccaucaaccacagcagaacaaagaugcaguggccugugccacgaguaaaggagcccaggacccccugggucucaaauugugcaacagcucccuaaaaagccugaacccugaagccaggcccaaggaagucacccaaacucccguuaucaaacguucuacuuuuaacaagcauucuuuucugcuuucgaagcccacaguacacuaacagcagaagccaaggugggguggguaggcuugcagagggagacacgaugggaggugauaacugagggaaaguucaaaagcagacccagcgccggguuuagguacguggggaggcggggguggcgguuuccaugaaacacugaaaaugaagcuuugcaccugugagcuguugagugggauggcuccuccucagggcccagcaaauacggcacugcucggcaagugugugcacccauaugagaauacgugcacauguguguaaauguguguacacguauguaagcacagagugugcaugcccggguguguaugagcacacacgcacgcauaugugugugcacguuugcaugcaugcauuaugcaauaucuguguaaugcucaccuguauucauguauauguucacaugugaauaugugcaugucucaaugaaugcaugcacauauauaagcauggagggugugcaugcccagcuguuaucuaugagagcaugugugugugcaggcaugcacaaugcaguaugugagugcaugcugcucaucucuaugcaugcauguguguacugacaagagaauaugcacacauguccacagaugcauauaagcauggagagugugcacggaggggugcaugggagagugcgugugugccugcauaugcguacaugcaggcacaugcgagaauacucaugugaugcaguauguaugugaaugcaugcucaccuguaugcauguguguucaugugcaaacaggugcaugcaugcaugugucugcaggcguggaggauguguguacacaggguacacaugugcaugcaagagcauacacguguacgugcacauacaugcauaaaaauacauggccgcacgugggaaugugcacaugcaugugugccagcugugugcaugcauugugauuaugcauauaugugugugugugugugugugugugugugcuucugcucccaucuuuuaggcagagugaagaggcccacugccguuccaucaggaagccaacaaggaucccugaagagccacugccucuguguaaggcacagguggccucuugcagauggaagggagucccuuuguuguuuuguuuuuccuccugaugguaaaugucuuugauguguggcuuacagaaaugaucucuuuacgcaucuguaucugcucaacaguucacagaaaaucugcucuaaauccacacagcccauacuuggucauacuuuuucuccugacucauccacaagaaagccaaccugggcacugcgggcuggguccccauccuccugagagaaggccauggccagcccaggggacaggaggagagaggcgguguucuaaaaauaacuuccccuauguucaccucuacugacagguggccgaggugcaggaccgagggucacucguaacuagugagcugggggcaugcggagccugcuagguccauuccaggaccugcgaugacacaggggcugcaaagugaggccaguggcagauuccaggggaggggcacguguaggcaggagggugagcaccacuucccucgcuggagcugauggaaagggcucgggggcaugcccuaucuagggaagacagguaacagaaggcaugauccugggagugcgugggucuccuguggcugcccacaauucagggacaguguggggaacagucugccuggagguuagagaauaggaggcgucccagaccggggcacagauggaacaggcaaugaccggguagauaaauggaucagggagcugcagugacuccuucugccacuugaagcaauagcuuucuguuugagagucuggccaacuggccgccggccuaacucugucauacgagagaaaucccacgugugaguuaaagggcuucagaauccucaggggacccucgagggccaaggcuaggagacauuggcagcacuggccauggggaagaggggcagggccuguaggaaguccccuccucagagcugugcguugagaugccugggcaagcuggggcagaggggagccccgagccauccugccuccucacaucagaugccaccaaggacaaucucccgcucccuccacucucaguccugaagcagcugggaagggacuggaccaagcagcgacuccugccacccucacccccaacaggcccucccugagcacggacagggagaaggacggaagagaaggggccagaguggccacagggcugccggccaugaguggcuccugaaguauagccagggcgucgggguggcacugacaugcucaggcggaggccgcacgaagcgcccccagccacaaggggagcucuaaggccaaggcuuugugcacuccaauacagagccagaagcccaggggcccacaggacggggcgagggcgggcaggcaggaggcacacaccacgcacauacggcacuugcguggaccugggcagcugggccggggggacccucuugcuccccacacagggucccacggcaucugcugcuacucugggcuggugagcagggaggcccuggucccccgccauccggcaccgguaggcgguggcugcgagagaagaaagcuuacugaccgcugggcgguuuaggccguggaggagcagguuucuucggaggcagagcaggaguguccuguuuacuuuuaaaggggucaucugagaauccugccccucccaaggaggaggugaaagggccagaaggugggggcuguaagagaggacaugaaagagaggcaaaaauaguuguuaaaacaaaggugacggauguccacugaacagacgcucaugcuccaagggcccuggcaaggccuccuacccucuggacugcacaacauggcccugcuuggacguggggucucuuucaagccccaugcuuuccuccacccucaacagcaggggcccucuggccugugggugaugagcugcccaacauaggguggcagagagcagucccauaccuccacgggcuucuagcaccaagggcauccccagucacacgaggcacacugggucuuuccugacuccaggacuuggcacauagggucccuugggccuccugcuuacacuucagagacacgccccacccucaccuguaugcuggcuguggugcuuggcacaugcccuggugugccgccuccccacugagcuggccgguguggucacugccuucaguuagugauggacagcuccaggugcugggucagcuggcaccagacuuucuuccuccaugccucugggcugcacaugcagcaccucagguggaagugcauccucacaugcccggccacccgcacuggucagcaugcccacgccaccuccacugggcucugaccaccucuggcccggacccucggucagccuccaucacacccauccacauccuccaccccacaccugcugucucaaacccaaaucggaccauauccuccagcuuaaagagagagacagucagagauaguuauaacaauuggauagaugaauggauggugggugggcagauggauggaaugguaguuggaugaauggauagacauauauguggauuaauggacgaaugaauggcggguggguggauggauggauggaugggcagguagagacagggaggcgggugggugguagacagggaggcagauauguggcgacgucuugcagguagguagguagguaggcacuuccuauagggaagcuccaagcucucauuaaggcaugcagggacuucaucgcugccccagcugccugauuuuucaggcucaccucugaagucaccccuccccucacaaugccuccuuaguccccagaacccacugaccccccagccgcugacucagccuccuguuuccaaguccugcaacacucaggucuccugcuggggaacucggcccaccucguccaccaggaaccccucuccuugcucagagccuggcuggaccccacugccgucccccagagcucucccagggcucucccuggggcugcuuccugccacccacgccugcacugcucacugagccacagagacacgcuuccaggccucucccaccuggagggcaagcacaguccucuccccggcaccugcugccuccaggccugugaugagcagauacuaagcgccgccaccuggggggaugcuugucccucacuuggagcgccggugaggcacaggggagccagggucuccaucagccacagaagggccagcauaucucaggcgucugagggaaggggcuggggugucccaggagggagaaaaucacuuucuaugggcagaagaaggaugaguaaccacucuuacuaaaacagaaaauaauuaagucuguaauaaaauagaaaauaacuacauuuuuacuaacagaggaaacacauuguuacaaaaaugcaaaauaacuaggaaauuauaggacaaagagauaacacugcgacaggaaacaaaaggaaugggcagaaauagggguaaaaaugaucauguguuccuggccgggcgcacuggcucacgccuguaaucccagcacuuugggaggccgaggcgggcagaucacgagguuaggagaucaagaccagcccagcuaauacggugaaaaaccccaucucuacuaaaaauacaaaaaauuagccggucgugguggcgggcgccuguagucccaacuacucgggaggcugaggcaggagaauggcgugaaccugggaggcggagcuugcagugagcugagaucccgccacagcagcacuccugggcaacagagcgagacuccaucucaaaaaauaaaaaaaauuaaaaaagaucauguguuccuccaagagcauagaagagaaagaucagaguggggcagagguggagggaggggccgggggucuuuaacuuucuccccagcagggaaggccuagagacagagaacaggucaagaguacaaaggcacacucccaggguuucccucgagaaucugaaugcaacagauugcagaugugggggaaaaggucuaccaccacguccagcagacagucuuagagguauggcugccucugccuccagcaucuagucacaccgaugcagcugacuaaggcuccagcgucuagucacacugacacggccaucuaggccuucagugucuagucacacagacaaggccaucuaaggcuccagcguuuagucacaccaaugcaaccaucuaaggcuccagcgucuagucacacagacguggccgucuaaggcuacaguguccagucacaccagugcagaggucuaaggcuccaguaucuagucacacagauguggccaucugaggcuccagcaucuagucacacaaaaguggcugucuaagacuguagacuagccacaccaaugcagccaucuaaggcuccagcaccuagucacacagacacggccaucuaagacuccagugucuagucacauagacgcggcugucugaggcucuagcuuccagucacaccaaugcagcugucuaaagcuccagcaucuagucacacugaugcagccagcuaaagcuccagugucuagucacacagaugcggcugccaaaggcucuggcaucugguuacacagaugcggccgucuaaggcuccggcaucuagucgcacagacgcagccaucuaaggcuccagcaucuagucacacagacguggccguguaaggcuccagcaucuagucacaccaaagcggccaucuaaggcuccagugucuaguuacagcaaugcagccaucuaaggcuccagcaucuagccacacagacacggccaccuaaggcucuggcgucuaaucacacagacguggucauuuaaggcucuagcgucuagucacacagacacagccgucuaagauuuuaguguccagucaugcagaugcagccgucuaggcuucuagcguuuacucauaccaaugcagccgucuaaggcucuagugucuagucacacagacauggcccucuaagguuccagggucuacucacacacacgcagccaucuaaggcucuagcguccagucacaccgacguggccaucuaaggcuccagggucuagucacacagacgcagccaucuaaggcucuagucacacugacacagucacacugacacauccagucacacugacacagcuauuugaggcucuagcuuccagucacaccgaugcggucgucugaggcucuggcaucuagucacacagaugcgacucucuaggucucuacaauuuaguugcacagacauggccguuuaggccucuggagucuagucagagacguggccaccugugucucuggcagcuaguuauagagaugcagucaucuaggccucuagcaucuaguuacagagaugcaucgaucugggcuauuugcgucccgucacagagauauggcugccucggaccuuguguaguccuagagucgagguugcucggcccagucagagccacaucagagacagaacagggagguggccccucuaagaggcagccuacccauuccagguccccccgauaagggcaguggcaggugcccccagggaggggaaggggccccaaaggcuccugcacagaugaccccaccagaucccuucccugggcuucacgccgcccucugaagcugcccaggcaggagacacucgcucugugcugaucuucucaccuaauaauaggcccagugaccuggcagggggucccacugucagcaccucugccuuacacacaaggaaacugaggcacacaaaggaggcgcagccugcccacaucacacagcagguccacggcggauccagggcugccacaucgucugccucccaggcuggggccaccagacgcugcccucagcugccgagggccaccccagugguggguccagggccucguccugggcagacuguccugcccaggcuggaaccccaacccugccaccuacucaacacccugugccuugguuucuucaucuguaaaauggcaagagugacagagcucggaaggcuccggcaagaaggaaaugaggugccaugugacaggcaucaguccacucacuggcacuagauaaaguuggcacauggaccacacgacaaugaucacaccaaguacgaagcugcgauuggaaucugggagugcccccaucugcugccccaguuguccccaggccuguccgagacaugaggggcagugucggccugcagcuuagcuuuaaaaugggccguuuagggucggcuguuugggaaagaaugggggaaaaacacuggcccgucugugggugcuucugcgauucauggaacaugucccugggccuagggcccgugcgagucccccgcggccugggauggggagccaagcaggucuagaugggaaguggugugaccggcugggccuuguccucccugggcaugugcuggcuucugggccacaucuccagacucggaguggggccucgguuccaguggcugcagugagccuuucuacccucugugucgcgcaauaggacccgggcaauaaaaccacacucagccuggacguccaaaguuguaagaccuggugacacacucaaaucagagccgccuaacccuccaggcugaccggggacaccucgggccaagccggcuuggcgccucccauguguguuuaaacccacgaggccaauuggcaacucgcgaggcgacaggcuuucaauaaacgccuggcacugccuccgcagugaaucagaucacuccuagcuccagaaugcccgcgucauuuccgaaucccaauuuucaugacuucaaguuucccaagaagccuccuuggggacucaacucuuuccuacucgggcagcggcuucaaggaaaaucucuauuuuuagaaagguuucaguaaagcugucaggggcucucugggcucggcaagagugaagugugcuuaaaauaaaaggaagacagaaaaagcuacuaugaaaaccagcucuaagagaaacacguuugaguucaccaguugaagaacugguucaaaacagaagacugaauuuguaaacagcagcccuaaauaucaaugcacagcuuuaaacaauugagaaguugcuaaaaaugggcugacgacuaacccaguauuucacagauggcuuuuuuuuuuuuucagggcagaagagggugaaauaaguuggacucuuguuuuuauucucaaaugcucccuggaaacauacuuuggggaaucuguuuuuaaagugagcuuaugucacauaggcuugauacugucuagaaaaaucucuucaggugaggguggggccucaacuaagagugcaggcccgaagagccucccaaaggaaacuucuagaaucaggcugugggcugugacucuccucagcaaagccacgcagagguaaggugcuucaauucagggacuuacaaaagggccucccugcucugcucagauggggaaaaguugaugaugguuuuuuuuuguuuuuuaaaaaaacaccuucuugccacuuucauuucccuuagcauuuuauuuauauccacaauguuguucuugaaaaacagauagguaaccaaaaaggaaaaacagagcugcaaggucaggguugagcucagaaugcggcuguacaagugucaugaaggcagcugauggaacgcuggaaucaaaacaagauaguauuggagacccauuuuccacagcucuguccaacucuguccuggcccggcaccgccaauaggaagugagaccggcucugaaaucacagcugcaugugugugaagagccccugguuucagggcccaaggacaggcagagggcggucauuagaucccggcccuagcucaggcucugcuagcucucccucccucugcucacagugagaggaggaagacagauccagccucccaaaggaagaggaguccacuugcgacaaccagaaacgaccaggacgccugagggacugcugccaccguguggccaacguuuucugcuuucgggagaugguuucccgccugcccaggagccugugcacugggcccuaaaucuucugccagucccaaaccgugucacagcguggcauaugagggauggaggccuucuccgugugcuggaaggaggggggcgccaugccagggccucugggcucccucugcccaggcucaucuguguaaacacacacccugccucggucagaagugggaucugcugcgccgccagggcacgcacacacgcgucuuugaaaaccugaacagaaucucaagugcuucucggaaucuguguucugugaucacaaguugcgaccgcugccaaccccaagaugcucagagacucaucugcuccaccagcugagugaacacggggcagccaagggagacugcccagucacacuggcaccuggggcaccugggcauggggccgguggggccccgagggggccucaugccuggggcacgcgucuuccagguacucccggggcucccuccccucaccaccuucaggcugacagcagcgcucacagggacugggcccagcugcuccaggggaccccccacaccggccaccccuuaccaccugggccaugggcuccaggaggggggcuguguucugcuuguggcuacugccucuucccgcagcguggauaaugccugggccucugcagguggaacucgugaggaaagcaggccccugcagccccccgaagacagagcccaucugccccugccugggggcugccgagaagggacagaguggacgcaggugucagggacgggacacaccucaucugcuuuccuucauuccugccaaagaaaaaugcuccucacucaaacagggaaacauacaacucacaaggaagcacaauggugccgcagcccuguccuucccacucaccacagcccccauuuccaacuuuccagcaguuucuuccggaaggcaccucagucguaaggggcuucuauuguuguuuuuugacuuguccauucuggauguucccuguugaauucucuaugcuaccuuaaagaugagcuccaaccacacugccagcgucuggagaagcccuacagcugucugggaccagagccacagugaguucaggucaccguguggugagggccggacaccaacggguccagucugguaaccagccucgcugcuguccuccuucaacaguucacuccucaccuguggaucugucugcauuuauucaaggaggccggcccucacuuuucaacaccccuugagaguucugucacaugggcgacucugaacacucgcuggcccacuuucccuggacgccucgcaccugcaggccugcugcccauggcccucucgagacgccugugcccaacgccuucucaaguuucuacucggccauggcaaugacuucaccgucugagaccugauggucgucagacaccagugggagccaggggagcccagggcaccuaugccacugggaagggucagggcucaccccacgggacugcagugcauuggaucacagccauggaugcuuuccagaccugaccuuguguuggaaaggugccggggagauacauacgugacaugaacaauuacgccuggcagcccacaccaugacaagaggcacaaagacacuagcagaggcgcgggggcuccguggaggggcuuuaccuuggacaucuggcugaagucggcaaagccuucagcacuauugaaggacccacuuccgaagggaucuaagguuccaaagggaucugcaaucggcaccaacaaagucagaguuacaggucuuuaagagaacaugccuucugggguggaggggaaaugcuagauggccccugaaccaggagacucaggaaggcugcauuuauucauuagacacgugugucugcaugaaggccucucagcaaggccccccugcccacucuggcauggcaagacgguuucucacugugacgaccacucugggagggccagcaucauucacggucaucagaagagugacaaguugccacagaggcguggccccugggucccacugggucucaaugggucaggaggcgaggagcaacuccagggcgaccugccacccacaugauuuauacaggguggugucuuuggauagagguuuuugcuguguuuucuccucuaaccuggaagggauuugccuagaguacuggauacacucgccuaugauaccaaacacugcuacccgccccacgcaagcugcaggaccaagcggggccuguucccaaaagaaaggggguguccacagaugcucccauugcauaaaggcucgagcgugcaucugcgaguucuacacugugagaugagguuccuucaaacacagaacccacaacauaggccaguaccuggggucaaauucuggauuucuuuuagggaaaaaacccaaagauacaaaccaaagauuuauaaggaggagugaguaaacaguaguuaauaucacuggugcuauuacugaauuccuacugccaaaauuccuuucuggaaagaugccagcgcgugcccaggaaggggagcagcagcgggugcuuguuuuggccuaaugggcucaggccaggaucugggugccacugacugaugacacaaacacagaggccacgcuggcuuugggagugaaaguguuaacugcgggggagcucugcuacugcccaaggaauagucaggaagaaaaauaagucaugggucucaccugauccuuuugaggagacacuggaggaugaaaagggaucacuggauucaaaggggucgagcuaaaugaaaggagagaggaaagaguaaaaagcaguucguugguuccaucacccauucauucaaccagaccuuccugacgucgauguacaacauccagugcugagccagagggaaaguggaaugauuaaaacucaacccaggcagaguaaaaucccaacagaucaacccuccugcagauagcaccuaucaaccuggacggaauauccccaaaauuacaaauacaaaaagcaguggccugaaggcugggaagugaacaagacaggaagaagacuuuggaggagaauuugaauguggcagaagaacauagcaggagguugaguuuccauuccgccagcuacagcaggaaggcacagugagggugccuaagauucugguagaaucugaccaccagaggauggagcccagagacaaccacucccaggggaaaggaaggggaaucgggauggaggggcagagaugcaaagaugcaagcccugaacuucaugauccacucucccccaagucucaggcuggccucugcacacgcaagccuggggggacucgaggcagccuguagcugaggccacaagaacugagcugggauuggagcuucugccaucugcuggugagugucugcagugugaguggcaccaaguuaacugccugcugaaacaaauccauuccugcucuuuggagaaaacagacuacagucucuacacagaacgcucaccauguaucagauacauuucuaaacauauaaagaacuggaaaaaugugaccaccucucaccggaaaagacaaucaguguagccaaucucaaaauaacccagaugguggaacucugagacagggacaacguaaaacggugauuauaacugugcugaaugaggaaaaggaaaauacacuuaaaaugagugaaaacacaggugaccuuagaagagaaauagaaaauauacgaaagaaacaaaugaaaguuccggaacugaaaaaguguaucuacaauaaaaacuucaucaccggggucaguggaucacccaagaucaggaguucaagaccagccuggacaacauggcaaaacccugucucuacuaaaaauacaaaaauuggccaggcgggcaaggcacaguagcucaugccuguaaucccagcacugugggggccaaggcaaguggaucaccugaggucaggaguuugagaccagccuggucaauaugguaaaacccauuucuacuaaaaauacaaaaaauuagaugggcguggugguggaugccuguaaucccagcuacuugggaggccgaggcagaagaaucacuugaacccaggaggcagagguugcagugagccgagauuaugccauugcacugcagccugggcaacaagagugaaacuccguuugaaaaauaaauaagccaggcuugguggugcaugccuguaaucccagcuacucaggaggcuaaggcagaagaauggcuugaacccaggagguggagguugcagugagcugagaucaugccacugcacuccagccugggcgaaagagcgagacucugucucaaacaaacaaaaaaaaaccccacuucauuagguuagcuaaauaaccaagaauaaaagaaagaguaagugaaguugaaaacagagcaguagaaauuacucaaucugaagaaaaaggagaaaaaagaaugaaaaauaaauaaauaaauagagccucaggaaccugugggacaauaacaaagggucucauauccauguaacuggaaucccagaaagagaggggagagaaaauugggcagaaaaaacaaauuaggagaacugacagcugaaagcuuaccaaauuuguuuuguuguuuugagaugggagucucacucugucacccaggcuggagcgcaguggugcaaucucagcucacugcaaccucugacucccagguucaagcgauucuccugccucagccucccaaguagcugggauuacaagugugcaccaccacgccuggcuaauuuuuguauuaguagagacgggguuucaccauguuggccaggcuggucucgaacuccuggccucaagugauccgcccaccucagccucccaaaguccugggauuauaggaaugagccacugaaccggcaaugaaaacuuaucaaauuuguugaaaagcauaauuuacagauucaagaagcugagcaaagccuaaacaguauaaacaccaagaaaacuacacccagaaacuucaaaaacuacugaaaaccaaagauaaagagagaaucuugaaaguagccagagaaaaaccaccuauuacauacaggauaacaaugaccugaagaaauacuccucuccaccgggcacgguggcucacgccuguaaucccagcacuuugggaggccaaggcaggcagaucacgaggucagaagaucgagaccauccuggcuaacauggucaaaccccgucucuacuaaaaauacaagaaauuagcugggcauaguggcgggcgccuguagucccaacuacucgagaggcugaggcaggagaauggcgugaacccgggaggcggagcuugcagugagcugagaucacgccacugcacuccagccugggcaacagagcaaacucugucucaaaaaaacaaacaaacaaacaaacaaaaacucuucucauuaaggacaauggaggcuggaaggcaguggaaaaacacacuaaacaaacaaacaaaaccccaacaaccuacaucaaacacaauguccuucaagaaugacaacaggccuggcacaguggcucaugccuguaauucuaucacuuugggaggacgaggcgggcagaucacuugaguucaguucaggaggucaagaccagccuggccaacauggugaaacuccaucugcauuaaaaauacaaaaauuaaccagaaaucgcuugaacuugggaggcggagguuggaaaaaaaaaaagaaaagaaaagaauaauagcugggugaagugacucaagccugugaucccagcacuuuggaggggcugaggcaggaggauugcuugagccuaggaguuugagaccagccuggccaacauauggaaaucccaucucuacaaaaaauaaaacaauagcuggguguggagguacaugccuguggucccagcaacuugggaggaugaggugggagaacugcuugagcccaggagguugagguugcaguaagccaagaucacaccacugcacuucagccugggcaacagagugagacucuguuucaaaacuaaaaauaaaaaaaugacaacacagucgaccugagcuauaagaagugcuaaagaaaguucuuuaggcugaaggaaaaugauaauggagggaaaaccaaucuucaguaacaaaugaagaguaucagaaaugguacauauuuggguaaaacuaaaugacuacuuuuuuccucuuucuuuacaauacccacaauggauuaauacaaaaauuguaacagucuuauggaguuucuaauguauuuagauguaugaaauucacaugacggcuauaacauaagacaugcuggcugcaaggguggguggacaaauggaccuacaugguugcaaguuuucuauauuuuacaugagauaauacaauacuaaccucaaguagacuaugaaaaguuaaagcuguacaugauauuuccuaaagcaaccucuaaacaaucauuaaaagagguaugauuaaaauaauaaaaggccaauagacagaauucaaaaaaacauucaaacaauucaaaagaaagcaggaaacaaaacaugggauaaaaagcaagcaaauaauaaaauaguagacuuaaaccauaucaauaauuacauuaaauguuaauggacuaaacauuacacuuacaaggcagggacuucugacuggauuuuaaaaaaaaaagcaagccccaacacuaugcuacuuacaaaagacaccuaucaguuuuaaagauccagguaaguugaaaguaaaugguugaaaaaugauguaucauguagugaauaacaugaggagaaugaagugauuaaacagacuucaagacaaagaacaucaccagagaucaaaugggaaucuuuuauaaugauaaaaagguuguugugucagaaagacacaacaaucauaaacaccuaugcaccugacaaagcuucaaaauacacaaagcaaaacuugaucaaauuaaagugcaguaugaacaauuccacaaucauaggagaauguuuaacgccucucucucagacacugguaggacuaaaaaacaaacaaacaagacacagauuaucugaacacuaugaggaaccucaaccucacugccauuuguagagcauuacacccaacaacuagauacacauucuucucaaguguacaugguuuguucaccaacauaggccacaaacaacaacccuugauuaaugugaagguauugaaaacauacagaauauguucucaaauaacaaauuuaauuaaaaaucaauaauaauaguauuauaauauaccuaggagaaaaagccaaguaucuggaaaugaaacaacauacuuuuaaguaauccauaagugaacagaauucacaagggaaacuggaaaauaucucaaaacugaauggcaaugaagagauaaaguauucaaauauaugaaauacauguaaagcagugcuuaagggaaauauguugcuuuaaauuuauacagaugcuccuugacuuaccaugggguuacauccugauaaacccauuguaaguugaaaauauuuuaaguugaaaauguacguaauaucccaauaaacccaucacaaagcaaaaaaucagaagucaaaccaauguuaaguccagacacuccuugacuuaugaugggacugcaucucgauaaaacuauuguaaagucaaaaaacuguaaauugaaccaucguaagucagggaccgccaguacuagaaaaugaagucuaaaauuaaugaaugaagcuuggaucuuaagauguuagaagagcaaaguaaccccaaauaaauaggaguaaggaaauggaaaaaaauagaaauagaaaagagaaaaucaaugaaauagaaaacaagcaguagagaaaaaugaagccaaaagcugguuaugggaaaggucaaugaaauugguaaacagaucaccaauaccaggaaugcuagggaaauucucacuacaggucuuaaggacauuaaaaaggggccaauaagaaaauacugcaaaugagucuuugccuucaaggagcuucaagcgcuaaagaccaaaagguccacagggagugagcgaggugggcgccaggguagcaggagcccugagaaggagggugagugcccgucucugagcaggccccgggccuggguugcagccuagaaaacggaagaaggcuaugaagcacgcucacuccaucaugaacauccucugcuccaucaccgaggcugcuuuuuuuuuuuuuuuugguuuugaaauccaaguugacaccuauuuaacccaaucucuugggcauaauaugcaaaauacccggugucugccacgcccggggaugggaguacagguaugcuggaguuggaaacuggagggucagaguuggcugaugcucucaggagacaccaggcaaggcagccgggcugagacgccugcacuuacuccugccgugacgggagcaccuaccaaacgugacucuaagguccccaccagugcuguguguuacaaggaccgugcaggguggccggguccaugcgagcauguggugcuugugugauuuagucuuuuuugggagaugaaggggcagugggggcagaugacuagaguugagggguaggaauggggauagagaaauaagaacuaugggugacauccuccuugcccugauguggggccacuggacugcuaacugcaccuuggggcucacaggaugucacugcagugacuaggccagugagcucccucacucagcaggaaugaaaucagccugggauaccagcucccggagaacagacaccauggcccacacucgcaggcaccauguacgcuccacgaagggaagggggccuucgggaagcgccacccuuaccacacagagcaggcacgcagcucucccgggcaacgucccaccccacucaccuucgaagguaaggaaggguuuuucgugaauggauccgagguaaaugggucauucuuugucuguuucuugaagaagucgucaguggcagagccacggaaugggucacuuucuuugaaaggguccccuccaaauggaucuagaaggaaaaaugccccauaaguaaacauuauaccaagugaaagaacccagacauaaaagaacacaucacagaaugaugccguuuacaugaaauucuagaaagguaagaacgcuagugacggaaaacaggauaaugguggccaggggacccugaggagaggguggagggugacaacaaaggggccucaggaaugacagaaguguucucaaauugcacacaaccgugcauauuuaaugaaacucaucuuauuacauaguaaaaugggugaauuuuguucuguguaaauuaugccacucaauaaaauugacuuuaaaaauaauaauauccuggccaggcacaauggcucaugccuguaaucccaucacuuuaggaggcugagauaggaggaucacuugaggccaggaguucaagaccagcaugggcaacacagagaaaaauaaaauaaaaaauuagccaggugugguggcacacgccuguaguaucagcuacuaaggaggcugaggcagaaaggcugcuugagcccaggaggucaaggcugcagugagcuauaauugcgccacugcacuccagccuaggcaauagaguaaaaccccaucucuaaauaaauaaauaaaauauccugcaggagcuggauauaauaauaauaauaauaauaauaauaauaauaauaauaauaauaauaaacaacgcagguaaauccauagagacagaaaauagguuggugggugccagggguugcgggagggaauggggagugacugcugauugggauggggucuccuuuuggggggaugagaauguuguggaacuagaugaaggugaucauugcacaacacugugagugugcucaauaccacugaauuggaugcuuuaaaacagugacuuuuauguuacauaaauuucaccugaaaaaaaauaaaucggucgggcaugguggcucacgccugucaucccagcacuuugggagaccaaggugggcagaucaccugaggucaagagugugagacgagccuggcuaacacggugaaaccccgucucuacuaaaaauacaaaaaauuagccgggcgugguagcgggcgccuguagucccagcuacuugggaggcugaggcaggagaauggcgugaacccgggaggcggagcuugcagugagccgagaucgcgccacugcacuccagccugggcgacagagcgagacuccgucucaaaaaaaaaaaaaauaaaaaauaaauaaauaaauaaauaaauaaaauaaauaaauaaauuagcaagcaaugugaucccaccacacuccaggguggggugcgggcagugacuggaccuggggaggggagccaccuccagaagggaacgggaccgagaauggguacaacauggauggacggccguccuucccaguuacauggcugccauccccgguguauguggacacaagucccaccacaugcgacuucugagccaggacuggacacagucuaaagaccgguccgggaaacacugaauuuuaccuguugaaguugucugcuguucugcaaaggggucauucuggaacgggucgccugguuggaagaggagagaaaugcuuauuagcucuagggcacaggaugcgggccgggcccuuggacacagccacccaccucccaagccuuucauugccuucuacuccuccaguguagggagagaauguuaguuccuucucuacuauccaccugcccucaaaaccuuggcaaaucaaagagggggaccuggaggaggcagcuguuucuggcuaggauguuuaagaugagaaggaagguacugcuggcugucccacacagacuggaguuggggaagacacagagugggcuagaauucacuccucucuucccaugcuggguuuccuuuaucccaucugccugccagcucccuggguaagaggacacaggacccugggcugucccucacuuuaucaccggcccugcagcaaugaggcggcggcaccccugggcuucaggggcugccagauucgccucucagacccggcaggcuucaaacccaagcugaagcucaagcucccgcugcccucuccccaccucaguguuuuucucaaaaauguagagagccuuccuccuggaaauacuguuuugcucugaaacauggacagaaacuuggaaaucuuguuucuggaauucuuaguuauucuugacucagguguggcucuggacagacuccuaaaauuauccagaccuuagguuuauguaggaauccaugguuuuccagguacuuucaugaucauuacuagcucugauuauuuuaucaacccugugaggugagcaaggaggaaauuuauuaaccugcugagggauuaggaaacugaaguacugaaggguucaagggggcuggccaagcugccuucaaaugugggucuuguggugagcuuggaacacuucccacuguaucuugaugccuuggcucucugguuaacagggugagauaagaagcuuaaaaggcguuccugcugggugcggugccucacaccuguaaucccagcacuuuguggggcugaggcggguggauuaccugaggucaagaguucgagaccagacugggcaacacagugaaaccccaacucuacuaaauauacaaaaauuagccgggugcggugaugggcgcugaggcaggagaauugcuugaacccaggaggcggagguugcagugagccgagauugcgccacugcauuccagccuggcugacagcaagagagcgagaguucgucuccaaaaaaaaaaaaaaaaaaggcauuccuuucccccuccauuucagauuguggcauguccuuacuuuucuaguugaagaaccacucuaaauucgacauaaaacacacagucuuucaaugagaaaguggguagcaagugagauaccuuugaaggggucagcuccuuuaaaugggucagauuugaaggggucuucugucuggaaaggauccggaugcaacucuugcguguuguugcuaaauaacaaggcuuuauuuuugaaaggaucauccuacaauuuugugaagaaacaggacagggauuuuauuauuucugaguuaaagcaaaguacggaauuccauacuuaacucacauuuccacuuugaguagcaugacccuaaaaagaaugauuuagccaggaguucgaggcuggccugggcaacauagcaaaaucccaucucuauaaaaacaaaaauuuaaaaaugaggccaggcaugguggcucacgccuguaaucccagcacuuugggaggccaaagcagguggaucaccugaggucaggaguucaagaccagccuggccaacauggugaaaaccugucucuacuaaaaauacaaaaaauuagcuggguguugugccgggcaccuguaaucccagcuacuugggaggcugaggcaggagaacugcuugaacccaggagguggagguugcagugagcugagauuacgccauugcgcuccagccugggcgauagagugagucuaucucaaaaaaaaaaaaaaaaaaaucaaggugugguggcguguaccuauaaucccagcuacuugggagguugacucaggagauugccugaacccaggagguggagguuacagugagcuaugauugugccacugcacuccagccacaacagugcaagacccuguaucuuuaaaaaaaaaaauuaauuaaagaucauugaagaaguaugaacuugagugaauaauaauguuuaauacugguucauuaguugugacaaauguacuauauaugaugugacuaacaggaggaacugggugugggauauagaggaacuaugcacuaucuuugcaguuuuucuuuuucugaaacagggucucacucuguuguccagguuggagugcaguugcacacucauggguuacuccagccuugaccaucugggcucaagugauccucccacgucggucucccgaguagccaggacuauaggcgcgcaccaccaagccuggcuaauuuuuauauuuuuuguagaaaugaagucucucacuauguugccagggcugguuuugaacuccugagcucaacugauccucccaccucagccucccaacguacugggauuauaggcaugagcuaccgcaccuggccuaucuuugcaauuuuuucauaaaucuaaaaacuauucuaaaauaaaaguucauuaaaaaaucauugaguggaagcaacucaaauguccaucgaugaaugaauggauaaacggaaaaacaaaauuuuuuucuaagucagaaaaaaauaaugaauuugaaaugucaucaagaaaauuguaacgagccacacaacagaaucugauucagccuucaaaaggaagcaaauucugacacaugcuccaacauggaagaaccuugaggagaggcugcugagugaaaucacagucacaaaacaacacacaagguaugauuccacuucuaugagaacccuagagucaucacauucacagugacgaaguagaacaguggcugccaggggcuguggguggggggauggggaguggguauuucauggggaugaaaacguucuagagcuggguuccacaacaaugugaauauaccuaacacuacugaacuguacacuuaaagacagugaagauggucaaguuuaugucuauuuuucuuucuuucuuuuuuuuuuucugagacagaguuucacucuugucauccaggcuggagugcaguggcgugaucucggcucacugcaaccuccaccucccggguucaagugauucuccugccucagccuccugaguagcugggauuacaggcgugcaccaccaugcccagcuaauuuuuguauuuuuaguagagaugggguuucaccauguugggcaggccagucuugaucuccugaccucaaguaauccaccccccucggccucccaaagugcugggauuacaggcgugagccaccgcgcccggcuguuugucuauuuuaccugaaaguuaaacaauuuuuuuuuaaucaaugagucagaaaaaaauaauaaacuuggaaaugccaugaagaaaacuguaaagagccacucaacaacagcagcacaggccucauuucagaggugugaccuuccucaaucauccuuuucucggugaguauguaccuaggugggcauuugggaaaauggaguuuucauaccaagaaacaugcugguuguuucuguccuaugaggaaaugaguacuuaugcaguuagaauuacuagagcauacacaaugcuuugcauuuuuuuuuuaaaguguguauuucuagaaacaaacagguucauuuaaacgagaagaaaaaauauuuacuuuugaagagcacauuuuuguaaugggaaguagucugaaaaggguggguuugucauauacaugggaacaauacaguugguuuaaauaaggacucuguuuuaguuaauaaagacacacccucagugaaaacaugaauguuucacugugauauuaaaaaaacagcacaacacccucauugaauuuggcagacacacuggcauuccugcguaggacucacaaaccaguccaguauuccaaccgaccaaaacaaaaucauuaaaaagccggggcguccacaaaaauagggacaaugguguggggaaaugacaucaaagguccaaaagaaaguuuccuagcaaggcugccaccacccuggggcagccaacuuaggggugcaggacaguuaugagagguacagaguuaagacaagccaccggucugggcugugaaugagugugaaucagcaugagugccgcuuccucggcccccacuucaggagaaugcacccacaucccugccaucugaugaacauggaaugguuuuucuuaccugggaaagaauagcuggagccuccgaccacaggguuuucccaagguggggaaaccaagccggguucuuagacaaguuaaguacagauguccacaagcacugcagcuggagacagugcugaguggacgucaggugcugacgaccacaagacacacacgcccagcaagcgucugaugggggucucggaugcagauaaagauggagaaguccuacucuaaagaagccaggaggcccacguggaaaaucugccuuucacacugccccauggaaggaggaauguauuuguuccagaagaaagagaggaaucaugaccuggauaaagcagcgaguuaagaaugccagcuugaccucagaaugaaagcuucuauuuaguuuguuuuuaaagguaggaucucacuacguugcccaggcuggagggcaauggcuauucacaggugcaaucccacuacugagcagcgugggaguuuugaccugcuccgcuucugaccagggcagguuuaccucuccuuaggcgacuggugguccccugcucccagaagguaccauacugaugacuaacuuaguguagacacccaaucagcauagcacacuacagcccagaacucccgggcucaaggauccuccugcuucagccucccaaguagcugggacuacaggcacucgccaccaugccuggcucuauuuaguuuuuaauuggcauuuauuuauaagguuuuuuuuuuucaguguuuucagucgucacuuggaagacugccaaguaacagugaacaauggcagagaagagacugagguucugggaaugcuggcugcaagcccccugcacugacagucaggccugcaaucacuuucucaggagucauuggccugaagccacaaucacuccuuccccuuccaaggggaagccugagaccccagcaggauucaggaggucaggguaacuaauagugguuuugauuccauugcacagaaucagagugggaaacgagauuucccuguuacaaagauaccaucaacucuaccccuugcagaccaccuacuaaggagaacagacccaucugccaacuugggggacacgaguacagcagacaagggccaggaugaaugacacggcccuuggcagagauguaauaucuugaacaaguucagcaaccagugugaaguuguacccuucuuaggaaauacacacggcaacucugaaagggggcugaagaagcuucugugacauucccgcccuuuagaggagugcugggcagcaggggugugcugggaaucaguucucucagaaaaaagcccugguuuagagcuucugccaauuccugugguguaaacagucucaucaugguugauuucaaguuuccaagcaacuagcucacaaguuccuguuuuuugcuuuuugggguuuuuuuuuuuuuuuuagagauugagucucgcugugucacccaggcuggagugcaguggcacgcagcuggccucaagcaauccucccaccucagccucccaaaggacugggauuacaggugugagccauugugcccggccaguuccuauuuaauaaucgguucuggaaagucaauaaaaacuggcuccagcaugccacugggucuggaugugacagaucaaucaaccuuucuuaaucuguccucaguaaggccuaagucugggaugauuuauuagcuucucuccauaaguugauuggauggugagcaagaggucaauauucucauaaucagaugauagacaagaaauaaauauggcuuuaagaacccugacuuuggcgggugagguggcucacgccuguaaucccagcauuuggggaggucgaggcgggcagauugccugaggucaggaguucaagaccagccugggcaacacugugaaaccucgucucuacuaaaaauacaaaaauuagcugggcaugguggcacgugccuguaaucucugcuacucgggaggcugaggcaggagaaucacuuggacccgggaggcagagguugcagugagcugagauugugccacugcacuccagucugggagacagagcgagacuccgucucaaaaaaaaaaaaacaaaaacaaaaaaaaaaaaaaaccccugacuuuugagauaaagucacacugcgugagcuucacauggaauuuaguaaccugaguagaacuguccaaacauaggaaguuccagauguaccacuguggauacacuauucucagggaccuaaaacccccaacuucgacccacaagggagaacuaagacaccucucucucggcucugaagcagucuugaaguguucaggaguaaacaaaaaucucucuuccaaguauuuauuaagaaauagaaacaagccagaaaaaugcuuuaaaaacuguauuuguacaacaggauaaaaacaguuuuucuuucggaugccaguugcaaguuuccauguaacguaucuuaaucuacauucccaaaguaauugugucucagguaaccuuugcccugcccaaaagaugaacaaaaauaaccagaaagguaaaaaucugucuuuggaguugggggaaucacuggccacuugcaaacugccacuucacugccaacuuuuauccaagaaaaccgguuucuaaaaaccugcaaaagggacauuuaagaggaagcuguucccugaacgaagacugagcaggacaagccaaaagcggugccaggggacaaugccagauggggaaaguaggagccggguugugagacggaaacacacacgccaagaacagccagggagcaaagcgaggaguucuggcuucucguaacucaugaaggaugaaugcucaucguuuaaauuuagacgauaaagcugaugaugacgggcccgggggcggcuauggaaaccaccucauuacgaguccacgagaaaagagaguaugggaggaaagagggaggcggugcacccagcgggggccagacacaagagacagaugagcucgccagcagugccuucccagcagcccaggggacgcgugugcuuccccauaaauccuugggacugaggacuuggcugcugagaaaagaaacacaucaagcauugaacauaaagaggcaagugugguguuuagagagcacgagcgcucacucuuauuccagggaggaagaggaauccaugacguacagaggcccaggagcagaagggcuccagggaggagcccugggagagaggguggcagcacggagagagcugcuggaggcagcagagcaccaaggaaacauccagacaugcgcggcccggcccauccgcucccggaacagcaccaagacgaaaugggaaacuacauguccccagguucgaggcugcaggggcagacucuggugugaacaggggggaugugaccaccuaaggaaaaggucacaccugucuugguaucaggggcucaagagcucucaaaaauguaaggggccgacaguccccugccccaggccugaucacaacuccagggucaugaggucagaguaaagugcagagguuuuuaaacauaaccaaaauuucaggagaggccaauucuuacuugaaagagcaacacccuggggcgcugcuugccauuacuuccucaucuuuagcaacacauuugcuuuucaagguguuccuuguggaaacacacauacacauagacacaugccccucagauguccccugcccccugauuaguagaaugugggguuuccacaaugagcagaaacugauccaauuuugguuaaguuugagaagcccucugaacuugggugguuggcccaauguaaauacuuccgcagagauggagggcauucaaaacagguucugaaaggauccaggccuaucuuggacuuuguucuggaagccaggauucagcauggccaccugugccaggcugcaaggccuggugugaacgcgcaaaguggcagcaaaaacaacagacagccgccugcacuuggcuggaaccaacguuggccaugaacagaucuggcgggugggauguucugcugucacaccaggggaccagagccccauacuguaauacguuuauucaaccuuuaccauggcuccaaaacugccccucucugccagggagacgccuucgcucagguuggccaggucggucaggcuggcaccaugggcuccaucgagcaccuggucauacugcuccaggcuccugugggccuccuggcggcuuucaugcagcugggaaaguuugcuccuugccugugcaacaaagacaucaucagcauuaagcagggucaggaaaacaugucagaaaagacgcuuuuuuuuuuuaaaacacagggucucacucugucacccagacuggaauguaguggagugaucauagcucacuguagccuugagcuccugaccucaggagcuccuccugccucagccuccugaguagcugggacuacaggugcgugucaccaccuauauuuuugggcaacaaaccaagacccaucucugcaaaaaauacaaaaaaaauucuguauuuuuuguagagauggggucucgcuauguuguccagucuggucuugaacuccuggccucaagugauccucuugccucagccuccuaaagugcugggaugacagguguaaggcacugcacugcgcaaagcaacauaucuuugcuccugacacccaacuacaaacucuaaggguuagaagagaaaacacugaaaguaauccuacagauauuaaccauaaagcacaagaaagggugguaaaucucugagcgguccaugcuugcgaucaacuguggccuauaaacuggcuaauggagcacagacagagaccaguucaauugguaaaagaagugugccuggccacuccgacacaggcgagggccagugucacaaccacuguguagacuggaugcccagggccaggacagaggccuucaucuacugcccacaggagagcagggaagggcaacggcugcaggccacgagaagccagcgccccccccuggacugggaagagggugggggcgucccaggcagcuuagagaauggggguccugcauggcgugaugcuccaggguggcgccuccugaacacaccaguggcuguggaggaugacgucuguucucuugcccaaggacaaagaagucaucucucugacuuugucccucuuguuugugugaggaccaggcuggaaagaaccccaaguucucuccaaaugagccauuaauuaaguguucccaccccaccccgccuacuccuugaagaugcugugugcucaggaaaggaaagugaacuccuccaggccaaugccaacaaacucuggaacaugcccuggggaguccuuggcccugcgccuccaggccagcaccacagccucccaaaagagacccucacguaaguaacaagggugagagcaaaggaguucagcaguggcagccucggcucuuggggcucgcuggucccuggcauguggcagggacccgacuccgugaaguaccugguugauuucgucuugcguugacuucagggacuugaugaugguuuccagcuggacucgcccagccugaaugcucugcuccagcuggguuuccuccugcugcaaucgguucagcuccgacuuggcucgguucagaucgucuuccugggacuuuaagucagauuccugagauuggauuugcguuuucagugaugagaucugaaaugagauguuaaaagauguuaaagagauucacagugcaggaugaaaugggacuccgagaaagaacucuuagcccccauccccgaaacaagcuaagccagggacgcagacaccuaacccaggcccgacaccuggcuuccuuacaggccucuuucuacacccaaaauagagacacaaaugaaaaggcagaugggcucaucccacuguggcuaacggaagaucacuuuggaauaaugaggggcaugaccaagcacgaacaaucuguccauccccccagaggcugaacgucauagaguuuucugagguugcagccuccgggaucugugaggagccucagagacaccugaggaggggacacaggcacccuggaacucccuguguuguggggcacagccaggugggguguguucagggcacaaguucgcagggaccaaggccauucacuuauacaaccugacuucuaggaguacagggggguggccaggaagucaagccacaggugcuuggacacuuuuccacgugguguuuggaggaacucuauugacccaguaggaugucuaaguguuguguucccagguaacacgagcucaggggaguccuugggaagccccugccugugcauagggcgcugccccggagguggccgggacccaccaucugagucucauccuggcacuucugccggacgucgcucagcaugucucggagcuuggccuucugcugguccaucucguccaggcggucuugagcauccuguuucugagccucgagcuccugcaaacugcuuguuucccggucuaggucauuuuguaauuccuagggaggaguugcagggguuuacgugaggaugggaaaaaugaagcauguccaagauaacggggggcagccugggccagaaguccaggggaagccuccgaaaccacccacugugaccgugcucagggccagcauuccgugcacacccacggccaaugugugccucuugggcuggaggcccagggccacugucucaccagcucccucagcagguauuucccgauggccuaacagaggccaggugcgagagaaggggcugggucccugugagaaaaaggccccagcucccggaugacaugcagcuguggcugcggaggggaacaucacccaaacgcaaauaaacguggacaaguggcaccaagggggucacagggaaacuacagucacaccuugugggcagggaagaugcccacaaaagcagcauuuaggauggggccaacaggugagcaggugccaggcaggugaagagccagggacagagccuggcggagggaaccacagggaccccagggucggggggugucgcacuccagcuagagcaaaagggaauggguggaggcaucagaggcugcaccccacaggccacgccaaggagacugcgcugggcucugugguggggagcccggugggaugugugagugugggaggcgggacaucaugauucuguuucugaagcucucucugaccccgugggauggauccagauggucagcccgaggcuccaaugccccaugauuccacuuccaagaaaagcauccuggaagcauacagcgugugcagagguauacaacgucuaugacagcaaaauccguaaacaaugcagauguccaugaggugcuggcuggaagguuccagcacagcccacacugugggacgcuccuuggccauggaacgggauggcgccgugugcuuugccuuacagugggacaugagcacacugcauuugugcgaacgggaaggggaggguaugugugguaugcaucaaccuuucuggaaggcccccuccaggagcucaugaacagcaccuccggggauggggacacccaagaagagggcagaggcuucucaccuccugauuuucaaccacgcaaaugcauuaucugucuuuaagauaaauaaccaaagcugaaauagcacaacgggcauugugacaagccuccucccuccagcugccauguggagcguggugcaaggggccaucaggacgcaggaacugcaggggccucgggugggguccagggagaggcagcagcagcuggggccugagugaggugguggucgugagaauggagaggagggguggguuugcggggagccauggcugggugguggggcugaguccgagagccagccugggcugcugggguggcuggugcccugagauaacaaaaccagagguggcccagggucuccccucuccucacuauggggacaaaaacauccuggugcuucccugccucgauaggcaaaucaugccucaggaagcuggggucuccguuccccagucucccugccccuggccuuucacuugagggcuggaucuggaggggacaaucagggucacuuauggacauguucgacaggaaacucaggagaaagacuccagugagugugccaggaagggaagaugcuggaaacauaaagucaggcgugucagcaucaaggugguauuuaaacacgugggaaugggugagguguccaguggggggcacagagagagccugagguagcccaaugcuccgagcgaugcucccaccagggacggaagccucuagagccuccuaagucuaacccuggccccaucaccggguaacgcuggcagcaacucccugguguccugggccucaggguucuaguuagcgccacacuggcuccuuccaggccacggcccauggauccaggacacuaggggcuccaacaccuuuggccugcccagagaaguucccuccuuuaccuccuccucaaaccaaagaugccaaaauguguacaucacauccuucaugcacagagcagagaauauuugcccagaagaggcaugacaggaggacaagagggaacucacuggccacaugccguguacugaaugucuguuguugaaauucucacccccaagaugaugguauuagguguggggccucuaggaggugauuagguacagcccuugugagugggauuaguggccuuauaaaagaggccccugagagcugccucgaucuuuccacugagggaggacacagcaagaaggugcugccuaugaaccaggaaguggguccucaccagacgcugaaucugcaggccccuugaucuuggacuucccagccuccugaacugugagcaguaaacuucuguuguuuauaagccucccagugcauggugugcuguuauggcaagccaaauggacuaagacacacaugccaugucagcgucugcagugacaaaggugcucaggguaccucaccacuucucuaagaggguucucacagucucaaccccuccucagaagcuccugcccuacucacucuuggcucucccuucccuuucuucuccccacuccccagcauuuuuuuuucuuuugagacagaaucucacucuaacacccaggcuggagugcagcggugcagucucagcucacugcaaccucugccuccuggguucaagggauucucgugccucagucucccgaguagcugggacuacaggugcacgccaccacgcccaguugcgugauuuuuuuguuucuguguuuuuguauuuuuaguauagacuggguuucaccauguuggccaggcuggucuugaacuccuggccucaagugauccgccagacucagucucccaaagugcugggauuauaggugugagccaccaugccuggccuucuuuuccccuucuugauucuugcuuucucccuucuugauauauaaaaucaauaaagcugaaauacacaauuguuuaaaccuugcuggguaauuuuuugcacauaguuucucccccauuuaggaaccugagcugcaguuuccuucagggcagucuccgucuucccccuucauugaaaaaugucauugcuccgucaggccacagcgcagccaaccccugugacgugacaacuccuggauuccccuagacacuaguggagacccugggccagaagggguggcugcugaugggacagagacugugucuccaaaccccugaacugaggcauuaagucuaagaaguuugggggugauaacacagaauaacugaaacagaguuaguugugggagcuggggauguggguggccacaucuaaggggagugauggauaagggaagggaagaugggaagagcguuaggccggaugggguagcucuggacaccagguaacaacaguguggaacugaaggaaccuggaccucauuccguaauggagaaggagccaucagaaagucccagagggacaaagacccaccagcucgagguuaggaaggggagcucagagcaaaaagaagacaaaaauaaccccaacaguccacggaguccacacaaucccugucagaaucccagcuggcuucuuugcagaaacagacaagcugauuccaaaauucauauggggccaggcacgguagcucacgccuguaaugccagcacuuuuggaggccaaggcaagcagaucaucugaggucaggaguuugagaccagccuggcuaacauggugaaacccaguaaaauacaaauuuguaaaaauacaaauuuuuacaaaauuuuguaaaaauacaaaaauuagcugggugugggggcacgcaucugcauucucagcuacucgggaggcugaggcaggacaaucacuugaacccaggagguagugguugcagugagccgagauugcgccacugcacuccagccugagugacagugagacuccgucucaaaaaaaaaaaaaaaucacauggaaacacaugggacccagaauagccaugacaacccugacagagaagaaaaagauggaggaugcccauuuccugauuucaaaacuuuuacagggcugcaguaaucaagucagugauguaguggcaugaggagaggcagauaggucaaugggauagagcugaggguccaaaaauaaaugcacagcuauagucaacucauccuugacaaggaugcuagggccauucaacgggggaaagaagaggcucuucaacaaauggcacuggcccagcaugguggcucacaccuguaaucccaacacuuugagaggccagagugggaagaucccuagaggccagguguuugagaugagccugagcaauacagcgagacccugucucuuaacaaaaaaaaauuguuuuugaauuagcuagguguggcagugcacacccuguaguccuagcuacucaggaagcugaugcaggaggaucccuugagcccaggauuuugaggcugcagugaacuagaaucauaccacugcacuccagccucggcaacagagcgagacugucucuaaaaacaaauuuuuuaaaguaaaauaauaaaaacaauggugccaugacaacuagauguccacaugcaaaacaaugacauugcaucccugccuuaugcuauauacaaaaauuaacuagaaauggaucaaagaccuacauggaaaagcgaaaacuauaaaacucuuagaagaaaacacagggauacaucaugugaccugagauuugguaauggguucucagcuaugacaccaaaagcaacagcagcaaaaaaaggauaaaccagacuucaccaacauuaacaacuugugcuucaaaagacaccaucaagaauguggaaagacaauccagaguggacucucaguggaugcugagaagguauuugcaagucacauaucugacaaggacuucuaccuagaaaugauaaagaauucuucaaauucagcuauaggccaggcgcaguggcucccgccuguaaucccagcacuuugggaggccaaggugggaggaucaccugaggucaggaguuugagaccagccuggccaacauggugaaacccugucucuacuaaaaacacaaaaauuagcugugugugguggugcacaccuauaaucccagcuacuugggaggcuaaggcaggagaaucacuugaaccugggaggcggagguugcagugagcugagaucgcaccacugcacuccagccugggccacagagugagacucugucucaaaaaaaaaaaaaaaaaaaaaaaaaaucagcuauaaaaagaacccaauuaaccagguguaguggcacaugccuguaaucccagcuacucgggaagccgaggcacgaaaaucauuugaacccaggaggcggaggcugcagugagcugagauugcacccuugugcuccagccuaggcaacagagugagacuccgucucaaaaaaaaaaaaaaaugcaauuuaaaaaucggcaagaaaaaaauuuuuucaauauaaaagggcaaggaaucggaaugauuuuucuccaaugacuacauacaaauggcuaauaagcacauggaaagauacuugacgucgcuagggaagcaugagggacaugccaaugaaauccacaaugaggcagugcuccacacccaccacgacggcuagaaggaaaaacgggaaauggguaaguguuggugaggcugugcagagcuggcacccuaguacacugcuuaugggaauguaaaaugguacagccacuuugaaaaacagucuggcagcuccucaacaguuaccauguggcccagcaaauucacucccagguauacacuugagauaaaggcaaacagguguucacacaaaaacuugcagacaaauguuccuagcaacaauauuugcaaagccaaaacaucuaucaaugagggauggaugaguaaaauguggcccaucguggcuuggcaugguggcucaugccuguaaucccagcacucugggaggccgaggcaggcagauugcuuugaguccaggaguuugagaccaaccuggacaacacagugagaccuugucgcugcaaaaaaaaauuaaaaauuagccaagcaugguggugcaugccuguagucccagcuacucgagaagcugaggugggaggaucaccugagucugggaggcagaaguugcagugaaccaagguugugucacuguacuccagccugggcaauggagugagacacugccucuuaaaacaaaaaaugugcuccauccacacaauggaauauuauucugccauaaaaaggaauucaacgcuaauauaugcuacaauauggaugacccucaaaaacaugaugcugaguggaagaagccaggcacaaaaggucauguguuguaugauuccacugacaggaaauguccggaacuccagguaccugagauaaaugcaaacagguguucgcacgaaaaccugcagacaaauguuccuagcaacauuauucacaacagccaaaaagugggaaaacccaaauauuccccgaugggaggaacagaugaaggaaaugugccccauuguggcuggguacaaauccauacacacagaaaaaagaugaguaguugccaggggcuggagaaaggggagaaugggaaguaacugcuuaauggggaugagguuuccuuuuggguuaauggaaaguuagugucaaacucuuccacucacugaaagagaacaguuaacgaugaaucuuucagaaaguaaccuuccauuuacuguucagggcuagauguuuuuaugggccuacuggcgccuacgggagaaacaaucagguucuaacucgauagagugaugguuaaucaacacggugauuaugcgaaacaccacugaaauguacacuuuaauacagcacauuugacauuaauuacauagccauccuucagauugguauuaaaauuugcagaugcucaagugugacauaaaacgguucaguguuugcauauaaccuacacauguccccuacccuagcaccaccccauauuacuuauucauuuauuuuugaggcagggucucacucuguugcccaggguggagugcaguagugcaaucacagcucacuacugccuuaaacuccugggcucaagugauucucccaccucagccuccugaguaacugggacuacagacacaugccacuacacccggcuuuugcaaauauuuuuguagaaacagggucccacuguguugcccaggcuggucucaaacuccugggcucaagcgauccuccggccucggccucccaaagugcugggauuacaggugugagccacuacagccagccucguauacuuuaaaucaucucuagguuauuuauaauaccuaauauaauguaaaugcuauguaaauaguuaucauauuguauuguuucaucaauuuggauuauuuuuuauuuuuuuauuuuuuuaaucugugguugguuagauccaaagaugcagaacccuuggauacagagggccaacuugucucaauuuuagaaaaagagaagccaccgucuaugguuauaagcaacuuuaaaaacuuuagccuguaauuccagcacuuugggaggcugaggcaggcagaucacgaggucaggagauuaagaccauccuagccaacauggugaaaccccaucucuacuaaaauacaaaaaauuagccaggcaugguggugcgugccuguaaucccaacuacuugggaggcugagacaggggaaucgcuugaacccaggaggcggaaauugcagugagcugagaucgugccacugcacuccagccuggcaacagagcaagacuccauuuuuaaaaaaaaagaaaaaaaaaucuucacucucgccaggcuugguggcuuacaccuauaauccuaacacuuugagaagccaagacaggagaaucauuugagcucaagagucugagaccccaucucuauuuggaaaaauauauauauauauauuuuuaaaaacuucuucuucuccgagaaaacaccgaauggcggaugacaccggugcagcgggggguggggggggggggggugucagaggcccugggaugggcaaccacaguaacuuccacggagguuucagcaguggcaucuggggcuggggucgcggccguggacagcaccggagccgggaccaaggccacggagcuugcagaggcaaggccgaggauaaggaguggaugcccaucaccaagcugggccgccuggucaaggacaugaagaucaagucccuggaggagagcuaucucuucucccgcccaucaaggaaucugagaucauugacuuuugccuggggggcucucucaaggaugagguuuugaagauuaugccagugcagaaacagacccgcgccggccagugcaccagguucaaggcguuuguugcuaucggggacuacaauggccacaucggucuggguauuaagugcuccaaggaggcggccacugccauccgcagggccaucauacuggccaagcucuccauuguccccgugugcagaggcuacugggggaacaagaucagcaaaccccacauugucccuugcaaggugacaggccacugcaacucugugcugguguaacucauccccacgcccaggggcacuggcauugucucagcaccuguguccaagaagcugcucaugauggcuaguaucaaugacugcuacaccucagccaggggcugcacugccauccugggcaacuucgacaaggccaccuuugaugccaucucuaagaccuacagcuaccugacucccaaccucuggaaggagacuguauucaccaagucucccuaucaggaguucacugaccaccuugucaagaccuacaccagagucuccaugcagagcacccaggcuccagcuguggcuacaacauaggguuuuuauacaagaaaaauaaagugaauucagccugaaaaaaaaaaaaacaaaaacuucauucugcagcccccaagagcucauguuuccauccagggcagaccccugcccuuccccaccaccagccagggagggaaguuuuccugaacuacauuuagcacaaaguagauguaaccaaaacgaacgagacccuuaccugcaccucgcugguuuucugucugauugccucuuccuuuucucgaaugucuuguuccagugaauauuucucucugaauguuuaaaaauauuucaugaaaacaagagugaauaauaagccuccaccccuucccaaggccugauucuguucacccccacaaaagccccucugugugcuggcagaagucuaagaaugagacccagcgacugcucgcccuguacagucccuuccccgucaacuguagguaggaccugugaccaugggagggaucgcucccaauguaaccacccucuaaaagcagcgcgcuuucuccaccugguugcccaaguggaaguuagagaugucccaagugugauaaggacccagagcgcccuugcugacuuugaagguggaggggccacgugagggggaacaggggcaguguccaggagcauggaguggcccuggcugaccucagaaaggaaaaagagaccucggacccccagccgcagggaaauggauucugccaacaccugaaugagccuagaaacagauucuuccccuagagccuccaacaagagcccagcccagccgacgccuugaccucagccugugacacccuggacagcccaggacagccugucugaacuacuacuuuuuuuuuuuugagacagagucucgcucugucacccaggcuggagugcaguggcgcaaucucagcucacugcauccuccgccuccccaguucaagcgauucuccugccucagccucccuaguagcugggacuacaggcacgugccaccacgcccagcuaauuuuuguauuuucaguagagacgggguuucgcuguguuggccaggauagucuugaucuccugaccuagugauccgcccgccucagccucccaaaguacuggaauuauaggcgugagccaacacgccuggccuuuuuuugguuuuguuuuuuuuuuuuuuugagacaggcucuugcucugucacccaggcuggacugcaguggcacgaucauagcucacugcauccuugacuuccugggcucaagcaauccucccaccuuagccuccugaguagcuaggaccacaggugugccccaccaggccuggcuaauuuuuuauuuuuuguagccgaggucucaauauauggcccaggcuggucuggaccuccugggcucaaccgauccucuugccuuggccucccaaagcacuuggauuacagucaugagccacagcacccagccuucuuuuauuuuuaaacugagauagaauucgugcauguauuuccuagcacugcuguaacaaaucaccaacuggguggcuuggaacaggaaaaauugauuauaggugugagccacaaggcccaggguuuagugcccuuauaagaaggaccccagagagcuuccuuugcuccuuuugcccugugaggacacggcaagaaggugacucuccaggaaucagcaaauggguccucagcagacccgaucugccgguaucuggagguuggacuuugcagccuccagaacugugcgaaaugucugauguuucagucacccauucagagugguuuguuauagcaguaugaauggacuaagacccuccucuugugcccaaagaggcugccucagggacaggaacaccaugugucuaacagacccugccuccugcccagggacccaggacuugugcaacaauaaggcccucucagggacaugucgccagacacacaguaagugaucauuggaauauucauuuccacaagcccagaaacuuacaauacaaagugcucuuuaaacugaaggaccugacaugcccuugcuggcuuauggcagugugaaaucauaagaggaaagcucagcccacacuccccgaaucaagggccacucucagagccaccugcucaaggggccacugcaggccccagccuccuacagaugggcacucugcacacaccagccugucaccuccacauuggggaaacaaggcuucuggcugucugaggccacacuggggugauucacgccccagcgucccuuccuagacccugacccuugcacgacaggggcucccuccauccuuggccugcccgguccugauucucaggccugcccaggcucuaggaugcuggcccugcauccucaagacacccucagccuugucaggcugcacauccuugcugaucgccaguuuggauaacacggcccccaggagcugagacagaacaggaaccaucugcugcacugaacaugaagugggaugccugacucaggccguggcucagguuuucuaaccagccacccaccuugauccccuccaagaccuaaccugccuuugcucaucagggcucugcuaacagcacaaaaccaaggccagaggagcugauagaauacugcaccuguuaauaugacccccggggaucccccagcuaggaccaggauccauccucccugggaaagucaaagcccuuuccauuuucagccaaguaaacaaucucuuucccacagagggcaaagcaccuuugggcccuucugcauggugccccgucaucacaagaguccacccuguccuagaaucgacuggaaaaaagaugcuggcuggcacaguggcucacgccuguaaucccagcacuuugggaggccaaggccagaggaucacuugagcucaggaguucgagaccagccugggcaacauggcgaaaccccaucucuacaaaaaauauaaaaaaauuagccaggcaugguggcaugcaccuguacucucagcuuccugggagggugagugggaagaucacuugagcccaggaggcagaggcugcagugagcugagaucacaccacugcacuccagccuaggugacagaaugagacucugucucaaauuaaaaaaaaaaaaaaaaaaucuagccagcaugguggugcguccuagcuacucgggaggcugaggugggaggauugcuuaagccuaggaaacagaugcuacagugagccaugaucacaccacuacgcuccagcuugggugacagagcgagacccugucugaaaaacaaacaacaaaaaaggaugucauucuugaagaggauccagaggggaauacaggaagugacugcauuucuuuauaccagacucuaaaaguacagacagcccauccaaagcccucguuuacacaugaggaaacuaaggcacuaggcaagaaggggagccacagaccuggaggccccuucacaccuucagcugcuggguccuaagcccgcuccucgccaucugagacccaauugcccuagcugucaaggauaacaaggccuuccuagcacuggggaggggcugaugccuggggcuacugagcugcgaccugccugagaccacaaagcugccacaggcucugcccaugaccugccugggacaacacagcugccacaggcugugcccaugaccugccugggaccacacagcugccacgggcucugcccacgaccugccugggaccacacagcugccacaggcucugcccacgaccugccugggaccacacagcugccacccacaggcucuggucaagaccugccugagaccacacagaugcuacgggcucuggcugaggcugauucaaauggaagaugucauucuucaagccccuugagccaguuuaggaccucagaagcuguaucuuuuccuuccuucugaauaaaccugugaugagcaaacuuccaggugagccucugauauuuccgauaacaaccugggagaguucguguaacaucuggauguggagggaagggccguuuccaacauaccuuuguaacugggcaaucucuugacugaugucaucaagcuccuucacgccaguaaacuccccggagccgagagagccugaacuguccuagaauugaauucagaggcgagaucucuaauuagcaaccugacaucaccugacaggaggcaccagcaguucucgggcccagggauaaaauugucccuuuaguacacagggugagguagcaaaagugucagcccccugccuggggaaauaccugggcagccaagccacccucccgggggccccuguugaggaaggcagggaccacaggcagcacccgccaccgugggcucaugugugccaccagugccaccugguggcaggcggugggaagggaugucaauacccccagggcaugaccagcaccacucaccgggccgggcgugccucucuccgaaggcgggaccauguccggcgagaggacuugaggagggucgaugccuuuacugaccuucugcugaaugaaauacauagcuaacgcgaauuggucuuugcuuaacuuccccguuugccucguaucggccagggcccugggagaaacguggggaugcuaauuacacaucacaggcgccgacucagccugaacccaagucaccgaucccuugcuuuucaaaaacgacagcgacgaaaacaacggcagggcgugguggcaagccccagcuccuucccuacuucacaucuccuucccaggaaguggcccagggguuccccgcucccagugucccccacccuaggagggcugucagggcugaagaaccccaagccccugaccugggcugaggagccgacccccugggaaaaccucacuagggcugagaugcagcugccucuuccuuuggcuuaucucgugcguggggcaggcucugaugcugcaggcauggaguagaccagcccuuccguggaaaugggugcugagaccaagcauugucccuguagcucugggucaucugaauggccccggcuacuggccuucaauggggaugacagcagcacuuuggggugucaucaugaugaagaaagaaucagcaacgacucucuuuccuuguuaugaacggaacguuuauguccccccagauuccuauguccaaauccuaucccucaaugggaugguguugggagguggggccucugggaggugaugaggucaugaggguggagccucaggagugggauuagugcccuuauaaaagaggccccagaaggcucucucugcuccuuuugccaugugaggacacggcaagcagguggccgucuacaaacuaggcagugagcccucaccagacacuggaucugcuggugccuggaucacagacuuccaccccccagagccgugagaaaugucuguuucuaagccacucugucuauggcacuuugucacagcagcccaauggucuaaaacacuccucuugugcccaaaugaggcugccacaggggcauggccacaaugcacaggacagucccccacaacuaagcguccccugcccacauagcucuuggauguccugaaagaugggccaaggcagcaucugaauagcagcacacagugguccuguggagcugaggugagaggcuccgcgacacucacaaucaaggagccagccagggccgggugcaauggcucaugccuguguucucaacacuuugggagcugaggcgggcagaucaccugaggucaggaguucgagaccagcuuggccaacauggggaaaucccgccucuacuaaaaauacaaaaauuagccgggcaugguggcgcgcgccuguaaucccagcugcucaggaggcugaggcacgagaaucacuugaacccaggaggcagagguuucagugagccaagauugcgccaaugcgcuccagccugggcaacagugagucucugucucaaaaaaaaaaaauaaaaaaaugaggagccaaccaggaagggaagggacccuuguggaguaaggacaaggccuuuggcaucuaugaaaaaugucuuccuucacccaugcugcccucucaacgagggaccucguuucccaccucccguguagcugcggcagaagccauuacaacagaaguuuccccuuuuaccaaaagagagcugggaccguucuaacagacuuauuuauacccaaaugcaguccgugaacagagcugcggagaaugagcagaucucaaagaacauugcugauaaaugccuaguuauccccacaguucgaggcccugacgauuucauacugccacugucucuccccagucugccccugcgggccccagccugcucgugggcugcagcugccucuccacucccgccccuucucugcuccugccaucucucaaggagugugggcuccaaggcccaccuguggaagguucugagagaaagaaggagaagcaagcuuagggguggcucagucagcggccauccggcucugacaccacauccugcucugcugacccguacgguggcagccaucgcagggaaaaagccucugucuucaugcucccccuccucccagucccuccuggugugucaucuacauugggccaugccccgccccagccacucgcagacacaucuagacuucuuuucucaugguuauucaagagccugaucauccuuuccuuccccuuugcugcccgcauggaaugaccucugaguuccuucuuuugauccagguggauuagugauuuccugugucauuuccaugucauuacaucaugugucaauugcagcaugcauuauaaauuacuuucccucuacugaccccuagacaugacagucagggugucagggcgcuaaccaggaacuguauguguguugguuucagagucauaaaggggacacuguguuuuguugguuucuaaaagggacacuggaucugaggcagcugagacccacugucccuagccaguuggaggcggcuuggccauuugggugaugacucugcgacagcuaguucucaggcucccaccucacaguguggucaucugugaauuaccacuaaggacagucauuucccccaagccacuaaguaacauccugaauuucacugcucuacuuggagguauuugccucucgagaauuauccagcaauucuuuccuuuugauagcucccaagugaagccuucucuaaggccacaaggcucugagcaacaagcucaaaagugacuucagcccuggccaguggcaagaggagugccccagcccuaugaagucggcuguguccagcccugggggaaagagggguugaggccgacuccucgacugggcucugaggcacugacagggucuccuugugcucacccucccgccaggagccaaagcacuggccuuuccagagcagggccuccugcccccgcccucacccugccaggccacucugcuagaggcuccaaggcccugcugcccgcaccucccggaggcggcugugacaaaguccaggccuccuguuagagccagcaucacagccagcaagaauagggcccagcuguguaagcaaauggccugggagcacuuaagacggaccagaggcccuuccuacugaaagacagugaacugaccgucacggagcgcgggcuucgagccuuggcacgugcaccuugcucagccucugucaggccagggagaauaaaggacgccagacacagcggaagccugugacaggcuggagggggcccccugaccaccacccuccacagucuucacccacaggcccccuggagccacccacagccacaacugccaccuguccggccuuaccauaugugugcuagaagguucugggugaggcccgagugcaugaagaucuccuucaccuccuggccacucacguagccauccagguccaggucggucuucaggaauaucucaucaaaucgcaucuugucugccacgggcaccacccaguucacuguuggcugaaacaguuuuuggcaaaacaguuaaucuggaagcuuuuuaugacccccagacacaugcuuuuugaugauggggcgauuaaagcacuuccaugcacauuuggcaucaaacucuccucacuuccaugagccaagagggcagaugugauccuuguucuguaacuggcaaaacugaggcugagacagguugaggcuggcucugugaagcucacccagaugccagucugcaccucucuccaccccaucacccgcucuccuuguccauccacccugccacccagggugugagggaggcugugaucuucaggggauggguucaagcaugccaggaaagacccucccgagcacccacuuggaaggaccgucccuggagaaccggcccggccacaugccagccucccugguccucccacuccucagcccgcaaaggcugcccuacaggcagccaaaguguccugucccaggacucugaagaccacccuucuaugucccugccccacuccugagacaacaaagauacccccaaggugugaguacacacacgucacugacagguaacaaaugagacaccaccauccaagagggccaccacccacgaggccccaccaacauucaugcagccccaaccccaccagggcagauggagccacgagcccagugcagcucaaaguucacagcccuggggcugggucacccgcugcacgugcgaccccucucgccaccagcucacaguuaacuugagagaggcaaacgccaucaugggucaaccagggcccggucaccuccugguucagaggcauugaggccccucaggcacucaggggcaggccccuuccguggccuacuccaccugcauuaccgcgggccuucaauacacccaccacgccacaguucacggcaucuguguccugaacucuagacgugcuuuuccucuucccuuuuuuuuuaaauauuuacacaaaucacuccuuuuaaacaaucucauaauagcaaugagaauaaacaccugauugaauuaucuagaugaugagggaguggagagaaaaaggacaggcaaauguggcuggagggaucgauuguuccuucuccacgcagcaacuguacagaaaagccacuccacuccucaccuucaaugaacgccaugaugccugaaacugccacucaaagucauuccucucaguuaugaaaggauuucuuaggcugggugcaguggcucacaccuauaaucccagcacuuugggaggcugagguggguggaucaccugaggccaggaguuugagaccagauuggccaacauggugaaacccccucucuacuaaaaacacgaaaaauuagccagguguggugguaggcaccugugaucccagcuacucaggaggcugaggcaggagaauugcuugaaccugggaggcagaaguugcagggagcugagauugugccacugcacuccagccugggcgacagagcaagacuccgucucggggaaaaaaaaaggggggggggauuucucaaagaguucucacaguguugacaacccgaagauguccauaggauugaggagaagggacucauggucaagacugggaaacaaugguuaaacucguuuacucuucaugaacgagucuccugugauguccaaaucuaacaggcuccugauaccaacucagggaaaucagaaagcaagcuugggaaacaagggauaccaugugacccagaucagcuuaguucagggguuucacguagcaaguaugugugaugaaguacagcaaggacuugaucaaacaauuuaucaaaauccauggagcuaggccaggcacagugcucaugccuguaaucucagcacuuugggaggccaaggcaggaggaucccucaagcccaggaguucaagaccagccagcauaacacagcaagaccccaucucuacaaaauaaauaaauaaauaaaauuagcuaggugugguggcauccaccuauuccagcuacuagggaggcugagguggaaggaucacuugagcccaggagguugagauagcaaugagccgugauugcaccacugcacuccagccagggcagcagagcaagauccugucucuuauauauuuaaaaaaaaaaaaucuauggaucuaauucaaaugaugagaguucagauggcaagagcaaccugauuuuuacuuguggcauuguacuguguaaauuuugugagccuucucaagucugguggacguaaagaugccaauaaaggaauucuaaugagaaaugggcuugcugccuuuuaagucacggagcuacagcaagcuaaccucagaagccagggaucacaaagagguaacaggagucagacaagcugagcuguggcgggacacagaaacaagggggguucugugucccacgggucccaagaagaaauuacguaugaaauuauagcucugggaugacaagaguccuaauaauacuugcugggcaaacaaaaggaacucacugccugauuucuggagccucagaguauguuagcagcaagauucugaugccaaauugacuauaaacccaacacggggcagccuugccguggagcuggcucucccagugacagcugggcuuuaaggccggcucagcagccacaggucccaaaggaaggauaucagacccugguggcuggaaguggcuucacucaaaccuggcaugagggcaaaaucggguggcccuugggaggcccagacaagagcauugcuggccuggagaugaggaaguuggaguagggggagcauguggacuguaggcccccagaaaugcucguuuucaugacugugauccuaccaaugccgucgugggggcaggagcuauacccucccaccccaccccaccaggggccacugguaaaaucggucuagucagagggucuugagagaaccaccagaagaucacuagagagguggguuaugacgcugggugaccugugccuaccagugaguuuggccccacuagcuucguugccaguaaaguaccuccccuaaccugacuuucaaaacucuuggcaagagcucugcagacacaggcugggcacgguggcucacaccuguaaucccagcacuuugggaggccgaggcaggaggaucacuugagccaaggaguucaagaccagccugaguaacauaggggagaccauguugaaauaaugagauaaaugaauacuuuuuuuuuuugagauagaguuucgcucuuguugcccaggcuggagugcaguggcgcgcucucagcucacugcaaccuccgucucccagguucaagcaauucuccugccucagccucccgaguggcugggauuacaggugcgcaccaccacacccagcuaauuuuuuuguauuuuuaguagagacgggguuucaccauguuggccaggauggucuugaucuccuaaccuugagaucugcccaccucggccucccaaagugcugggauuacaggcgugagccaccgcaccuggccacaagcauuuuuuaaagacauuucaucacaagcuugaccguucugggguugcauguuaagaacucccgagaaacauccuacugugcucugagagggggcugugcccgcugagggcuccguaccuguguuugcuugaggcugugcuugggggacaggcucccugugcuguugaggcugcugacgcugccgugggacggcguggagcggaggcugucuuuugguggggggcuggcaggcaggacggggacggcgccagggaacacagucuucuuucucuuggagggugggaugagggacgggggcagggcggagggcacgggcuccuucuccagggcucgguacaccaagugcauggccugcaggugcaaacaacaauggcacugaaggggcaaggcuggggccgggaccaucaggagaaggcagagggcagcccuuugggggcugcagugacaggacacucugucaggacgcucccaagcugaccagagugaaaagaaaucauuccucaugaguuaucuuuuauguguaacuuuccaagacauguguugaauuauuccucgagacugaaaugcacacagaaagaauccaaucaagccagacuccauaugcaucccuucaccacucagggaggccaccagcuccagggcuggcaccuucccaguacuggauuuggaagucuaaagacaccagaagagagaccuguacuucaagacguucaggaguagucccagcuacuugggaggcugaggugggaggauugccugagcccaggagauggaggcugcagugagcugugaucgcgccacugcacuccagccugggugacagagcgagacucugucucuauaaaacaaaacaaaacaaaacaaaaaacaguggaacugaggaugcauccaugaggcaggccacagccauagaaauaaauuccuuguggaaggccaacuaauaaaagugcaaggaaugaugguuuugauuagcacaucaccauuuggcagccaccaucaucauaauuaaucuugccagauuaaggcgagacucaucagcgaugguggaacucucauggaagagucugagagucauggguguugaccguaucaaggcgugccccacaugagaugaacugagcacagagggaaaaagagcaacugcccacaggaacccacaaccuugacccaccuugacccagugaugaaugucaacauggcaguaagaagacauguugacaucacguucccccaggugggaggcccauguggggcgggugugaccuccgugggauuccugucucacaagagugcaugaccugggucaucaagaggaccuggcagccaggcccaggccuaggaacacuccauaacugcuggccugugcucuucaaaauguccacguugaaaccaggcaugguggcucaugccuguaaucucagcacuuuggaggccgagacgggcagaucaccugaggucaggaguucaagaccagccuggccaacagggagaaaccgcaucucuacuaaaaauucaaaaaaaaaauuagcuggcugugguggugggcaccuauaaucccaguuacuuggaagacugaggcaggagaaucgcuugaauccaggagguggaggaugcagugagcugagaucaugccacugcacaccagccuagaugacagagugagacucccucucaaaaacagaacaacgacaacaaaaaaacaaaaaguccacgucaagagacacgaagagcgauggaggaacuguucuagaucccaggaaacgaaagacaaaagacaacaggauguaacacacaggacuggguucucuuuagacacaaggaacauuuuugggacaacugauaaaaucugaguaauauccugggauuagauaauaauagacacgcucauacagaauauaagggguauauacaggauauaaugaaaacaucauaaaugcaaugcuaugaugugaauuuccugauuuugaaguggauaaugguuaugugugagagaaguccuuguuuuuaggaaauacgcacugaaguguuuguggaugaagaggcaucaugucugcaacuuaacccuaaaaugguucacaggaaaacuucgugcagcagugggaagggcgagagagugauggagggagggaggaagaagggaggagaaagauaaaacaaauguaggaaauuagugacacugggaaauuugacugaagaguuuucaaaagaauuuucugucggaggccaaggggggaggucgcuugaguugaguucgaggcugcagcaaggguguucacgucacugcacuggagcuggggugacagaacaagacucugucucaaaaacaaaaaauaauucucuguauuacagguugcguaucccuuauccaaaaugccugggaccacaggguuucaguucuggaguuuucugaauuucugaauguguguauuacacuuacugguucagcauuacuaauccaaaaauccaaaaucugaaauucuucaaugagcauuuccuuugagugucauguugaugcucaaaaaaugucagaucuugaagcauucugguuucagacuuucagauuaaggauacucaaccuauacugaaacuuuccuacauacaaagaacuaugucaagacaaacacuuaaaaaaugaaagaaggaaggcuggguguggugucucaugccuguaaucccagcacuuuaggaggcagaggcgggcagaucacuugaggccaggaacucaagaccagccuggccaauaugguaaaaccccaucucuaucaaaaauacaaaaaaauuaucuggcugugauggagugcaccuguaauuccagcuacuugggagacugaggcaugggaauugcuugaacccaggagguggaggcugcagugaaccaagauugcaccacugcacuccagccugggugacagagcaagacuccgugucaaaaaaaaagaaagaaagaaagaaagaaggcuaggugcaguggcucacgccuguaaucccagcacuuugggaggccaaggcggguggaucacuaggcaggagaucgagaccauccugaccaacauggugaaacccugucucuacuaaaaauacaaaaaugaggugggcauaguggcaggugccuguaaucccagcuacuugggaggcugaggcaagagaacugcuugaaccugggaggcggaggcugcagugaaccaagauuacaccacugcacuccagccugugugacagagcaagacuccguaucaaaaaaaaaaagaaagaaagaaagaaagaaggccaggcacaguggcucacgccuguaaucccagcacuuugggaggccgaggcggguggaucacaaggcaggagauggagaccauccuggccaagaucgggccacugaaugccagccuggcgauagagugagacuccaucuaaaaacaaaaaaaaaaagaaagaaagaaagaaaagggagggagggaaggaaggaaggaaggaaggaaggaaggagggagggagggagacagagagaggagagagggagagagggagggagggagggagggagagagagagagaaagaaagugaaagaaagaaaggaagaaagacagaaaagaaaggaaaagaaaggaaaaggaaaggaaaagaaaagaaaagaaaagaaaaaagaaaagaaaaaagagagaaagacaaacgaauccagcaaccccugcgcacugcacauuuccuuccugggcuggguggggaggaaacagcaggacuuaccacagcgaacucaucucgauccaagugcccauccuugucaaugucacugaggucccagaccugcaagggagagaccagcauggguaacugugggaggaaggacugggugagagugagaccaccugccggaacucagacucucagccguggcacucacugggcucaggagacggcagucaauauacauuucaggaccaguccgcgaguucucagaaaaaccaucaccugugaaguacugucaacuaccagaucuguggucugacaaucaucaugauuauaaucauauugauuauaagauuauaaguuuaaaggcuauacuuuaaacuuacccugaguuucuucuuuauugucuuacagagacaucuuagaaaagacagcuuugauugaguacagguguugcccuaaacacccacacucccuaugcucacuccugcaaaccccaccccucccuugcauucucagcugggcagggcugcgagcucaugucugagcaggucugugggucucgucuccacuccccagcaguggauggugagacaggugucaggccacucagugcgcugaagagaaggcaggcaggcguggguucuggagcgugccuaagacacgugcagaucucaagcaccaucacgcugccagcuuccugacccaugccagccuuccuggaugggcacacugccugccaggccaacgcugggcaggcugccaguccccggaucuaagcagaugcccguggcucuauccaugaugcuucaugugucagcaucaccucucuccagccaaucaccagggcuucaguccaugcagguuucucacaucugguccuccucuccaccucugcugcugcgcccgaggcucaggccucaccagcccacacagccaagagccuccagcuggccucccuaucccagucuugucccuauggcuaccacaggaacugcuccagaacacacaccugacccugccccacccugcuccucagccuggcagauggggcccugucaccuggcugcugcugagccccugacgguagcaggucccugcaccccaacccagccuccacagacuccacggggaccuccaccuacuuuaccagggauccaggacuccaacaggccuuucuggcuccacaguccucccucagcccagggcuuccccaccucagcacuacugccuguuagggcuggaucaugcucuggggugugggccaugccgugcacugcaggguggugagcagcauuccuggccuugacccaccagaugccagcagcacucgacccaggugugacaaccaaaaauguccccagacauugcccaauguccccugggggguggaaguguccagggggagcuguggcccuaacuggcaugccagacugccugaggccucugugccuucacucaaguugcccacaugcccagacuucuaccagagucccccucacccuggaggaugugaccaggggcaccucuucuagaaagucuuccccagcugcccugcuccccgugcucgagugggucaggggcccuccccuccaccacugcccucacugggccaaacugugauuaucagggaugcugugggggugucuaauggacagggcaggugaagagggcaggcucuagggacagcugcuccagaaugcacacuggacccugccccgcccuguccacaguaggaccucaucccuucuccacccuuccacaacugugcaaccaaggugacuucccaaccacccugaagaucugcuucgccaucugaaaaaugggugguggaggggugugagacacaguccuuaacaggagggcugcaagugcuggaugugugucuucacgcagagcacuagggcccggccugcccauacuaagcccucaguaaauaagucucagccucuuagcuauuacuuauuugacuucuuugacgguaucuaauuauccccaccuucccacugcccagcacaaggcaugguccacugcaggcucugaaaaaugcuuacugaaugacugaccagaugcacgaugugugagugccuggaugcacagauggaugacagcacggaugcaagugcgcacggaugaauguauaaauauggacacacggggacauggcagcauagacauaugggcacaaagacgcaugcacagauguggauaaauacauugcaugggcaugugcacacacagaugaauggaucauagggaugcggagggacaugggugcauagaugcauggauacaaagauguaugcauggccgggcacaguggcucacgacugucauccaucccagcacuuugggaguccaaggcaggcggaucaccugaggccaggaguucgagaccagccuggccaacauggugaaacccuaucucuacuaaaaauauaaaaauuagcugggcgugauggggugcacccguguucccagcuacuugggaggcugagacaggagaauugcucgaaccagggaggcggagguugcagugagccaagauggugccagugcacuccagccucggugacagcgagacuucaucucaaaaaaaaaaaacuuuuuuuuaauaaauaaauaaauaauacuuauauuuaugguuagauagaagguauacauucuuuuuuuuuuugagacagagucucacucugucacccaggcuggagugcagugguaugaucuuggcucacugcaaccucugccucccagauucaagcgauucuccugccucagcuucccgagucgcugggacuacaugagugugccaccaugcccagcuaauuuuuguauuuuuaguagagauggggcuucaccauguuggccaggauggucuugaucuuuugaucucgugaucugcccgccucggccucccaaagugcugggauuacaugcgugagccaccguaccgggccagaaggaauaaguucuaaaguucaacagcacaacaggggaacuauagcuaacaauaauuuaucauaucuuucagagucuuccagaagagaagauuugaauguucccaacacaaagaaaggaucaguguuugaggugauggauaugcuaauuacccugcugggaugauuacacauugugugcauguaucaaaccaccacguggaccccacacuacaacuauuauguaucaucaaaaauaaaaauaaugaaacgcaaaauaaagcaaaacacgguugacucuugaacaacaugguuuguugaacugugcaagcucacuuaugcuuguauuuuucuaaccaaacguggauacaaaauacaguagucgugggacgugaaacccgaauauacagagggccgacuuuuguaugugcaggacugauugcaggacuugaguaugcguacauuucgguguaugauaggggcccuggaaccaaucccccuaaguauaccaagggacaacuguacuuuuaguuaacagaaacaaauugaggcuuuuaaaauuaauuaauuuggccaggcacgguggcucacgcuuguaauccuugcacuuugggaggccgaggcagguggaucaccugaggucaggaguucaagacuagccugaccaacauggugaaaccccaucucuauuaaaaauacaaaaauuggcugggcaugguggcucacaccugcaaucccagcacuuugggaggccaaggcaggcggauaaugaggucaggagaucgagaccauccuggcugacauggugaaaccccaucucuacuaaaaauaugaaaaauuagccaggcgugguggcgggcgccuguagucccagcuacuugggaggcugaggcaggagaacggcgugaacccaggaggcggagcuugcagugagcagagauugcgccacuguacuccagccugggcaacagagcgagacucugucucaaauaaauaaauaaauaaauaaauacaaauacaaauacaaauacaaauacaaaaauuagccggcuguuguggugcaugccuguaaucccagcuacucgggaggcugaggcaggagaauugcuugaaccugggaggaaagguugcagugagcugagaucaugccacugcacuccagccugggugacagagcgagacucugucucacaaacaaaacaaaacaaaacaaaaaauuaauuauuauuauuauuuuuuuaaacagagucucaauccgguugcccuggcuggagugccauggcacgaucucagcuuauugcagccucgacuucccaggcucaggugugauucucccaccucaaccucuagaguagcugggacuacagucacgcaccaccacaccuggcuaguuuuuuguauuuuuuuuucaguagggaugggguuucaccauauugcccaagcuggacucaaacuccuggacucaaguaaucugcccgccccagccucccaaagugcugggauuacaggcaugagccgccacaccagccuaaauugaggguuuuuuuuguuuuuguuuuuguuuugagacagagucucgcucuguugcccuggcuggagugcaguggugcaaucucagcucacugcaaucuccaccuccuggguucaaacgauucuccugucucagccucccaagugucugggauuacaggcgaacaccaccacaccuggcuaauuuuuguauuuuuuuuuaguagagacaggguuucaccauguuggccaggcuguucucgaacuccugaccucaaguuauccacccaccucggccucccaaagugcugggauuacgggcgugagccaccgcaccaggcuaagacuuucuuuaaagagaaugcauaaaauuuuuccuaaauuugcagcagaguugaaaauacuuuuaccuugagcuuuaucagaagaaaaagaguaauuaauaguagaaaagagccaggagugguggugcucuugcagucccaguuacuccagaggcugaggugggaggauggcuucagccuggcaguucgagaccagccugggcaacacagugagaccccaucucuaaaaacucaaaaaaagaaauaaaaaagcccgggugugguggcucacgccuguaaucccagcacuuugggaggccgaggcgggugaaucugagauaggaguuugggaccagccuggccaacaugguaaaacaccaucucuacuauaaauacaaaaauuagcugggcgugguggcaugcaccuguaaucccagcuacuugggagguugaggcaugagaauugcuugaaccggggaggcagagguugcagugagccgagaucgugccacugcacuccagccuaggcaacagagcaagacuccaucucauaaauaaauaaauaaauaaauaaauaaauaaauagacacagacacacauucccacauucagcacaauggaaagggggaaagcccaaguuggggagcuuaagacugagcucuacuggucccaaagccccaggcagcaauuucacuucugaguccaccuccucaucugugaaguggaaggauucuggcaccuuccccagggacugggugaacacuguaagccacacccuaggaagcccugagccagcuggggcuggacccacaggagcgcugaugaaagccccugauggcacagggagaaaacagagcaagagccuuguaagcaccauggggaaagagaacaguggcgcccacacacagcagggacacugagugcagaagaaccaagcccguggcccacuuacccugcccaggacaucaagaggcagcuuugaguucaugaggacuggcuugacuuugucuccagagagcaaaccauugaugggcaagaggcuuucaaaaaucccaucaaauuuggccuuuucuuccaccuaguuggaaagaaauagcccgaguaaguaggagagcacaccugugugaauguccagaccgagcucugaccgaaagccaagugaaaauggccacggacccaucaucacccuuggcuaaaagcacaaaaugaucuuagaacagucuuggccccuugguuuccaaagugaacauauacccugaaggaaauaacguuauggcaaccucggaucugggagccaagguccucaggagggaggcccuggccccgggucuuguccuucguccuagcugcugccugaguguggcaggagucucccaugguggggcagugucuuugcagggagacaaagaucagucucaccugccuccaaggagcccacuuguaccagaaagacaaaagugugagcagauguuagugcuugagcaaauaauuaucaaaaucaacuuaaaguacaggaaguccucuuuuuuuuuuuuuuuuucuuuuuuugagacaaaaaucuugcucuguugcccaggcuggaguguaguggcacaaucucagcucacugcaacuuccgacucccagguucaagcaauucucgugccucagcacucguaccucccgaguagcugggaucacaggcaugcgccaccaggcccggcuaauuuuuguauuuuuuguagagaugguguuucaacaugauggccggguuggucuugaacuccuggccucaagugauccgccugccucggccucccaaagugcugggauuacaggugugagccaccaagcccagccacauacaggaagcccuccauuucuaaugguaaauaaauuaauacguaaauaggaauagcucuucaugaacagagggaagguacagcauuaggauggggagucacaguuccugcuguucugaaagacauagggcaggcagcccguaaaaggggccaugagugaggcaguggcuuccagucuguuccacccuccaaaggaaacuuaacauuccugaacuguacacuuagaaaugguuaagaugguaaauguuacaugaugugucuuucaaccacaauaaaaauuuuuuaauuuuuaaaagacaaaaaccaagacagagcccucagucacagagaugagaucaccggcagacaccgcaugcuuucacagcuguuggugcuaagaagcugagcgcugcaggucuuucucgggggccugggauccucuccuggccaucggacuugcugacucagugccuucagaagcccagaaauguucacaacggaaacaaacacuuggcacuucgggcuuguucuuucugacuguggcugugaauggaaugcagaaucucucucgaccacaguacaccccaauuacagcaucugguccugugcucccugacuccucucugcgagguccccaggccccucagucccagcucuuccagugaggccuggacauaaccccugguggaaaagagccaucacauuuuaaaguauaagaucucuuggcacuguuucccaugacaaaguagcucuuuuucaaaguccacacaaugcgcugggugacagggagaaacccuucaccacagugauugccacuggcaaagugcuugaugacagaggugacugcaugacuccucagucacaugacauaucuucauguccucucccugcacagauacccccacccagcccaugaccucuccaagaagggagcaaaccaaccguguaaacaugggacgaaagugcuugggaccuuuauuugagagcaagaguguuauucaugucaggauuuaagccacauaaacgugaggaaaugugacagucugaaagugaagggaaggugaggaggccugauguuacuuggagggaccaugcucacuuccuuuagaaggaauucuguacuuagaagacagcccucguuuuuuuucuucuuucuggacgcaguagcuuaucuuuccagccacaacauccucuguuuuaaaaauaacacuucaagugcugagagaggcuuuucacaaagcaaucagaacaucagggaggaaagaaugguaacaugcaaaguggcuggaaagaagcgagaaagcaagggacacauuuggggguccacgugcuugcaagcucucaccguuuccucuucuauucugaauaaccaacacaagcagcaaaaaccacagaaugugaccuaaagaugcaagauuuaaacugcagcccuuuaauaauccaacuccugacacuuaguuguccagguaggcaacucccaauuccagugaagggccacagccuuuguaaaagguguucauuagaagaggcguuucauccaagugcuguggccacucacacugagacagaagagcugacacaaucauccuauaaaauguucugaacaacaucaaacuagaacaauuccagaacaauucuagaacaacugcuggaacaauucuaucugaaggagagccaaggagggagcuauucccguucacuuacccucacagcccagugggccucugcagagggcggugugaccaucagagggcugcuggugucgugcugagaagagagagaaacauuccuuuguggcuggcacagaauuaaaucauagguggguggguuugcugaaaaggauacacguuucaaagugcuuucaaaaaagggaagacuucacaaaguuaaacacagaaucaccacaugacccagcaauuccacuccuacguauugacccaaaugaauuaaaaacggauguccaaacaaauccuuguacaugaaugcugguagcagcacuauucacaacagucaaaaggguggaaauaacccacauguccagagagaugaauggauaaagaugugguccauccaguaaauggaauauggaaacacugauccauucuacaacauggaugaacccugaaaacacgaugcugagagagaggccagacacaaaagaccauguuagagaauuccauugauaggaaauguccagaacaggcaaauccauugacagaaauaaaauuagugguugccagcgacugggagggggagacaaggagugauuacuuaauguggauggggucuccuugcggagggaugaaaaaguucuggagcuagacagagguaaugaagacacaacacuguaaaugcacuaaauaccacuaaauaguucacuuuaaaauuauuaauuuucuauuaugugaauuucaccacaauaaaaggggaaggcuagagaaaacauggaaauauacaugcacauacacacaugcacauacacacacacacacaucugguauuagaagaaugugaacuugaaggacuuggacacucacaaauuuaggcgguggcaugcucaaauucagauugcucaagguaacuucauggccacucugugcacaggccaccagucucagugcaacauagaaacccugcaaguccaaagaaagggaaggaguaaacagcauaucgccagugaggguagggggagcugucucuaacagcaggcuucagggaaagaggaugugcacuucaacaaugaaggccguccgugcaaaaaccccuuggagcguugggcugaacuggacucaccuuggggacaucgcuuaaaugaauacacuaaaauggacuuauccuggccaggugugguggcucaugucuguaauccuagcacuuugggagaccgaggcagguggaucaccugaggucaggaguucgagaccagccuggccaacauggcgaaaccucauuucuacuaaaaacauaaaaaucagccaggcgugguggcaggugccugaaaucccagcuacuugggaggcugaggcaggagaaucacuugaacccagaggguggaggcugcagugagccaagaucaugccacuucacuccaggcugggcaaaaagagcaaaacuccgucucaaaauaaauaaauaaaauaaaauaaaauggacuuauuccacugcaucuggaaaucuguaaaauuucagaugcauauauuuuccaaaaacuaugagcucccaacauuuaggaaauguuagguuguauaaagcaacaaaauuaaacaugguuaagguuacgaaugauggaccaaauaugugccgaauuuuuguuuguuuuagagauagggucucacucugucacccagagugcaguggcgcaaucacagcucacugcaaccucaaacucaugggcucaagcgauccuccugccucagccuccugaguagcugggaccacaggugugcaccacuaugcccagcuaaguuuuuauuuauuuuuuuagaggugggaucucacuauguugcccaggcuggucucaaauuccuguccuccugccuuagcuuccugaguagcuaggauuacagguaugagccacugcaccuggcuauguguugaauuuuuuuuaaagcagucguaaauacacacgguuggucagaaacucauaucugugguucaccacgauccccucggccucguugaauggaacauccccugcccacccccaguggccugacguggaccccaccuagacacgggaaggaaguugaacuaggcugucaggugccucccuccuaacccaggacccaccacacaaaggcucaguggacuugugagggaucacuuagcuuguuuuuuuucuguuuuuuuuuuuuuuuauuaacuggccuaagaacauggauacuuuuaaagcuauaaauacuguuaacaguuuuaaaagugucuucaaagagguaagugcuaggaucggccuuucucagccugcuguccucagaagcccuugcagaguguagaggaucauaagaggguuuugagaaaaggggaccuuucaucccugcaaggucugagaaaagagaaaaauuaauaaauaguaaagaaaaaaagaaaaaggaauuaaguaaguuuagaggaacugcauuaagcaaagucaaauuuauuuuccauaggaauucucagaacuuuuaacaugcagacaugaggccgggcacgguggcucaugccuauaaucccagcacuuagggaggccaagaugggaggauugcuugagcacaggaguuugagaccaaccugggcauagugagaccucgucucuacaaaaaaaauaauaaaaauuagccagguguggcagugugugccuguggccucagguacacgagaggcugaggcagaagaucacuugaacccagaagaucgaggcugcaguaagcagugaucgcaccacugcacuccagccugggcaacagagcgaggcucaaaaaauaaaaaauaaaaaaacaaaacaacaaacaugcagacaugcaccaugaaccucaaagaagggagguacaagugaagggggcuuccuggacagacuggaucacaagucauggcacagcacaaacaaggucccuucuaacaaaauggccaucuacgaccacuuaaaaucacuuauaaguacaggcugaguauuccucaucccaaaugcuugguaucagaagaguuucagauuucagauuuuuuuuuuuuuuuuuucagaugggguuuucacuguggaggcuaaggcaugagaaucuugugaauccagagggcagaggcugcagugagccaagaucaugucacugcacuccagccugggcaagaguuagacucugucuccaaaaaaaaaaaaaaaaaacucugauuaaggccuuuagucaaaguuacaccaaugucuacuuuguuacauuaauaacaccaauguggcugggcgugguggcucaugcccauaaucccagcaguuugggaggccgaggugggcagaucaccugaggucaggaguucgagaccagccuggccaagauagugaaacacuaucucuacuaaaaauacaaaaauuagccaggcaugaugguucucgccuguaaucccagcuacuccagaggcugaggcaggggaaucacuugauccugggagguggagguugcagugagccgagauugcaccacugcacuccagccugggcaacagagugagacuccaugucaaaaaaauaaaaaauaacaccaauguuauuuucuggcucugaucacugugcugugguuauguaagacaccaucacuggggagagcuggcaaaagauacacaggaacccuccaagcuauuugugcaacuuccacgagagacugguccaaaauaaaaagucuggacaacacuuuaaucacauguaagguuacaaaacauuaaaagaaaaauaaauaaauaaauaaauaaaagauacacuagccaugaaagauggcuccaaguguuuaaaagaccuuuauuucaaaaugaaaacuucccguguuaaguuugacagccgugcucaugccuaguaauacuugacaguggaggaauguggaaggagccguggaggucacccagccugggggcucugcccagccccuccauuugcucuguguacauguguauauaccuguuuguccaagaacccuuuaccuucuggaucggccaagucccauaucugcggaaacacaaaaaugcucauaagcaugacugccgaucacuguccacguguuaacaaaaaccagagccgccaccaccccaucacuggccuugcggggcaggagugacuguccccagguuguccugcagaugaagaagccaauucagagcaggugaaugaucugcccaggggcgcacagccagucagcggcagggcccagaggacauccaggugcacucagcucccaagccaaugguguuuaugacacccuucuucccccaacuaaaguccgcaaguggccaagcgcggugguucacgccuguaaucccagcacuuugggaggccaaggugggcgauucaccugaggucaggagugcgagaccagucuggcuaacacagugaaaccccgucccuacuaaaaauacaaaaaauuagccgggcgugguggcaggugccuguagccccagcuacucgggaggcugaggcaggagaauggcgugaacccagaagguggagcuugcagugagcugagaucacgcuacugcacuccagccugggcgacagagcgagacugucucaaaaaaaaaauuagccgggugugguagcaugugccuguaaucccagcuauucaagaggcugaggcaggagaaucacuugaacccgggaggaggagguugcagugagccgagaucgcgccgcugcauuccagccuaggcaacaagagcgaaacucugucucaaaaaaaaaaaaaaaaaaaaaaguccacaagcuaucaagaccccaaaaguacucggguuucuuaucugcuaccaaaguaguggugggggcugccaccugggcauuuggauccaccagcugcagccugagaggucugcagcgaccaggccacuacccaggaggccgggccccauggaaggaggccugcacaggcuggcccugaccugcggggggagcugugagggcagccacagaagagaaaucacuauucaucuucacauaccuucccaaggauaauguccgagaggccagacuucuuuagaaaaagcgcagcuucacucgcccccacccucccuguguaugccggaucgaccugaaaugggagaccaagaggcaaaauaacuuuucagcaaaugcagcagcaggugaaguggcacccgccacgcuaacuauccgcugacagugaacagaaaaggacaaaaggccgcucagccgggcuucuauucuguacugugcuuucagcucaggcaugcucuaguuccaucugaagagacaucagcuaaacuuaccugcuuguaauaagauucauacaacgaauuuccagugggaaucuguaaaugaaaccacagauauuggucaaaagugaacacaaccccuuggggaaaaaaaggguugcccccucaauuuugucaugaccaaaauauaugaugauaguuagagucaaaaugcaugcacuuuaaacauccucugaacacagaauucaguuuaucuucagacacagauauuauuaugcuuaccugauuuagaaaaaguaagcuuaauguucuuuaauaaauccugauucuagggcaaacaauauagucacucaggaaacagcagcagcagcccagugucaauuuccauucacugagcaaagggauuucagcuccuggagagcucagagggaaaggacacucuauccucugagauuguucucuggcuccggaaucagaaaagaaguuuccacgcauuaucauaaaucaccaggccugcaagcuuucgaccaguuucccuggccugggucugguucucaaccaucccauccauccuccuccagcuaccugagugcucagagacgcacacugaccagcccgcgcccggagagcgcuggccaguaacuguucccaccagggaaggaaggaagugcaguguccucagcuuggcacugaagauauuccauuucccgacaccucagagccccaagacaucgcuguuuggaggucacuuccccaucuagggucacgcagcuaaucggggccaccagaggccacaccuggauccagccuggcuggcggccaaguccagacacuucccgcuguguccugagcucugccagacgucucccagggaaggggagggacacccaggggagugugccaaccugguggggaauuaugcagucccugaaaugcuggcuguaaaaguuuacgugcguugguguuuuaguaagugaggugaaaaaagagcacacaaaccugccgcugauguaauaagcgauaaaagugaagaaugcacaaugacaccuaauuauacagaauggauguguaaacagcuaaagagaauagaacugggcagggaaaagaggacuaucuugggggcaggauuacaguguuuauccaacaaauucugggacugcuguuguacgauuucucacaaugaauaaaaccagggggacguagacuccuuccaguuauagucauuggauuugaaccaauacgcacccaccacuugcauauuguugugcuacaaagggucauuugaagcuaaaaauaaugcccaggccgggcgcaguggcucacgccuauaaucccaguacuuugugaggccaaggcaggcagaucaccugaggucaggaguucgagaccuggccaacaugacaaagcgagacaccaucucuacaacaaauacaaaaauuagccaggcgugguggcaugcaccuguaaucccagcuacuugggaggcugaggcaggagaaucgcuugaacccaggaggcggagguugcagugagccgagaucguaccacugcacuccagccugggugacaagagugaaacucugucucaaaaauaaaaagaaaaaaauaauaaugcccggauuauggucagcgucucugggggacgccaacaccugugaauguauaaagaagugaaaguuguaaucccaaacagcacuuugggaggccgaggcaggcagaucacgaggucaggagcucaagaucagucuggccaacauagugaaaccccgucucuacuaaaaauacagaaaauuagucaggugugguggugugcgccuguaaucccagcuacucaggaggcugagacaggagaauugcauuaauccgggaggcagagauugcagugagccgagaucgcgccacugcacuccagcccaggcgacggugcgagacuccgucucaaaaaaaaaaaaaaaaaaaagaagugaaaguacagagaaaacuaccaugacaaaaugaaaauagaaggaaaauagcauaaagaucugaaaggggagagggaaaaagucaaaaaaaaaaaaaagaggaaaagaaagggggaaacacugaaaaggcagaaaaaacuagaauaacaugaaaaagcaagaaaagccagagauuuaggagccaucauuuuaaaacagacaaagacaucauggaaaagacauaggagguaaguguguauagcaacagcagccccaagauggcugccccccucgugcuuggaggcagugacaccauuccugggugagggguacaggaaggaguggcuaucacccuuagcaucuuacaaccucguuagaugacaguguccagccaucacaccugugucaacuucugggcucaaacuccagcuuauuuccaaaauaugucuccccagaggaagaagacccacagaaaggaggccaaggcaggcaggcuguuugucaucugucaguaaaggugacaguggucaggucuaggcagcaaacagcacaucgccugccauggguucacagacuccagaggcccucacuucagaugacaaaggugcccuuccugccaaugaucagagaggucuggaucugaagcacauuuccagacaaguuuuuuuuuuuuuuuuugagacagggucuuguucugucacccaagcuggagagcaguggcgcaaucucagcucauugcaaucucugacuccuggauucaagccauucuccuaccucagccucccgaguagcugggacuacaggugcgugccaccaugcccacuuaauuucuguauuuucaguagaagcgagguuucaccauauuggccaggcugguccugaccucaggugauccgccugcuuuggccucccaaagugcugggauuacaggcaugagccaccacgcccagccccaggcgaguuuuuuaacaaucucaugggaagcaagggaaagagguuuccaagcuacugugauuccaguggaaaaaaaagaguuucagucuuugaggcaugcaggguuauuaaauaucugcucuacuucccaggcgcuaaugagcaacaagauccgcaaccaagagaaacaaggccuggacuaauccagaagagucgcugaaggacacagcccagagcuccaaccucugcccauccaugcuaaaggcucauccggcucgaacacuugaugaccaccggaugucacucucaaaagaccuacagcugagggaaagcccagggaguauggcucaaccauugcucaucaccacgggaguccaucuggguaaccuggaacaaugacaguggucagagguuuugaucuaauuacacauaugucagguuuugcauaugcaaaagcagaagggggaagaaagaagguacagcaccaggccccaacugccacuuccucuuaugccaggcuucuucccaggaacaauggacucacaccugcacgcugcccugauaugucauugcgacagaacugaagacacauguugcuaaugacauaaauccccagccccaggcagucugucacuggccccugugcagagaccucuuggcccccaaaaggaagauucacagcuacugggaaagagcccucuguaugcugagagcagccucuggagcugcccacccaugucugaccccaaagugagccuggggccaagcccgaggcaacagcagagaggggacgcaccaggggaugaggccugcaccguaagaggcugcagguggcaccaggauggccguaggaauggaaggaagugcagcagagcugacccgauguguucuccugacccagcccacugugcugagaagacgccaucuucgccucugcagugugugaauuguugaugagguucaguguagcuuucagcucggucuuucaguugcucuuccuaacucaaaaugcuaagagacaacaugcaaaguuccuguggccuccucacuuauccuccagcccagaaacaauuuacaagugggaugacagagagaggggcacaaggagaaggacaaguucacauccuucugcucugaaggcuuuaaaacaccgcaauucacacaagcgccuguaacuguaacccaggacaacagcaguugagauggagaaacccagcagaaccaccucggaggagaaacugucucaggauuguguucuaacgacuccuaagcaggguucacccaacucugauccccgcacguggccgagggcaggacgccuccuacaucuucaugccuggcugccuccugcccaaacucucacucucacucugcuagcaaaguacgcgcucuugugcaaaacaaaccaaugaucaucagccuugguucaaaaugacuuuuggaaagcaauccauuuucacuguaaaauguucagagaaguaccuauaaucccuuguuuccuauccaguaccucucauccucccgacaacgcuaaagggcagguaauauuacuaguccaguugacagguggggaaacugaguuugcccuacucaggaccacaacagccaaugagcaacagucagugaagcacccaggauaggugguccuggagucagacccucaccuacugugcacccuguaaugacagcccaggugucacagggcugugcaccggaccacaggacagccucaugcauaugcuggccugggaaaaugcacguccgugaugacgugcuggagcauuuuauuaaacagaagaggucaaaaggcaacacucaauuugagcauauaaauggacuugaaagccaguguuuucgaugaccugccauuuccccaggaaagcugagaccccauaauggcuauguuuuucaaugccacugccaaguuuugcaggaaguuaggcauauaacacugaaacacaucucagucugaguuccuacuuagaaaaacauauggaugcaaaaacauagcccggaguagagcuugcuugauaauccuuccauuucugccuuccccuuagaggcccccacaggccuugcacaaccaucacccaaugugagcccagcccucccagcaggccggcccacauucugcgggugagauaaccuggcucagucauguggcaagcacggggcagaacugggacuugacucaaaacauucaaaaggcaucagggaaacgcugggguaugucuaaccuuccuggacuggaugggcagcucucuccaacugcuccaucagagguuucuacagcagagcuaagguaaauguuaccaagagaaggagaagacuuggcaagugaaaagagagcuuuuccaaaucacaaggaaaaagacaucucaauuaaaaaugagcaaagagagaggcaauucagaaagaagagaugcagcaaaguuagaaagaaaauguuccaucucacuaguaauuuaaguauuacagggccaggcacucuggcucacaccuguaaucccagcacuuagggaggccaaggugggugaaucaccugaggucaggaguucaagaccagccuggccaacaugaugaaaccccaucacuacuaaaaauacaaaaauuagccaggcaugguggcaggugccuguaaucccaguuacucaggaggcugaggcaggagaaucacuugaaccugggaggcggaggcugcagugagccgagaucauaccacugcacuccagccugagcgacagagcaagacuucaucuucggaaaaaaaaaaaaaggcagagaagcuaaaacaauucugaaaaagaauaauaaaguggaaagagucagucuaccugauuucaagacugacucuauagcuagaguaguuaagacaguggaguauuggcagggggcgggcacagacaguaaugcacagaacagaauguagaaucugagaaacagacacacacagaucugcccaguggauuucuugacaaaggugcaaaaguauuucaggaggaaggaaagccuuuccacaaagggcacuggagcaaucggcauccauaggaaaaacaugggccucgaacuaaaagucuuaugccucguacaaaauguaacucaaaguggaucaugaauucaaauguaaaacauaauccucaggaucuagggcaaagcaaagaguucuuagacuugacaccaaaagcccgauucacaaaaggaaagauuggcagacaaacuuuauguuugcacugugaaagagccauguaaggccuggcguggugguucaugccuguaaucccagcacuuugggaggccgaggcaggaggaucaccagaguuugggaguucaagaccagucugaccuacauggagaaaccccaucucuacuaaaaauguaaaauuagccaggcaugguggcgcaugccuguaaucccagcuacucgggaggcugaggcaggagaaucgcuugaacccgggagauggagguugaggugagccgagaucacaccauugcaccauugcacuccagccugggcaauaagagcaaaauuccguauuaaaaaaaaagggggggggagaaaggccgggcgcgguggcucacaccuguaaucccagcacauugggaggccaagguaggcggaucaccuggggucaggaguucaagaccagccuggcuaacauggcuaaaaauacaaaaaaauuagcuggguguaguggugugcaccuguaaucccagcuacccaggaggcuaagccaggagaacugcuugaacccagcgggcagaggcugcagugagccgagauugugccacugcacucuagccugggugacagagcaagacuccgucucaaaaaaaaaagccagauaaaaaggugaaaaggcaagcuacagacuagaaagaaagguuugcaaagcacauauccaacaaaugacuacuaucuaaaauauauacuagagagcucucaaauucaacagcauaaaaaagaaaacaaucaaauuagaacaugggcaagccaggcaugguggugcguaccuguagucccagcacuuugggaggccaaagcaggaggacugcuugagcccaggaguuccagaccagccugggcaacauagugagaccccaucucuacaugaaauuaaaaaacuagccaggcgucguggugcacaccuguagucccagcuacucaggaagccaaagcaggaggauugcuugaucccaggaguucaagaccagccugggcaacauaacaagaucugauuucuuaaaaaacaaacaaacaaacaaacaaacaaacaaaaaaacacgaagaagaaaagaacaugggcaaaagaucugaaggcaaaaagacauuuuaccaaagaggaaauauagcagauggcaaauaaacguaugaaaauauguuuaacaucauuagcaaaaagaagaaugcaaauuaaaaccacagugagaugccacugcacgcuaucagaguggcuaaaauaacaaauagugacaacaucaaaugcuggugaggaugcaggcaaacugggccacucauacacugcugaugggaaaguuaaaagguacggugacucuggaaacagacuggcaguuucuuaaaacaacaacaacaaaaaaaaacuaaacacaacaugaaacuaccgcaugaaccagcaacuguccugggcauuuacccgggagaaaugaagagucauguucauaccacauccuguaugcaguguuggccacagcuuuauaugucacugcuccaaacugguaacaccccggauguccuccaauaagugagugguucagcaaacugugguccaagcacaccauggaauacuacucagcaaugaaaaggaaugaacagcugacacauaugcaauaaucuggaugacucuccagagaauuaugcugaaugacaaaggccaaaccucaaagguuacauacugaauaauuccaucacauaacaucauuaaaaugauaaaauuguagaaaugaacagaguggugguugccggggauaaggaagagaugggcugggagggaaguggguguggcuauaaaagggcaacaggagggacguguucuguaccuggcuaucaacaagacccuaucucuacaaaaaaaaaaaaauagccacgcaugguggcacaugccuguggucccagcuacucaggaggcugaggcagaaggauuaccugagcccaggaguucaaggcugcagugagcuaugaucgugcuacugcacuccagccugggcaacagagcugucucuuaaaaaagaaaaaaaaagcuuucaaaccuugauuccgugcucugaugcccuccccaguccaugucauucaccuugcugcuuugcugaaugucuaaacucucaggggugguucuauugcuucucgguuccucuccagggcagggaacgcaugccuuaccccugugucaugccccacugcaggcccugaguucugucugggcuggacggaggccgugagccccaggcauguccaucuucuuuuuuuuuuuuuuuuuuuuugagacggagucucacuuuguugcccaggcuggagugcaauggugcgaucucggcucacugcaaccuccgccucccagguucaagugauucuccugccucagccucccaaguagcugggauuacagaugcaugccaacacaccuggcuaaauuuuuguauuuuuuaguagagacaggguuucaccauguuggccaggauggucucgcccuccugaccucaggugauccacccgccucagccucccaaagugcugggauuacaggcgugagccaccacgccuggccagggcauguccaacuucugcuggucucgcaagguggucauuuggguccccagagaauccaggacucuuccuucagaaccugaacauagccaucaucaucaauaucccagaugcaauacuguaccaccauuaugcaaauguugcuucagaggaaacuggauaaaugguacaggcucuuuuuuuuuugagacaagagucucgcucuguugcccaggcuggauggcaguggugcaaucuuggcucacuacaaccuccgccucccagguucaagcaauucuccugccucagccucccgaguagcugggauuacaggcacccaccaccgugcccggcuaguuuuuauacuuuuaguagagaccgggucucaccacguuggccaggcuggucuugaacuccugaccucaggugaucugccugccucggccucccaaagugcugggauuacaggcgugagccaccgcgcccgcccagacucuccaacaacugcaagugagucuaccaucaucucaaaaugagaaguuuuguuuuuucuuuaaagacuuaggaaaccuaaugaccaaaugcaaggugacauuugcagacaaucagggaaaugugaauauggucuuguuaucagauaauaccaauaccaaaggcguuauuauuaguuguguaaggugugauaaggcauugugguuauguaaaggaaaacggucuuaacuguuagaggugcauguugaaauacaauuucuuuuauuuauuuauuuuauuuuuuuuauuuuuuuugagauggaguuuugcucugucgcccaggcuggagugcaguggugagaucuccacucacugcaagcuccaccucccggguucacgccauucuccugccucagccucccaaguagcugagacuacaggugcccgccaccucacucgucuaauuuuuuguauuuuuuaguagagacaggguuucaccauguuagccaggauggucucgaucuccugaccucgugauccacccgccucggccugccagagugcugggauuacaggcgugagccaccgcgccuggccuacaauuucuaagauuaaaaaaaaacaggccaggcacgguggcucacaccuguaauccuagcacuuugggaggucgaggcaggcaguuaccugaggcugggaguucaagaccagccuggccaacauggugaaacccugucucuacuaaaaauacaaaaaaauuagcugggugcgguggcgugcaccuguaaucccaguuacucuggaggcugaggcaggagaaaugcuuaaacccaggaggcguagguugcagugagccaagaucacgccacugcacuccagccugggcuacagagugagacuucgucucaaaaaaaaaaaaccacacaacaggaggcugggugcaguggcucacgccugucaucccagcacuuugggaggcugagguggguagaucaccugaggucaggaguucuaaaccagccuggccaacauggugaaaccccaucucuacuaaaaauauaaaaauuagccaagcgugguggcaggcaccuggaaucccagcuacucaggaggcugcggcaggagaaucacuugaacccgggaggcagaguuugcagcgagcugagauuaugcuacugcacuccagccugggcaacaggagugaaauuccaucucgaaaaaaaaaaaaaaacacaagccagagccagguguaguggcacucgccuguagucccagcuacucgagaagcuaaggcaggaggauugccugaggccaggaauuccaggcugcagugagcuaugaucacugggccucugaauggcuacugcacuccggccugcacaacauagcaaaaugucaucugaaaaaaaaaaaaaaaaaaccuaagaacuaaaaauauacguaggugggggaaaagaucaaagggugguacaaagaaaucugcaaaauauugauaacuguuguaaaugggcaguggguacaugggaauucauuaaacccuucccucuacaucuauuuuauuuuuuuauuuuuuuauuuuuuuugagauggagucucgcucugucccccaagcuggagcgcaguggcacgaucuuggcucacugcaagcuccgccuccccgguucaugccauucuccugccucagccucccgaauagcuaggacuacaggugcccaccaccaugcccagcuaauuuuuuuguauuuuucuuaguagagacgggguuucaccguguuagucaggauggccucgaucuccugaccucaugaucugcccgccucggucucccaaagugcugggauuacaggugugagccaccgcgcccgggcuuuauuuuauuuuucauagagacagagacuugcucugucacccaggcuagaguacaguggugccaucauagcucacugcagccucaaccuccuggacuuaagggauccuccuuccuuagccuuccaaguagcugggucuauaagugcaugccaccacacccagcuaauuacuauuuuuuauuuuuuguagagacggggucuugcuuuguugcccaggccagucucuaacuccuggguucaaaagaucuucccaccggggccucccacggugcugggauuauaggugugagcaugcccagccaucaacuuuuaauguguuuaaaggccauuugggcugggcacaguggcucaugccuguaaucccaacacuuugggaggccgaggugggcggaucaugaggucaggagaucgagaccauccuggcuaacacggugaaaccccgucuccacuaaaaauacaaaaaauuagcccagcgugguggcaggcgccugcagucccagcuacucgggaggcugaagcaggagaauggcgugaacccgggaggcggaucuugcagugagccgacaucgagccacugcacuccagccugggcgacagagcgagacuccaucucaaaaaaaagaaaaaaaaaaugacuuaucggguacuauguucacuaccagggugacaggauccguauuccaaaccucagcaucaugcaauacucucauguaacaaauaugcacauguacucucuguaucuacaauaaaaaaagcugaaauccaagaaagaaaaaagaauuccuauaaaaaaaaaaaaaaggccauuugaugugcuucugccuuggcaaggacccuaauggcacaagcugcgucagguuuaagugugacaaaugaggagagcuuggugacaggaucgugcuucugugaaacaauacaaacuggcauuccuuuagaacacacacaagugugcccuaccauggcuacaaggucugcuccugggagacugagaagugaugcaggagugggggaaggguaagaggguucgcuguuuuccccccuugagggcacagaugcagacugcaaggcacuggaaacagcagaggacugguuaagcugcuaauaaauugcugagucuccaugggacagaauaaauaccuuacagccaucaaaacagcagaauguuuacaaaugggguccaaucuucaucagcuugcuaaaugagaagggggcaaucuagcaggugcagugugugaccuggcuuauaagcacacgguauccuaucgccccgcuacuggaaccuggcgggacagggccaugcuuaccaggauuucuacgggccagcuaguuugcuuccucauggcuuccuauguucccugguguacuaugucagcaugagcugcuuuuguaaauuagacagaaauagaaagaugugcaaggaaaagcaggaucugaaggaauuuucauggauucuccccagggacccaaaugagugccuugugagaccagcagaagacgaacaugcucggggcucaaggccuccauccaaaccagacagaacucagggccuacaguggggcauggcacagggguaaggccuacagucgcugcccuggagaggaaccaacaagcaagagaacugccccgagcauuuagacaugcagcaaagcagcaaggucaaugacauggaccaggaaggucgucagaacacagaaucaagguuugaaagcuuucuuuuuucuuuuuuuuuuuuuuaagagacagcucugggccaggcaugguggcucacaccuguaaccccagcacuuuugggggcuaagguggguggaucaccugaggucagcaguuugagaccagccuggccaacaugguaaaagccugucucuacuaaaaauauaaaauuagccaggugugguggcgcacaccuguaaucccagcuacuugggaggcugaggcaggagaauugcuugaacuagggaggcagaggcugcagugagccaggaucacaucauugcacuccagccugggcaacaagagcgaaacuccaucucaaaaaaaaaaagagagacagcucuguuguccaggcuggagugcaguggcacgaccauagcucacuguagccucaaauuccugggcuuaagugauccuccugccuuagccuccugaguaauugggaccauagccaugcaccaccauguguggcuaauuuuuuuuuucuuuuuuuuguaaagauugggggggucucauuauuuugccaggcuggucuugaacuccuggccucaagcaauccuccugccuuggccucccaaagugcugggauuacaggcaugagcaccaaacucagcauuccagaaacagaacugcuggagaaaaaacauugccugcagcaggcuuccugccucgaugcacugcccuguggaggaugcaggacuaugcugagcccuaaacgucuucaggagagacugcccagcuccaucuacaccuaugggcuguguucucccaucuugcuucacuaagagaagcugucucauguggaggucaacagugcugccagacaaauguggauuugaguccuguccugcugcuggaaugcugugcaacccuggggcaggacgagcagccucucugugccucagcuucugcaucuggagaugagggugagcacucccacccccggggacuugucaaucaccggcuguugugauuccugguauccuccucaucgcccuccuuccacuggcuccagguaaaaauguacccucuccccagaaacaucccuccaucucucuuccaccuccagcuacugaccuccccccacccuucgcauaaaaccuccugaaagccaggcgcaguggaucacaccuauaauuccagcaauaugggagaccaagacggguggaucaccugaggucaggaguucgagaccagccugaccaacauggagaaaucuugucucuacuaaaaauauaaaauuagcuaggcaugguggcacaggccuguaaucccagcuacucaggaggcugaggcagaagaaucauuugaacccaggaggcagagguugcagcgagccgagguugugccauugcacuccagccugggcaacaagaggaaaacccugucucaaacaaacaaacaaaaaacccuccugaaaaaggguccacccuuggauuccccagcucucccuucuuuggaccuggaaauuuauuuguuugcucacucaaucaacacaugcugaacucgugcuaagaggcagcacugaggauacaaaaguguguaggacagaguccugggcuucaggccaggcgugguggcucacgccuguaaucucagcacuuugggaagccaagguggguggaucacaugaggucaggaguucgagaccagccuggccaacauggugaaacucuaucucuacuaaacauauaaaaauuagcugggcgugguggcggguaccuguaaucucagcuacuugggaggcugaggcgggagaaccgcuugaacccaggaggcuagagguugcagugagccaagaugaugccauugcacuccagccugggugacaagagugaaacuccaucucaaaacaaaaacaaaaacaaaacaaacaaaaaauagaguccugggcuucaggaagggcaggcgggacaaagucagcccaggacuauggcacaggggaccgcaugauaugacugcagcaguaggcacagugaggggaacucagggcuuggggccaggugugcaccgggacagagaagacaggugagcugugggugauucagcacggccccagucagguggaagggcaugugcauaggaugccagggucugugcacgcugugcugaaaagacaggaugucauccccagggcaagcagaacauggggagggggugccugcaggccagcaaggugggcgcauaugcauaugagaugguaaacggcagaaauccgcugcaaggagcagggcuggaaggaagugaucagagagagacugccauggcccuccagcagcagaacuccagcagccuggggacugcagcgacucacaaugcagacacccggagaaggaggacaugccaguucccuaaaaacgaauguguuuccuugggauguccccaggggcauugagguggaaaucuaauugccauucuagacaccuuggugcagguguggaggugaacaacgggacauuccccacccacagccucauggagcugugacaaagcacagagacggcugccaagagcuagauggaagagacaggauggagggccaguccgcagccagcagcagacauacacccagggcaccaggagaccuggaaggcccccccuccauggcugagccuguccagggagacucagucaagcgaggcuguggagcacccgcaccaaagcagugccagagacaggcuugccacggggagggagggaggaggcuccaccacaggaaauaccagggcagcuggguccuggagggauggaggggcgggcguguagggaagggcucaagggucuugugcagccaugcagagggcagaagggauggaacuggaauggcgcccgggcaggaggggaacagauuccagcccucccuccugaaaacgcugcuuaagagcaaaagcagaugaagccucugagcagcccucccagcugcugaccuguguccccuggacaucaccccucccgggcaucucagagaacagaccuauucaguuccaucuguuuccuuccucugacccaugagcggucucccuggagagacaugggagagcagucacccaagacugggggggaggggggaacaccgagaggggcucaaugacucagcaguguguccuccgcagcaggaacacccaccgccucccacaagggcccacuucccagagucucccaacuuuccaaaguguaccccgggccuucccaacauuccuuuccugcaucagcuacuccugggcuccaaugucccugccaucuacuacucccuaacagagcacacugcccaggacucgguugggaugggucuggccuccugucgggguguuccugacagugggggguggcucccugccaaggacgccaagauccccugcacuggccaggucagugccaugccaccuuccuccucaucgcugugggugacagcgucagccuccuagugcacuguucuuuuucuggccccucuaaacaucaggcaccccucgaggcucccggaccccacagugagcagaaagaugguugcugccaccauggagcaucauagucagggcaucaaagccagugagcugacacacacaccaacacagaagagcaaaugcacagcaggggugacaaggacaaggacaggggcucuguccugaugggagggccgccccgcccccaccccgcuugccccauacaugccucuacagagccuggcccagccuccucacccacggcccugccuucacccgcuuccccacugcaccucgcacacagccacuccucugcucagaaaggcucuucaggguguguaacggaggcuaagguccaagcccugagcccaguccugaaagugcucccuggccaucuccuaccuugccgggcugauuucacuccacacacacacucacucacacacacucagccacacacacauacacacaaucacacauguacacucaggcucacccacauacacucacacucacauauaucacacucaagucucaccuccuucccccggcuggcagagcucuacugaacauaucgggcaccuuucacuccuugucuuggcacaagaugcagucaugcaucguuuaacuacagggaugcguccugagaguugcaucgucagguuaauuucaucgucgugaggacauccuggagugaacuuacacaaaccuagaaggcagcgccugcuccacgccugggcuguggucuagccuauuacucccaggcuacaaaccugggcagcguggcccgguacagaaaacugcaggcaacuguaacacaaugcuaaguagcugcguaucuaaacauaucuaaacauagcaaaggcacaggaaaaauacagcaguauaaucuuacgggagcacugucacauaugcaguccaucaugguuaugcggugcgugacugcauucccuaugcuuggggccgcugccugcugcaggccaacgcccugcucuaagaugacccuagguucccccaaaugaaauaagucccuccugccuccacacucccauagccccaaacuuugacaagggacacuuccugaaguugauuugauggaaaagcugcuguaaugaccggccccucucacuacauucuuaaugccuggaggguggagggaucacgcugugcccuccuagaagcaggccuucaguaaaugucuguugagggcaugggugagauuaaaguguugagggaggcagguggugggcugagugcaggaaggugcaguugguaguggggagcgggcagacauagcucuguggcucaguagcagugaggacaagccaccaagccacccugggccucaguguccccaucuguaaaaugagaauagacagcaccuggccugaggaugcugguaagucccaaaugagaauaugcaagugaaauacacucugcaaugggaagccauuauuacauccccuauuaugguuacucuuguauuauuauuccugagacaggggagcaggccguauuuacaaagaauggugggcggggagggaggucaggcaaggcugugaaucagcacgugaguugcagguguaaaaucacaguccuuauagccugcccugccaauugaucuuugccaagcaauaaaguauuucaacaaauguuggcuacacuaugguacauaugguagccauuugcucucucaacucaacagcuaagcagcucccaacaucuaggauagaacaauauuucaguuugggaaugguggcucaggccuguaaucccaacacuuuggagauuaaggcaggaggaucccuuaaggucaggaauucaagaccagccugggcaaaacagugagacccuagcccuacaaaaauuaaaaaucagaaaauuagcugggcgugguggugugcugaggagcaccugcagucccagcuacuaaggaggcugagacaggaggaugaacccaggagucugaggcugcagugagccgugauggcaccacugcacuccaaccugggcgacagagccugucucuaaaaauaaaaaaagaacaguguuucaccaauucucuuagucucagcugucauuuucuuaaaaaaaauacaauuuuacacacagcagauaaguacacaccuguaaaaacccacuuagugugaauuaaaggacauuuuaaaugugcauuaaaugugaauuaaaggacauuuucuaguggcuaagagucaacaacaacaaauuaaaucaauaaagucaacugacuauaaaugccaacucagaggcuggccuaaaagaaaaugccaacuccauggccuggugugagcaagcaaaauaacagcaacaauuugcacccuggugauggacaaccuugcccagcccaucagcaauuguggagccugcuccuccacuccagaagccucgacccacagagaaaguuuccaaagccagcacgggggugccgcgggcacagagcguucuaguucucagcaaagaaaaaacucaaagggaagaacguuugcaagaacaugcgccuaggccaaucgugucugggaccccccaaccacaaacagugccauuuguaggguguggggggaauugagggggacaguccauccccauaaccguacaguccugguuaaacacgcucagugugagggccucaucaucaaguuuuuucguguuucaucuuuccccuuuggagagugugaaaugagauaguuuucucuuccacuggaaaauauaaaauugaaaagcacguccucuucagauuaagaaaagccagcuggggccaggcgcgguggcucacgccuguaaucccagcacuuugggaggccgaggcgggcggaucaugaggucaggagaucgagaccauccuggcuaacacggugaaaccccgucucuacuaaaaauacaaaaauuagccgggcgugguggcaggcgccuguagucccagcuacucaggaggcugaggcaggagaauggcaugaacccgggagacggagcuugcagugagccgagauugcgccacugcacuccagccugggcgacagagcaagacuccgucucuuaaaaaaaaaaaaaaaaagaaagaaagaaaagccagcugggcauaguggcugacacaugcaaucccagcacuuucggaggccgaggcagguggaucgcuuugagcucaggaguucgaaacuggccuaggcaacauggagaaaccccaucucuacaaaaaauacaaaaauuggcagggugugguggcauacacguguggucccagcuacucggagggcugaggcuggaaaaucacuugaacccaagaggcaaagguugcggugagcugagaucgcgccacugcacuccagccugggucacagagugagacucugucucaaaaaaaagaaagaaagaaagaaagaaaagccaguuuucuacagauuggcguaaugacagaggcacacuuguugaugucacuuacacaagaggaaagcccuuuccucacccucugaugagcggaggugaggagguagcagggccccagcccugguggugcccugacugcugucaccggccagugggcucgagcaggcggcucugggcccugugccuguuucuucacccaagagacaaaacguucccuucugucaacuacccucaaagacagcuggagagacagacugcgcuccuggcugcuguuccaaguacccagccuccaaucaacagauaucaccagccuacuaugugccaggagcccagauuucaggggcugggaacccagcagggagcaggaaagacagagcuccucgacccucccggagcccaugguguggcaaucauaggacaaaaugguggcuuuggagcccauggucugauucagacgccuguucuccaugggggucugaccaguuguuuuaccucucucccucucaguuuccucaucuagaaacaagcacagggacaauggcaccauuguuggucccacaacauucccucacuccugcaucagaccugugccccaaaucucuccccagggcccagagcugccugccugggcccacucacuggugagggcagucaggguaccaccagggcuggggucccguugccaccuguucugggagaccagguuaccagaaucagggaagugggggggagggcaugguggcucacaccuguaaucccagcacuuuggggggccaagguggguggaucacuagaggccaggaguucgagaccagccuggccaacauggugaaacccugucucuacuaaaaauacaaaaauacaaaaaaauuagccaggcuugguggugugcaccuguaaucccagcuacuugggaggcugaggcagaauugcuugagcccagauggcggaagcugcagugagccaagaucaugccauuacacuccagccugggugacaaagcgggacuccaccucaagaaaaaauaaaguaaaacaaagaaucagggaagugggacucugagaaggcagagagggggccaggaagcugugaagaugguggugggagacagggccugugcaaagggugggggcaggacacugguccacgcaguguacagccagucagagaggcugcacccagcugcuuccuccaggccuguuggaacagaggagggaaaagacaaaaggaggcacaggcgcccucuuccuccuguccuuuauucccagcccaguggaggugauucaucccaccgcugugggugccaccugacuuccacgagugugucacacuauguccuaauuuucugugugccugggugcccagcugcaguugagcugaccuggaggguggggcucgguuuuauuuaucuuggucccaagacagcacacaguagcucagcagacagaaucucauggugccccagccccagagcuggucuucuuuuugacuguaccuaaauguggggucucacguggcuuggaggguuuccugcaaagugauggguuuugacucaacugacacagccacagcccaccaggcucugcccaccaggcacucccacugcugcuguccuggcucccugaagguggccucaaccugacgguugcagacacuaugccugcuucuucccccugcuuccucucccaccuagacccucaccuguccaaacagcuaccccacauauuccuuucacccccagcccuuucuacucuuccugaaacaaccucaggccagguuccucuugaucacuucaugcccauaucacagagacugucucggagcuagaacccagcuccaagcacucccuguguaagcagccagaucaucuaaaggugucacuccucaagaaccugccauagcucccuacugccucucauaauguggcccaugcuacucuucccucaacagaugauuguugagcaccugagugccagcugcagccuggcaaacaaggaugaauaaaacaggcacagucucugcccuuguggaccuagucuaggugguuggggaagacagaccaucaaucaaccccgcaaagagaaaauuauaaacggcuaaauggaaaagguguccaucuccaccagugguaacagagaugcugggccaguuugucaggaaaggcuucccugaggaagugaugccccagcugauaugaaaagguguagggauucaccagaggaugaaggguuuggaaagagcauuccagagagagggaauagcagaugcaaacgccuugaggcaagaugaaggaucgccugcgcagaugacagaaagaggggccagggggccacagagcagagggaaugaggacugcaggccugggaaacacggggagcaggugugcugucagcugccgguagcagcgccugauccagccuggcuggugugcccaagaggaggagaagugacuuuaugucagccugaccugcaggcagucaguaaacagauucuguuaucaggucuacauuccacaccacaggcagugcagauggaaauccgagacaaaugucuguggucaucugugaccuuuacuuucaccccaaagcuuguaguaucaagagcugggacuccuaugaagggaaaagcccaaagaagcuuuaagagcuaauggucugcacuccaugcaggagcaaacuucagggccaccacucugaccagcgguaaaacccaguccagcgcgaaggacagugggcaggucucagcuccucagcccccaccagccacuggccacucucucggcaagcagacauccugucaguucggccgauuuguagcccagacacaaacucucacgucuuauuuaccaaaagaccuuccuccucucaucccugagcugccuaaauuaaaggaaggacaugaaccccaaagucccagccgcauguuuuggcccuuugaccuagaccugcagccucucagcucuggcucaguccucuuugccuccgugugaaaggcuauuccccauggccuagaccagggguguccaaucuuuuggcuucccugggccacacuagaauugucuugggccacacauaaaauacacuaacacuaacacuaacacuaacacuaacacuaacacuaaugauagcugaugagcuuuaaaaaauucacgggugggcaugguggcucacgccuguaaucccagcacuuugggaggccaaggcgggcagaucacaaggucagaucgagaccauccugccuaaccagugaaaccccgucucuacuaaaaauacaaaaaauuagccaggugugguggcgggugccuguagucccagcuacgcaggaggcugaggcaguagaauggcaugaacccaggaggcggagcuugcagugagccgaaauugcaccacugcacuccagccugggcaacagagcgagacuuagucucaaaaaaaaaaaaaaaauucacaagaaaaccucauaauguuuuaggaaaguuuacaaauuuguguugggcugcauucaaagccauccugggccacaugcagccauggguuggacaagcuuggccuacaccaaacacgcccucuccuccauacaaccauguccaacacccaaauggaagccagucaucugccccuccugcagcuuggaccacccgugaccugagccucugcugugggccgggccuggacaacucaauucugcaugggccaggagcacugauuaccacucuggcagggaaaccuuuggauucuccuaaagacaacuggcugggagugguggcucacaccuguaaucucagcgcuuuggaggcagaggcaggaggaucacuugaggucaggaguucgaaaccagccugggcaacauagcaagauccugucucuacaaaaaaauuaaaaauuagccaggugugguguugcaugccuguagucucaguuccuugagaggcugaggugggaggcucacuugaggccaagagucgaggcugcaaugagcuuugauugcaccacuguacuccagcguaggcaauagagcaagagccugucucuaaaggaaaaaggaagacaauaagcaggccuuuccaugucccucucuaccuuuuaaugagaugagauuaaaguaauaaaauaaaaacucagacuacaugauaucuaauaacuagguauaaaaacaaaugagguuaggagaugucauaaacuuaaaaacaaacaaacaaaaaaauaacuuuccaagacaagaaacuauggugcaaugaagaggccugaaccugugucagaaaagccaugucugccugagcucacuggguacaaacuugggcaagggacguaacaaucucuggccucacuuuaucuauuuuuuuuuuuuuuuuuuuugagacagagucuugcucugucacccaggcuggaguacaguggugcaaucucggcucacugcaaccuccaccucucagguccaagcaauucuccugccucagccuccugaggagcugggacuacaggcaugugccaccacgccuggcuaauuuuuguauuuuaguagagacaggguuucagcauguuggccaggcuggucuugaacucucgaccuccagugaucugcccuuccuggccuccagugaucugccccucuugccccuauacacugaagauaauacuggccagagugaccgggaggaugaaccaggcaaucuaugauguuuucuuuacucaguccuuccagccugguggugagaccuuuccugaccuccaucaucagaucggaaccugcccugcucuacucaucucacagcaucaauccccaccgaaugcacuacacauugggcucauuucuuuauaucugggccccucccaacgaugucagccccgugaggcggcacugccuucagauucacuguuccauccacugcccagaaaguguccagcaaaaagaagaugccaaauaaauacucacugaacgaacagugugaucuacaaaaggcaggcaugagggccaggcgcggugccuccugccuguaaucccagcacuuugggaggcugaggcagacagaucacuugaggucaggaguucgagaccagccuaggcaacauagugaaacuccaucucuacuaaaaauacaaaaauuagcugggugugguagugggcgccuguaaucccagcuacucaggaggcugagacaggagaaucgcuugaauccaggaggcagagguugcagugagccaagacagcgccauugcacuccauccugggugacaagagugaaacucugucucaaaaaaaaaaaaaaaaggaaagcacugagagcacaugcgucacacggcaggguccugacacucuacugugacaaagcaggucaagcgaguccacaguaccauucugcagaugagaaaacuaagguacagaaaguauuugcaggacugagggcagugaaggaauaucugggaauccaaacaaacaucuaaggaccuaaacauugaaaagcaggcaccacugcaccugauggugccugcuuuucuuuucuuuuuuuuuuuuuugagacguagugucacuuuguugcccaggcuggagugugcaguggagugaucuuggcucacugcaaccuccgccuccuggguucaagugauucuccugccucagggucccgaguggccgggauuacaggcguccgccaggacgccaggcuaauguuuuguauuuuuaguagagaugagguuucaccauguuggccaggcuggucucaaacuccugaccucaggugauccaccugccucagccucccaaagugcuaggauuacaggcgucagccacugcacccggccuggaaaguuguuuuaaaguucagaauggagguggaggggucuugcccagggagaaucuauuuagucgaaaaaacaacaacaacaacaaaaacaaaaaaaaaacaggccagugcaggucaauaagugacagucagggaauucuggaucuuucaggaguggauuuuacucuaaaacuucguucucaucaauuuagacugcauugccauuagcauucuacuaagauagacuagcacuuauuucagaggaagaaaagaaacaagggacaagaggacaaguaaguguccgagccacucagcauucauuccagacacacuggccgggugcugcucugggagaggugcccagcaggccaucuggaacagcagggcucugcggcaggaggacgcaggugugaccucagcucugcgcccaccaacuaugagacuucagcaaguuacucuauuucugugggucuugguuuccucacuuguaaaaggggaauaaaagccuccuagaauggaggcaccuacugaaauacagcaaaagcuccuggaugaagaacacauaacaagggggaaaggaggaagguguagcucuuugggcccagggcagucucuccucaucacugagcccaguuaccacgcgcuuccuagguacagcggucacaaaagggacccacggaagguacaagggagagaacucucauucggguggggcuaagggaggacaacacaggggaggccucaaagaccguccuucagggcaggcagcauacggcaggagcucacagugauguucuagcaaccggagcaacacagcuaaggaugcugaggcuagaaaguguugccaagagccagaagugcaggaaagggacccagcaagguuagguggagucgauucagggcuuacuaaggucaucaaagcugacuuuuuuugagacugagucucacccuguugcccaggcuggggugcaguggcgcgaucucagcucacugcaaccuccgccgccugguuucaagcgauucuugugccucagccucccaaguugcugggauuauaggcguuugccacuaugccuggcuaacuuuuguauuuuuaguacagacaggguuuugcuauguuggccaggcuggucucgagcuccuggccucaagcaauccauccaccucagccuccuaaagugcugggauuauaggcaugagccacagcgcccagccauaaacugaguucuuuuggaggaaggggaaugggagcugugaaagguuuuuggaacaggggaauauguuuuagaagaugaauccuagccagaugcaguggcugacaccguaauuccaauacuuuaggaggcugagauagaaggauugcuugaggcuagggguuuaagaccugccuaggcagcauagcaagacuucaucucuucaaaaaaaaaauuguuuaauuagcuggguaugauuggugcugcgcuccuguagucccagcuacuugagaggccaaggugggagaauugcuugagcccaggaguuugagguugcagugagcuaugauccuaccacugcacuccagccugggggacagagcgagacccugucucaaaaaucaaaaagaugacuuccacaguggcgugggauuaagugggagggagugggcaaguaggaaguagaauggcccagaccacuuuggggcauggcaaggaaauggcccauuccagaguccagcaggcuggcagaggugcaggagagagacaccuucuggacucuagaaggcagguuugaaguccucugcacagaagcuccaggggagggagcgcacagagagauaagaugcagguagggaggcugaaauuaggggacaagaaggagagacugaaaggagagaggaugaagagugaagaccgacgggcuccaguguugcggaguucgaggaggaucggcugcagccacagggcaccgggguuaaggacggaggggccaccgguaaccucggggaguacaaggaggaaagagaucuggaugcauuuccacggaaggcuuuuuggaaagcagaagagagcugagcagggggacagggagacacacaaaucacugagaugcuguugggaaaaaaaaaucacuccuaaagaggcagaggugcagaccuuucgaauuuacguugauauucagggucagaaaagaguauauaaggaaggagauucugagaugaugucauggaguacagaacagacugaaaaagaugcugaugggaaaagugcagacaggaguggggguggagaaaacacaccccuccuccccuaggcuagcccgcuggguuauccacuuugcucaccuucaccuggccaucugcuugccaagugugcucugucaccuaaauccaaccagaucacagccaccugcugcagggugcuucccuuuugcccccaaccaaaaauuuuggaauuauacccuugguucccccagaguuaucugugaacccaagugaucuccugagcuagacaguaagggccugggagggccaugccucacaccugggccaacaguaacccaugguguagauuuucacucgagagcaaguguaaagaagugcugacauuuccaaacgaagaaaaccaggccacgccuucauucaacaaauguauagggaaaggaacaggaagaggcuaagaagucagugaccuggccaggcgcaguggcuaacgccuguaaucccagcacuuugggaggccaaggcggguggaucacucgaguucaggaguuugacacgagccucgccaaaauggugaaaccccgucuccacuaaaaaaaaaauacaaaaauuagccgggugugguagcacgugccuguagucccagcuacucaggaggcugaggcaggagaaucacuugaacucgggaggcggagguuacagugagcugagaucaugccacugcacuccacccugggugacagagcaauacuccaucucaaaaaaaaaaaaauuggacaggaaguuuuagaaagauccacgccucccaaacugggagugcuuagugcuuucucaugaaaugaucuuaggugauuuucccccgacucccgccuuccccgccccccacccccugacuacauacucuaaacuguagcacuuagcuauuaacaccuauuaucgguaggacacuuaacaguuuacagagcacuuucaugucaguaacaagaacuugcuaauuaauaaucaccggguuuuagcacuguuaacuuagugacaguguugcaaauuggcuagcugugcacuucucucuccuuggaucagcuaaccagucaugcaagcaugcaaccggccuaucaacucucuuuggguuuggaauucuuaauugcugcggucucuacucccaaacguccaaaucuggcagagauuaaaugaugacaguaauuauaggaucacugagugccucucauaugcuaggcacuguucuaagcgcuuuuucacgugcuuaauuuucacauaaucccaacacauuuuuauaucuccauuuuccaaaggaagcaacugauggguggaauggcuaagagcuucaaccaaaggcacagagaaaucggggcuggagccaagauuugaacacaugaucugacccuguguccucacucuuaaucaccaugcugugcuagaucauucuagcaaaaugcuuauauggugcuuugcacaacacagguauucagcaaauaaaggcagcugugauuagcauaacacagguaguuucuaguucccacgagugucaccuccaggaaagcagcgaccuugucugucuggaagaaugcagcgcucccagcaccugacccaacgcacauuugagggauggauagaaaaugaaugaaugaaagucucucccaaauaacagagcugccuacgcauggcucuuuuucgcaugucugugucgcgcuaucgauacugccccuucauaagcgcaucaggcgaauuugaggacacagagaggcgcccggagacguacgaucugcgcccggugcagggguggcggaagcagcuuccaaggaggcaggggaucagucugagaucgcacugcugcugacggguccgggcuccggcgggacccugcccgcccgggcgccgggaccggagggagacaaagacucgcugggccgccgcgccgacagaaacgcucgcaccccucgcccaccccuccgggaugcagcccagcgccuccgcggguccccggccugggagcuucagcggcggcaggguccgggcccugggcggagaggacacgcgcugcgcaccuccucgccucgccggugcccgcgagggucgcucgggcacgggaggccgcgggucccggccugucaccuucagggccgccugcccacccgcccgccgcaagcccuucagcacgcgccgcccccgccgccgccuggcugagucucccagcgccucagccucgccgcaccgcucgccucgcgccccgcaccccggcgccgcccccaggcccgcccggcccguaccugcugggagagggggaugagcggcgccgccaucuuccc

SEQ ID NO: 191900 - RNA, 110355 nt, Homo sapiens
gggaagauggcggcgccgcucaucccccucucccagcagguacgggccgggcgggccugggggcggcgccggggugcggggcgcgaggcgagcggugcggcgaggcugaggcgcugggagacucagccaggcggcggcgggggcggcgcgugcugaagggcuugcggcgggcgggugggcaggcggcccugaaggugacaggccgggacccgcggccucccgugcccgagcgacccucgcgggcaccggcgaggcgaggaggugcgcagcgcguguccucuccgcccagggcccggacccugccgccgcugaagcucccaggccggggacccgcggaggcgcugggcugcaucccggaggggugggcgaggggugcgagcguuucugucggcgcggcggcccagcgagucuuugucucccuccggucccggcgcccgggcgggcagggucccgccggagcccggacccgucagcagcagugcgaucucagacugauccccugccuccuuggaagcugcuuccgccaccccugcaccgggcgcagaucguacgucuccgggcgccucucuguguccucaaauucgccugaugcgcuuaugaaggggcaguaucgauagcgcgacacagacaugcgaaaaagagccaugcguaggcagcucuguuauuugggagagacuuucauucauucauuuucuauccaucccucaaaugugcguugggucaggugcugggagcgcugcauucuuccagacagacaaggucgcugcuuuccuggaggugacacucgugggaacuagaaacuaccuguguuaugcuaaucacagcugccuuuauuugcugaauaccuguguugugcaaagcaccauauaagcauuuugcuagaaugaucuagcacagcauggugauuaagagugaggacacagggucagaucauguguucaaaucuuggcuccagccccgauuucucugugccuuugguugaagcucuuagccauuccacccaucaguugcuuccuuuggaaaauggagauauaaaaauguguugggauuaugugaaaauuaagcacgugaaaaagcgcuuagaacagugccuagcauaugagaggcacucagugauccuauaauuacugucaucauuuaaucucugccagauuuggacguuugggaguagagaccgcagcaauuaagaauuccaaacccaaagagaguugauaggccgguugcaugcuugcaugacugguuagcugauccaaggagagagaagugcacagcuagccaauuugcaacacugucacuaaguuaacagugcuaaaacccggugauuauuaauuagcaaguucuuguuacugacaugaaagugcucuguaaacuguuaaguguccuaccgauaauagguguuaauagcuaagugcuacaguuuagaguauguagucaggggguggggggcggggaaggcgggagucgggggaaaaucaccuaagaucauuucaugagaaagcacuaagcacucccaguuugggaggcguggaucuuucuaaaacuuccuguccaauuuuuuuuuuuuugagauggaguauugcucugucacccaggguggagugcaguggcaugaucucagcucacuguaaccuccgccucccgaguucaagugauucuccugccucagccuccugaguagcugggacuacaggcacgugcuaccacacccggcuaauuuuuguauuuuuuuuuuaguggagacgggguuucaccauuuuggcgaggcucgugucaaacuccugaacucgagugauccacccgccuuggccucccaaagugcugggauuacaggcguuagccacugcgccuggccaggucacugacuucuuagccucuuccuguuccuuucccuauacauuuguugaaugaaggcguggccugguuuucuucguuuggaaaugucagcacuucuuuacacuugcucucgagugaaaaucuacaccauggguuacuguuggcccaggugugaggcauggcccucccaggcccuuacugucuagcucaggagaucacuuggguucacagauaacucugggggaaccaaggguauaauuccaaaauuuuugguugggggcaaaagggaagcacccugcagcagguggcugugaucugguuggauuuaggugacagagcacacuuggcaagcagauggccaggugaaggugagcaaaguggauaacccagcgggcuagccuaggggaggagggguguguuuucuccacccccacuccugucugcacuuuucccaucagcaucuuuuucagucuguucuguacuccaugacaucaucucagaaucuccuuccuuauauacucuuuucugacccugaauaucaacguaaauucgaaaggucugcaccucugccucuuuaggagugauuuuuuuuucccaacagcaucucagugauuugugugucucccugucccccugcucagcucucuucugcuuuccaaaaagccuuccguggaaaugcauccagaucucuuuccuccuuguacuccccgagguuaccgguggccccuccguccuuaaccccggugcccuguggcugcagccgauccuccucgaacuccgcaacacuggagcccgucggucuucacucuucauccucucuccuuucagucucuccuucuuguccccuaauuucagccucccuaccugcaucuuaucucucugugcgcucccuccccuggagcuucugugcagaggacuucaaaccugccuucuagaguccagaaggugucucucuccugcaccucugccagccugcuggacucuggaaugggccauuuccuugccaugccccaaaguggucugggccauucuacuuccuacuugcccacucccucccacuuaaucccacgccacuguggaagucaucuuuuugauuuuugagacagggucucgcucugucccccaggcuggagugcagugguaggaucauagcucacugcaaccucaaacuccugggcucaagcaauucucccaccuuggccucucaaguagcugggacuacaggagcgcagcaccaaucauacccagcuaauuaaacaauuuuuuuuuugaagagaugaagucuugcuaugcugccuaggcaggucuuaaaccccuagccucaagcaauccuucuaucucagccuccuaaaguauuggaauuacggugucagccacugcaucuggcuaggauucaucuucuaaaacauauuccccuguuccaaaaaccuuucacagcucccauuccccuuccuccaaaagaacucaguuuauggcugggcgcuguggcucaugccuauaaucccagcacuuuaggaggcugagguggauggauugcuugaggccaggagcucgagaccagccuggccaacauagcaaaacccugucuguacuaaaaauacaaaaguuagccaggcauaguggcaaacgccuauaaucccagcaacuugggaggcugaggcacaagaaucgcuugaaaccaggcggcggagguugcagugagcugagaucgcgccacugcaccccagccugggcaacagggugagacucagucucaaaaaaagucagcuuugaugaccuuaguaagcccugaaucgacuccaccuaaccuugcugggucccuuuccugcacuucuggcucuuggcaacacuuucuagccucagcauccuuagcuguguugcuccgguugcuagaacaucacugugagcuccugccguaugcugccugcccugaaggacggucuuugaggccuccccuguguuguccucccuuagccccacccgaaugagaguucucucccuuguaccuuccgugggucccuuuugugaccgcuguaccuaggaagcgcgugguaacugggcucagugaugaggagagacugcccugggcccaaagagcuacaccuuccuccuuucccccuuguuauguguucuucauccaggagcuuuugcuguauuucaguaggugccuccauucuaggaggcuuuuauuccccuuuuacaagugaggaaaccaagacccacagaaauagaguaacuugcugaagucucauaguuggugggcgcagagcugaggucacaccugcguccuccugccgcagagcccugcuguuccagauggccugcugggcaccucucccagagcagcacccggccagugugucuggaaugaaugcugaguggcucggacacuuacuuguccucuugucccuuguuucuuuucuuccucugaaauaagugcuagucuaucuuaguagaaugcuaauggcaaugcagucuaaauugaugagaacgaaguuuuagaguaaaauccacuccugaaagauccagaauucccugacugucacuuauugaccugcacuggccuguuuuuuuuuuguuuuuguuguuguuguuguuuuuucgacuaaauagauucucccugggcaagaccccuccaccuccauucugaacuuuaaaacaacuuuccaggccgggugcaguggcugacgccuguaauccuagcacuuugggaggcugaggcagguggaucaccugaggucaggaguuugagaccagccuggccaacauggugaaaccucaucucuacuaaaaauacaaaacauuagccuggcguccuggcggacgccuguaaucccggccacucgggacccugaggcaggagaaucacuugaacccaggaggcggagguugcagugagccaagaucacuccacugcacacuccagccugggcaacaaagugacacuacgucucaaaaaaaaaaaaaagaaaagaaaagcaggcaccaucaggugcaguggugccugcuuuucaauguuuagguccuuagauguuuguuuggauucccagauauuccuucacugcccucaguccugcaaauacuuucuguaccuuaguuuucucaucugcagaaugguacuguggacucgcuugaccugcuuugucacaguagagugucaggacccugccgugugacgcaugugcucucagugcuuuccuuuuuuuuuuuuuuuugagacagaguuucacucuugucacccaggauggagugcaauggcgcugucuuggcucacugcaaccucugccuccuggauucaagcgauucuccugucucagccuccugaguagcugggauuacaggcgcccacuaccacacccagcuaauuuuuguauuuuuaguagagauggaguuucacuauguugccuaggcuggucucgaacuccugaccucaagugaucugucugccucagccucccaaagugcugggauuacaggcaggaggcaccgcgccuggcccucaugccugccuuuuguagaucacacuguucguucagugaguauuuauuuggcaucuucuuuuugcuggacacuuucugggcaguggauggaacagugaaucugaaggcagugccgccucacggggcugacaucguugggaggggcccagauauaaagaaaugagcccaauguguagugcauucgguggggauugaugcugugagaugaguagagcagggcagguuccgaucugaugauggaggucaggaaaggucucaccaccaggcuggaaggacugaguaaagaaaacaucauagauugccugguucauccucccggucacucuggccaguauuaucuucaguguauaggggcaagaggggcagaucacuggaggccaggaagggcagaucacuggaggucgagaguucaagaccagccuggccaacaugcugaaacccugucucuacuaaaauacaaaaauuagccaggcgugguggcacaugccuguagucccagcuccucaggaggcugaggcaggagaauugcuuggaccugagagguggagguugcagugagccgagauugcaccacuguacuccagccugggugacagagcaagacucugucucaaaaaaaaaaaaaaaaaaaauagauaaagugaggccagagauuguuacgucccuugcccaaguuuguacccagugagcucaggcagacauggcuuuucugacacagguucaggccucuucauugcaccauaguuucuugucuuggaaaguuauuuuuuuguuuguuuguuuuuaaguuuaugacaucuccuaaccucauuuguuuuuauaccuaguuauuagauaucauguagucugaguuuuuauuuuauuacuuuaaucucaucucauuaaaagguagagagggacauggaaaggccugcuuauugucuuccuuuuuccuuuagagacaggcucuugcucuauugccuacgcuggaguacaguggugcaaucaaagcucauugcagccucgacucuuggccucaagugagccucccaccucagccucucaaggaacugagacuacaggcaugcaacaccacaccuggcuaauuuuuaauuuuuuuguagagacaggaucuugcuauguugcccaggcugguuucgaacuccugaccucaagugauccuccugccucugccuccaaagcgcugagauuacaggugugagccaccacucccagccaguugucuuuaggagaauccaaagguuucccugccagagugguaaucagugcuccuggcccaugcagaauugaguuguccaggcccggcccacagcagaggcucaggucacgggugguccaagcugcaggaggggcagaugacuggcuuccauuuggguguuggacaugguuguauggaggagagggcguguuugguguaggccaagcuuguccaacccauggcugcauguggcccaggauggcuuugaaugcagcccaacacaaauuuguaaacuuuccuaaaacauuaugagguuuucuugugaauuuuuuuuuuuuuuuugagacuaagucucgcucuguugcccaggcuggagugcaguggugcaauuucggcucacugcaagcuccgccuccuggguucaugccauucuacugccucagccuccugcguagcugggacuacaggcacccgccaccacaccuggcuaauuuuuuguauuuuuaguagagacgggguuucacugguuaggcaggauggucucgaucugaccuugugaucugcccgccuuggccucccaaagugcugggauuacaggcgugagccaccaugcccacccgugaauuuuuuaaagcucaucagcuaucauuaguguuaguguuaguguuaguguuaguguuaguguuaguguauuuuauguguggcccaagacaauucuaguguggcccagggaagccaaaagauuggacaccccuggucuaggccauggggaauagccuuucacacggaggcaaagaggacugagccagagcugagaggcugcaggucuaggucaaagggccaaaacaugcggcugggacuuugggguucauguccuuccuuuaauuuaggcagcucagggaugagaggaggaaggucuuuugguaaauaagacgugagaguuugugucugggcuacaaaucggccgaacugacaggaugucugcuugccgagagaguggccaguggcuggugggggcugaggagcugagaccugcccacuguccuucgcgcuggacuggguuuuaccgcuggucagagugguggcccugaaguuugcuccugcauggagugcagaccauuagcucuuaaagcuucuuugggcuuuucccuucauaggagucccagcucuugauacuacaagcuuuggggugaaaguaaaggucacagaugaccacagacauuugucucggauuuccaucugcacugccugugguguggaauguagaccugauaacagaaucuguuuacugacugccugcaggucaggcugacauaaagucacuucuccuccucuugggcacaccagccaggcuggaucaggcgcugcuaccggcagcugacagcacaccugcuccccguguuucccaggccugcaguccucauucccucugcucuguggcccccuggccccucuuucugucaucugcgcaggcgauccuucaucuugccucaaggcguuugcaucugcuauucccucucucuggaaugcucuuuccaaacccuucauccucuggugaaucccuacaccuuuucauaucagcuggggcaucacuuccucagggaagccuuuccugacaaacuggcccagcaucucuguuaccacugguggagauggacaccuuuuccauuuagccguuuauaauuuucucuuugcgggguugauugauggucugucuuccccaaccaccuagacuagguccacaagggcagagacugugccuguuuuauucauccuuguuugccaggcugcagcuggcacucaggugcucaacaaucaucuguugagggaagaguagcaugggccacauuaugagaggcaguagggagcuauggcagguucuugaggagugacaccuuuagaugaucuggcugcuuacacagggagugcuuggagcuggguucuagcuccgagacagucucugugauaugggcaugaagugaucaagaggaaccuggccugagguuguuucaggaagaguagaaagggcugggggugaaaggaauaugugggguagcuguuuggacaggugagggucuaggugggagaggaagcagggggaagaagcaggcauagugucugcaaccgucagguugaggccaccuucagggagccaggacagcagcagugggagugccuggugggcagagccuggugggcuguggcugugucaguugagucaaaacccaucacuuugcaggaaacccuccaagccacgugagaccccacauuuagguacagucaaaaagaagaccagcucuggggcuggggcaccaugagauucugucugcugagcuacugugugcugucuugggaccaagauaaauaaaaccgagccccacccuccaggucagcucaacugcagcugggcacccaggcacacagaaaauuaggacauagugugacacacucguggaagucagguggcacccacagcggugggaugaaucaccuccacugggcugggaauaaaggacaggaggaagagggcgccugugccuccuuuugucuuuucccuccucuguuccaacaggccuggaggaagcagcugggugcagccucucugacuggcuguacacugcguggaccaguguccugcccccacccuuugcacaggcccugucucccaccaccaucuucacagcuuccuggcccccucucugccuucucagagucccacuucccugauucuuuguuuuacuuuauuuuuucuugagguggagucccgcuuugucacccaggcuggaguguaauggcaugaucuuggcucacugcagcuuccgccaucugggcucaagcaauucugccucagccucccaaguagcugggauuacaggugcacaccaccaagccuggcuaauuuuuuuguauuuuuguauuuuuaguagagacaggguuucaccauguuggccaggcuggucucgaacuccuggccucuagugauccacccaccuuggccccccaaagugcugggauuacaggugugagccaccaugcccucccccccacuucccugauucugguaaccuggucucccagaacagguggcaacgggaccccagcccuggugguacccugacugcccucaccagugagugggcccaggcaggcagcucugggcccuggggagagauuuggggcacaggucugaugcaggagugagggaauguugugggaccaacaauggugccauugucccugugcuuguuucuagaugaggaaacugagagggagagagguaaaacaacuggucagacccccauggagaacaggcgucugaaucagaccaugggcuccaaagccaccauuuuguccuaugauugccacaccaugggcuccgggagggucgaggagcucugucuuuccugcucccugcuggguucccagccccugaaaucugggcuccuggcacauaguaggcuggugauaucuguugauuggaggcuggguacuuggaacagcagccaggagcgcagucugucucuccagcugucuuugaggguaguugacagaagggaacguuuugucucuugggugaagaaacaggcacagggcccagagccgccugcucgagcccacuggccggugacagcagucagggcaccaccagggcuggggcccugcuaccuccucaccuccgcucaucagagggugaggaaagggcuuuccucuuguguaagugacaucaacaagugugccucugucauuacgccaaucuguagaaaacuggcuuuucuuucuuucuuucuuucuuuuuuuugagacagagucucacucugugacccaggcuggagugcaguggcgcgaucucagcucaccgcaaccuuugccucuuggguucaagugauuuuccagccucagcccuccgaguagcugggaccacacguguaugccaccacacccugccaauuuuuguauuuuuuguagagaugggguuucuccauguugccuaggccaguuucgaacuccugagcucaaagcgauccaccugccucggccuccgaaagugcugggauugcaugugucagccacuaugcccagcuggcuuuucuuucuuucuuuuuuuuuuuuuuuuuaagagacggagucuugcucugucgcccaggcuggagugcaguggcgcaaucucggcucacugcaagcuccgucucccggguucaugccauucuccugccucagccuccugaguagcugggacuacaggcgccugccaccacgcccggcuaauuuuuguauuuuuaguagagacgggguuucaccguguuagccaggauggucucgaucuccugaccucaugauccgcccgccucggccucccaaagugcugggauuacaggcgugagccaccgcgccuggccccagcuggcuuuucuuaaucugaagaggacgugcuuuucaauuuuauauuuuccaguggaagagaaaacuaucucauuucacacucuccaaaggggaaagaugaaacacgaaaaaacuugaugaugaggcccucacacugagcguguuuaaccaggacuguacgguuauggggauggacugucccccucaauuccccccacacccuacaaauggcacuguuugugguuggggggucccagacacgauuggccuaggcgcauguucuugcaaacguucuucccuuugaguuuuuucuuugcugagaacuagaacgcucugugcccgcggcacccccgugcuggcuuuggaaacuuucucugugggucgaggcuucuggaguggaggagcaggcuccacaauugcugaugggcugggcaagguuguccaucaccagggugcaaauuguugcuguuauuuugcuugcucacaccaggccauggaguuggcauuuucuuuuaggccagccucugaguuggcauuuauagucaguugacuuuauugauuuaauuuguuguuguugacucuuagccacuagaaaauguccuuuaauucacauuuaaugcacauuuaaaauguccuuuaauucacacuaaguggguuuuuacagguguguacuuaucugcuguguguaaaauuguauuuuuuuuaagaaaaugacagcugagacuaagagaauuggugaaacacuguucuuuuuuuauuuuuagagacaggcucugucgcccagguuggagugcaguggugccaucacggcucacugcagccucagacuccuggguucauccuccugucucagccuccuuaguagcugggacugcaggugcuccucagcacaccaccacgcccagcuaauuuucugauuuuuaauuuuuguagggcuagggucucacuguuuugcccaggcuggucuugaauuccugaccuuaagggauccuccugccuuaaucuccaaaguguugggauuacaggccugagccaccauucccaaacugaaauauuguucuauccuagauguugggagcugcuuagcuguugaguugagagagcaaauggcuaccauauguaccauaguguagccaacauuuguugaaauacuuuauugcuuggcaaagaucaauuggcagggcaggcuauaaggacugugauuuuacaccugcaacucacgugcugauucacagccuugccugaccucccuccccgcccaccauucuuuguaaauacggccugcuccccugucucaggaauaauaauacaagaguaaccauaauaggggauguaauaauggcuucccauugcagaguguauuucacuugcauauucucauuugggacuuaccagcauccucaggccaggugcugucuauucucauuuuacagauggggacacugaggcccaggguggcuugguggcuuguccucacugcuacugagccacagagcuaugucugcccgcuccccacuaccaacugcaccuuccugcacucagcccaccaccugccucccucaacacuuuaaucucacccaugcccucaacagacauuuacugaaggccugcuucuaggagggcacagcgugaucccuccacccuccaggcauuaagaauguagugagaggggccggucauuacagcagcuuuuccaucaaaucaacuucaggaagugucccuugucaaaguuuggggcuaugggaguguggaggcaggagggacuuauuucauuugggggaaccuagggucaucuuagagcagggcguuggccugcagcaggcagcggccccaagcauagggaaugcagucacgcaccgcauaaccaugauggacugcauaugugacagugcucccguaagauuauacugcuguauuuuuccugugccuuugcuauguuuagauauguuuagauacgcagcuacuuagcauuguguuacaguugccugcaguuuucuguaccgggccacgcugcccagguuuguagccugggaguaauaggcuagaccacagcccaggcguggagcaggcgcugccuucuagguuuguguaaguucacuccaggauguccucacgacgaugaaauuaaccugacgaugcaacucucaggacgcaucccuguaguuaaacgaugcaugacugcaucuugugccaagacaaggagugaaaggugcccgauauguucaguagagcucugccagccgggggaaggaggugagacuugagugugauauaugugagugugaguguaugugggugagccugaguguacaugugugauuguguguauguguguguggcugagugugugugagugaguguguguguggagugaaaucagcccggcaagguaggagauggccagggagcacuuucaggacugggcucagggcuuggaccuuagccuccguuacacacccugaagagccuuucugagcagaggaguggcugugugcgaggugcaguggggaagcgggugaaggcagggccgugggugaggaggcugggccaggcucuguagaggcauguauggggcaagcggggugggggcggggcggcccucccaucaggacagagccccuguccuuguccuugucaccccugcugugcauuugcucuucuguguuggugugugugucagcucacuggcuuugaugcccugacuaugaugcuccaugguggcagcaaccaucuuucugcucacugugggguccgggagccucgaggggugccugauguuuagaggggccagaaaaagaacagugcacuaggaggcugacgcugucacccacagcgaugaggaggaagguggcauggcacugaccuggccagugcaggggaucuuggcguccuuggcagggagccaccccccacugucaggaacaccccgacaggaggccagacccaucccaaccgaguccugggcagugugcucuguuagggaguaguagauggcagggacauuggagcccaggaguagcugaugcaggaaaggaauguugggaaggcccgggguacacuuuggaaaguugggagacucugggaagugggcccuugugggaggcgguggguguuccugcugcggaggacacacugcugagucauugagccccucucgguguuccccccucccccccagucuugggugacugcucucccaugucucuccagggagaccgcucaugggucagaggaaggaaacagauggaacugaauaggucuguucucugagaugcccgggaggggugauguccaggggacacaggucagcagcugggagggcugcucagaggcuucaucugcuuuugcucuuaagcagcguuuucaggagggagggcuggaaucuguuccccuccugcccgggcgccauuccaguuccaucccuucugcccucugcauggcugcacaagacccuugagcccuucccuacacgcccgccccuccaucccuccaggacccagcugcccugguauuuccugugguggagccuccucccucccuccccguggcaagccugucucuggcacugcuuuggugcgggugcuccacagccucgcuugacugagucucccuggacaggcucagccauggagggggggccuuccaggucuccuggugcccuggguguaugucugcugcuggcugcggacuggcccuccauccugucucuuccaucuagcucuuggcagccgucucugugcuuugucacagcuccaugaggcuguggguggggaaugucccguuguucaccuccacaccugcaccaaggugucuagaauggcaauuagauuuccaccucaaugccccuggggacaucccaaggaaacacauucguuuuuagggaacuggcauguccuccuucuccgggugucugcauugugagucgcugcaguccccaggcugcuggaguucugcugcuggagggccauggcagucucucucugaucacuuccuuccagcccugcuccuugcagcggauuucugccguuuaccaucucauaugcauaugcgcccaccuugcuggccugcaggcacccccuccccauguucugcuugcccuggggaugacauccugucuuuucagcacagcgugcacagacccuggcauccuaugcacaugcccuuccaccugacuggggccgugcugaaucacccacagcucaccugucuucucugucccggugcacaccuggccccaagcccugaguuccccucacugugccuacugcugcagucauaucaugcgguccccugugccauaguccugggcugacuuugucccgccugcccuuccugaagcccaggacucuauuuuuuguuuguuuuguuuuuguuuuuguuuugagauggaguuucacucuugucacccaggcuggagugcaauggcaucaucuuggcucacugcaaccucuagccuccuggguucaagcgguucucccgccucagccucccaaguagcugagauuacagguacccgccaccacgcccagcuaauuuuuauauguuuaguagagauagaguuucaccauguuggccaggcuggucucgaacuccugaccucaugugauccacccaccuuggcuucccaaagugcugagauuacaggcgugagccaccacgccuggccugaagcccaggacucuguccuacacacuuuuguauccucagugcugccucuuagcacgaguucagcauguguugauugagugagcaaacaaauaaauuuccagguccaaagaagggagagcuggggaauccaaggguggacccuuuuucaggaggguuuuuuguuuguuuguuugagacaggguuuuccucuuguugcccaggcuggagugcaauggcacaaccucggcucgcugcaaccucugccuccuggguucaaaugauucuucugccucagccuccugaguagcugggauuacaggccugugccaccaugccuagcuaauuuuauauuuuuaguagagacaagauuucuccauguuggucaggcuggucucgaacuccugaccucaggugauccacccgucuuggucucccauauugcuggaauuauaggugugauccacugcgccuggcuuucaggagguuuuaugcgaaggguggggggaggucaguagcuggagguggaagagagauggagggauguuucuggggagaggguacauuuuuaccuggagccaguggaaggagggcgaugaggaggauaccaggaaucacaacagccggugauugacaaguccccgggggugggagugcucacccucaucuccagaugcagaagcugaggcacagagaggcugcucguccugccccaggguugcacagcauuccagcagcaggacaggacucaaauccacauuugucuggcagcacuguugaccuccacaugagacagcuucucuuagugaagcaagaugggagaacacagcccauagguguagauggagcugggcagucucuccugaagacguuuagggcucagcauaguccugcauccuccacagggcagugcaucgaggcaggaagccugcugcaggcaauguuuuuucuccagcaguucuguuucuggaaugcugaguuuggugcucaugccuguaaucccagcacuuugggaggccaaggcaggaggauugcuugaggccaggaguucaagaccagccuggcaaaauaaugagacccccccaaucuuuacaaaaaaaagaaaaaaaaaauuagccacacaugguggugcauggcuauggucccaauuacucaggaggcuaaggcaggaggaucacuuaagcccaggaauuugaggcuacagugagcuauggucgugccacugcacuccagccuggacaacagagcugucucucuuuuuuuuuuugagauggaguuucgcucuuguugcccaggcuggagugcaaugaugugauccuggcucacugcagccucugccucccuaguucaagcaauucuccugccucagccucccaaguagcugggauuacaggugugcgccaccacaccuggcuaauuuuauauuuuuaguagagacaggcuuuuaccauguuggccaggcuggucucaaacugcugaccucaggugauccacccaccuuagcccccaaaagugcugggguuacaggugugagccaccaugccuggcccagagcugucucuuaaaaaaaaaaaaaagaaaaaagaaagcuuucaaaccuugauucuguguucugacgaccuuccugguccaugucauugaccuugcugcuuugcugcaugucuaaaugcucggggcaguucucuugcuuguugguuccucuccagggcagcgacuguaggccuuaccccugugccaugccccacuguaggcccugaguucugucugguuuggauggaggccuugagccccgagcauguucgucuucugcuggucucacaaggcacucauuugggucccuggggagaauccaugaaaauuccuucagauccugcuuuuccuugcacaucuuucuauuucugucuaauuuacaaaagcagcucaugcugacauaguacaccagggaacauaggaagccaugaggaagcaaacuagcuggcccguagaaauccugguaagcauggcccugucccgccagguuccaguagcggggcgauaggauaccgugugcuuauaagccaggucacacacugcaccugcuagauugcccccuucucauuuagcaagcugaugaagauuggaccccauuuguaaacauucugcuguuuugauggcuguaagguauuuauucugucccauggagacucagcaauuuauuagcagcuuaaccaguccucugcuguuuccagugccuugcagucugcaucugugcccucaaggggggaaaacagcgaacccucuuacccuucccccacuccugcaucacuucucagucucccaggagcagaccuuguagccaugguagggcacacuuguguguguucuaaaggaaugccaguuuguauuguuucacagaagcacgauccugucaccaagcucuccucauuugucacacuuaaaccugacgcagcuugugccauuaggguccuugccaaggcagaagcacaucaaauggccuuuuuuuuuuuuuuauaggaauucuuuuuucuuucuuggauuucagcuuuuuuuauuguagauacagagaguacaugugcauauuuguuacaugagaguauugcaugaugcugagguuuggaauacggauccugucacccugguagugaacauaguacccgauaagucauuuuuuuuuucuuuuuuuugagauggagucucgcucugucgcccaggcuggagugcaguggcucgaugucggcucacugcaagauccgccucccggguucacgccauucuccugcuucagccucccgaguagcugggacugcaggcgccugccaccacgcugggcuaauuuuuuguauuuuuaguggagacgggguuucaccguguuagccaggauggucucgaucuccugaccucaugauccgcccaccucggccucccaaaguguugggauuacaggcaugagccacugugcccagcccaaauggccuuuaaacacauuaaaaguugauggcugggcaugcucacaccuauaaucccagcaccgugggaggccccggugggaagaucuuuugaacccaggaguuagagacuggccugggcaacaaagcaagaccccgucucuacaaaaaauaaaaaauaguaauuagcugggugugguggcaugcacuuauagacccagcuacuuggaaggcuaaggaaggaggaucccuuaaguccaggagguugaggcugcagugagcuaugauggcaccacuguacucuagccugggugacagagcaagucucugucucuaugaaaaauaaaauaaagcccgggcgcgguggcucacaccuguaaucccagcacuuugggagaccgaggcgggcagaucaugaggucaggagaucgaggccauccugacuaacacggugaaaccccgucucuacuaagaaaaauacaaaaaaauuagcugggcaugguggugggcaccuguaguccuagcuauucgggaggcugaggcaggagaauggcaugaaccggggaggcggagcuugcagugagccaagaucgugccacugcgcuccagcuugggggacagagcgagacuccaucucaaaaaaaauaaaaaaauaaaaaaauaaaauagauguagagggaaggguuuaaugaauucccauguacccacugcccauuuacaacaguuaucaauauuuugcagauuucuuuguaccacccuuugaucuuuucccccaccuacguauauuuuuaguucuuagguuuuuuuuuuuuuuuuuucagaugacauuuugcuauguugugcaggccggagugcaguagccauucagaggcccagugaucauagcucacugcagccuggaauuccuggccucaggcaauccuccugccuuagcuucucgaguagcugggacuacaggcgagugccacuacaccuggcucuggcuuguguuuuuuuuuuuuuuucgagauggaauuucacuccuguugcccaggcuggagugcaguagcauaaucucagcucgcugcaaacucugccucccggguucaagugauucuccugccgcagccuccugaguagcugggauuccaggugccugccaccacgcuuggcuaauuuuuauauuuuuaguagagaugggguuucaccauguuggccaggcugguuuagaacuccugaccucaggugaucuacccaccucagccucccaaagugcugggaugacaggcgugagccacugcacccagccuccuguugugugguuuuuuuuuuuugagacgaagucucacucuguagcccaggcuggagugcaguggcgugaucuuggcucacugcaaccuacgccuccuggguuuaagcauuucuccugccucagccuccagaguaacugggauuacaggugcacgccaccgcacccagcuaauuuuuuuguauuuuuaguagagacaggguuucaccauguuggccaggcuggucuugaacucccagccucagguaacugccugccucgaccucccaaagugcuaggauuacaggugugagccaccgugccuggccuguuuuuuuuuaaucuuagaaauuguaggccaggcgcgguggcucacgccuguaaucccagcacucuggcaggccgaggcggguggaucacgaggucaggagaucgagaccauccuggcuaacauggugaaacccugucucuacuaaaaaauacaaaaaauuagacgagugagguggcgggcaccuguagucucagcuacuugggaggcugaggcaggagaauggcgugaacccgggagguggagcuugcagugaguggagaucucaccacugcacuccagccugggcgacagagcaaaacuccaucucaaaaaaaauaaaaaaaauaaaauaaauaaauaaaagaaauuguauuucaacaugcaccucuaacaguuaagaccguuuuccuuuacauaaccacaaugccuuaucacaccuuacacaacuaauaauaacgccuuugguauugguauuaucugauaacaagaccauauucacauuucccugauugucugcaaaugucaccuugcauuuggucauuagguuuccuaagucuuuaaagaaaaaacaaaacuucucauuuugagaugaugguagacucacuugcaguuguuggagagucugggcgggcgcgguggcucacgccuguaaucccagcacuuugggaggccgaggcaggcagaucaccugaggucaggaguucaagaccagccuggccaacguggugagacccggucucuacuaaaaguauaaaaacuagccgggcacgguggugggugccuguaaucccagcuacucgggaggcugaggcaggagaauugcuugaaccugggaggcggagguuguagugagccaagauugcaccacugccauccagccugggcaacagagcgagacucuugucucaaaaaaaaaagagccuguaccauuuauccaguuuccucugaagcaacauuugcauaauggugguacaguauugcaucugggauauugaugaugauggcuauguucagguucugaaggaagaguccuggauucucuggggacccaaaugaccaccuugcgagaccagcagaaguuggacaugcccuggccaggcgugguggcucacgccuguaaucccagcacuuugggaggcugaggcggguggaucaccugaggucaggagggcgagaccauccuggccaacauggugaaacccugucucuacuaaaaaauacaaaaauuuagccagguguguuggcaugcaucuguaaucccagcuacuugggaggcugaggcaggagaaucacuugaaccugggaggcggagguugcagugagccgagaucgcaccauugcacuccagccugggcaacaaagugagacuccgucucaaaaaaaaaaaaaaaaaaaaagaagauggacaugccuggggcucacggccuccguccagcccagacagaacucagggccugcaguggggcaugacacagggguaaggcaugcguucccugcccuggagaggaaccgagaagcaauagaaccaccccugagaguuuagacauucagcaaagcagcaaggugaaugacauggacuggggagggcaucagagcacggaaucaagguuugaaagcuuuuuuuuucuuuuuuaagagacagcucuguugcccaggcuggagugcaguagcacgaucauagcucacugcagccuugaacuccugggcucagguaauccuucugccucagccuccugaguagcugggaccacaggcaugugccaccaugcguggcuauuuuuuuuuuuuuguagagauagggucuuguugauagccagguacagaacacgucccuccuguugcccuuuuauagccacacccacuucccucccagcccaucucuuccuuauccccggcaaccaccacucuguucauuucuacaauuuuaucauuuuaaugauguuaugugauggaauuauucaguauguaaccuuugagguuuggccuuugucauucagcauaauucucuggagagucauccagauuauugcauaugugucagcuguucauuccuuuucauugcugaguaguauuccauggugugcuuggaccacaguuugcugaaccacucacuuauuggaggacauccgggguguuaccaguuuggagcagugacauauaaagcuguggccaacacugcauacaggaugugguaugaacaugacucuucauuucucccggguaaaugcccaggacaguugcugguucaugcgguaguuucauguuguguuuaguuuuuuuuuguuguuguuguuuuaagaaacugccagucuguuuccagagucaccguaccuuuuaacuuucccaucagcaguguaugaguggcccaguuugccugcauccucaccagcauuugauguugucacuauuuguuauuuuagccacucugauagcgugcaguggcaucucacugugguuuuaauuugcauucuucuuuuugcuaaugauguuaaacauauuuucauacguuuauuugccaucugcuauauuuccucuuugguaaaaugucuuuuugccuucagaucuuuugcccauguucuuuucuucuucguguuuuuuuguuuguuuguuuguuuguuuguuuguuuuuuaagaaaucagaucuuguuauguugcccaggcuggucuugaacuccugggaucaagcaauccuccugcuuuggcuuccugaguagcugggacuacaggugugcaccacgacgccuggcuaguuuuuuaauuucauguagagauggggucucacuauguugcccaggcuggucuggaacuccugggcucaagcaguccuccugcuuuggccucccaaagugcugggacuacagguacgcaccaccaugccuggcuugcccauguucuaauuugauuguuuucuuuuuuaugcuguugaauuugagagcucucuaguauauauuuuagauaguagucauuuguuggauaugugcuuugcaaaccuuucuuucuagucuguagcuugccuuuucaccuuuuuaucuggcuuuuuuuuuugagacggagucuugcucugucacccaggcuagagugcaguggcacaaucucggcucacugcagccucugcccgcuggguucaagcaguucuccuggcuuagccuccuggguagcugggauuacaggugcacaccacuacacccagcuaauuuuuuuguauuuuuagccauguuagccaggcuggucuugaacuccugaccccaggugauccgccuaccuuggccucccaaugugcugggauuacaggugugagccaccgcgcccggccuuucucccccccccuuuuuuuuuaauacggaauuuugcucuuauugcccaggcuggagugcaauggugcaauggugugaucucggcucaccucaaccuccaucucccggguucaagcgauucuccugccucagccucccgaguagcugggauuacaggcaugcgccaccaugccuggcuaauuuuacauuuuuaguagagaugggguuucuccauguaggucagacuggucuugaacucccaaacucuggugauccuccugccucggccucccaaagugcugggauuacaggcaugaaccaccacgccaggccuuacauggcucuuucacagugcaaacauaaaguuugucugccaaucuuuccuuuugugaaucgggcuuuuggugucaagucuaagaacucuuugcuuugcccuagauccugaggauuauguuuuacauuugaauucaugauccacuuugaguuacauuuuguacgaggcauaagacuuuuaguucgaggcccauguuuuuccuauggaugccgauugcuccagugcccuuuguggaaaggcuuuccuuccuccugaaauacuuuugcaccuuugucaagaaauccacugggcagaucugugugugucuguuucucagauucuacauucuguucugugcauuacugucugugcccgcccccugccaauacuccacugucuuaacuacucuagcuauagagucagucuugaaaucagguagacugacucuuuccacuuuauuauucuuuuucagaauuguuuuagcuucucugccuuuuuuuuuuuuuccgaagaugaagucuugcucugucgcucaggcuggagugcagugguaugaucucggcucacugcagccuccgccucccagguucaagugauucuccugccucagccuccugaguaacugggauuacaggcaccugccaccaugccuggcuaauuuuuguauuuuuaguagugaugggguuucaucauguuggccaggcuggucuugaacuccugaccucaggugauucacccaccuuggccucccuaagugcugggauuacaggugugagccagagugccuggcccuguaauacuuaaauuacuagugagauggaacauuuucuuucuaacuuugcugcaucucuucuuucugaauugccucucucuuugcucauuuuuaauugagaugucuuuuuccuugugauuuggaaaagcucucuuuucacuugccaagucuucuccuucucuugguaacauuuaccuuagcucugcuguagaaaccucugauggagcaguuggagagagcugcccauccaguccaggaagguuagacauaccccagcguuucccugaugccuuuugaauguuuugagucaagucccaguucugccccgugcuugccacaugacugagccagguuaucucacccgcagaaugugggccggccugcugggagggcugggcucacauugggugaugguugugcaaggccugugggggccucuaaggggaaggcagaaauggaaggauuaucaagcaagcucuacuccgggcuauguuuuugcauccauauguuuuucuaaguaggaacucagacugagauguguuucaguguuauaugccuaacuuccugcaaaacuuggcaguggcauugaaaaacauagccauuauggggucucagcuuuccuggggaaauggcaggucaucgaaaacacuggcuuucaaguccauuuauaugcucaaauugaguguugccuuuugaccucuucuguuuaauaaaaugcuccagcacgucaucacggacgugcauuuucccaggccagcauaugcaugaggcuguccugugguccggugcacagcccugugacaccugggcugucauuacagggugcacaguaggugagggucugacuccaggaccaccuauccugggugcuucacugacuguugcucauuggcuguugugguccugaguagggcaaacucaguuuccccaccugucaacuggacuaguaauauuaccugcccuuuagcguugucgggaggaugagagguacuggauaggaaacaagggauuauagguacuucucugaacauuuuacagugaaaauggauugcuuuccaaaagucauuuugaaccaaggcugaugaucauugguuuguuuugcacaagagcgcguacuuugcuagcagagugagagugagaguuugggcaggaggcagccaggcaugaagauguaggaggcguccugcccucggccacgugcggggaucagaguugggugaacccugcuuaggagucguuagaacacaauccugagacaguuucuccuccgaggugguucugcuggguuucuccaucucaacugcuguuguccuggguuacaguuacaggcgcuugugugaauugcgguguuuuaaagccuucagagcagaaggaugugaacuuguccuucuccuugugccccucucucugucaucccacuuguaaauuguuucugggcuggaggauaagugaggaggccacaggaacuuugcauguugucucuuagcauuuugaguuaggaagagcaacugaaagaccgagcugaaagcuacacugaaccucaucaacaauucacacacugcagaggcgaagauggcgucuucucagcacagugggcugggucaggagaacacaucgggucagcucugcugcacuuccuuccauuccuacggccauccuggugccaccugcagccucuuacggugcaggccucauccccuggugcguccccucucugcuguugccucgggcuuggccccaggcucacuuuggggucagacaugggugggcagcuccagaggcugcucucagcauacagagggcucuuucccaguagcugugaaucuuccuuuugggggccaagaggucucugcacaggggccagugacagacugccuggggcuggggauuuaugucauuagcaacaugugucuucaguucugucgcaaugacauaucagggcagcgugcaggugugaguccauuguuccugggaagaagccuggcauaagaggaaguggcaguuggggccuggugcuguaccuucuuucuucccccuucugcuuuugcauaugcaaaaccugacauauguguaauuagaucaaaaccucugaccacugucauuguuccagguuacccagauggacucccguggugaugagcaaugguugagccauacucccugggcuuucccucagcuguaggucuuuugagagugacauccgguggucaucaaguguucgagccggaugagccuuuagcauggaugggcagagguuggagcucugggcuguguccuucagcgacucuucuggauuaguccaggccuuguuucucuugguugcggaucuuguugcucauuagcgccugggaaguagagcagauauuuaauaacccugcaugccucaaagacugaaacucuuuuuuuuccacuggaaucacaguagcuuggaaaccucuuucccuugcuucccaugagauuguuaaaaaacucgccuggggcugggcgugguggcucaugccuguaaucccagcacuuugggaggccaaagcaggcggaucaccugaggucaggaccagccuggccaauauggugaaaccucgcuucuacugaaaauacagaaauuaagugggcaugguggcacgcaccuguagucccagcuacucgggaggcugagguaggagaauggcuugaauccaggagucagagauugcaaugagcugagauugcgccacugcucuccagcuugggugacagaacaagacccugucucaaaaaaaaaaaaaaaaacuugucuggaaaugugcuucagauccagaccucucugaucauuggcaggaagggcaccuuugucaucugaagugagggccucuggagucugugaacccauggcaggcgaugugcuguuugcugccuagaccugaccacugucaccuuuacugacagaugacaaacagccugccugccuuggccuccuuucugugggucuucuuccucuggggagacauauuuuggaaauaagcuggaguuugagcccagaaguugacacaggugugauggcuggacacugucaucuaacgagguuguaagaugcuaagggugauagccacuccuuccuguaccccucacccaggaauggugucacugccuccaagcacgaggggggcagccaucuuggggcugcuguugcuauacacacuuaccuccuaugucuuuuccaugaugucuuugucuguuuuaaaaugauggcuccuaaaucucuggcuuuucuugcuuuuucauguuauucuaguuuuuucugccuuuucaguguuucccccuuucuuuuccucuuuuuuuuuuuuuugacuuuuucccucuccccuuucagaucuuuaugcuauuuuccuucuauuuucauuuugucaugguaguuuucucuguacuuucacuucuuuuuuuuuuuuuuuuuuuugagacggagucucgcaccgucgccugggcuggagugcaguggcgcgaucucggcucacugcaaucucugccucccggauuaaugcaauucuccugucucagccuccugaguagcugggauuacaggcgcacaccaccacaccugacuaauuuucuguauuuuuaguagagacgggguuucacuauguuggccagacugaucuugagcuccugaccucgugaucugccugccucggccucccaaagugcuguuugggauuacaacuuucacuucuuuauacauucacagguguuggcgucccccagagacgcugaccauaauccgggcauuauuauuuuuuucuuuuuauuuuugagacagaguuucacucuugucacccaggcuggagugcagugguacgaucucggcucacugcaaccuccgccuccuggguucaagcgauucuccugccucagccucccaaguagcugggauuacaggugcaugccaccacgccuggcuaauuuuuguauuuguuguagagauggugucucgcuuugucauguuggccaggucucgaacuccugaccucaggugaucugccugccuuggccucacaaaguacugggauuauaggcgugagccacugcgcccggccugggcauuauuuuuagcuucaaaugacccuuuguagcacaacaauaugcaaguggugggugcguauugguucaaauccaaugacuauaacuggaaggagucuacgucccccugguuuuauucauugugagaaaucguacaacagcagucccagaauuuguuggauaaacacuguaauccugcccccaagauaguccucuuuucccugcccaguucuauucucuuuagcuguuuacacauccauucuguauaauuaggugucauugugcauucuucacuuuuaucgcuuauuacaucagcggcagguuugugugcucuuuuuucaccucacuuacuaaaacaccaacgcacguaaacuuuuacagccagcauuucagggacugcauaauuccccaccagguuggcacacuccccugggugucccuccccuucccugggagacgucuggcagagcucaggacacagcgggaagugucuggacuuggccgccagccaggcuggauccagguguggccucugguggccccgauuagcugcgugacccuagauggggaagugaccuccaaacagcgaugucuuggggcucugaggugucgggaaauggaauaucuucagugccaagcugaggacacugcacuuccuuccuucccuggugggaacaguuacuggccagcgcucuccgggcgcgggcuggucagugugcgucucugagcacucagguagcuggaggaggauggaugggaugguugagaaccagacccaggccagggaaacuggucgaaagcuugcaggccuggugauuuaugauaaugcguggaaacuucuuuucugauuccggagccagagaacaaucucagaggauagaguguccuuucccucugagcucuccaggagcugaaaucccuuugcucagugaauggaaauugacacugggcugcugcugcuguuuccugagugacuauauuguuugcccuagaaucaggauuuauuaaagaacauuaagcuuacuuuuucuaaaucagguaagcauaauaauaucugugucugaagauaaacugaauucuguguucagaggauguuuaaagugcaugcauuuugacucuaacuaucaucauauauuuuggucaugacaaaauugagggggcaacccuuuuuuuccccaagggguuguguucacuuuugaccaauaucugugguuucauuuacagauucccacuggaaauucguuguaugaaucuuauuacaagcagguaaguuuagcugaugucucuucagauggaacuagagcaugccugagcugaaagcacaguacagaauagaagcccggcugagcggccuuuuguccuuuucuguucacugucagcggauaguuagcguggcgggugccacuucaccugcugcugcauuugcugaaaaguuauuuugccucuuggucucccauuucaggucgauccggcauacacagggagggugggggcgagugaagcugcgcuuuuucuaaagaagucuggccucucggacauuauccuugggaagguaugugaagaugaauagugauuucucuucuguggcugcccucacagcuccccccgcaggucagggccagccugugcaggccuccuuccauggggcccggccuccuggguaguggccuggucgcugcagaccucucaggcugcagcugguggauccaaaugcccagguggcagcccccaccacuacuuugguagcagauaagaaacccgaguacuuuuggggucuugauagcuuguggacuuuuuuuuuuuuuuuuuuuuuugagacagaguuucgcucuuguugccuaggcuggaaugcagcggcgcgaucucggcucacugcaaccuccuccucccggguucaagugauucuccugccucagccucuugaauagcugggauuacaggcacaugcuaccacacccggcuaauuuuuuuuuugagacagucucgcucugucgcccaggcuggagugcaguagcgugaucucagcucacugcaagcuccaccuucuggguucacgccauucuccugccucagccucccgaguagcuggggcuacaggcaccugccaccacgcccggcuaauuuuuuguauuuuuaguagggacgggguuucacuguguuagccagacuggucucgcacuccugaccucaggugaaucgcccaccuuggccucccaaagugcugggauuacaggcgugaaccaccgcgcuuggccacuugcggacuuuaguugggggaagaagggugucauaaacaccauuggcuugggagcugagugcaccuggauguccucugggcccugccgcugacuggcugugcgccccugggcagaucauucaccugcucugaauuggcuucuucaucugcaggacaaccuggggacagucacuccugccccgcaaggccagugauggggugguggcggcucugguuuuuguuaacacguggacagugaucggcagucaugcuuaugagcauuuuuguguuuccgcagauaugggacuuggccgauccagaagguaaaggguucuuggacaaacagguauauacacauguacacagagcaaauggaggggcugggcagagcccccaggcugggugaccuccacggcuccuuccacauuccuccacugucaaguauuacuaggcaugagcacggcugucaaacuuaacacgggaaguuuucauuuugaaauaaaggucuuuuaaacacuuggagccaucuuucauggcuaguguaucuuuuauuuauuuauuuauuuauuuuucuuuuaauguuuuguaaccuuacaugugauuaaaguguuguccagacuuuuuauuuuggaccagucucucguggaaguugcacaaauagcuuggaggguuccuguguaucuuuugccagcucuccccagugauggugucuuacauaaccacagcacagugaucagagccagaaaauaacauugguguuauuuuuuauuuuuuugacauggagucucacucuguugcccaggcuggagugcaguggugcaaucucggcucacugcaaccuccaccucccaggaucaagugauuccccugccucagccucuggaguagcugggauuacaggcgagaaccaucaugccuggcuaauuuuuguauuuuuaguagagauaguguuucacuaucuuggccaggcuggucucgaacuccugaccucaggugaucugcccaccucggccucccaaacugcugggauuaugggcaugagccaccacgcccagccacauugguguuauuaauguaacaaaguagacauugguguaacuuugacuaaaggccuuaaucagaguuuuuuuuuuuuuuuuuuggagacagagucuaacucuugcccaggcuggagugcagugacaugaucuuggcucacugcagccucugcccucuggauucacaagauucucaugccuuagccuccacagugaaaaccccaucugaaaaaaaaaaaaaaaaaaucugaaaucugaaacucuucugauaccaagcauuugggaugaggaauacucagccuguacuuauaagugauuuuaaguggucguagauggccauuuuguuagaagggaccuuguuugugcugugccaugacuugugauccagucuguccaggaagcccccuucacuuguaccucccuucuuugagguucauggugcaugucugcauguuuguuguuuuguuuuuuuauuuuuuauuuuuugagccucgcucuguugcccaggcuggagugcaguggugcgaucacugcuuacugcagccucgaucuucuggguucaagugaucuucugccucagccucucguguaccugaggccacaggcacacacugccacaccuggcuaauuuuuauuauuuuuuuuguagagacgaggucucacuaugcccagguuggucucaaacuccugugcucaagcaauccucccaucuuggccucccuaagugcugggauuauaggcaugagccaccgugcccggccucaugucugcauguuaaaaguucugagaauuccuauggaaaauaaauuugacuuugcuuaaugcaguuccucuaaacuuacuuaauuccuuuuucuuuuuuucuuuacuauuuauuaauuuuucucuuuucucagaccuugcagggaugaaagguccccuuuucucaaaacccucuuaugauccucuacacucugcaagggcuucugaggacagcaggcugagaaaggccgauccuagcacuuaccucuuugaagacacuuuuaaaacuguuaacaguauuuauagcuuuaaaaguauccauguucuuaggccaguuaauaaaaaaaaaaaaaaacagaaaaaaaacaagcuaagugaucccucacaaguccacugagccuuugugugguggguccuggguuaggagggaggcaccugacagccuaguucaacuuccuucccgugucuaggugggguccacgucaggccacugggggugggcaggggauguuccauucaacgaggccgaggggaucguggugaaccacagauaugaguuucugaccaaccguguguauuuacgacugcuuuaaaaaaaauucaacacauagccaggugcaguggcucauaccuguaauccuagcuacucaggaagcuaaggcaggaggacaggaauuugagaccagccugggcaacauagugagaucccaccucuaaaaaaauaaauaaaaacuuagcugggcauaguggugcacaccuguggucccagcuacucaggaggcugaggcaggaggaucgcuugagcccaugaguuugagguugcagugagcugugauugcgccacugcacucugggugacagagugagacccuaucucuaaaacaaacaaaaauucggcacauauuugguccaucauucguaaccuuaaccauguuuaauuuuguugcuuuauacaaccuaacauuuccuaaauguugggagcucauaguuuuuggaaaauauaugcaucugaaauuuuacagauuuccagaugcaguggaauaaguccauuuuauuuuauuuuauuuauuuauuuugagacggaguuuugcucuuuuugcccagccuggagugaaguggcaugaucuuggcucacugcagccuccacccucuggguucaagugauucuccugccucagccucccaaguagcugggauuucaggcaccugccaccacgccuggcugauuuuuauguuuuuaguagaaaugagguuucgccauguuggccaggcuggucucgaacuccugaccucaggugauccaccugccucggucucccaaagugcuaggauuacagacaugagccaccacaccuggccaggauaaguccauuuuaguguauucauuuaagcgauguccccaaggugaguccaguucagcccaacgcuccaagggguuuuugcacggacggccuucauuguugaagugcacauccucuuucccugaagccugcuguuagagacagcucccccuacccucacuggcgauaugcuguuuacuccuucccuuucuuuggacuugcaggguuucuauguugcacugagacugguggccugugcacagaguggccaugaaguuaccuugagcaaucugaauuugagcaugccaccgccuaaauuugugaguguccaaguccuucaaguucacauucuucuaauaccagauguguguguguguguaugugcauguguguaugugcauguauauuuccauguuuucucuagccuuccccuuuuauuguggugaaauucacauaauagaaaauuaauaauuuuaaagugaacuauuuagugguauuuagugcauuuacaguguugugucuucauuaccucugucuagcuccagaacuuuuucaucccuccgcaaggagaccccauccacauuaaguaaucacuccuugucucccccucccagucgcuggcaaccacuaauuuuauuucugucaauggauuugccuguucuggacauuuccuaucaauggaauucucuaacauggucuuuugugucuggccucucucucagcaucguguuuucaggguucauccauguuguagaauggaucaguguuuccauauuccauuuacuggauggaccacaucuuuauccauucaucucucuggacauguggguuauuuccacccuuuugacuguugugaauagugcugcuaccagcauucauguacaaggauuuguuuggacauccguuuuuaauucauuugggucaauacguaggaguggaauugcugggucauguggugauucuguguuuaacuuugugaagucuucccuuuuuugaaagcacuuugaaacguguauccuuuucagcaaacccacccaccuaugauuuaauucugugccagccacaaaggaauguuucucucucuucucagcacgacaccagcagcccucugauggucacaccgcccucugcagaggcccacugggcugugaggguaagugaacgggaauagcucccuccuuggcucuccuucagauagaauuguuccagcaguuguucuagaauuguucuggaauuguucuaguuugauguuguucagaacauuuuauaggaugauugugucagcucuucugucucagugugaguggccacagcacuuggaugaaacgccucuucuaaugaacaccuuuuacaaaggcuguggcccuucacuggaauugggaguugccuaccuggacaacuaagugucaggaguuggauuauuaaagggcugcaguuuaaaucuugcaucuuuaggucacauucugugguuuuugcugcuuguguugguuauucagaauagaagaggaaacggugagagcuugcaagcacguggacccccaaaugugucccuugcuuucucgcuucuuuccagccacuuugcauguuaccauucuuuccucccugauguucugauugcuuugugaaaagccucucucagcacuugaaguguuauuuuuaaaacagaggauguuguggcuggaaagauaagcuacugcguccagaaagaagaaaaaaaacgagggcugucuucuaaguacagaauuccuucuaaaggaagugagcauggucccuccaaguaacaucaggccuccucaccuucccuucacuuucagacugucacauuuccucacguuuauguggcuuaaauccugacaugaauaacacucuugcucucaaauaaaggucccaagcacuuucgucccauguuuacacgguugguuugcucccuucuuggagaggucaugggcuggguggggguaucugugcagggagaggacaugaagauaugucaugugacugaggagucaugcagucaccucugucaucaagcacuuugccaguggcaaucacuguggugaaggguuucucccugucacccagcgcauuguguggacuuugaaaaagagcuacuuugucaugggaaacagugccaagagaucuuauacuuuaaaaugugauggcucuuuuccaccagggguuauguccaggccucacuggaagagcugggacugaggggccuggggaccucgcagagaggagucagggagcacaggaccagaugcuguaauugggguguacuguggucgagagagauucugcauuccauucacagccacagucagaaagaacaagcccgaagugccaaguguuuguuuccguugugaacauuucugggcuucugaaggcacugagucagcaaguccgauggccaggagaggaucccaggcccccgagaaagaccugcagcgcucagcuucuuagcaccaacagcugugaaagcaugcggugucugccggugaucucaucucugugacugagggcucugucuugguuuuugucuuuuaaaaauuaaaaaauuuuuauugugguugaaagacacaucauguaacauuuaccaucuuaaccauuucuaaguguacaguucaggaauguuaaguuuccuuuggaggguggaacagacuggaagccacugccucacucauggccccuuuuacgggcugccugcccuaugucuuucagaacagcaggaacugugacuccccauccuaaugcuguaccuucccucuguucaugaagagcuauuccuauuuacguauuaauuuauuuaccauuagaaauggagggcuuccuguauguggcugggcuugguggcucacaccuguaaucccagcacuuugggaggccgaggcaggcggaucacuugaggccaggaguucaagaccaacccggccaucauguugaaacaccaucucuacaaaaaauacaaaaauuagccgggccugguggcgcaugccugugaucccagcuacucgggagguacgagugcugaggcacgagaauugcuugaaccugggagucggaaguugcagugagcugagauugugccacuacacuccagccugggcaacagagcaagauuuuugucucaaaaaaagaaaaaaaaaaaaaaaaagaggacuuccuguacuuuaaguugauuuugauaauuauuugcucaagcacuaacaucugcucacacuuuugucuuucugguacaagugggcuccuuggaggcaggugagacugaucuuugucucccugcaaagacacugccccaccaugggagacuccugccacacucaggcagcagcuaggacgaaggacaagacccggggccagggccucccuccugaggaccuuggcucccagauccgagguugccauaacguuauuuccuucaggguauauguucacuuuggaaaccaaggggccaagacuguucuaagaucauuuugugcuuuuagccaagggugaugauggguccguggccauuuucacuuggcuuucggucagagcucggucuggacauucacacaggugugcucuccuacuuacucgggcuauuucuuuccaacuagguggaagaaaaggccaaauuugaugggauuuuugaaagccucuugcccaucaaugguuugcucucuggagacaaagucaagccaguccucaugaacucaaagcugccucuugauguccugggcaggguaagugggccacgggcuugguucuucugcacucagugucccugcugugugugggcgccacuguucucuuuccccauggugcuuacaaggcucuugcucuguuuucucccugugccaucaggggcuuucaucagcgcuccuguggguccagccccagcuggcucagggcuuccuaggguguggcuuacaguguucacccagucccuggggaaggugccagaauccuuccacuucacagaugaggagguggacucagaagugaaauugcugccuggggcuuugggaccaguagagcucagucuuaagcuccccaacuugggcuuucccccuuuccauugugcugaaugugggaaugugugucugugucuauuuauuuauuuauuuauuuauuuauuuauuuaugagauggagucuugcucuguugccuaggcuggagugcaguggcacgaucucggcucacugcaaccucugccuccccgguucaagcaauucucaugccucaaccucccaaguagcugggauuacaggugcaugccaccacgcccagcuaauuuuuguauuuauaguagagaugguguuuuaccauguuggccaggcuggucccaaacuccuaucucagauucacccgccucggccucccaaagugcugggauuacaggcgugagccaccacacccgggcuuuuuuauuucuuuuuuugaguuuuuagagauggggucucacuguguugcccaggcuggucucgaacugccaggcugaagccauccucccaccucagccucuggaguaacugggacugcaagagcaccaccacuccuggcucuuuucuacuauuaauuacucuuuuucuucugauaaagcucaagguaaaaguauuuucaacucugcugcaaauuuaggaaaaauuuuaugcauucucuuuaaagaaagucuuagccuggugcgguggcucacgcccguaaucccagcacuuugggaggccgagguggguggauaacuugaggucaggaguucgagaacagccuggccaacauggugaaacccugucucuacuaaaaaaaaauacaaaaauuagccagguguggugguguucgccuguaaucccagacacuugggaggcugagacaggagaaucguuugaacccaggagguggagauugcagugagcugagauugcaccacugcacuccagccagggcaacagagcgagacucugucucaaaacaaaaacaaaaacaaaaaaaacccucaauuuaggcugguguggcggcucaugccuguaaucccagcacuuugggaggcuggggcgggcagauuacuugaguccaggaguuugaguccagcuugggcaauauggugaaaccccaucccuacugaaaaaaaaauacaaaaaacuagccaggugugguggugcgugacuguagucccagcuacucuagagguugaggugggagaaucacaccugagccugggaagucgaggcugcaauaagcugagaucgugccauggcacuccagccagggcaaccggauugagacucuguuuaaaaaaauaauaauaauaauuaauuuuuuguuuuguuuuguuuuguuugugagacagagucucgcucugucacccaggcuggagugcaguggcaugaucucagcucacugcaaccuuuccucccagguucaagcaauucuccugccucagccucccgaguagcugggauuacaggcaugcaccacaacagccggcuaauuuuuguauuuguauuuguauuuguauuuguauuuauuuauuuauuuauuuauuugagacagagucucgcucuguugcccaggcuggaguacaguggcgcaaucucugcucacugcaagcuccgccuccuggguucacgccguucuccugccucagccucccaaguagcugggacuacaggcgcccgccaccacgccuggcuaauuuuucauauuuuuaguagagaugggguuucaccaugucagccaggauggucucgaucuccugaccucauuauccgccugccuuggccucccaaagugcugggauugcaggugugagccaccaugcccagccaauuuuuguauuuuuaauagagaugggguuucaccauguuggucaggcuagucuugaacuccugaccucaggugauccaccugccucggccucccaaagugcaaggauuacaagcgugagccaccgugccuggccaaauuaauuaauuuuaaaagccucaauuuguuucuguuaacuaaaaguacaguugucccuugguauacuuagggggauugguuccagggccccuaucauacaccgaaauguacgcauacucaaguccugcaaucaguccugcacauacaaaagucggcccucuguauauucggguuucacgucccacgacuacuguauuuuguauccacguuugguuagaaaaauacaagcauaagugagcuugcacaguucaacaaaccauguuguucaagagucaaccguguuuugcuuuauuuugcguuucauuauuuuuauuuuugaugauacauaauaguuguagugugggguccacguggugguuugauacaugcacacaauguguaaucaucccagcaggguaauuagcauauccaucaccucaaacacugauccuuucuuuguguugggaacauucaaaucuucucuucuggaagacucugaaagauaugauaaauuauuguuagcuauaguuccccuguugugcuguugaacuuuagaacuuauuccuucuggcccgguacgguggcucacgcauguaaucccagcacuuugggaggccgaggcgggcagaucacgagaucaaaagaucaagaccauccuggccaacauggugaagccccaucucuacuaaaaauacaaaaauuagcugggcaugguggcacacucauguagucccagcgacucgggaagcugaggcaggagaaucgcuugaaucugggaggcagagguugcagugagccaagaucauaccacugcacuccagccugggugacagagugagacucugucucaaaaaaaaaaagaauguauaccuucuaucuaaccauaaauauaaguauuauuuauuuauuuauuaaaaaaaaguuuuuuuuuuuugagaugaagucucgcugucaccgaggcuggagugcacuggcaccaucuuggcucacugcaaccuccgccucccugguucgagcaauucuccugucucagccucccaaguagcugggaacacgggugcaccccaucacgcccagcuaauuuuuauauuuuuaguagagauaggguuucaccauguuggccaggcuggucucgaacuccuggccucaggugauccgccugccuuggacucccaaagugcugggauggaugacagucgugagccacugugcccggccaugcauacaucuuuguauccaugcaucuaugcacccaugucccuccgcaucccuaugauccauucaucugugugugcacaugcccaugcaauguauuuauccacaucugugcaugcgucuuugugcccauaugucuaugcugccauguccccguguguccauauuuauacauucauccgugcgcacuugcauccgugcugucauccaucugugcauccaggcacucacacaucgugcaucuggucagucauucaguaagcauuuuucagagccugcaguggaccaugccuugugcugggcagugggaagguggggauaauuagauaccgucaaagaagucaaauaaguaauagcuaagaggcugagacuuauuuacugagggcuuaguaugggcaggccgggcccuagugcucugcgugaagacacacauccagcacuugcagcccuccuguuaaggacugugucucacaccccuccaccacccauuuuucagauggcgaagcagaucuucagggugguugggaagucaccuugguugcacaguuguggaaggguggagaagggaugagguccuacuguggacagggcggggcaggguccagugugcauucuggagcagcugucccuagagccugcccucuucaccugcccuguccauuagacacccccacagcaucccugauaaucacaguuuggcccagugagggcagugguggaggggagggccccugacccacucgagcacggggagcagggcagcuggggaagacuuucuagaagaggugccccuggucacauccuccagggugagggggacucugguagaagucugggcaugugggcaacuugagugaaggcacagaggccucaggcagucuggcaugccaguuagggccacagcucccccuggacacuuccaccccccaggggacauugggcaaugucuggggacauuuuugguugucacaccugggucgagugcugcuggcaucuggugggucaaggccaggaaugcugcucaccacccugcagugcacggcauggcccacaccccagagcaugauccagcccuaacaggcaguagugcugagguggggaagcccugggcugagggaggacuguggagccagaaaggccuguuggaguccuggaucccugguaaaguagguggagguccccguggagucuguggaggcuggguuggggugcagggaccugcuaccgucaggggcucagcagcagccaggugacagggccccaucugccaggcugaggagcaggguggggcagggucagguguguguucuggagcaguuccugugguagccauagggacaagacugggauagggaggccagcuggaggcucuuggcugugugggcuggugaggccugagccucgggcgcagcagcagagguggagaggaggaccagaugugagaaaccugcauggacugaagcccuggugauuggcuggagagaggugaugcugacacaugaagcaucauggauagagccacgggcaucugcuuagauccggggacuggcagccugcccagcguuggccuggcaggcagugugcccauccaggaaggcuggcaugggucaggaagcuggcagcgugauggugcuugagaucugcacgugucuuaggcacgcuccagaacccacgccugccugccuucucuucagcgcacugaguggccugacaccugucucaccauccacugcuggggaguggagacgagacccacagaccugcucagacaugagcucgcagcccugcccagcugagaaugcaagggaggggugggguuugcaggagugagcauagggaguguggguguuuagggcaacaccuguacucaaucaaagcugucuuuucuaagaugucucuguaagacaauaaagaagaaacucaggguaaguuuaaaguauagccuuuaaacuuauaaucuuauaaucaauaugauuauaaucaugaugauugucagaccacagaucugguaguugacaguacuucacaggugaugguuuuucugagaacucgcggacugguccugaaauguauauugacugccgucuccugagcccagugagugccacggcugagagucugaguuccggcagguggucucacucucacccaguccuuccucccacaguuacccaugcuggucucucccuugcaggucugggaccucagugacauugacaaggaugggcacuuggaucgagaugaguucgcugugguaaguccugcuguuuccuccccacccagcccaggaaggaaaugugcagugcgcagggguugcuggauucguuugucuuucucucuuuuuucuuuucuuuuuucuuuucuuuucuuuucuuuuccuuuccuuuuccuuucuuuuccuuucuuuucugucuuucuuccuuucuuucuuucacuuucuuucucucucucucucccucccucccucccucccucucucccucucuccucucucugucucccucccucccuccuuccuuccuuccuuccuuccuuccuucccucccucccuuuucuuucuuucuuucuuuuuuuuuuuguuuuuagauggagucucacucuaucgccaggcuggcauucaguggcccgaucuuggccaggauggucuccaucuccugccuugugauccacccgccucggccucccaaagugcugggauuacaggcgugagccacugugccuggccuucuuucuuucuuucuuucuuuuuuuuuuugauacggagucuugcucugucacacaggcuggagugcagugguguaaucuugguucacugcagccuccgccucccagguucaagcaguucucuugccucagccucccaaguagcugggauuacaggcaccugccacuaugcccaccucauuuuuguauuuuuaguagagacaggguuucaccauguuggucaggauggucucgaucuccugccuagugauccacccgccuuggccucccaaagugcugggauuacaggcgugagccacugcaccuagccuucuuucuuucuuucuuucuuuuuuuuugacacggagucuugcucugucacccaggcuggagugcaguggugcaaucuugguucacugcagccuccaccuccuggguucaagcaauucccaugccucagucucccaaguagcuggaauuacaggugcacuccaucacagccagauaauuuuuuuguauuuuugauagagaugggguuuuaccauauuggccaggcuggucuugaguuccuggccucaagugaucugcccgccucugccuccuaaagugcugggauuacaggcaugagacaccacacccagccuuccuucuuucauuuuuuaaguguuugucuugacauaguucuuuguauguaggaaaguuucaguauagguugaguauccuuaaucugaaagucugaaaccagaaugcuucaagaucugacauuuuuugagcaucaacaugacacucaaaggaaaugcucauugaagaauuucagauuuuggauuuuuggauuaguaaugcugaaccaguaaguguaauacacacauucagaaauucagaaaacuccagaacugaaacccuguggucccaggcauuuuggauaagggauacgcaaccuguaauacagagaauuauuuuuuguuuuugagacagagucuuguucugucaccccagcuccagugcagugacgugaacacccuugcugcagccucgaacucaacucaagcgaccuccccccuuggccuccgacagaaaauucuuuugaaaacucuucagucaaauuucccagugucacuaauuuccuacauuuguuuuaucuuucuccucccuucuuccucccucccuccaucacucucucgcccuucccacugcugcacgaaguuuuccugugaaccauuuuaggguuaaguugcagacaugaugccucuucauccacaaacacuucagugcguauuuccuaaaaacaaggacuucucucacacauaaccauuauccacuucaaaaucaggaaauucacaucauagcauugcauuuaugauguuuucauuauauccuguauauaccccuuauauucuguaugagcgugucuauuauuaucuaaucccaggauauuacucagauuuuaucaguugucccaaaaauguuccuugugucuaaagagaacccaguccuguguguuacauccuguugucuuuugucuuucguuuccugggaucuagaacaguuccuccaucgcucuucgugucucuugacguggacuuuuuguuuuuuuguugucguuguucuguuuuugagagggagucucacucugucaucuaggcuggugugcaguggcaugaucucagcucacugcauccuccaccuccuggauucaagcgauucuccugccucagucuuccaaguaacugggauuauaggugcccaccaccacagccagcuaauuuuuuuuuugaauuuuuaguagagaugcgguuucucccuguuggccaggcuggucuugaacuccugaccucaggugaucugcccgucucggccuccaaagugcugagauuacaggcaugagccaccaugccugguuucaacguggacauuuugaagagcacaggccagcaguuauggaguguuccuaggccugggccuggcugccagguccucuugaugacccaggucaugcacucuugugagacaggaaucccacggaggucacacccgccccacaugggccucccaccugggggaacgugaugucaacaugucuucuuacugccauguugacauucaucacugggucaaggugggucaagguuguggguuccugugggcaguugcucuuuuucccucugugcucaguucaucucauguggggcacgccuugauacggucaacacccaugacucucagacucuuccaugagaguuccaccaucgcugaugagucucgccuuaaucuggcaagauuaauuaugaugaugguggcugccaaauggugaugugcuaaucaaaaccaucauuccuugcacuuuuauuaguuggccuuccacaaggaauuuauuucuauggcuguggccugccucauggaugcauccucaguuccacuguuuuuuguuuuguuuuguuuuguuuuauagagacagagucucgcucugucacccaggcuggagugcaguggcgcgaucacagcucacugcagccuccaucuccugggcucaggcaauccucccaccucagccucccaaguagcugggacuacuccugaacgucuugaaguacaggucucucuucuggugucuuuagacuuccaaauccaguacugggaaggugccagcccuggagcugguggccucccugaguggugaagggaugcauauggagucuggcuugauuggauucuuucugugugcauuucagucucgaggaauaauucaacacaugucuuggaaaguuacacauaaaagauaacucaugaggaaugauuucuuuucacucuggucagcuugggagcguccugacagaguguccugucacugcagcccccaaagggcugcccucugccuucuccugauggucccggccccagccuugccccuucagugccauuguuguuugcaccugcaggccaugcacuugguguaccgagcccuggagaaggagcccgugcccuccgcccugcccccgucccucaucccacccuccaagagaaagaagacuguguucccuggcgccguccccguccugccugccagccccccaccaaaagacagccuccgcuccacgccgucccacggcagcgucagcagccucaacagcacagggagccugucccccaagcacagccucaagcaaacacagguacggagcccucagcgggcacagcccccucucagagcacaguaggauguuucucgggaguucuuaacaugcaaccccagaacggucaagcuugugaugaaaugucuuuaaaaaaugcuuguggccaggugcgguggcucacgccuguaaucccagcacuuugggaggccgaggugggcagaucucaagguuaggagaucaagaccauccuggccaacauggugaaaccccgucucuacuaaaaauacaaaaaaauuagcugggugugguggugcgcaccuguaaucccagccacucgggaggcugaggcaggagaauugcuugaaccugggagacggagguugcagugagcugagagcgcgccacugcacuccagccugggcaacaagagcgaaacucuaucucaaaaaaaaaaaguauucauuuaucucauuauuucaacauggucuccccuauguuacucaggcuggucuugaacuccuuggcucaagugauccuccugccucggccucccaaagugcugggauuacaggugugagccaccgugcccagccugugucugcagagcucuugccaagaguuuugaaagucagguuaggggagguacuuuacuggcaacgaagcuaguggggccaaacucacugguaggcacaggucacccagcgucauaacccaccucucuagugaucuucuggugguucucucaagacccucugacuagaccgauuuuaccaguggccccuggugggguggggugggaggguauagcuccugcccccacgacggcauugguaggaucacagucaugaaaacgagcauuucugggggccuacaguccacaugcucccccuacuccaacuuccucaucuccaggccagcaaugcucuugucugggccucccaagggccacccgauuuugcccucaugccagguuugagugaagccacuuccagccaccagggucugauauccuuccuuugggaccuguggcugcugagccggccuuaaagcccagcugucacugggagagccagcuccacggcaaggcugccccguguuggguuuauagucaauuuggcaucagaaucuugcugcuaacauacucugaggcuccagaaaucaggcagugaguuccuuuuguuugcccagcaaguauuauuaggacucuugucaucccagagcuauaauuucauacguaauuucuucuugggacccgugggacacagaaccccccuuguuucugugucccgccacagcucagcuugucugacuccuguuaccucuuugugaucccuggcuucugagguuagcuugcuguagcuccgugacuuaaaaggcagcaagcccauuucucauuagaauuccuuuauuggcaucuuuacguccaccagacuugagaaggcucacaaaauuuacacaguacaaugccacaaguaaaaaucagguugcucuugccaucugaacucucaucauuugaauuagauccauagauuuuuuuuuuuuaaauauauaagagacaggaucuugcucugcugcccuggcuggagugcaguggugcaaucacggcucauugcuaucucaaccuccugggcucaagugauccuuccaccucagccucccuaguagcuggaauagguggaugccaccacaccuagcuaauuuuauuuauuuauuuauuuuguagagauggggucuugcuguguuaugcuggcuggucuugaacuccugggcuugagggauccuccugccuuggccucccaaagugcugagauuacaggcaugagcacugugccuggccuagcuccauggauuuugauaaauuguuugaucaaguccuugcuguacuucaucacacauacuugcuacgugaaaccccugaacuaagcugaucugggucacaugguaucccuuguuucccaagcuugcuuucugauuucccugaguugguaucaggagccuguuagauuuggacaucacaggagacucguucaugaagaguaaacgaguuuaaccauuguuucccagucuugaccaugagucccuucuccucaauccuauggacaucuucggguugucaacacugugagaacucuuugagaaauccccccccccuuuuuuuuuccccgagacggagucuugcucugucgcccaggcuggagugcaguggcacaaucucagcucccugcaacuucugccucccagguucaagcaauucuccugccucagccuccugaguagcugggaucacaggugccuaccaccacaccuggcuaauuuuucguguuuuuaguagagaggggguuucaccauguuggccaaucuggucucaaacuccuggccucaggugauccacccaccucagccucccaaagugcugggauuauaggugugagccacugcacccagccuaagaaauccuuucauaacugagaggaaugacuuugaguggcaguuucaggcaucauggcguucauugaaggugaggaguggaguggcuuuucuguacaguugcugcguggagaaggaacaaucgaucccuccagccacauuugccuguccuuuuucucuccacucccucaucaucuagauaauucaaucagguguuuauucucauugcuauuaugagauuguuuaaaaggagugauuuguguaaauauuuaaaaaaaaagggaagaggaaaagcacgucuagaguucaggacacagaugccgugaacuguggcgugguggguguauugaaggcccgcgguaaugcagguggaguaggccacggaaggggccugccccugagugccugaggggccucaaugccucugaaccaggaggugaccgggcccugguugacccaugauggcguuugccucucucaaguuaacugugagcugguggcgagaggggucgcacgugcagcgggugacccagccccagggcugugaacuuugagcugcacugggcucguggcuccaucugcccuggugggguuggggcugcaugaauguugguggggccucgugggugguggcccucuuggaugguggugucucauuuguuaccugucagugacguguguguacucacaccuuggggguaucuuuguugucucaggaguggggcagggacauagaaggguggucuucagaguccugggacaggacacuuuggcugccuguagggcagccuuugcgggcugaggagugggaggaccagggaggcuggcauguggccgggccgguucuccagggacgguccuuccaagugggugcucgggagggucuuuccuggcaugcuugaacccauccccugaagaucacagccucccucacacccuggguggcaggguggauggacaaggagagcgggugaugggguggagagaggugcagacuggcaucugggugagcuucacagagccagccucaaccugucucagccucaguuuugccaguuacagaacaaggaucacaucugcccucuuggcucauggaagugaggagaguuugaugccaaaugugcauggaagugcuuuaaucgccccaucaucaaaaagcaugugucugggggucauaaaaagcuuccagauuaacuguuuugccaaaaacuguuucagccaacagugaacuggguggugcccguggcagacaagaugcgauuugaugagauauuccugaagaccgaccuggaccuggauggcuacgugaguggccaggaggugaaggagaucuucaugcacucgggccucacccagaaccuucuagcacacauaugguaaggccggacagguggcaguuguggcuguggguggcuccagggggccugugggugaagacuguggagggugguggucagggggcccccuccagccugucacaggcuuccgcugugucuggcguccuuuauucucccuggccugacagaggcugagcaaggugcacgugccaaggcucgaagcccgcgcuccgugacggucaguucacugucuuucaguaggaagggccucugguccgucuuaagugcucccaggccauuugcuuacacagcugggcccuauucuugcuggcugugaugcuggcucuaacaggaggccuggacuuugucacagccgccuccgggaggugcgggcagcagggccuuggagccucuagcagaguggccuggcagggugagggcgggggcaggaggcccugcucuggaaaggccagugcuuuggcuccuggcgggagggugagcacaaggagacccugucagugccucagagcccagucgaggagucggccucaaccccucuuucccccagggcuggacacagccgacuucauagggcuggggcacuccucuugccacuggccagggcugaagucacuuuugagcuuguugcucagagccuuguggccuuagagaaggcuucacuugggagcuaucaaaaggaaagaauugcuggauaauucucgagaggcaaauaccuccaaguagagcagugaaauucaggauguuacuuaguggcuugggggaaaugacuguccuuagugguaauucacagaugaccacacugugaggugggagccugagaacuagcugucgcagagucaucacccaaauggccaagccgccuccaacuggcuagggacagugggucucagcugccucagauccagugucccuuuuagaaaccaacaaaacacaguguccccuuuaugacucugaaaccaacacacauacaguuccugguuagcgcccugacacccugacugucaugucuaggggucaguagagggaaaguaauuuauaaugcaugcugcaauugacacaugauguaaugacauggaaaugacacaggaaaucacuaauccaccuggaucaaaagaaggaacucagaggucauuccaugcgggcagcaaaggggaaggaaaggaugaucaggcucuugaauaaccaugagaaaagaagucuagaugugucugcgaguggcuggggcggggcauggcccaauguagaugacacaccaggagggacugggaggagggggagcaugaagacagaggcuuuuucccugcgauggcugccaccguacgggucagcagagcaggauguggugucagagccggauggccgcugacugagccaccccuaagcuugcuucuccuucuuucucucagaaccuuccacaggugggccuuggagcccacacuccuugagagauggcaggagcagagaaggggcgggaguggagaggcagcugcagcccacgagcaggcuggggcccgcaggggcagacuggggagagacaguggcaguaugaaaucgucagggccucgaacuguggggauaacuaggcauuuaucagcaauguucuuugagaucugcucauucuccgcagcucuguucacggacugcauuuggguauaaauaagucuguuagaacggucccagcucucuuuugguaaaaggggaaacuucuguuguaauggcuucugccgcagcuacacgggaggugggaaacgaggucccucguugagagggcagcaugggugaaggaagacauuuuucauagaugccaaaggccuuguccuuacuccacaagggucccuucccuuccugguuggcuccucauuuuuuuauuuuuuuuuuuugagacagagacucacuguugcccaggcuggagcgcauuggcgcaaucuuggcucacugaaaccucugccuccuggguucaagugauucucgugccucagccuccugagcagcugggauuacaggcgcgcgccaccaugcccggcuaauuuuuguauuuuuaguagaggcgggauuuccccauguuggccaagcuggucucgaacuccugaccucaggugaucugcccgccucagcucccaaaguguugagaacacaggcaugagccauugcacccggcccuggcuggcuccuugauugugagugucgcggagccucucaccucagcuccacaggaccacugugugcugcuauucagaugcugccuuggcccaucuuucaggacauccaagagcuaugugggcaggggacgcuuaguugugggggacuguccugugcauuguggccaugccccuguggcagccucauuugggcacaagaggaguguuuuagaccauugggcugcugugacaaagugccauagacagaguggcuuagaaacagacauuucucacggcucugggggguggaagucugugauccaggcaccagcagauccagugucuggugagggcucacugccuaguuuguagacggccaccugcuugccguguccucacauggcaaaaggagcagagagagccuucuggggccucuuuuauaagggcacuaaucccacuccugaggcuccacccucaugaccucaucaccucccagaggccccaccucccaacaccaucccauugagggauaggauuuggacauaggaaucuggggggacauaaacguuccguucauaacaaggaaagagagucguugcugauucuuucuucaucaugaugacaccccaaagugcugcugucauccccauugaaggccaguagccggggccauucagaugacccagagcuacagggacaaugcuuggucucagcacccauuuccacggaagggcuggucuacuccaugccugcagcaucagagccugccccacgcacgagauaagccaaaggaagaggcagcugcaucucagcccuagugagguuuucccagggggucggcuccucagcccaggucaggggcuugggguucuucagcccugacagcccuccuagggugggggacacugggagcggggaaccccugggccacuuccugggaaggagaugugaaguagggaaggagcuggggcuugccaccacgcccugccguuguuuucgucgcugucguuuuugaaaagcaagggaucggugacuuggguucaggcugagucggcgccugugauguguaauuagcauccccacguuucucccagggcccuggccgauacgaggcaaacggggaaguuaagcaaagaccaauucgcguuagcuauguauuucauucagcagaaggucaguaaaggcaucgacccuccucaaguccucucgccggacauggucccgccuucggagagaggcacgcccggcccggugaguggugcuggucaugcccuggggguauugacaucccuucccaccgccugccaccagguggcacugguggcacacaugagcccacgguggcgggugcugccuguggucccugccuuccucaacaggggcccccgggaggguggcuuggcugcccagguauuuccccaggcagggggcugacacuuuugcuaccucacccuguguacuaaagggacaauuuuaucccugggcccgagaacugcuggugccuccugucaggugaugucagguugcuaauuagagaucucgccucugaauucaauucuaggacaguucaggcucucucggcuccggggaguuuacuggcgugaaggagcuugaugacaucagucaagagauugcccaguuacaaagguauguuggaaacggcccuucccuccacauccagauguuacacgaacucucccagguuguuaucggaaauaucagaggcucaccuggaaguuugcucaucacagguuuauucagaaggaaggaaaagauacagcuucugagguccuaaacuggcucaaggggcuugaagaaugacaucuuccauuugaaucagccucagccagagcccguagcaucuguguggucucaggcaggucuugaccagagccuguggguggcagcuguguggucccaggcaggucgugggcagagccuguggcagcuguguggucccaggcaggucgugggcagagcccguggcagcuguguggucccaggcaggucaugggcacagccuguggcagcuguguugucccaggcaggucaugggcagagccuguggcagcuuuguggucucaggcaggucgcagcucaguagccccaggcaucagccccuccccagugcuaggaaggccuuguuauccuugacagcuagggcaauugggucucagauggcgaggagcgggcuuaggacccagcagcugaaggugugaaggggccuccaggucuguggcuccccuucuugccuagugccuuaguuuccucauguguaaacgagggcuuuggaugggcugucuguacuuuuagagucugguauaaagaaaugcagucacuuccuguauuccccucuggauccucuucaagaaugacauccuuuuuuguuguuuguuuuucagacagggucucgcucugucacccaagcuggagcguaguggugugaucauggcucacuguagcaucuguuuccuaggcuuaagcaauccucccaccucagccucccgaguagcuaggacgcaccaccaugcuggcuagauuuuuuuuuuuuuuuuuuaauuugagacagagucucauucugucaccuaggcuggagugcaguggugugaucucagcucacugcagccucugccuccugggcucaagugaucuucccacucacccucccaggaagcugagaguacaggugcaugccaccaugccuggcuaauuuuuuuauauuuuuuguagagaugggguuucgccauguugcccaggcuggucucgaacuccugagcucaagugauccucuggccuuggccucccaaagugcugggauuacaggcgugagccacugugccagccagcaucuuuuuuccagucgauucuaggacaggguggacucuugugaugacggggcaccaugcagaagggcccaaaggugcuuugcccucugugggaaagagauuguuuacuuggcugaaaauggaaagggcuuugacuuucccagggaggauggauccugguccuagcugggggauccccgggggucauauuaacaggugcaguauucuaucagcuccucuggccuugguuuugugcuguuagcagagcccugaugagcaaaggcagguuaggucuuggaggggaucaagguggguggcugguuagaaaaccugagccacggccugagucaggcaucccacuucauguucagugcagcagaugguuccuguucugucucagcuccugggggccguguuauccaaacuggcgaucagcaaggaugugcagccugacaaggcugagggugucuugaggaugcagggccagcauccuagagccugggcaggccugagaaucaggaccgggcaggccaaggauggagggagccccugucgugcaagggucagggucuaggaagggacgcuggggcgugaaucaccccaguguggccucagacagccagaagccuuguuuccccaauguggaggugacaggcuggugugugcagagugcccaucuguaggaggcuggggccugcaguggccccuugagcagguggcucugagaguggcccuugauucggggagugugggcugagcuuuccucuuaugauuucacacugccauaagccagcaagggcaugucagguccuucaguuuaaagagcacuuuguauuguaaguuucugggcuuguggaaaugaauauuccaaugaucacuuacugugugucuggcgacaugucccugagagggccuuauuguugcacaaguccugggucccugggcaggaggcagggucuguuagacacaugguguuccugucccugaggcagccucuuugggcacaagaggagggucuuaguccauucauacugcuauaacaaaccacucugaaugggugacugaaacaucagacauuucgcacaguucuggaggcugcaaaguccaaccuccagauaccggcagaucgggucugcugaggacccauuugcugauuccuggagagucaccuucuugccguguccucacagggcaaaaggagcaaaggaagcucucugggguccuucuuauaagggcacuaaacccugggccuuguggcucacaccuauaaucaauuuuuccuguuccaagccacccaguuggugauuuguuacagcagugcuaggaaauacaugcacgaauucuaucucaguuuaaaaauaaaagaaggcugggugcuguggcucaugacuguaauccaagugcuuugggaggccaaggcaagaggaucgguugagcccaggagguccagaccagccugggccauauauugagaccucggcuacaaaaaauaaaaaauuagccaggccugguggggcacaccugugguccuagcuacucaggaggcuaaggugggaggauugcuugagcccaggaagucaaggaugcagugagcuaugaucgugccacugcaguccagccugggugacagagcaagagccugucucaaaaaaaaaaaaaaacaaaaccaaaaaaaggccaggcguguuggcucacgccuauaauuccaguacuuugggaggcugaggcgggcggaucacuaggucaggagaucaagacuauccuggccaacacagcgaaaccccgucucuacugaaaauacaaaaauuagcugggcgugguggcacgugccuguagucccagcuacuagggaggcugaggcaggagaaucgcuugaacuggggaggcggaggaugcagugagcugagauugcgccacugcacuccagccugggugacagagcgagacucugucucaaaaaaaaaaaaguaguaguucagacaggcuguccugggcuguccagggugucacaggcugaggucaaggcgucggcugggcugggcucuuguuggaggcucuaggggaagaaucuguuucuaggcucauucagguguuggcagaauccauuucccugcggcuggggguccgaggucucuuuuuccuuucugaggucagccagggccacuccaugcuccuggacacugccccuguucccccucacguggccccuccaccuucaaagucagcaagggcgcucuggguccuuaucacacuugggacaucucuaacuuccacuugggcaaccagguggagaaagcgcgcugcuuuuagagggugguuacauugggagcgaucccucccauggucacagguccuaccuacaguugacggggaagggacuguacagggcgagcagucgcugggucucauucuuagacuucugccagcacacagaggggcuuuugugggggugaacagaaucaggccuugggaagggguggaggcuuauuauucacucuuguuuucaugaaauauuuuuaaacauucagagagaaauauucacuggaacaagacauucgagaaaaggaagaggcaaucagacagaaaaccagcgaggugcagguaagggucucguucguuuugguuacaucuacuuugugcuaaauguaguucaggaaaacuucccucccuggcuggugguggggaagggcaggggucugcccuggauggaaacaugagcucuugggggcugcagaaugaaguuuuuguuuuuuuuuuuuucaggcugaauucacuuuauuuuucuuguauaaaaacccuauguuguagccacagcuggagccugggugcucugcauggagacucugguguaggucuugacaagguggucagugaacuccugauagggagacuuggugaauacagucuccuuccagagguugggagucagguagcuguaggucuuagagauggcaucaaagguggccuugucgaaguugcccaggauggcagugcagccccuggcugagguguagcagucauugauacuagccaucaugagcagcuucuuggacacaggugcugagacaaugccagugccccugggcguggggaugaguuacaccagcacagaguugcaguggccugucaccuugcaagggacaaugugggguuugcugaucuuguucccccaguagccucugcacacggggacaauggagagcuuggccaguaugauggcccugcggauggcaguggccgccuccuuggagcacuuaauacccagaccgauguggccauuguaguccccgauagcaacaaacgccuugaaccuggugcacuggccggcgcgggucuguuucugcacuggcauaaucuucaaaaccucauccuugagagagccccccaggcaaaagucaaugaucucagauuccuugaugggcgggagaagagauagcucuccuccagggacuugaucuucauguccuugaccaggcggcccagcuuggugaugggcauccacuccuuauccucggccuugccucugcaagcuccguggccuuggucccggcuccggugcuguccacggccgcgaccccagccccagaugccacugcugaaaccuccguggaaguuacugugguugcccaucccagggccucugacaccccccccccccccaccccccgcugcaccggugucauccgccauucgguguuuucucggagaagaagaaguuuuuaaaaauauauauauauauauuuuuccaaauagagauggggucucagacucuugagcucaaaugauucuccugucuuggcuucucaaaguguuaggauuauagguguaagccaccaagccuggcgagagugaagauuuuuuuuucuuuuuuuuuaaaaauggagucuugcucuguugccaggcuggagugcaguggcacgaucucagcucacugcaauuuccgccuccuggguucaagcgauuccccugucucagccucccaaguaguugggauuacaggcacgcaccaccaugccuggcuaauuuuuuguauuuuaguagagaugggguuucaccauguuggcuaggauggucuuaaucuccugaccucgugaucugccugccucagccucccaaagugcuggaauuacaggcuaaaguuuuuaaaguugcuuauaaccauagacgguggcuucucuuuuucuaaaauugagacaaguuggcccucuguauccaaggguucugcaucuuuggaucuaaccaaccacagauuaaaaaaauaaaaaaauaaaaaauaauccaaauugaugaaacaauacaauaugauaacuauuuacauagcauuuacauuauauuagguauuauaaauaaccuagagaugauuuaaaguauacgaggcuggcuguaguggcucacaccuguaaucccagcacuuugggaggccgaggccggaggaucgcuugagcccaggaguuugagaccagccugggcaacacagugggacccuguuucuacaaaaauauuugcaaaagccggguguaguggcaugugucuguagucccaguuacucaggaggcugaggugggagaaucacuugagcccaggaguuuaaggcaguagugagcugugauugcacuacugcacuccacccugggcaacagagugagacccugccucaaaaauaaaugaauaaguaauaugggguggugcuaggguaggggacauguguagguuauaugcaaacacugaaccguuuuaugucacacuugagcaucugcaaauuuuaauaccaaucugaaggauggcuauguaauuaaugucaaaugugcuguauuaaaguguacauuucagugguguuucgcauaaucaccguguugauuaaccaucacucuaucgaguuagaaccugauuguuucucccguaggcgccaguaggcccauaaaaacaucuagcccugaacaguaaauggaagguuacuuucugaaagauucaucguuaacuguucucuuucagugaguggaagaguuugacacuaacuuuccauuaacccaaaaggaaaccucauccccauuaagcaguuacuucccauucuccccuuucuccagccccuggcaacuacucaucuuuuuucuguguguauggauuuguacccagccacaauggggcacauuuccuucaucuguuccucccaucggggaauauuuggguuuucccacuuuuuggcuguugugaauaauguugcuaggaacauuugucugcagguuuucgugcgaacaccuguuugcauuuaucucagguaccuggaguuccggacauuuccugucaguggaaucauacaacacaugaccuuuugugccuggcuucuuccacucagcaucauguuuuugagggucauccauauuguagcauauauuagcguugaauuccuuuuuauggcagaauaauauuccauuguguggauggagcacauuuuuuguuuuaagaggcagugucucacuccauugcccaggcuggaguacagugacacaaccuugguucacugcaacuucugccucccagacucaggugauccucccaccucagcuucucgaguagcugggacuacaggcaugcaccaccaugcuuggcuaauuuuuaauuuuuuuuugcagcgacaaggucucacuguguuguccagguuggucucaaacuccuggacucaaagcaaucugccugccucggccucccagagugcugggauuacaggcaugagccaccaugccaagccacgaugggccacauuuuacucauccaucccucauugauagauguuuuggcuuugcaaauauuguugcuaggaacauuugucugcaaguuuuugugugaacaccuguuugccuuuaucucaaguguauaccugggagugaauuugcugggccacaugguaacuguugaggagcugccagacuguuuuucaaaguggcuguaccauuuuacauucccauaagcaguguacuagggugccagcucugcacagccucaccaacacuuacccauuucccguuuuuccuucuagccgucgugguggguguggagcacugccucauuguggauuucauuggcaugucccucaugcuucccuagcgacgucaaguaucuuuccaugugcuuauuagccauuuguauguagucauuggagaaaaaucauuccgauuccuugcccuuuuauauugaaaaaauuuuuuucuugccgauuuuuaaauugcauuuuuuuuuuuuuuugagacggagucucacucuguugccuaggcuggagcacaagggugcaaucucagcucacugcagccuccgccuccuggguucaaaugauuuucgugccucggcuucccgaguagcugggauuacaggcaugugccacuacaccugguuaauuggguucuuuuuauagcugauuuuuuuuuuuuuuuuuuuuuuuuuugagacagagucucacucuguggcccaggcuggagugcaguggugcgaucucagcucacugcaaccuccgccucccagguucaagugauucuccugccuuagccucccaaguagcugggauuauaggugugcaccaccacacacagcuaauuuuuguguuuuuaguagagacaggguuucaccauguuggccaggcuggucucaaacuccugaccucaggugauccucccaccuuggccucccaaagugcugggauuacaggcgggagccacugcgccuggccuauagcugaauuugaagaauucuuuaucauuucuagguagaaguccuugucagauaugugacuugcaaauaccuucucagcauccacugagaguccacucuggauugucuuuccacauucuugauggugucuuuugaagcacaaguuguuaauguuggugaagucugguuuauccuuuuuuugcugcuguugcuuuuggugucauagcugagaacccauuaccaaaucucaggucacaugauguaucccuguguuuucuucuaagaguuuuauaguuuucgcuuuuccauguaggucuuugauccauuucuaguuaauuuuuguauauagcauaaggcagggaugcaaugucauuguuuugcauguggacaucuaguugucauggcaccauuguuuuuauuauuuuacuuuaaaaaauuuguuuuuagagacagucucgcucuguugccgaggcuggagugcagugguaugauucuaguucacugcagccucaaaauccugggcucaagggauccuccugcaucagcuuccugaguagcuaggacuacagggugugcacugccacaccuagcuaauucaaaaacaauuuuuuuuuguuaagagacagggucucgcuguauugcucaggcucaucucaaacaccuggccucuagggaucuucccacucuggccucucaaaguguugggauuacaggugugagccaccaugcugggccagugccauuuguugaagagccucuucuuucccccguugaauggcccuagcauccuugucaaggaugaguugacuauagcugugcauuuauuuuuggacccucagcucuaucccauugaccuaucugccucuccucaugccacuacaucacugacuugauuacugcagcccuguaaaaguuuugaaaucaggaaaugggcauccuccaucuuuuucuucucugucaggguugucauggcuauucugggucccauguguuuccaugugauuuuuuuuuuuuuuugagacggagucucacugucacucaggcuggagugcaguggcgcaaucucggcucacugcaaccacuaccuccuggguucaagugauuguccugccucagccucccgaguagcugagaaugcagaugcgugcccccacacccagcuaauuuuuguauuuuuacaaaauuuuguaaaaauuuguauuuuuacaaauuuguauuuuacuggguuucaccauguuagccaggcuggucucaaacuccugaccucagaugaucugcuugccuuggccuccaaaagugcuggcauuacaggcgugagcuaccgugccuggccccauaugaauuuuggaaucagcuugucuguuucugcaaagaagccagcugggauucugacagggauuguguggacuccguggacuguugggguuauuuuugucuucuuuuugcucugagcuccccuuccuaaccucgagcuggugggucuuugucccucugggacuuucugauggcuccuucuccauuacggaaugagguccagguuccuucaguuccacacuguuguuaccugguguccagagcuaccccauccggccuaacgcucuucccaucuucccuucccuuauccaucacuccccuuagauguggccacccacauccccagcucccacaacuaacucuguuucaguuauucuguguuaucacccccaaacuucuuagacuuaaugccucaguucagggguuuggagacacagucucugucccaucagcagccaccccuucuggcccagggucuccacuagugucuaggggaauccaggaguugucacgucacagggguuggcugcgcuguggccugacggagcaaugacauuuuucaaugaagggggaagacggagacugcccugaaggaaacugcagcucagguuccuaaaugggggagaaacuaugugcaaaaaauuacccagcaagguuuaaacaauuguguauuucagcuuuauugauuuuauauaucaagaagggagaaagcaagaaucaagaaggggaaaagaaggccaggcaugguggcucacaccuauaaucccagcacuuugggagacugagucuggcggaucacuugaggccaggaguucaagaccagccuggccaacauggugaaacccagucuauacuaaaaauacaaaaacacagaaacaaaaaaaucacgcaacugggcgugguggcgugcaccuguagucccagcuacucgggagacugaggcacgagaaucccuugaacccaggaggcagagguugcagugagcugagacugcaccgcugcacuccagccuggguguuagagugagauucugucucaaaagaaaaaaaaaugcuggggaguggggagaagaaagggaagggagagccaagagugaguagggcaggagcuucugaggagggguugagacugugagaacccucuuagagaaguggugagguacccugagcaccuuugucacugcagacgcugacauggcaugugugucuuaguccauuuggcuugccauaacagcacaccaugcacugggaggcuuauaaacaacagaaguuuacugcucacaguucaggaggcugggaaguccaagaucaaggggccugcagauucagcgucuggugaggacccacuuccugguucauaggcagcaccuucuugcuguguccucccucaguggaaagaucgaggcagcucucaggggccucuuuuauaaggccacuaaucccacucacaagggcuguaccuaaucaccuccuagaggccccacaccuaauaccaucaucuugggggugagaauuucaacaacagacauucaguacacggcauguggccagugaguucccucuuguccuccugucaugccucuucugggcaaauauucucugcucugugcaugaaggaugugauguacacauuuuggcaucuuugguuugaggaggagguaaaggagggaacuucucugggcaggccaaagguguuggagccccuaguguccuggauccaugggccguggccuggaaggagccaguguggcgcuaacuagaacccugaggcccaggacaccagggaguugcugccagcguuacccggugauggggccaggguuagacuuaggaggcucuagaggcuuccgucccuggugggagcaucgcucggagcauugggcuaccucaggcucucucugugccccccacuggacaccucacccauucccacguguuuaaauaccaccuugaugcugacacgccugacuuuauguuuccagcaucuucccuuccuggcacacucacuggagucuuucuccugaguuuccugucgaacauguccauaagugacccugauuguccccuccagauccagcccucaagugaaaggccaggggcagggagacuggggaacggagaccccagcuuccugaggcaugauuugccuaucgaggcagggaagcaccaggauguuuuuguccccauagugaggagaggggagacccugggccaccucugguuuuguuaucucagggcaccagccaccccagcagcccaggcuggcucucggacucagccccaccacccagccauggcuccccgcaaacccaccccuccucuccauucucacgaccaccaccucacucaggccccagcugcugcugccucucccuggaccccacccgaggccccugcaguuccugcguccugauggccccuugcaccacgcuccacauggcagcuggagggaggaggcuugucacaaugcccguugugcuauuucagcuuugguuauuuaucuuaaagacagauaaugcauuugcgugguugaaaaucaggaggugagaagccucugcccucuucuuggguguccccauccccggaggugcuguucaugagcuccuggagggggccuuccagaaagguugaugcauaccacacauacccuccccuucccguucgcacaaaugcagugugcucaugucccacuguaaggcaaagcacacggcgccaucccguuccauggccaaggagcgucccacagugugggcugugcuggaaccuuccagccagcaccucauggacaucugcauuguuuacggauuuugcugucauagacguuguauaccucugcacacgcuguaugcuuccaggaugcuuuucuuggaaguggaaucauggggcauuggagccucgggcugaccaucuggauccaucccacggggucagagagagcuucagaaacagaaucaugaugucccgccucccacacucacacaucccaccgggcuccccaccacagagcccagcgcagucuccuuggcguggccuguggggugcagccucugaugccuccacccauucccuuuugcucuagcuggagugcgacaccccccgacccuggggucccugugguucccuccgccaggcucugucccuggcucuucaccugccuggcaccugcucaccuguuggccccauccuaaaugcugcuuuugugggcaucuucccugcccacaaggugugacuguaguuucccugugacccccuuggugccacuuguccacguuuauuugcguuugggugauguuccccuccgcagccacagcugcaugucauccgggagcuggggccuuuuucucacagggacccagccccuucucucgcaccuggccucuguuaggccaucgggaaauaccugcugagggagcuggugagacaguggcccugggccuccagcccaagaggcacacauuggccgugggugugcacggaaugcuggcccugagcacggucacagugggugguuucggaggcuuccccuggacuucuggcccaggcugccccccguuaucuuggacaugcuucauuuuucccauccucacguaaaccccugcaacuccucccuaggaauuacaaaaugaccuagaccgggaaacaagcaguuugcaggagcucgaggcucagaaacaggaugcucaagaccgccuggacgagauggaccagcagaaggccaagcuccgagacaugcugagcgacguccggcagaagugccaggaugagacucagauggugggucccggccaccuccggggcagcgcccuaugcacaggcaggggcuucccaaggacuccccugagcucguguuaccugggaacacaacacuuagacauccuacugggucaauagaguuccuccaaacaccacguggaaaaguguccaagcaccuguggcuugacuuccuggccaccccccuguacuccuagaagucagguuguauaagugaauggccuuggucccugcgaacuugugcccugaacacaccccaccuggcugugccccacaacacagggaguuccagggugccuguguccccuccucaggugucucugaggcuccucacagaucccggaggcugcaaccucagaaaacucuaugacguucagccucuggggggauggacagauuguucgugcuuggucaugccccucauuauuccaaagugaucuuccguuagccacagugggaugagcccaucugccuuuucauuugugucucuauuuuggguguagaaagaggccuguaaggaagccaggugucgggccuggguuaggugucugcgucccuggcuuagcuuguuucggggaugggggcuaagaguucuuucucggagucccauuucauccugcacugugaaucucuuuaacaucuuuuaacaucucauuucagaucucaucacugaaaacgcaaauccaaucucaggaaucugacuuaaagucccaggaagacgaucugaaccgagccaagucggagcugaaccgauugcagcaggaggaaacccagcuggagcagagcauucaggcugggcgaguccagcuggaaaccaucaucaagucccugaagucaacgcaagacgaaaucaaccagguacuucacggagucgggucccugccacaugccagggaccagcgagccccaagagccgaggcugccacugcugaacuccuuugcucucacccuuguuacuuacgugagggucucuuuugggaggcuguggugcuggccuggaggcgcagggccaaggacuccccagggcauguuccagaguuuguuggcauuggccuggaggaguucacuuuccuuuccugagcacacagcaucuucaaggaguaggcgggguggggugggaacacuuaauuaauggcucauuuggagagaacuugggguucuuuccagccugguccucacacaaacaagagggacaaagucagagagaugacuucuuuguccuugggcaagagaacagacgucauccuccacagccacugguguguucaggaggcgccacccuggagcaucacgccaugcaggacccccauucucuaagcugccugggacgcccccacccucuucccaguccaggggggggcgcuggcuucucguggccugcagccguugcccuucccugcucuccugugggcaguagaugaaggccucuguccuggcccugggcauccagucuacacagugguugugacacuggcccucgccugugucggaguggccaggcacacuucuuuuaccaauugaacuggucucugucugugcuccauuagccaguuuauaggccacaguugaucgcaagcauggaccgcucagagauuuaccacccuuucuugugcuuuaugguuaauaucuguaggauuacuuucaguguuuucucuucuaacccuuagaguuuguaguugggugucaggagcaaagauauguugcuuugcgcagugcagugccuuacaccugucaucccagcacuuuaggaggcugaggcaagaggaucacuugaggccaggaguucaagaccagacuggacaacauagcgagaccccaucucuacaaaaaauacagaauuuuuuuuguauuuuuugcagagaugggucuugguuuguugcccaaaaauauagguggugacacgcaccuguagucccagcuacucaggaggcugaggcaggaggagcuccugaggucaggagcucaaggcuacagugagcuaugaucacuccacuacauuccagucugggugacagagugagacccuguguuuuaaaaaaaaaaagcgucuuuucugacauguuuuccugacccugcuuaaugcugaugaugucuuuguugcacaggcaaggagcaaacuuucccagcugcaugaaagccgccaggaggcccacaggagccuggagcaguaugaccaggugcucgauggagcccauggugccagccugaccgaccuggccaaccugagcgaaggcgucucccuggcagagaggggcaguuuuggagccaugguaaagguugaauaaacguauuacaguauggggcucugguccccuggugugacagcagaacaucccacccgccagaucuguucauggccaacguugguuccagccaagugcaggcggcugucuguuguuuuugcugccacuuugcgcguucacaccaggccuugcagccuggcacagguggccaugcugaauccuggcuuccagaacaaaguccaagauaggccuggauccuuucagaaccuguuuugaaugcccuccaucucugcggaaguauuuacauugggccaaccacccaaguucagagggcuucucaaacuuaaccaaaauuggaucaguuucugcucauuguggaaaccccacauucuacuaaucagggggcaggggacaucugaggggcaugugucuauguguauguguguuuccacaaggaacaccuugaaaagcaaauguguugcuaaagaugaggaaguaauggcaagcagcgccccaggguguugcucuuucaaguaagaauuggccucuccugaaauuuugguuauguuuaaaaaccucugcacuuuacucugaccucaugacccuggaguugugaucaggccuggggcaggggacugucggccccuuacauuuuugagagcucuugagccccugauaccaagacaggugugaccuuuuccuuagguggucacauccccccuguucacaccagagucugccccugcagccucgaaccuggggacauguaguuucccauuucgucuuggugcuguuccgggagcggaugggccgggccgcgcaugucuggauguuuccuuggugcucugcugccuccagcagcucucuccgugcugccacccucucucccagggcuccucccuggagcccuucugcuccugggccucuguacgucauggauuccucuuccucccuggaauaagagugagcgcucgugcucucuaaacaccacacuugccucuuuauguucaaugcuugauguguuucuuuucucagcagccaaguccucagucccaaggauuuauggggaagcacacgcguccccugggcugcugggaaggcacugcuggcgagcucaucugucucuugugucuggcccccgcugggugcaccgccucccucuuuccucccauacucucuuuucucguggacucguaaugaggugguuuccauagccgcccccgggcccgucaucaucagcuuuaucgucuaaauuuaaacgaugagcauucauccuucaugaguuacgagaagccagaacuccucgcuuugcucccuggcuguucuuggcguguguguuuccgucucacaacccggcuccuacuuuccccaucuggcauuguccccuggcaccgcuuuuggcuuguccugcucagucuucguucagggaacagcuuccucuuaaaugucccuuuugcagguuuuuagaaaccgguuuucuuggauaaaaguuggcagugaaguggcaguuugcaaguggccagugauucccccaacuccaaagacagauuuuuaccuuucugguuauuuuuguucaucuuuugggcagggcaaagguuaccugagacacaauuacuuugggaauguagauuaagauacguuacauggaaacuugcaacuggcauccgaaagaaaaacuguuuuuauccuguuguacaaauacaguuuuuaaagcauuuuucuggcuuguuucuauuucuuaauaaauacuuggaagagagauuuuuguuuacuccugaacacuucaagacugcuucagagccgagagagaggugucuuaguucucccuugugggucgaaguuggggguuuuaggucccugagaauaguguauccacagugguacaucuggaacuuccuauguuuggacaguucuacucagguuacuaaauuccaugugaagcucacgcagugugacuuuaucucaaaagucagggguuuuuuuuuuuuuuuguuuuuguuuuuuuuuuuuugagacggagucucgcucugucucccagacuggagugcaguggcacaaucucagcucacugcaaccucugccucccggguccaagugauucuccugccucagccucccgaguagcagagauuacaggcacgugccaccaugcccagcuaauuuuuguauuuuuaguagagacgagguuucacaguguugcccaggcuggucuugaacuccugaccucaggcaaucugcccgccucgaccuccccaaaugcugggauuacaggcgugagccaccucacccgccaaagucaggguucuuaaagccauauuuauuucuugucuaucaucugauuaugagaauauugaccucuugcucaccauccaaucaacuuauggagagaagcuaauaaaucaucccagacuuaggccuuacugaggacagauuaagaaagguugauugaucugucacauccagacccaguggcaugcuggagccaguuuuuauugacuuuccagaaccgauuauuaaauaggaacuggccgggcacaauggcucacaccuguaaucccaguccuuugggaggcugaggugggaggauugcuugaggccagcugcgugccacugcacuccagccugggugacacagcgagacucaaucucuaaaaaaaaaaaaaaaaccccaaaaagcaaaaaacaggaacuugugagcuaguugcuuggaaacuugaaaucaaccaugaugagacuguuuacaccacaggaauuggcagaagcucuaaaccagggcuuuuuucugagagaacugauucccagcacaccccugcugcccagcacuccucuaaagggcgggaaugucacagaagcuucuucagcccccuuucagaguugccguguguauuuccuaagaaggguacaacuucacacugguugcugaacuuguucaagauauuacaucucugccaagggccgugucauucauccuggcccuugucugcuguacucgugucccccaaguuggcagaugggucuguucuccuuaguagguggucugcaagggguagaguugaugguaucuuuguaacagggaaaucucguuucccacucugauucugugcaauggaaucaaaaccacuauuaguuacccugaccuccugaauccugcuggggucucaggcuuccccuuggaaggggaaggagugauuguggcuucaggccaaugacuccugagaaagugauugcaggccugacugucagugcagggggcuugcagccagcauucccagaaccucagucucuucucugccauuguucacuguuacuuggcagucuuccaagugacgacugaaaacacugaaaaaaaaaaaccuuauaaauaaaugccaauuaaaaacuaaauagagccaggcaugguggcgagugccuguagucccagcuacuugggaggcugaagcaggaggauccuugagcccgggaguucugggcuguagugugcuaugcugauugggugucuacacuaaguuagucaucaguaugguaccuucugggagcaggggaccaccagucgccuaaggagagguaaaccugcccuggucagaagcggagcaggucaaaacucccacgcugcucaguagugggauugcaccugugaauagccauugcccuccagccugggcaacguagugagauccuaccuuuaaaaacaaacuaaauagaagcuuucauucugaggucaagcuggcauucuuaacucgcugcuuuauccaggucaugauuccucucuuucuucuggaacaaauacauuccuccuuccauggggcagugugaaaggcagauuuuccacgugggccuccuggcuucuuuagaguaggacuucuccaucuuuaucugcauccgagacccccaucagacgcuugcugggcgugugugucuuguggucgucagcaccugacguccacucagcacugucuccagcugcagugcuuguggacaucuguacuuaacuugucuaagaacccggcuugguuuccccaccuugggaaaacccuguggucggaggcuccagcuauucuuucccagguaagaaaaaccauuccauguucaucagauggcagggaugugggugcauucuccugaagugggggccgaggaagcggcacucaugcugauucacacucauucacagcccagaccgguggcuugucuuaacucuguaccucucauaacuguccugcaccccuaaguuggcugccccagggugguggcagccuugcuaggaaacuuucuuuuggaccuuugaugucauuuccccacaccauugucccuauuuuuguggacgccccggcuuuuuaaugauuuuguuuuggucgguuggaauacuggacugguuugugaguccuacgcaggaaugccagugugucugccaaauucaaugaggguguugugcuguuuuuuuaauaucacagugaaacauucauguuuucacugagggugugucuuuauuaacuaaaacagaguccuuauuuaaaccaacuguauuguucccauguauaugacaaacccacccuuuucagacuacuucccauuacaaaaaugugcucuucaaaaguaaauauuuuuucuucucguuuaaaugaaccuguuuguuucuagaaauacacacuuuaaaaaaaaaaugcaaagcauuguguaugcucuaguaauucuaacugcauaaguacucauuuccucauaggacagaaacaaccagcauguuucuugguaugaaaacuccauuuucccaaaugcccaccuagguacauacucaccgagaaaaggaugauugaggaaggucacaccucugaaaugaggccugugcugcuguuguugaguggcucuuuacaguuuucuucauggcauuuccaaguuuauuauuuuuuucugacucauugauuaaaaaaaaauuguuuaacuuucagguaaaauagacaaacagccgggcgcgguggcucacgccuguaaucccagcacuuugggaggccgagggggguggauuacuugaggucaggagaucaagacuggccugcccaacauggugaaaccccaucucuacuaaaaauacaaaaauuagcugggcaugguggugcacgccuguaaucccagcuacucaggaggcugaggcaggagaaucacuugaacccgggagguggagguugcagugagccgagaucacgccacugcacuccagccuggaugacaagagugaaacucugucucagaaaaaaaaaaagaaagaaagaaaaauagacauaaacuugaccaucuucacugucuuuaaguguacaguucaguaguguuagguauauucacauuguuguggaacccagcucuagaacguuuucauccccaugaaauacccacuccccauccccccacccacagccccuggcagccacuguucuacuucgucacugugaaugugaugacucuaggguucucauagaaguggaaucauaccuuguguguuguuuugugacugugauuucacucagcagccucuccucaagguucuuccauguuggagcaugugucagaauuugcuuccuuuugaaggcugaaucagauucuguuguguggcucguuacaauuuucuugaugacauuucaaauucauuauuuuuuucugacuuagaaaaaaauuuuguuuuuccguuuauccauucauucaucgauggacauuugaguugcuuccacucaaugauuuuuuaaugaacuuuuauuuuagaauaguuuuuagauuuaugaaaaaauugcaaagauaggccaggugcgguagcucaugccuauaaucccaguacguugggaggcugaggugggaggaucaguugagcucaggaguucaaaaccagcccuggcaacauagugagagacuucauuucuacaaaaaauauaaaaauuagccaggcuugguggugcgcgccuauaguccuggcuacucgggagaccgacgugggaggaucacuugagcccagauggucaaggcuggaguaacccaugagugugcaacugcacuccaaccuggacaacagagugagacccuguuucagaaaaagaaaaacugcaaagauagugcauaguuccucuauaucccacacccaguuccuccuguuagucacaucauauauaguacauuugucacaacuaaugaaccaguauuaaacauuauuauucacucaaguucauacuucuucaaugaucuuuaauuaauuuuuuuuuuuaaagauacagggucuugcacuguuguggcuggagugcaguggcacaaucauagcucacuguaaccuccaccuccuggguucaggcaaucuccugagucaaccucccaaguagcugggauuauagguacacgccaccacaccuugauuuuuuuuuuuuuuuuuuugagauagacucacucuaucgcccaggcuggagcgcaauggcguaaucucagcucacugcaaccuccaccuccuggguucaagcaguucuccugccucagccucccaaguagcugggauuacaggugcccggcacaacacccagcuaauuuuuuguauuuuuaguagagacagguuuucaccauguuggccaggcuggucuugaacuccugaccucaggugauccaccugcuuuggccucccaaagugcugggauuacaggcgugagccaccaugccuggccucauuuuuaaauuuuuguuuuuauagagaugggauuuugcuauguugcccaggccagccucgaacuccuggcuaaaucauucuuuuuagggucaugcuacucaaaguggaaaugugaguuaaguauggaauuccguacuuugcuuuaacucagaaauaauaaaaucccuguccuguuucuucacaaaauuguaggaugauccuuucaaaaauaaagccuuguuauuuagcaacaacacgcaagaguugcauccggauccuuuccagacagaagaccccuucaaaucugacccauuuaaaggagcugaccccuucaaagguaucucacuugcuacccacuuucucauugaaagacuguguguuuuaugucgaauuuagagugguucuucaacuagaaaaguaaggacaugccacaaucugaaauggagggggaaaggaaugccuuuuuuuuuuuuuuuuuuggagacgaacucucgcucucuugcugucagccaggcuggaaugcaguggcgcaaucucggcucacugcaaccuccgccuccuggguucaagcaauucuccugccucagcgcccaucaccgcacccggcuaauuuuuguauauuuaguagaguugggguuucacuguguugcccagucuggucucgaacucuugaccucagguaauccacccgccucagccccacaaagugcugggauuacaggugugaggcaccgcacccagcaggaacgccuuuuaagcuucuuaucucacccuguuaaccagagagccaaggcaucaagauacagugggaaguguuccaagcucaccacaagacccacauuugaaggcagcuuggccagcccccuugaacccuucaguacuucaguuuccuaaucccucagcagguuaauaaauuuccuccuugcucaccucacaggguugauaaaauaaucagagcuaguaaugaucaugaaaguaccuggaaaaccauggauuccuacauaaaccuaaggucuggauaauuuuaggagucuguccagagccacaccugagucaagaauaacuaagaauuccagaaacaagauuuccaaguuucuguccauguuucagagcaaaacaguauuuccaggaggaaggcucucuacauuuuugagaaaaacacugagguggggagagggcagcgggagcuugagcuucagcuuggguuugaagccugccgggucugagaggcgaaucuggcagccccugaagcccaggggugccgccgccucauugcugcagggccggugauaaagugagggacagcccaggguccuguguccucuuacccagggagcuggcaggcagaugggauaaaggaaacccagcaugggaagagaggagugaauucuagcccacucugugucuuccccaacuccagucugugugggacagccagcaguaccuuccuucucaucuuaaacauccuagccagaaacagcugccuccuccaggucccccucuuugauuugccaagguuuugagggcagguggauaguagagaaggaacuaacauucucucccuacacuggaggaguagaaggcaaugaaaggcuugggagguggguggcuguguccaagggcccggcccgcauccugugcccuagagcuaauaagcauuucucuccucuuccaaccaggcgacccguuccagaaugaccccuuugcagaacagcagacaacuucaacagguaaaauucaguguuucccggaccggucuuuagacuguguccaguccuggcucagaagucgcauguggugggacuuguguccacauacaccggggauggcagccauguaacugggaaggacggccguccauccauguuguacccauucucggucccguucccuucuggagguggcuccccuccccagguccagucacugcccgcaccccacccuggaguguggugggaucacauugcuugcuaauuuauuuauuuauuuuauuuauuuauuuauuuauuuauuuuuuauuuuuuuuuuuuuugagacggagucucgcucugucgcccaggcuggagugcaguggcgcgaucucggcucacugcaagcuccgccucccggguucacgccauucuccugccucagccucccaaguagcugggacuacaggcgcccgcuaccacgcccggcuaauuuuuuguauuuuuaguagagacgggguuucaccguguuagccaggcucgucucacacucuugaccucaggugaucugcccaccuuggucucccaaagugcugggaugacaggcgugagccaccaugcccgaccgauuuauuuuuuuucaggugaaauuuauguaacauaaaagucacuguuuuaaagcauccaauucagugguauugagcacacucacaguguugugcaaugaucaccuucaucuaguuccacaacauucucauccccccaaaaggagaccccaucccaaucagcagucacuccccauucccucccgcaaccccuggcacccaccaaccuauuuucugucucuauggauuuaccugcguuguuuauuauuauuauuauuauuauuauuauuauuauuauuauuauuauuauauccagcuccugcaggauauuuuauuuauuuauuuagagaugggguuuuacucuauugccuaggcuggagugcaguggcgcaauuauagcucacugcagccuugaccuccugggcucaagcagccuuucugccucagccuccuuaguagcugauacuacaggcgugugccaccacaccuggcuaauuuuuuauuuuauuuuucucuguguugcccaugcuggucuugaacuccuggccucaagugauccuccuaucucagccuccuaaagugaugggauuacaggcaugagccauugugccuggccaggauauuauuauuuuuaaagucaauuuuauugaguggcauaauuuacacagaacaaaauucacccauuuuacuauguaauaagaugaguuucauuaaauaugcacgguugugugcaauuugagaacacuucugucauuccugaggccccuuuguugucacccuccacccucuccucaggguccccuggccaccauuauccuguuuuccgucacuagcguucuuaccuuucuagaauuucauguaaacggcaucauucugugauguguucuuuuaugucuggguucuuucacuugguauaauguuuacuuauggggcauuuuuccuucuagauccauuuggaggggacccuuucaaagaaagugacccauuccguggcucugccacugacgacuucuucaagaaacagacaaagaaugacccauuuaccucggauccauucacgaaaaacccuuccuuaccuucgaaggugaguggggugggacguugcccgggagagcugcgugccugcucugugugguaaggguggcgcuucccgaaggcccccuucccuucguggagcguacauggugccugcgagugugggccauggugucuguucuccgggagcugguaucccaggcugauuucauuccugcugagugagggagcucacuggccuagucacugcagugacauccugugagccccaaggugcaguuagcaguccaguggccccacaucagggcaaggaggaugucacccauaguucuuauuucucuauccccauuccuaccccucaacucuagucaucugcccccacugccccuucaucucccaaaaaagacuaaaucacacaagcaccacaugcucgcauggacccggccacccugcacgguccuuguaacacacagcacugguggggaccuuagagucacguuugguaggugcucccgucacggcaggaguaagugcaggcgucucagcccggcugccuugccuggugucuccugagagcaucagccaacucugacccuccaguuuccaacuccagcauaccuguacucccauccccgggcguggcagacaccggguauuuugcauauuaugcccaagagauuggguuaaauaggugucaacuuggauuucaaaaccaaaaaaaaaaaaaaaagcagccucggugauggagcagaggauguucaugauggagugagcgugcuucauagccuucuuccguuuucuaggcugcaacccaggcccggggccugcucagagacgggcacucacccuccuucucagggcuccugcuacccuggcgcccaccucgcucacucccuguggaccuuuuggucuuuagcgcuugaagcuccuugaaggcaaagacucauuugcaguauuuucuuauuggccccuuuuuaauguccuuaagaccuguagugagaauuucccuagcauuccugguauuggugaucuguuuaccaauuucauugaccuuucccauaaccagcuuuuggcuucauuuuucucuacugcuuguuuucuauuucauugauuuucucuuuucuauuucuauuuuuuuccauuuccuuacuccuauuuauuugggguuacuuugcucuucuaacaucuuaagauccaagcuucauucauuaauuuuagacuucauuuucuaguacuggcggucccugacuuacgaugguucaauuuacaguuuuuugacuuuacaauaguuuuaucgagaugcagucccaucauaagucaaggagugucuggacuuaacauugguuugacuucugauuuuuugcuuugugauggguuuauugggauauuacguacauuuucaacuuaaaauauuuucaacuuacaauggguuuaucaggauguaaccccaugguaagucaaggagcaucuguauaaauuuaaagcaacauauuucccuuaagcacugcuuuacauguauuucauauauuugaauacuuuaucucuucauugccauucaguuuugagauauuuuccaguuucccuugugaauucuguucacuuauggauuacuuaaaaguauguuguuucauuuccagauacuuggcuuuuucuccuagguauauuauaauacuauuauuauugauuuuuaauuaaauuuguuauuugagaacauauucuguauguuuucaauaccuucacauuaaucaaggguuguuguuuguggccuauguuggugaacaaaccauguacacuugagaagaauguguaucuaguuguuggguguaaugcucuacaaauggcagugagguugagguuccucauaguguucagauaaucugugucuuguuuguuuguuuuuuaguccuaccagugucugagagagaggcguuaaacauucuccuaugauuguggaauuguucauacugcacuuuaauuugaucaaguuuugcuuuguguauuuugaagcuuugucaggugcauagguguuuaugauuguugugucuuucugacacaacaaccuuuuuaucauuauaaaagauucccauuugaucucuggugauguucuuugucuugaagucuguuuaaucacuucauucuccucauguuauucacuacaugauacaucauuuuucaaccauuuacuuucaacuuaccuggaucuuuaaaacugauaggugucuuuuguaaguagcauaguguuggggcuugcuuuuuuuuuuaaaauccagucagaagucccugccuuguaaguguaauguuuaguccauuaacauuuaauguaauuauugauaugguuuaagucuacuauuuuauuauuugcuugcuuuuuaucccauguuuuguuuccugcuuucuuuugaauuguuugaauguuuuuuugaauucugucuauuggccuuuuauuauuuuaaucauaccucuuuuaaugauuguuuagagguugcuuuaggaaauaucauguacagcuuuaacuuuucauagucuacuugagguuaguauuguauuaucucauguaaaauauagaaaacuugcaaccauguagguccauuuguccacccacccuugcagccagcaugucuuauguuauagccgucaugugaauuucauacaucuaaauacauuagaaacuccauaagacuguuacaauuuuuguauuaauccauuguggguauuguaaagaaagaggaaaaaaguagucauuuaguuuuacccaaauauguaccauuucugauacucuucauuuguuacugaagauugguuuucccuccauuaucauuuuccuucagccuaaagaacuuucuuuagcacuucuuauagcucaggucgacuguguugucauuuuuuuauuuuuaguuuugaaacagagucucacucuguugcccaggcugaagugcaguggugugaucuuggcuuacugcaaccucaaccuccugggcucaagcaguucucccaccucauccucccaaguugcugggaccacaggcauguaccuccacacccagcuauuguuuuauuuuuuguagagaugggauuuccauauguuggccaggcuggucucaaacuccuaggcucaagcaauccuccugccucagccccuccaaagugcugggaucacaggcuugagucacuucacccagcuauuauucuuuucuuuucuuuuuuuuuuuccaaccuccgccucccaaguucaagcgauuucugguuaauuuuuguauuuuuaaugcagauggaguuucaccauguuggccaggcuggucuugaccuccugaacugaacucaagugaucugcccgccucguccucccaaagugauagaauuacaggcaugagccacugugccaggccuguugucauucuugaaggacauuguguuugauguagguuguugggguuuuguuuguuuguuuaguguguuuuuccacugccuuccagccuccauuguccuuaaugagaagaguuuuuguuuguuuguuuguuuguuuuuuugagacagaguuugcucuguugcccaggcuggagugcaguggcgugaucucagcucacugcaagcuccgccucccggguucacgccauucuccugccucagccucucgaguaguugggacuacaggcgcccgccacuaugcccagcuaauuucuuguauuuuuaguagagacgggguuugaccauguuagccaggauggucucgaucuucugaccucgugaucugccugccuuggccucccaaagugcugggauuacaggcgugagccaccgugcccgguggagaggaguauuucuucaggucauuguuauccuguauguaauaggugguuuuucucuggcuacuuucaagauucucucuuuaucuuugguuuucaguaguuuuugaaguuucuggguguaguuuucuugguguuuauacuguuuaggcuuugcucagcuucuugaaucuguaaauuaugcuuuucaacaaauuugauaaguuuucauugccgguucaguggcucauuccuauaaucccaggacuuugggaggcugaggugggcggaucacuugaggccaggaguucgagaccagccuggccaacauggugaaaccccgucucuacuaauacaaaaauuagccaggcgugguggugcacacuuguaaucccagcuacuugggaggcugaggcaggagaaucgcuugaaccugggagucagagguugcagugagcugagauugcaccacugcgcuccagccugggugacagagugagacucccaucucaaaacaacaaaacaaauuugguaagcuuucagcugucaguucuccuaauuuguuuuuucugcccaauuuucucuccccucucuuucugggauuccaguuacauggauaugagacccuuuguuauugucccacagguuccugaggcucuauuuauuuauuuauuuuucauucuuuuuucuccuuuuucuucagauugaguaauuucuacugcucuguuuucaacuucacuuacucuuucuuuuauucuugguuauuuagcuaaccuaaugaagugggguuuuuuuuuguuuguuugagacagagucucgcucuuucgcccaggcuggagugcaguggcaugaucucagcucacugcaaccuccaccuccuggguucaagccauucuucugccuuagccuccugaguagcugggauuacaggcaugcaccaccaagccuggcuuauuuauuuuucaaacggaguuucacucuuguugcccaggcugcagugcaauggcauaaucucggcucacugcaaccucugccuccuggguucaagugauucuucugccucggccucccaaguagcugggauuacaggcauccaccaccacgcccaucuaauuuuuuguauuuuuaguagaaauggguuuuaccauauugaccaggcuggucucaaacuccugaccucaggugauccacuugccuuggcccccacagugcugggauuacaggcaugagcuacugugccuugcccgccuggccaauuuuuguauuuuuaguagagacaggguuuugccauguuguccaggcuggucuugaacuccugaucuugggugauccacugaccccggugaugaaguuuuuauuguagauacacuuuuucaguuccggaacuuucauuuguuucuuucguauauuuucuauuucucuucuaaggucaccuguguuuucacucauuuuaaguguauuuuccuuuuccucauucagcacaguuauaaucaccguuuuacguugucccugucucagaguuccaccaucuggguuauuuugagauuggcuacacugauugucuuuuccggugagagguggucacauuuuuccaguucuuuauauguuuagaaauguaucugauacauggugagcguucuguguagagacuguagucuguuuucuccaaagagcaggaauggauuuguuucagcaggcaguuaacuuggugccacucacacugcagacacucaccagcagauggcagaagcuccaaucccagcucaguucuuguggccucagcuacaggcugccucgaguccccccaggcuugcgugugcagaggccagccugagacuugggggagaguggaucaugaaguucagggcuugcaucuuugcaucucugccccuccaucccgauuccccuuccuuuccccugggagugguugucucugggcuccauccucugguggucagauucuaccagaaucuuaggcacccucacugugccuuccugcuguagcuggcggaauggaaacucaaccuccugcuauguucuucugccacauucaaauucuccuccaaagucuucuuccugucuuguucacuucccagccuucaggccacugcuuuuuguauuuguaauuuuggggauauuccguccagguugauaggugcuaucugcaggaggguugaucuguugggauuuuacucugccuggguugaguuuuaaucauuccacuuucccucuggcucagcacuggauguuguacaucgacgucaggaaggucugguugaaugaaugggugauggaaccaacgaacugcuuuuuacucuuuccucucuccuuucauuuagcucgaccccuuugaauccagugaucccuuuucauccuccagugucuccucaaaaggaucaggugagacccaugacuuauuuuucuuccugacuauuccuugggcaguagcagagcucccccgcaguuaacacuuucacucccaaagccagcguggccucuguguuugugucaucagucaguggcacccagauccuggccugagcccauuaggccaaaacaagcacccgcugcugcuccccuuccugggcacgcgcuggcaucuuuccagaaaggaauuuuggcaguaggaauucaguaauagcaccagugauauuaacuacuguuuacucacuccuccuuauaaaucuuugguuuguaucuuuggguuuuuucccuaaaagaaauccagaauuugaccccagguacuggccuauguuguggguucuguguuugaaggaaccucaucucacaguguagaacucgcagaugcacgcucgagccuuuaugcaaugggagcaucuguggacacccccuuucuuuugggaacaggccccgcuugguccugcagcuugcguggggcggguagcaguguuugguaucauaggcgaguguauccaguacucuaggcaaaucccuuccagguuagaggagaaaacacagcaaaaaccucuauccaaagacaccacccuguauaaaucauguggguggcaggucgcccuggaguugcuccucgccuccugacccauugagacccagugggacccaggggccacgccucuguggcaacuugucacucuucugaugaccgugaaugaugcuggcccucccagaguggucgucacagugagaaaccgucuugccaugccagagugggcaggggggccuugcugagaggccuucaugcagacacacgugucuaaugaauaaaugcagccuuccugagucuccugguucaggggccaucuagcauuuccccuccaccccagaaggcauguucucuuaaagaccuguaacucugacuuuguuggugccgauugcagaucccuuuggaaccuuagaucccuucggaaguggguccuucaauagugcugaaggcuuugccgacuucagccagauguccaagguaaagccccuccacggagcccccgcgccucugcuagugucuuugugccucuugucauggugugggcugccaggcguaauuguucaugucacguauguaucuccccggcaccuuuccaacacaaggucaggucuggaaagcauccauggcugugauccaaugcacugcagucccguggggugagcccugacccuucccaguggcauaggugcccugggcuccccuggcucccacuggugucugacgaccaucaggucucagacggugaagucauugccauggccgaguagaaacuugagaaggcguugggcacaggcgucucgagagggccaugggcagcaggccugcaggugcgaggcguccagggaaagugggccagcgaguguucagagucgcccaugugacagaacucucaagggguguugaaaagugagggccggccuccuugaauaaaugcagacagauccacaggugaggagugaacuguugaaggaggacagcagcgaggcugguuaccagacuggacccguugguguccggcccucaccacacggugaccugaacucacuguggcucuggucccagacagcuguagggcuucuccagacgcuggcagugugguuggagcucaucuuuaagguagcauagagaauucaacagggaacauccagaauggacaagucaaaaaacaacaauagaagccccuuacgacugaggugccuuccggaagaaacugcuggaaaguuggaaaugggggcuguggugagugggaaggacagggcugcggcaccauugugcuuccuugugaguuguauguuucccuguuugagugaggagcauuuuucuuuggcaggaaugaaggaaagcagaugaggugugucccgucccugacaccugcguccacucugucccuucucggcagcccccaggcaggggcagaugggcucugucuucggggggcugcaggggccugcuuuccucacgaguuccaccugcagaggcccaggcauuauccacgcugcgggaagaggcaguagccacaagcagaacacagccccccuccuggagcccauggcccaggugguaagggguggccggugugggggguccccuggagcagcugggcccagucccugugagcgcugcugucagccugaagguggugaggggagggagccccgggaguaccuggaagacgcgugccccaggcaugaggcccccucggggccccaccggccccaugcccaggugccccaggugccagugugacugggcagucucccuuggcugccccguguucacucagcugguggagcagaugagucucugagcaucuugggguuggcagcggucgcaacuugugaucacagaacacagauuccgagaagcacuugagauucuguucagguuuucaaagacgcgugugugcgugcccuggcggcgcagcagaucccacuucugaccgaggcaggguguguguuuacacagaugagccugggcagagggagcccagaggcccuggcauggcgccccccuccuuccagcacacggagaaggccuccaucccucauaugccacgcugugacacgguuugggacuggcagaagauuuagggcccagugcacaggcuccugggcaggcgggaaaccaucucccgaaagcagaaaacguuggccacacgguggcagcagucccucaggcguccuggucguuucugguugucgcaaguggacuccucuuccuuugggaggcuggaucugucuuccuccucucacugugagcagagggagggagagcuagcagagccugagcuagggccgggaucuaaugaccgcccucugccuguccuugggcccugaaaccaggggcucuucacacacaugcagcugugauuucagagccggucucacuuccuauuggcggugccgggccaggacagaguuggacagagcuguggaaaaugggucuccaauacuaucuuguuuugauuccagcguuccaucagcugccuucaugacacuuguacagccgcauucugagcucaacccugaccuugcagcucuguuuuuccuuuuugguuaccuaucuguuuuucaagaacaacauuguggauauaaauaaaaugcuaagggaaaugaaaguggcaagaagguguuuuuuuaaaaaacaaaaaaaaaccaucaucaacuuuuccccaucugagcagagcagggaggcccuuuuguaagucccugaauugaagcaccuuaccucugcguggcuuugcugaggagagucacagcccacagccugauucuagaaguuuccuuugggaggcucuucgggccugcacucuuaguugaggccccacccucaccugaagagauuuuucuagacaguaucaagccuaugugacauaagcucacuuuaaaaacagauuccccaaaguauguuuccagggagcauuugagaauaaaaacaagaguccaacuuauuucacccucuucugcccugaaaaaaaaaaaaagccaucugugaaauacuggguuagucgucagcccauuuuuagcaacuucucaauuguuuaaagcugugcauugauauuuagggcugcuguuuacaaauucagucuucuguuuugaaccaguucuucaacuggugaacucaaacguguuucucuuagagcugguuuucauaguagcuuuuucugucuuccuuuuauuuuaagcacacuucacucuugccgagcccagagagccccugacagcuuuacugaaaccuuucuaaaaauagagauuuuccuugaagccgcugcccgaguaggaaagaguugaguccccaaggaggcuucuugggaaacuugaagucaugaaaauugggauucggaaaugacgcgggcauucuggagcuaggagugaucugauucacugcggaggcagugccaggcguuuauugaaagccugucgccucgcgaguugccaauuggccucguggguuuaaacacacaugggaggcgccaagccggcuuggcccgagguguccccggucagccuggaggguuaggcggcucugauuugagugugucaccaggucuuacaacuuuggacguccaggcugagugugguuuuauugcccggguccuauugcgcgacacagaggguagaaaggcucacugcagccacuggaaccgaggccccacuccgagucuggagauguggcccagaagccagcacaugcccagggaggacaaggcccagccggucacaccacuucccaucuagaccugcuuggcuccccaucccaggccgcgggggacucgcacgggcccuaggcccagggacauguuccaugaaucgcagaagcacccacagacgggccaguguuuuucccccauucuuucccaaacagccgacccuaaacggcccauuuuaaagcuaagcugcaggccgacacugccccucaugucucggacaggccuggggacaacuggggcagcagaugggggcacucccagauuccaaucgcagcuucguacuuggugugaucauugucgugugguccaugugccaacuuuaucuagugccagugaguggacugaugccugucacauggcaccucauuuccuucuugccggagccuuccgagcucugucacucuugccauuuuacagaugaagaaaccaaggcacaggguguugaguagguggcaggguugggguuccagccugggcaggacagucugcccaggacgaggcccuggacccaccacugggguggcccucggcagcugagggcagcgucugguggccccagccugggaggcagacgauguggcagcccuggauccgccguggaccugcugugugaugugggcaggcugcgccuccuuugugugccucaguuuccuuguguguaaggcagaggugcugacagugggacccccugccaggucacugggccuauuauuaggugagaagaucagcacagagcgagugucuccugccugggcagcuucagagggcggcgugaagcccagggaagggaucugguggggucaucugugcaggagccuuuggggccccuuccccucccugggggcaccugccacugcccuuaucggggggaccuggaauggguaggcugccucuuagaggggccaccucccuguucugucucugauguggcucugacugggccgagcaaccucgacucuaggacuacacaagguccgaggcagccauaucucugugacgggacgcaaauagcccagaucgaugcaucucuguaacuagaugcuagaggccuagaugacugcaucucuauaacuagcugccagagacacagguggccacgucucugacuagacuccagaggccuaaacggccaugucugugcaacuaaauuguagagaccuagagagucgcaucugugugacuagaugccagagccucagacgaccgcaucggugugacuggaagcuagagccucaaauagcugugucagugugacuggaugugucagugugacugugucagugugacuagagccuuagauggcugcgucugugugacuagacccuggagccuuagauggccacgucggugugacuggacgcuagagccuuagauggcugcgugugugugaguagacccuggaaccuuagagggccaugucugugugacuagacacuagagccuuagacggcugcauugguaugaguaaacgcuagaagccuagacggcugcaucugcaugacuggacacuaaaaucuuagacggcugugucugugugacuagacgcuagagccuuaaaugaccacgucugugugauuagacgccagagccuuagguggccgugucuguguggcuagaugcuggagccuuagauggcugcauugcuguaacuagacacuggagccuuagauggccgcuuuggugugacuagaugcuggagccuuacacggccacgucugugugacuagaugcuggagccuuagauggcugcgucugugcgacuagaugccggagccuuagacggccgcaucuguguaaccagaugccagagccuuuggcagccgcaucugugugacuagacacuggagcuuuagcuggcugcaucagugugacuagaugcuggagcuuuagacagcugcauuggugugacuggaagcuagagccucagacagccgcgucuaugugacuagacacuggagucuuagauggccgugucugugugacuaggugcuggagccuuagauggcugcauugguguggcuagucuacagucuuagacagccacuuuugugugacuagaugcuggagccucagauggccacaucugugugacuagauacuggagccuuagaccucugcacuggugugacuggacacuguagccuuagacggccacgucugugugacuagacgcuggagccuuagaugguugcauuggugugacuaaacgcuggagccuuagauggccuugucugugugacuagacacugaaggccuagauggccgugucagugugacuagacgcuggagccuuagucagcugcaucggugugacuagaugcuggaggcagaggcagccauaccucuaagacugucugcuggacguggugguagaccuuuucccccacaucugcaaucuguugcauucagauucucgagggaaacccugggagugugccuuuguacucuugaccuguucucugucucuaggccuucccugcuggggagaaaguuaaagacccccggccccucccuccaccucugccccacucugaucuuucucuucuaugcucuuggaggaacacaugaucuuuuuuaauuuuuuuuauuuuuugagauggagucucgcucuguugcccaggagugcugcuguggcgggaucucagcucacugcaagcuccgccucccagguucacgccauucuccugccucagccucccgaguaguugggacuacaggcgcccgccaccacgaccggcuaauuuuuuguauuuuuaguagagaugggguuuuucaccguauuagcugggcuggucuugaucuccuaaccucgugaucugcccgccucggccucccaaagugcugggauuacaggcgugagccagugcgcccggccaggaacacaugaucauuuuuaccccuauuucugcccauuccuuuuguuuccugucgcaguguuaucucuuuguccuauaauuuccuaguuauuuugcauuuuuguaacaauguguuuccucuguuaguaaaaauguaguuauuuucuauuuuauuacagacuuaauuauuuucuguuuuaguaagagugguuacucauccuucuucugcccauagaaagugauuuucucccuccugggacaccccagccccuucccucagacgccugagauaugcuggcccuucuguggcugauggagacccuggcuccccugugccucaccggcgcuccaagugagggacaagcauccccccagguggcggcgcuuaguaucugcucaucacaggccuggaggcagcaggugccggggagaggacugugcuugcccuccaggugggagaggccuggaagcgugucucuguggcucagugagcagugcaggcguggguggcaggaagcagccccagggagagcccugggagagcucugggggacggcagugggguccagccaggcucugagcaaggagagggguuccugguggacgaggugggccgaguuccccagcaggagaccugaguguugcaggacuuggaaacaggaggcugagucagcggcuggggggucaguggguucuggggacuaaggaggcauugugaggggaggggugacuucagaggugagccugaaaaaucaggcagcuggggcagcgaugaagucccugcaugccuuaaugagagcuuggagcuucccuauaggaagugccuaccuaccuaccuaccugcaagacgucgccacauaucugccucccugucuaccacccacccgccucccugucucuaccugcccauccauccauccauccacccacccgccauucauucguccauuaauccacauauaugucuauccauucauccaacuaccauuccauccaucugcccacccaccauccauucaucuauccaauuguuauaacuaucucugacugucucucucuuuaagcuggaggauaugguccgauuuggguuugagacagcaggugugggguggaggauguggaugggugugauggaggcugaccgaggguccgggccagagguggucagagcccaguggagguggcgugggcaugcugaccagugcggguggccgggcaugugaggaugcacuuccaccugaggugcugcaugugcagcccagaggcauggaggaagaaagucuggugccagcugacccagcaccuggagcuguccaucacuaacugaaggcagugaccacaccggccagcucaguggggaggcggcacaccagggcaugugccaagcaccacagccagcauacaggugaggguggggcgugucucugaaguguaagcaggaggcccaagggacccuaugugccaaguccuggagucaggaaagacccagugugccucgugugacuggggaugcccuuggugcuagaagcccguggagguaugggacugcucucugccacccuauguugggcagcucaucacccacaggccagagggccccugcuguugaggguggaggaaagcauggggcuugaaagagaccccacguccaagcagggccauguugugcaguccagaggguaggaggccuugccagggcccuuggagcaugagcgucuguucaguggacauccgucaccuuuguuuuaacaacuauuuuugccucucuuucauguccucucuuacagcccccaccuucuggcccuuucaccuccuccuugggaggggcaggauucucagaugaccccuuuaaaaguaaacaggacacuccugcucugccuccgaagaaaccugcuccuccacggccuaaaccgcccagcggucaguaagcuuucuucucucgcagccaccgccuaccggugccggauggcgggggaccagggccucccugcucaccagcccagaguagcagcagaugccgugggacccuguguggggagcaagaggguccccccggcccagcugcccagguccacgcaagugccguaugugcguggugugugccuccugccugcccgcccucgccccguccugugggccccugggcuucuggcucuguauuggagugcacaaagccuuggccuuagagcuccccuuguggcugggggcgcuucgugcggccuccgccugagcaugucagugccaccccgacgcccuggcuauacuucaggagccacucauggccggcagcccuguggccacucuggccccuucucuuccguccuucucccuguccgugcucagggagggccuguugggggugaggguggcaggagucgcugcuugguccagucccuucccagcugcuucaggacugagaguggagggagcgggagauuguccuugguggcaucugaugugaggaggcaggauggcucggggcuccccucugccccagcuugcccaggcaucucaacgcacagcucugaggaggggacuuccuacaggcccugccccucuuccccauggccagugcugccaaugucuccuagccuuggcccucgaggguccccugaggauucugaagcccuuuaacucacacgugggauuucucucguaugacagaguuaggccggcggccaguuggccagacucucaaacagaaagcuauugcuucaaguggcagaaggagucacugcagcucccugauccauuuaucuacccggucauugccuguuccaucugugccccggucugggacgccuccuauucucuaaccuccaggcagacuguuccccacacugucccugaauugugggcagccacaggagacccacgcacucccaggaucaugccuucuguuaccugucuucccuagauagggcaugcccccgagcccuuuccaucagcuccagcgagggaaguggugcucacccuccugccuacacgugccccuccccuggaaucugccacuggccucacuuugcagccccugugucaucgcagguccuggaauggaccuagcaggcuccgcaugcccccagcucacuaguuacgagugacccucgguccugcaccucggccaccugucaguagaggugaacauaggggaaguuauuuuuagaacaccgccucucuccuccuguccccugggcuggccauggccuucucucaggaggauggggacccagcccgcagugcccagguuggcuuucuuguggaugagucaggagaaaaaguaugaccaaguaugggcuguguggauuuagagcagauuuucugugaacuguugagcagauacagaugcguaaagagaucauuucuguaagccacacaucaaagacauuuaccaucaggaggaaaaacaaaacaacaaagggacucccuuccaucugcaagaggccaccugugccuuacacagaggcaguggcucuucagggauccuuguuggcuuccugauggaacggcagugggccucuucacucugccuaaaagaugggagcagaagcacacacacacacacacacacacacacauauaugcauaaucacaaugcaugcacacagcuggcacacaugcaugugcacauucccacgugcggccauguauuuuuaugcauguaugugcacguacacguguaugcucuugcaugcacauguguacccuguguacacacauccuccacgccugcagacacaugcaugcaugcaccuguuugcacaugaacacacaugcauacaggugagcaugcauucacauacauacugcaucacaugaguauucucgcaugugccugcauguacgcauaugcaggcacacacgcacucucccaugcaccccuccgugcacacucuccaugcuuauaugcaucuguggacaugugugcauauucucuugucaguacacacaugcaugcauagagaugagcagcaugcacucacauacugcauugugcaugccugcacacacacaugcucucauagauaacagcugggcaugcacacccuccaugcuuauauaugugcaugcauucauugagacaugcacauauucacaugugaacauauacaugaauacaggugagcauuacacagauauugcauaaugcaugcaugcaaacgugcacacacauaugcgugcgugugugcucauacacacccgggcaugcacacucugugcuuacauacguguacacacauuuacacacaugugcacguauucucauaugggugcacacacuugccgagcagugccguauuugcugggcccugaggaggagccaucccacucaacagcucacaggugcaaagcuucauuuucaguguuucauggaaaccgccacccccgccuccccacguaccuaaacccggcgcugggucugcuuuugaacuuucccucaguuaucaccucccaucgugucucccucugcaagccuacccaccccaccuuggcuucugcuguuaguguacugugggcuucgaaagcagaaaagaaugcuuguuaaaaguagaacguuugauaacgggaguuugggugacuuccuugggccuggcuucaggguucaggcuuuuuagggagcuguugcacaauuugagacccaggggguccugggcuccuuuacucguggcacaggccacugcaucuuuguucugcugugguugaugguugcugugccacucggugcucugcagaaauauauuaacauugaugggcccuuaggaagugcuugaacaguucuuaucucacuaggucccagcaagacccgugagggagacaggccaggccaugcccauuuccuggaagaggaaaggcggggagggaggucaugggggcuccccaaggucacacagcaagguggcagcagggccaggucuacacccagugaccugccuccugccccaagacaggaguaacgagaaccaagccaugagcuucagaacauucucuaaaacagccaaugcacgcgcagcauuuuaaguccggagcaacugcagaucuguguggaggccuaaauauuucucauuugauucuuuuacccagaagcaauggcugaacagaaaaauucugcauuguacucgcugcugggugguagguacagaccguguggugguugccguuugagcuugcagcauuauuugugcugugauuccguacuaaccucuaacaguccaaacacugaguugacccagugguugaccuuuggugagucacauguuggggagaaguguuuggcucuuuggggaauugcaaaggaagaugcuugcccuacccuugcucucuggucaagggaaucagagccgggcucuguacaauucccuucccgguuccuggccacacggcacagacccacgugcagcccaggaggccucugguuaugggcaagagcggucagcagaugagugucgggugaagucgugcucagaaaguucgccaggaagacacaaggcagaucucuuguuuucuuggcuucuuuaagacagaagauagugaagcuaaucugugaauuuuuuuuuuuuuuuuuaagcauaaaguccaacguuuucaaacugcuggacuuuauguuuucuuaaaacaaacaaacaaaccaaaaaaagccuuucugccuuucuugcuaccccaggcuuuuucugcucagggagaccacacggccagcacacagugacggccgccuuccccuggccaccccagggcuucccagaugcuggggcuuugcgcgagaugcgugggucccagcguggcugagugaggaggaaggugaaaugcgacccccugugagccuggcggucgagccuugagcugguggagauagacagacugacaaaaagucugaaggacccauaggcuguccagugggcagucuuaaacaugcacacagcguugacaccugcacucauggaaaucacaaugaaggaacaagcuuuucugucaucucuccgccuggcacauggaacaugucugaugucccaugcucccauccaggguuuguccaucccagggcacccagagguuucuagaacccugcuaggccucugugccaggaaauggcugaugugugaggccaggacaggagaacugaggccgcuuccuucuguccucugggcagccaauucugcuagaauccaggggacugcuugaucaggcugguuucuggacauuggaggaaagggaggccccgggugggucacuuaaccucccugagccucaguuuuccugccugaccaugggacccacucaggccuagcaggugggugugugggugaagcgccuugcacggugacgugcuguauguggucuguagcccccauccccacccugcggcacagggaccgggacgcaggcuucugccauaugggcaccuuuuccaggaaagacaggcugggcagcugagguggcugcacacauucugggagucauuaauugggcccuuuucucccugugaggucacaguuuaguggaaaucuuuuccguuaaaaaaagcgugcagggaguugaacuucaaagagggcuccagcguccucugugggucaucgcucauacaggaccaaaugugaguuugggucugagucacguguggcuuuggugccaucucuuguguucuagaggcugcaguuuucaaauuccgugggagcugcuugucuuauuuuguuuaaaggucaauugaggugaaauugacauuugguguggcuggcaugcagugugggugcacgggcagacagguguugaccuggacagucacagguggaccccuccaccugggaaccugcagagguuccucgagggagaguuccggucacagcguacagcugaguagcccacaguuggccaucugcccucaaggccacauacucaguucugucuccaucuaagccagaaagugcacucuggggaccaccaagggccaucuccuggggcaugcauggagcuuuggugugggcacuaaguucuucuugccuggaggucuuuucaagaaagguguaucaagguauuaaauaaccagcaggugucuguuuugggcagaagaaacugguuucuuucaggcagaugcagcacagacccggcaggcugccgaaaccugucaguuagaguuagguuaaaguuagccguggcacacaccucccccagguaaacaaugguauauuuucugcaacggaccggagaucaagaucagucagagcucaccgcugaagaguuucuagguaaaaguuguugauuugcaaagagagaaacagauuuuuuuuuuaagugcaggaaacggcugugugggugucagugauugggccucagcccugcugcgauagugggauccugcgaccggccccacccuugccacuuccugccagcgcggcccugcguugcgguuccugccugcagcgcccggugacaccagccagcgcaguucuaccgcuaaccagccagucaccuuuaaccucuccccaauuuaaugauuauuuuauuacugcuaaugaccuuuucaccuccuaaacaaagccgcauaggugauggugaugagcaugucuuuucgcccccuccccacaguugcacuaacgaacagcuuuuaccuaaguuuaaccagcggcuguccuguuugauuugagcagcucucucaacaaaagaagaagacaaaagucauucuuccccuugcaaacaagccccucccguaccuguguguggcauccacccaggguggccgugaguucuugaccucccugccgggggugccacacaggaugcagccaccgaggaagcccugagguccuaagugcugccagcucucccacuucucugaaaugccaggccaacaucgaaaccagggcucagugaccucuccccaucaugugcccaugugggucccaaaaccuuuuguugauugcacaagauccacuuuaaaaauggcaucuccauuugaacccugcgguuagcaccucagccuugaacuuaacuacuucaauuucguucccacgaugaucucagagagauaauccgguggguacaugugaaauucuacaaugggacaagugguuccaccaucucaaggggccuggaaaauucuggcacuugccugccagccaggauggggagggggucccaaggagccuaaaacggccaaccagguggagucccucuuuccugcccacgccccccaucccccagcacugcuguguucaaggaagcuucagagcuuccgucugagcccucuggaaggucugucuuagggcugggugggaccugcugacggugccaaggaacggucccacucugagagggaggaaugucagccuuguauguuuaaacugacugcaggcagauugccguuuggagcacuuucuguucuguaaagaccacugaguuugaaaauagaagcauuugccuuccugggcacacuguacccagaggcggauccagggagugucgugugacucgauuaucaucugguguucaguggggugcaaaugcugaggccuggggggcugcaggguggggugcaggccuagaguggcugggcucccaccccagcaucugaguauaggugugaacagacgggagccaucgcccuggggacaucggguguaccugccuccaggacaccucaaccccuugcuuggcaccugagggaggugagggcuggggcagacgccucagaagggggcucugggugcagcucugggcaccgccucccugcuuuucuggcggggugaacauggccccucaucuuucaucucuccuauucaaagcccugagucagcgcgccccuugccugccacugcuaacugcaaaauaucacaugcacucgggcaauggggaaucuggccauaaagagagcaaaagugucccccaccaugggagcuccuggugggcucugcgccucacuugcuccccucccaggggcucuuuuggguccuuucaugcacgaccccuaaccagcuuucagacucgcugcacggcguucucagggaucuuguuacaugugggcaaggcgccuuccuacccuuugcagagguggcgucugcgacauuggcacacuccguagggaggaacaaagcugggcccccuugcccugucagggcuccccgugccuggcucaugcauagauagcaucucucccuggaaauccccccagaggauggggcugacacccagggguguucacgcaggguaugucaaaggugcccgccagagaacaaaugcgaauuuucaaagaagccagaauugugacaccugccagucuguauuauuuuugucaugaagacuggcuugugauuuguaaauucauuuccaaaucacauaccccacccuacacacacacacacacacacacacacacacacuuuuuuuucuuccagggcuggugcagcccuugccuggcagguuuuauguaaaugucaugggagccuuuuguggugaccucuagaaaauuguuauuucucacuucaaaugauauuugccuuuugaggaccccaaggcacagcaccuuuuccccacuuucuucuuuuaauggcaagaugaggccacagccauuggguucaacagcccccugcccaccucacacaccucacagggcaggaaaacacagcggccagcaguggcucguaguaaauauuuguucagcuuuucucaacaguucagaaccaaaccucauccuguucccuucaaugcaugaagcagauuuucucaaaauucgguaaauauuuuuaguggaaaaucucaacgcugcgaucgcagggaccucagauucuuaucucccggggcugugcugcuugacacagcuuugaucuaaggcagagugcgcgcggggcuggugccugcaggacucccagccugcaggucccuuacguggucccgugugucacauuguaaaaaacaaacuccccucaugugucuuagaugggagccagaggaagacguugacguguguuggggaaaagcacucuuucaagacaaguccccgagcagugaugaauuuuagaaccuauacuguuuucuuucuccccucuccccgcagcuaagcuuuuuuucuggcaggauggggaggguggaauaagacaugucaguggccuuggaugagcucugcuggaguggugccccgcccgggccacugcucuccuaggcagcgugacucucagaaaccuggcaguuguaugggcaucuguguuguguaggaugaaugacaguugugguugugugggaucaccuguuguguagggugaaugacaguugcauaggugucuguguuguguagggugaaugaugguuuugugggaucaccuguuguguagggugaaugacaguuaggugggugucuguguuauguagggugaaugaugguuuugugagaucgccuguuguguagggugaaugacaggugggugccuguguuguguagggugaaugaugguugugugggcaccaccuguuguguggaaugaauaacaguugugugggugugcauguugugcaggaugaacgagagaugugugggaucaccuguuguguagggugaaugacaguugugugggugucuguguucugcaggaugaaugacaauugugugggcauccucuguuguguaggaugaaugggaguugugugaguguccauauugugcaggaugaaugacaguuguguagccaucuccuguuguguaggaucaaugaugcuugugcauguguguccccuguuguguaggaucaaugaugguuguaugugugcguccacuguuguguaggaucagugaugcuugugugugugugucccauuguguaggaucaaugaugguuguguauguguguccacaguuguguaggaugagugagaguugugugaucguucuguguuguauaggauaauagcgaaggugggcagcuucccugaccacaaacccuuguuuuguauuuuuuuguuuucuuuuuguuuuuguauguaucucucaucugcagaacugcauuuuccaaguacagcacugaacugaacuguauaaacagaaccuagccaggaucaaacacacacacacacacacacacucucucucucucucacucucauguuuauuacuaauauuuuuauuaaucggauugauugagaccauaccucaccugaaccuuuuaugcuccuccuaagcaaaaaauuuaaaccaagagaguuuccuuuccaagguuuuuauagcauucaccguuuuuaugguuugcaauuguauauuucuauucaauuuuuuguuuguuuguuguuuuuuggguuuuuuuuuuuuuuuuuuugcuuugcacccagcucuugaggaugcuuuuaagcggagggcuuccugcaaagcaagauagaaaagucagaaccuugaaaaacuuugcugaccaagaacgcuagugcagcagagccagccccaucacagccccgaucccgggugcuaggggcgugcgcagccucgagaagaagcuugagaaauaggagaauuaaagaaauuucuaucaggguggagccggccaccaaguuuuuuuuuuuuuuuuuuuuuuuuuuuuuaacagcacauacugugguaaaccauuugguucauauuguuuuugcuaaagucaguccugugugugguuucgguacaccgcuuggguaacuguugaaacugcugugguuugaaaauaaguucuauuuuguguuuucuucagucuuguaucccuugcccccuguuaaugaagucucccugcgguaggcagucagcacacccaagagggucuuuaauuucauuugucuuuauucacugccgucugcugugguccccgguaguucccgcugcaaauaucuaggauugauggcaucgaaccaggugccaggaugaugccuggcaccugguuugaugccaucauucccagauguuucuauacccacuuuuuuggguuuuguuuucaugauuuccauccccuuuucugaaaugcgcgucaguaaagcucucuccuuacucauguuuucuggagccauaaaaaaguauaaaacccuggcgugggugcgcguggcagcuuuugcuucagggccuggaggcagauuaaaguuacuuugucacguuugagauaagcuauaccucacaaaaucggaaaaaacgauuaaggaguuagcagaagugguuacauaaaagcaggaacuagaccuagaagguuugaaaaauacagccgcuaaaaauaaaucgcugagcaaaagugggaaguuugggcugagggccguggcccuacagugaugccgggggcuuucuuugcucaaagcgucuggucauuagcaaggucgagagcuggaccgggcacucggcugaccucacacgugucagguccaaaaucuccucucuuaccaaagcacaaacacuaacaacugagaaaaaaaccguuguuguuguugauguuccuucugaaaacaagaggccagcaguugaugugcccugguuucauauuaccauagucaugauuucuaaauaacaacgguuucggcaacagagcaaaaccaggcacaggcaguucuuggugugaacgaagcuuuucaucucucugaacaucucuuugcgcaucagaaaccucagcuugaaaugguagcaggcagaauucuuaaccgcuccucccaaaaaccaauuucuuuuuuuuaaaccccccaaaccaagggaggaagaucuucauugaaaagaagaagaaaagcagcucaaaaaugacugauuuauuugaaccuucuguaccguggcagucgcucuugggggccuggcuggggcguccucccuuuacaccucccuccacauucuugcaaaucugccucaggugaucacucccugcaggaacggcuucgagaaaucaagcaguguccacccuggacuugcugcccgucccagggggcuacaccguguccugggacuuugagcuucuccccuggaaacacuuaacuguuuccucugcuagaaucuugcuauuugauccauaucacauagguauucgaggaaaaaucaaauacccaagcaugcacaguaacauugcuguuuccugcaaaccaggaagggcagaugccuuuauucccuucucgcuccccaggguguugcuccaaagggccccaggucccuggagacccguggaaucuguaacagguggcaccugguucaccaggaccuccugaagcccacugugugccgagcccugggcuggagggcaccagggacauggggcaguauuggcuggcauuugugguaugcugggcccgcuuuucacagagcugacccucagccgugccagaggccagugccacgggaagcagaguggugagggacccugggggagggggggcuuucccguggagggagaagcugggcagaagcaggcaggggcucgagggacuggcugaggucacugucccuauccccugcaaacccacaggcuggggugcaggacacugucacacugucccccagggugccccugccgguggcuuugguggcucccugcucacacuugcucuaucucagccuaaacagcagacauggauugucccgcaguucuagaggcucaaaguccaagaucaaggcgccagugggguugguuucuucugagaccucuccuuggccuggugcaucuucacauugcuguucuguguguagaucuguguccuaaguucuuucagugaagacagucauugauccuuugacuucguuuuaacucaguuaccccuuuaaauaugcuaucuucaaguaugguuauauucuaaggcacagggguuaggacuugaacguaugaacaauuguuggggggacacagcccuuuguuuggauuaagaaacaggcugagggggguggccgccaugccccacaccgucuuccagggccacucccagccccagggcuuggcugcagagcugaacacaggcaugauggggaaggggcugccauuucuucccugagaaggccacugccugugauggcauuccaguugggagugccuuccaggcagagggacaaggcauagccaggaaagaagcccuggguuuggggguuccuggggaaggaggugccaccuggacaagacuggggugucauccccaagcgggagaagcccucaagcagucugggcagggugcuggggcccaccuguguugaggccacuuugcuggguggguuuggcucacagggaagggagccgagcuggugggcggccgauagggagaugaggcuucuagggacgggaggguggaggugaggggcccucgcccacccuccauccugcucaggagcccuagggagccccuucugcuccaguggacagccuggggcucacaggaggcugggcaggccucacuugacccccgcccgccagagcugccugcccgucccuuaggagagggaacggggcaacuccgggagaccuggcagcgaggccuuggcuuaccauuggcucaugccugggaccaggaguggcccugcaugggaggccgucucaaggugggggugugaggcaguuccucaaggccagcggaaccagcccggggucugcgggcugggccagaucacccugcucucugcagccccggggaggucgggguaggaggaggccgcaguagagcugaaggugggagggacaucuggggauagaaaaagggagacaccuagaaagcucggguguggggacugcccugagagggcaggcgcugucggaaggagaggggccacauuccuguccugcccgcgugggcugggcacugccccucuagggaagggucuccagcauggcuugcccacaaguuuuggcaaagauaggccccuuccagauugcagggcccccucugcuaacugggccuugggucugacagugaauugauuugaggccacaggaggagacugauaccaggccucgaccuccccucuuucucauccaugugaguccuaauagagcccaggacagcucgcccuccaacccugaggaggagccucuuagauggacucacacagacaaggagucuggaaggaucucccgcagcugguggccagaggucagcuaaggaugcaacggcgaccccgguggaacccugugggacgggcagaggcggacaggcaggccgcaagggugggcugcaggggaguuugucuccgaguccuucugugcaaaccgugggaaggaagacuguuuuuccuugaauaugcaaaaagaaagcagcaguccuuaugcuggcccagaacugccgguugagagaaaagugaauuuccauuuccagaaguagggcuacaggcaagggggggcuacgggccagguucucacuggccuaugcugggcacggcggugcaggacacugagugggaggagacuccuggaccccaggaaugucaccuuguuuggcgcccuccuucucauuuccacuucacagauaaggaaacggaggccagcugggaggaggcacuuucccuugccgaggcccagagcuaaagguggcagaugggggcuguagccccggagcccacaaggacaccuggggccucaaaaaugaggccugggauggcugaucugcugggggaacagagggaaaggcuuuagaucugggcauggagagggaccgaggcuggccugugugggcucguucuaccggaugaggaaggcaggugucccaggcucagguggugggcggggcagguguggcugggagccagggugcucucuggaggugcagccagagauccaaggucaacccuggagggacaggcaguuccugguuuuuucuaaacauuagcuucgaaacuuccagaguuaacacgccggaaucguguugcauauuauugagcuuccagucuggggugcugcguggaccacguugaaugcccagggacuccguugggcagauagaggggugucaggagcauggagucagcccggcuggccugcaaacugcagaugcuggaaggcccgucaggugggaccucccgucaccaagcagaucuuaacaggccucugcuucuugguggaauguucugguacauuggcaggaugcacugggaaaagcuaccauccucaggccaugucccccacacagugucauuuuccuccauuucugaacacuucucucucaccucccugucaagauauaccuugcugggaccgggcauccuggaguucccugcuuggcagaagcccagaaaggcccagauaaacgcugccccuuggagccaccaacaccagagggacagaagugggggcuaaaaaagaacuuaaggccaggugcaguggcucaugccuguaaucccagcacuuugggaggcugaggcgggcagaugacuugagggcaggaguuugaggcuagccugggcaacauggcaaaaucccaucucuacuaaaaauacaaaaauuagccacgcaugguggcucaugccuguaggaggcugaggugggaggaucgcuugagcccuggaggccaaggccgcaauaagccaugauugcaccacugcauuucagcccaggugacagagcaagacucugucucugaaaaaaaaaaaaaaaaaaaaaaaaaaaagaacuuaaaccucagcauggcagagcugugugcagacccuuauaacuaacacaccgaauaaccauaccacguugugaaacuaauuccuccuuuucauuugcaaguaacucuccccucugccuuuuuuuuuuuuuacuguuagaagcuugcaguguauuuuucugcucagccaugauuuuuuaaauuaguauguuaauaaauguguugccaugcuaaaaugaaucuguuugaaacguaccugcaugcaaacuauucuaggacaacucaaguuuuagcugcucugugugcguuguguaugggagucaucugaaguguuuuuccuguguuguucacaacccguuaagccccugggauaaagcugauuaaaacugggauuccccaggguacccccguccagccuguuagccaaguuacaagcuuuucucagagaagcgccccgggcuugugcccaccagcauucugcucuguccgggugaguaacucauauuucuuucuuucuccuuuuuuuuuucuccuaaacuuuccagguaaaaguacaccuguaagccagcuugguuccgcagacuuucccgaggcccccgauccauuccagccacucggggcugacagcggcgacccguuccaaaguaaaaagggguuuggggacccguuuaguggaaaagacccauuuguccccuccucugcagcuaaaccuucuaaggccucugccucgggcuuugcagacuucaccucuguaaguugaguccuccgccuccgggccaccccacucccuuccgcuugcagcuucccugggauuuuugucuccuuuuaaaggcaaaccucccagcuucuuuagccucuugguaccucacacucucugucccucgcguuauuuauucuacacugccacuucuguaagaaaaacaguuucucaau

SEQ ID NO: 191901 - RNA, 53298 nt, Homo sapiens
gguuugugcaaaugguuuuuuuuuuuuuuuuauuuccacauuuauaucacaagguguccacuuacuggaccaaauagcaaaguugcucccuucugcguccugagaacacagaagucuagguacuguacauucacuaaggcuccuuguuuuugcaaaucgcguuuaugacaaauaaccauaaggcaaacgaaucuaaaggaaugguuaugaguguuuccagcguacagacaggucuucccccucgccccacaguacagcauaaaaccaguagcacccacaauaacuuuuguguuguuuuggggggacucuagaaaggugaaguuuucuagauguguacaggaagggaaaaaagaaaagggaggaagaaaggaaagguuuuuuugucugguggucugauggaagaggaauuguuuaaaauaaacaugagaaaacuuaaauuuuugcagcauuucuuuaaaaacuggguuauaacugaaaccagauauaaacagguggcugcccauggagugugggucacacuggcuggccagcuggcccgccugcccaaugccaguggcucaccacagcugagaagcuucuggcacaugacagacaacacuggccugacaguggcuggguagggagcaaacagaggcaguggcauggcccacugucucaagacacucagggccaaauuaaagaacagaaaaugcaagagagaugagaugcgugcuucuguugcuguguuaaaggugaccucucccacagguuuucugugccugccugcaacugaggccccagcuuucaggugcuggaaaguguccgcaccucuuugggggugagggacuaacgcuuuuuauagcugguuugcuauagaguucugaacucacuuugccguccuuccuuccacgcgguccuucuucgcaauuuuguuaguaaacugguagcagcauuucacaaaaagaguuuugagggaagagcgcagagagaccgcgugacucccgcccccucccucccgccugggccggacuccccgaguucccagcgcaggaggcagcugggccccggccaccugcccaccugccugcccgcccacccggcuucugcaagaugggaaugcacuuuguggcugacaggccggucaguccaagcagacauaaggcagaauguucaagcgcccgucgucgccgugcggaucgagcgauaugcacugcguccagucauaccaguuacccuguguguccugacacccguucacccccggccacuggcuggccuggauucugucgagaucguccugugugaccucccgggucagaccagggagguccgugggcgggcuuugaggcaccagcacaugcagcugccuggccccuugccgggugcucuccuccugcuucagguacucagacaugaaguggugagccccuggggucugcgcgcccgaugaugagagcaggcugcucugccggcucagguaggacuggaugaucucguugcgugacagcuccuuccaguucgucuguucgaaggggcucuggaggcuggccuuggccuccugcuuguccagcucuguccuggacugcugcuccaugugcacagggcugucugcccgcacuggcucuuucugggucagagguuugaucugucucgucauggggucaaaggugagcuuccgcucuuuuaaccggacaggcuugacgcccgccucagccaccugcccguccaaguuaaccguauagucucgaggucgguaccucuucuucuuuuuacuguccgagcccccugaggaggcagcaucacuguccgccuuggaggagucuggggaaaagccugcccgggacaggaggggcucggcuggggacagcccugccuugcagcccggccccgccagccgcugguggcucucaggcugcucaagccagcacacugggcuuuccgcacugggcagcagcucgagccgccguacgggggguguggacggcugugccaguggaagcggugacggcaccuguguggcaucgagugccuggggccgcggugaggggcugggcacggagcccuugggugcauacaagcucugcugccgggcaaaggagcccucaugccgugaguuccgaggacugaaagagcagcgagggggucccuugggauggggaggccccggagucucguccacccuguccagcugcugcagcaccgaagccuuuggcugcaagcaggguccagggggcuugcccaggcccggggagcuggugugcggucgcacggcguugacggggaucuugccacugugcuugucauucucgucacgcuccaggcggcugcccucugggccugcaugcccacugccauccagggagcuggcgaagcucucuggacucccacugaucccguugguggggaggggggaugaguuggggaccagggggucguggcuagcuuuggagaccuuggguggcggcccuggguggccgaggucacgcuggucaccccggcgcuugcggcugcccagccuguccagccgcugcccgggcagccucuggaggucauugcggcucuucaggucauggaugcuccugggugggccagccgcccccaccuccggccggcaguugugugcgcccccguuggcagagccgguggcccccgccagcccccgcagcgccgccucaugcuggugugccggcucgaugagcuucugccagcuccgcagcagcuucuuggcccgcuuggcgagcuccucguucuugguuuucuugcggacgucguugaugagcuucccaagucguguuuccuacaaccagagggagaugaugacauacuuucgggacaggaacuucuccaugagcugagccagaaauggugggaaguggcccugacagugaaaugacccgguucccacugagcccuaaacugccagcuucccugacacaaaacuucuggggauuuccgguccuuugugacaauauaaauucucaaaccuaguucccagaccuucagggucccagguggcuucucagcagugcugucacccaggcuccuggugucagggggcuguggaccaucaaggccacuguaaggacacugccagagaggcuuccugggugagagggugcuguggccgaggcgacagcacagaggguccgcuucaaguggaggguuggggauggugccucucacuggagccuccuccaagcacaccucuccugauguccccacgugcccacgaagugugcugggcauguaggaugggaguaacaccacuuggucucugcagugcccgugggagagcaagaucgcgaggcacgagcugugagggcacaccgccucucuugguccuccgaagcaaagacacugaugcucccagaagcugcggaaggaccugguugguaccauccccugccccccguucugcccucccaaaugcuggggucugggauacucaccucaagugccucuuugguaauaggguauuucuccaggcuggagaugacuuccagcaccgccaccauguuccggaucuguggaaauaaaaagccauuugucaggucccuguccuucuccacugggaggcuggaacacccugccccagccugcuccagucucuccccaaccccagagcaagaggagccagcagcacugaagcccccacuccaugucgucuccuaccugcucccugggccaaccuggcacccagugcucauccucaccugccgucugaccuccuccaguguguggugugcgggcugccccaagcccuccaguguacaugguacauacccacccaccugcugaaacccaggaugccuguggaacaagagcugcuccugauacuuaagaugaccucuacucugccaucugaugggagugggagaggagacacggaagaauucaucgaauaaaauccacaaagcuuaaaagaucaauacacaggccaggcgcgguggcugacaccuguaaucccagcacuuugggaggcugacgaaggcggaucagaaggucaggaguuugagaccagccuggccaacacagugaaaccccaucucuauuaaaaauacaaaaauuaguugggugugcuggcaugcgccuguaguuccagcuacuugggaggcugaggcacgagaaccacuugaacccgggaggcggaggguguagugagcugagaccacaccacugcacuccagccugggugacagagcaagacuccguguaaaaaauaauaauaauaauaauaaugauaaaccagucaaucugaauccaaagacaccauaaagagagcagaaagucacaaagugggagaaggcauaggccacaggcccccaaggagcuguaucuggaacacagaaugccuguacagcaguacagcugaccaggagcccggcguagacuggccacaagacaggaacaggcacacggcaaugaaaugucagugcugaugcucagccucucagcuuuaucgauaaucaggaaaacucaaacugaacccacaaauggauacaugauacacgugccccacugacaacacuagguacuucgggggauacagcugacuuuggggacugcugggcuuugucuggcagagugaagcaugaacacaucccaugaccaaguaaucccucccuuuuaggaucuugcuaggagccacaccuuguucuaagcacuucccacacauuacugacucccuuaauuguuacaacaagaauuccuaccacucaaccaccaccuccagcaacuacagguuucuggugggcuggcuagcgggugggagcccaggggcccugaggaaaccacagugaguagauuacucaacucccccccaccccaacaugauaaaggaguuaagcgggcacaugauacaaauuaaaacagcauaaaagggcacacaaggaaaugggcaucucugacccagccacuguagcauuuccuugcauuuuuuuccaaaaauaucccuuguguauauaggcguauacauccacacuuaucacauauuucaaaaccaaacugacagugguucuugccuuuucugacuuaaugucagcaauguccagccucaaacagagccccucauuuggcucaccaucccuuccagaguggggaaggcccgacuugaaugcugugggacacuuaggcacuuuccguccgccauuacaaaauaaggcugcaaccgacggcagugacagaccugacucugagcuagugcacagacagccauggaggagcuggggcuccacauccaugcaggguggucaccucacccccagggaggcugcucuauuccauucccaccaggccacauccuugccaagacugcguggcaagaguuuccguaacacaugauuguaaacuuagcaucuuacacagcacacauuuaucaucuuaggcucuagggcucagaaaucaggucugagucucacugggcugggauccucucuagaggauccauuuccugcuccuucagguguuagcagaguucagcucuuauuuuguuuuuuuuuuugagaugaaguuucacucuugucgcccaggcuggagugcaauggcacgaucucggcucacugcaaccuccgucuccuggguucaagcaauucuccugccucagccucccgaguagcugagauuauaggcacccgccaccacgcccagcuaauuuuuguauuuuuuuuuaguagggacaggguuucaccauguugaaggcuggucuugaacuccugaccucaggugaucugcccuccucggccucccaaagugcugggauuacaagcgugagccacugcacccggcccagaguucagcucuuuacacuacaggaaugaggcccauuuucuugcugguugucauccgaagccauucccagcuucuggagggcacugcauccagcucacacccccuccccuuaugcucaaagccagcuacaggcugaguccucacccggcaucucucugacccagccaggauaggugccaucucuaaggacucccugacuaggcagggccugcccagaugaucucggaucaccuccccaucuccaggcuguucccuuagucacaucugucauguacgguaccaugugcccaggcuccaggacuagaauguggacguccuugagggcuguuaauucugcuggccucauggauucuggcuuuucuacucuucugccccacuuccagugggaggcagccacugccacucccucccuucccguguugucuccucuggguguaaaguugcagagccacgacagcaguccccgcagaacucccacaaagcugcccugccaaugggcccauuugcucuuuggcaacaacggccuugccuugcaauguucuccauucagggcuccaaaugacccugaaaacccugcuucaagcugugucaugguggggguggacgggugauaugaggggagauacaguccuguccgcacuccucgugcaaugggcagggaucagugcaggggaagacugugcgaugaggaggccagucccagacagacagcaaggccaaccacucccugccccaggcacuccagcaccgacucagucccugggcuugccacauggcuucaccuccacccugcugaccucacccugguauauuuggagcccugguuccccacauacuccugaagcagcaguccuugcagagcagaacacugcccagacccagcuagccugguggcacaaaguguccuuguccuugggcagacaccauccugcugccagacaagagggaggagacagaacaccugggcaaccccagggucugguacugagcuggugccccagaaaucaccgcugaacuaacagccagucccaagagucuccuggaaacugugugggagcuggggacaccaggcgaaggugugagggcccugugacuguguauccuuacccuuggccccuccccugccuuaugagccacgcuuaagcgugugcagagaggccuucagccucuaggagccccaagggaaaugcuacagccuuggcaguccccuuucuguccccaccgugugagcugcucaccugaggaguagaggagcccgccugcucuaccuguaaggugcuagaaacccacaguccuacgccguaaacagaugaacucugccaacaccugaaggggcagaaaauggauccuccagagaggagcgcagcucgcugcuuccuggaucccagcccggugagacuggagcugacuucugagcccuagagccugagaugauaaauguguguuguguaagacacagagagagggugaguguccagugcggccacucccuggagccagcagaaggcagucagugaugucagcagagcuaaggaugggggcaaggugagacugcccugcccugcgaccucuggggcauugaugucaagcagucugaacacuguguggggagcaccaccugggcauccagacacaggccucccaggcccaggaggcagacacugagcaaugcagcgaggaaucccugcaaagggccuggccccgaccccaggcacacugagccagaaggcuccacagagccucuuuauagauggccacagucugucccaaagaacacuuagcacccaauuggugcuggucccauaggagcaaaauaggagcuggcuucugacccuggcccuggggacccugccuuaacaaccaacugaccccccacccaggaguggcaggucucccacucucauggagguggcccucugugagugacagagacaccaggacucguauguggcugaggggaggcucccgcucugacuccaggccugcuaaguccagcaugaacccucagggcagggaggcaggccacagggggagggcagcaccuaagguggccucccagggaggucaaaaaaggauguggcagaacgagcuguguccaccugggcuggagaccgacuuccaugcuggaaagcagaaaagagcuggagaaggaugggcagggagcuggccagacagcaccaaagcccugcggcaggggagaggccauggguaaggacaccgggaggaaaaacagacccaaaagacccaagguggcuccuucacaaccugucuucuaucccccuuagcgacugcccccacagaccaccugcccuugcccuguuucugggaugcccuuggcaccuguccaucuaucuggggaaguacacuagauccuaaucucagcacagacacaguuugacuccacauggggagccgcuccaggcgauggccucaaaagauggcuuuaaggcagcucuucaggcuugccagggccaugucuguggcccgauggccaauugcagccucuugcugucaggaauagccuggcacaucugaggcccccuccuccuuuggauucucccuugggauuuguucccaguccaaaaaaaccucucaaaacaccugccaaguugcuuucccaaaggggcaggaaucccgucaggaacuguagccucucacuucuccacuagggaccccucaauagaugcagaugggucugaacuuccuuaaccaucaacgaagacaggcguugccuccccuuucuaccaacacugaccgccccugcccacuuaauuugcuucaguuuggccucuucauugcugcgggaagugccugugaagggcaaggguguuggguggggguggggggugucgacagcagaaccuccaugcagcuacuaggagaagcagggguaaaugcagcaaggagcacucuggaagcaggugggaccucccuggggugccugcuccaaaggcaggcagggcaggaaguuagcaggugggaccagguguggcacagguauacaugcagguccagcccagccgccugguacaugaauguugauggaacugacuccacugucacaccgaacacuuucaggucuuagaauggaaauccaugaggcaugaucagguacacaugggccaauaggaaugugaacauuaaucucguccuucuggaaucucagaaaaaccaagcagggaggccuggucucaggucauaggcaucacagcuagcauagauacugaggaagaacaguuugcauccaggcagagggugaacuggggccaccagcacaacccucagcacacaggugccccacacuucagggaugccccaggaacacacgcaugggggcauggaggggacaacuucucgcccaagaccacaagaggucuggcugucccagggcucuuuuguggucauccuuccacaugagaacuuaaaaaggcuuccacgggcgcgguggugugcaccuguaaucccagcuacucgggaggcugaggcaggagaaucgcucaaaccugggaggcggagguugcaaugagcugagaucacgccacugcacuccagccucggugacagagcaagacuccgucucaaaaaaaagaaaaagaaaaaaaaaaccgaaacccaaacacugcccccccccgccccgccaaaaaaaaacaaaaaacaaaacaaaaaaaagaaaggcuuccggaaaggcuggcaccuuuguccccagagagccccauagccugugcuaagccacaauuccagccagccuaacuggugacaugugcuguucagcucacaggaaaugugaggaaggaggcggggcuggacacgcacagagacagccugagggaggggccagcaccccucagaagcagccugggucaggcgccuggagcugcgugagacaccucauucucccacacccugggagcaguggggaacccuguaugcgacuucacagcacaccacgcuccgugugagcuauuaaagacccaccacgcauccucgucuuucagugacacuuuccugaagaaauaauacaaucuggaauuugcuacagaaucauccccuagggugagugacaggagggggaugggugaaacaaagucacauggcuguaagcagcuaucuacugaagcaggaugguuaccuuucucuacuuuuaugcuugaaauuucucacaaauaaagaugagaaaauacaucuauuuccuagcauuuguuugggagaguucacugaucuagaaggacuggcagccaucuaaaggggaagugagcaaauagcuguuuccaacuccucauaguggcuucacuguccaccaucuggccccugaguggggcagcaagggccgagggcuggguaggaugccaccucccuccacgugagccugucucaagucucaggccuccuaacugauuugaacugcacaacaccaucuaucuggugagaccccaggagccccucaccaagcuccccuacucugguacugggcugcugcuuaacagaccuggugcagaaacagcaggcaccccuggggcuggagaggggagcucugaguacccaugccagcuguccaucccgguccgacucucagguguccucacgccucucuucuaaaggaaaccacagagagcccgaaccaggggcacacgcuaggucgacaguuccuuccugcagggagaggccugaccuguaccaggaaggagcccaggacagccaccaccacagagaggacaggcccucaaguggcccagaccaggagggaggacuuggcaagaaggggugggggcuaggucacucucuuccagaaggggagaaacauaacaaugagccagcaguaacccagggaagggacagccgucacuccaggaccugcccagccccagucagcaccaccucccucccaucugcgauccacauccuauggcucugggcacagcugagccacaggacacagccacucagaacuuucuuuccagguuucccucaaaggccagccagcagcacuccucuguggcccugugaaacccagugacaccucugaccccuccggaguccggaagacuagacucuucugaaaacccaccuacgacagggugcguggaaucaccuuucaaaccaaacuccugucggcaaauauuuuaauugggccacggcauguguccgaguuuuucuucugugaagaggaucacugggucugagugcaaagcuggggccuguucaguggaguggacccgcuacuggccaaccucuuccucgcuuuauuacagggguguguaaguaaaacccucaggcccugaguaauuacugcuggggauuuccagcccuggucugaaacaaggaacugagacugaguuuugagucccagcagccccuuggcuugccucuccauuuucuccacaucugaacuguucccaccccgccugagauccccagccucuugggaaugcagcugugguagcaaaggggaaacccugugcugcccaaggucugaccaaccaauagucccaagggugcugagccugggcaggcccaaccgggcacaacucgcacaggaccaucacugguggguugcccuugugccaaguucuuucacgucauccucacaagcgcacucuacagauaagguaacugagggccaggaagguaauggaggucccggguagaccacacagcuagaagauggugaggccuggccuuccacuagccugacauggcuaccaaacacacagggcccaucuggugcuuugaguagguggggugaaggguaccaggugccaccagccuguggugaugucggcacucuguaaagacucuccugacgugcuccugcagugaaaugcacagguuacaaacaguuccuugaacccacacagggccaccuccacggucuccguguugucuaugccuuguccccaggaugccugagaggcaggaccagggugacccaggcaugcacgggccaccacagcagggcuucagauggcacuggagcccacuccccaccgggcuggcccugggaacagugcacauggagcacagacugcaguucugcacucccccaccucgguguccggccagccuuccugaccacccuggacggugggcggcacugcccuggcagccugugggcccgcaccugugccccacagcccacauaaccugcuccuugggcucaaaacagccccugcugaggccucaguggcaaagcaccuguaaaaaccgguucacuuuaaaaacaacaauggggauguugucggguuuuuuuuuuuuuuuuaaugcagaauggucuagacaguaauuuacaaaaacuacuuagcucaaaagacuguggaaguguucaucagcaagcaagcuguccuuccaaacccaaacaugccacagauggcacccagaaacagacagucugccuucaaugugcuaagcauucuaaugccguccgcggcugagucaccucgcccaccccccaacccccaacacacagucgugucugcugaggacacacgggugaaucaaacagggcuuugcugggagagugugugucugugauuugguucccgccacaccaagucuuccugcuucugacaaacuccgcacguguucccaggcagcugggagccaaacugccucuggugcaagucaguacaagaggcggcaccugcauccccaccccaccuccaccccaagaccccagcucugcccucccucucagcucuggaaagcgcagcccugaggggugcugcugugcuuacccucaggcgggccccacccugcacucuccgcucagccucauggggcuggugcagguccaccaggcucugcccagugaaggcaccuuccucugaggggaccucaugggagccucaaaccccaggggcaaagccucaaguucacagcuucucagaggaagaaugacacugggaggaacaaugacgggaaggugcaugucucggccacagccaccaagcucaccacuugaaaagcacuuccugcuggggcccuccugcuacucccaggagcagccggccaccugaguggucugucauguccauguggcccucccuguccugcagccacagcuccuguaaugcuugggcaaguaugcaauugcaugcuacaacucagcccgggggacgggaaaugccaccugaguacaggcagcacgcggagcccugacugaaccccaugagcaacucagaaagaggaagcccagggcuuggggcagaaguaggagcuccaucaguaggcaugccugacuucugcagcgagggaaacuugcagaugaagccaggaggcaggcagcgcugcucuccacagccacugcccccacagcguccuucccucccacuuucuguuuuuagcagcucuucccaaccaaacuaccaaccuagacucuccugaccucugcuucaggucugcagaacuuacgauucuuacugccauuuggcccuuugugaaggcacaagagcucucaaagcucaucuguaaauugacucguugcuacgcggauagaacuggagcagugggaagccaagcggaguccuggugauagcacgcugggugggggcuucucccucucagccucucucuucuaggagcagcugauaagaaugccagcugcagaagacuggaaaugacccaacauccucgggggaaacacacacacagugcucggcccauauauguuccgccaaagacagagcccaaauaagaacgagccagcuuuucaggaaucaacagggaacaaccuucaagagacugccaagcacagagaugcacacaacagcgcacccugugccgccgccuggaagauccuagcugaggcugggcagacaaggaccugaugguugagccgcgcauagcuguagcaggggaccgcaccuggccuccagcacugacgcaagcaagaccuaucacugacuggagcccaguuccuccucugagagcaugagaaaaccacaagauggugucuguagagcaugaauggugugcuggagaccacgcccccaggggccaggccacgaggacccgcacacugcacuuucugcugggcugcucuguggucuguaagauccauucaggcagggcagugcccagcacggugccuggaggcagccucagaggcccauugagagaggaagccgaaggagagcagccccccgccugccuguccaauugggcugcuguaagauccugagaacuagugaccuucuagaauuccccgagacaagucaucaaaugcucucugagcaccgacugcacacaggugcucuaccaaacucugggcccgcuggaugcugggagggggcguuaggaucccuguguacugacccggaggaguagacagagacagccaaggucaagaacagaagcaacagauaaaaugccaccacugaggcucucacccaggcugccaggaaaccccaggggaggacuacacuuggcucagguccagggccaccccuucccccacagcuccugggcucuguguggagcuggagggacaggagugggcacaggggccuucucauugggcauuccugcaacgagggccacggugcagagaaccaaggacacugucacccaagaaagagucuggugacucuguggaucccaugguaaccaccauuuaaggauggacacucacgcuaugauccagcaauuccacuccaagcagcaccuacagaaaugcacucagagcagcuguaucagaacagccccaacugaaaacagcccacgcagccaccaacagaacaccgaauaaauaaaucauggucuguccauucaauguuggaugaacaaacugcugcuacacauaaccucaaagacaaaucucaaaacaacguugagucaaagagccaaacacaaaaaaacacauuuuuuuuuuguccuggauuaaaaggucaaaagcaggcaagacuucuagauggugagagcagucaggguaguggcaggcagagaaugacuaggagaggacguugaagauggcuucaggggaaaggcucuguuccuuaaccuggguggacugggguucucagauguguucauaaauguucauucagcuguaaaacuugggacuuguacacuuuucuagauguauauuuucuagacuauauuuacaaagguuguuaaaaauaaccuacugugugugaauuccaugaucuuagaggccaccucauccuacagaaacagauggugaagcugucaggguuguggaggagggggagguguuggcaaagcagccccucguuccccacggcccagacccucugagagccccacagaacaaggucugaaaacagcuucaacacaagcccuggccaccucuacaacacacagugaugcaaugugcacugcacuucacugcucacugagaaacgugucugcacucuccugcccuggaugggacugaggaggacaagggcacucugaagcuuccccggcaggaguacucaacagaugaguguccccaggaagaagugagcacuaaugcuacuggaaagaggcaggcaggcagcacccacugggcauggugccagcacccugcagggcacuggggucuugccacaccauggucuccccugagaccacagauacgcccccuccacccccaacagguauuaagccacuuucccauccaagaagccagggugccagcuggccacagauucguuacuaaccuaaccugcuaccccaugcagccagcacacaccugccucccugcuccacugugacacaggacacuuuaggaugaggcaaaucugcacaucuauacagcggaaaaggacagugaagaaaugccucuucuacuccuaguuugcugagagguuuuaucaggaauagaugucugauuuugucacaugcuuuuccugcauguacugggaugauuauaaggcuuuucauuucuggccuuguaauaugguugauuacacacauuuucaaauguuaucugccucccuugcuuuaauuucagcucccuuucuuugcuaccuugauugugguguugguguuacugauguacuuacaaguuaaaauuuaucaaauuauauacuucugcuaugcgcaguuuauuguaugucaauuauaucucaauaaagcuauuaaugucaggcacagcggcucacaccuguaauccaagcacuuugggagguggaggcagguggaucaccugaggccaggaguuugagaccagccugggcaacauggcgaaacccugucucuacuaaaaauacaaaaaaauuagccaggcgugguggcaggcaccuguaaucccagcuacuugggaggcugacgcaugagaaucacuugaacccgggagguggagguugcagugagcugagauugcaccacugcacuccagccugggccacagagagagacuuucucaaaauaaaauaaaauaaauaaauaaauaaauaaauaaauaaauaaauaaauaaauaaagcuauuaaaaaaacacccauggaggcagacagaugcagcagguccuaggaaaaguaggagggauggcaggcagagagaaggacugcuucuuuguuagagaggggaaccagaugccaccuggguuuguccucccuggggaaggagggugggcccuuuggggaggcuccuucucuccucaguagaaggagaaugacugucacgccuaggaucucagagggacuguaaggacugaaagauacacuugagaaugcacacaaugcacuccccaucucagaccagacuccugcaggcaucaguaggcaccugcuuuuuccuucugggacauucuguaugcacccacaaacacuugugcacugcacugauuaggcauccuaauuguagcuuuggaaaaaagcuguagcugaagcugggucacaguguccuaugagcugugaaauaaaaugccaagcagccaccaagccacuucccaaggcugaacuuacacacacacccccuuguaugccuaccuauaggguuuggucauacuucacuggagacccaggugaaggaaccaacuuccuacacucgagaaaaggccagcggcugcagacaucugcaaagucuugggcaaacgacagucugcucuccccaaaacauggugcaagcaaugaugcuggauccauccuccugaccugaaaguagccacggugcgucugacagagucuuuucccuccuaauuccgcaugguuuucuccuaugggaauuaagcuccuagagugagaaaucugucugaaauccugacuuuccccgcuagagagcugaucuagauccuuccuauucaaguguggccuaggggucaacagcacgggcaucaccagggagcugcuuugaaacgcacaauccccauccccauccccccuagaccuccugcaucagaagcugcauuccaacaagcccucaaggaggcccagccccacagggaugaugggcagaggcacccaaggcugugggcucugcuuggcaccaugugcccagcugcagcccugaccccuacuucuguggccagccaaucagaggcucccugguaacacuccuggcaccaccugcacccugcuuuccagagucccucccaggugugacucauccaaucccucugacaacuguaaacccugagggggugugaugugcccaaguuccaucugcaggaggggacugcagaguccauaccacgaccccacagagcccaccaggcacagcuguggggcccugucccgucccaugccaaucucagagaaagccucucccgaugguggugugacaggguccagacaaaccacaacaggaugaaaggacaggaaauauccaggcuggugggggacguaccgccaccaaccagcaauggccacugucagggacaauggcaucuggcagaggcuggggagcucccagaggauguuagcaaaucacgccacacaugucccuuccaaacaaaguucagcagcagcaggucucacccgcucgccuaggcaugacauguggagccugucaccagcuucauaaccaguguccccaccuucauccacuuggcucccagagcuccuggucaaaacggcacccccuucuucuaaaccucaaagccgguguuucuaagauaauuccacuucagcuccaauaaggaccugaguagcuucugcgggcuggaccgaugaccaguuauugcaacuggggacauuuucuaagggcagaugauggcugucuugguuccaaucaacugccuuacaaaccacugcccuggaaugcaacuguuccaaaggcggcaucacucaacccucuguuuuaaaaacacaagucaacgaaaauaacaaguugcaccaccacccccaacucacagccaaaccucccacaggacuggccgaauucugcccugcuuggcuggcgccgacucuguaggugggccaagcaggcaacugaugcccaccaauccagacaccagcaccugguccccaggagggccaccagcccacagccugcaaggagaaaagaagaaauccuccuacggcccucagugacaucucauagacccaacaaccugaugccgaggugccuauccgaagucacugcauauuucaucggcacccucuggcccaggcugugcagaggacagggccaaaucaccaccucaccauucacugggucuggaaagcaagcccuuuccagcaagggagaggcagggaggcaugagggagcuccuccccuggucaucuggcucacagagcucuuccucccaccugcccacacaucugcucagacuuucuuuagcccucacugccugcaacacacccgcuuucucacaugugguccagccuccaccugcaggucugcuccucaggugcagggaccuugguuuuguucacuguugccuccuaagugccuagaacagugccuggcaacuagcagggacuugauacaugccaaaugauggguggaugaagucccucauccacgguugcuggccaccauguucacuccaauaucacaaacaucucaggggucucccucuguggcaagucaacaccuagagagcaaacacgcuuugucccguugucagcugucaccugcacuggccaucccagaggaucaugagaacacagugacucuuggugguccucacaaagcuucaucaaaguccaggucaagggugccaucucugaguggguccuggagaugcugcuagacagaaggccaccucuccugucccuccaaagcuguggucaaugguggcacuggcucugcugcucucucucaggcaaacauguuugcucagcaaggcucaacguguuuugagagagccuucguuuucaaugcagagguccuggaaguuacuaugaccacacaaauuuucuccaguuuaccuucuuggcaauccuaaagcuauuccaaauuguuauauaaggagggagaagggaagccacaugagauuuuugcaaagccacgaauuaaagcaauguggaaauuaaaccuaacaauccacugugguuaacucagugacaggauuauccauauaguggcggcacaguguggcaaggcagggagaguggaagcuugcugguagaagccuguguuaucugcuggcuacagugagggcacacucaagggccaccagggcuccugaggccacuugccgccgagagccaaaucaaccacuuccuuccuuucccacuaaaggcuaggcagccccugguggcucuggggaaagcccagccacacagcaguggccccagucaagccccaagugggguggagcggaucucaccgguacuuccugcuguggaccugaaccacgcgcaucucacaaguggggaaggggcagcgaaaccaaccugagaggccaugauuuggccugggcuaaaugccagaggacacccugcagcgagacucgugcucccuugucaugacauguccaaggcaagguggggucugagcuggguucuaggagaggcacugaaguggccugcagagguggcagaccacuggacauggagaagguucauuuuucaccacggugaagaugaagaagggggaaaaaaccagaacuuucuucauuugcuaacagcaccucuucaauauuuuaaaccuuuuuuaacuuaaaaaaaaaaucugguuucccccaccuucaucuucaccacacaagugcugacagucaaccacagccacagaaaaugcaacagugcaauuaagggcaggaacgcauguuuuuacuacacccuaaggcagcauuaaaaagugcuggcucuggacccuaccugucaccacaccaaaacggcucuacccagggaaccugucaccaaagccagggacccaucagccugccucggccucaccucucagagcaguuccucgaauccagggcugcuccuuccuccugaacucugcuccugccgguggccccucuacagucucaacuuccuccacuuggggcuccucaggccccaaccccagauccuuccucccucacugcggauucacacuccaggagcaguggcagcaccccccauguaggaaagcccacaguccaggagucaccuccaguaggugccucugcguuggaccccuguuucaaagcccugagaugguugaccccagcccuccucaaacccaacucgugacacgugcgcaccucuuuccagcucugugacugucuagacacucugaccacauugggccuaaugcugugcugaccgagcacaccgagggaagcaagaagggaccuggugacuugauugugcacgugcucucacccugccccuguggucuuccucuccucugagagcaucuacugagccacugcuguugucagaugugcgcugucuugaaccccagcagccucaggaggugagaugaacauugucauugcacaaauggacaccuggaaacucaggaagggaugacauccugugguggcuucaggcugagagugcccagcagacccaagaauggagaccagugcucaggucugaccucagaggccaagcucugcacagaacaaaguguggagccaacucacacccuucacucccccaacagcaaugcuuuccugggugacuuucccguccuaguccagugccaguaacaauuauaucacugcaucacagauacugcauucuuuuuucauuuaacacuucuuguugcuacauaaucuucaagaucaugucuaacagcuaaauguucuauuaauguaucauaauucccuuaaccuucuccgauugcugggcaguucacuucuuucuagguucuccugcugcaaccaguacuggaaugaacaucuucaaacaugcuuccuucucucauuuuuuccuuaggaaucaauucccagguguuaaacuuuacuccaagagaguucaaauacugucauggcaacugguacugccucaacuuuuuucuuuuuguuuuucuugagacagggucucgcccuguugcccagauuggagugcaguggcaccaucguggcucacugcagcuucgaccucacuugagcucaagugauccuccugccucagccuccccaagugcuaagauuacaggcaagccacugugcccagccaugcuucaacuguuuuuggcucuuggcuuccacagugcaaugaccccaucacaaaagggagggagaaagcaguuaaaucugcugugcccugccaagggucccagaaagcaaccccaugcugcgucagagcuguuauccugcccuccuuauguuucccuugacucugcacagguauggcagugugucuccaaacgugaaggccagucaggcaagagagaggaucuggcacagacauucauaaauaauuuccuaggacuggcacugaagccauacugcccacaauugcugaccacagccucagccaucgagugcauacgugggacaccuccuugcguggagagaugcagacaacucggcugcacgcugccacacccagcucuaacucagacaggcaugugucaaugccauuguugcucuaccuggagcagguuacauuccuucaggaacaugcuggcacaggguggggauguuccugggaugcugggcaggaugcgggguugaaguggaagaggcaagagcagaucuagccccucuuccacgccacucccuucgcccuucacaaaggaacggggugacaggaccugggguaaggucuuccaagacuccuccaggugucuugggcaaagugaggcccuggacgggguuccacagccuagccacuucccaucugcuggcuucccagccuguagcccuugcacggcacacugugccacagccccaaaguugcaaacaaauggccaagaaugaggugggccaacuugcagcaguucauauuccaaccucacaagaagaccaccacuccaucacgaaguccuauaucucacagaccacgcccacauggucagagggugacagaugccagaggggaacagugcccccagguucaugagaacaccaagccugagcccgagcaugucuaccagacagggccaagaugguggcagagccuagauccuucucuaggaacucuggguucuucugggacacggguacaguacaaaagcuguagccugagaugacaaccucagcuaucaaucccacgucccugugcccagcacugccagcugacaauaaucucaauucagaacagccucaaaagcaaguuaaguuucccccacuucacaggcagugcaggacccauucagggcucuccugcuacuguuauauaccagaucccaguaugacacauucuccgacauucccacuuuccuaguuuauuucagcagcaccucuugaggcaagaagucaacuuaccacuguuguuucacaccgcacuuccuaaacagguaacauuuaagguuagacaacagaaacaacacaccaagacaaucaugccugggugagcaucagguuaaguuuguuugcaaaguuugccaucggaaaauaugaaaggaggcacacaccaacacgguccugaguucacccucucucuccugguucccagcagcacacagaggugcguccggcucugugggcugcuuggugcagccuucguuuacccuuuguucuugccacaucagagccagccacuuucuaaggcugguuuuuuguuuguuuguuuuugagacagggucuuacucugucacccaguauggagcgcaguggcaugugaucucagcucaccgcaaccucugcgucccaggcucaagccaucuucccaccucagccucacaagcagcugggauuacaggugugcaccaccuugcccggcuaauuuuuuuguauuuuuaguagagacaggguuucaucauguuggccaggcuggccuugaacuccugaccucagaugauucgcucaacuugcccucccaaagugcugggauuacaggcgcaagccauugugcccagccucuaaggcuguuuucaaauuaccucccuggccaggugcaguggcucacgccuguaaucccagcacuuugggaggccaaggcagguggaucaccugaggucaggaauucaagagcagccuggccaagauggugaaacccugugucuacuaaaaauaaaaaaaaauuagccgggcgagguggugcacaucuguaauuccagcuacucgggaagcugacgcaggagaauggcuugaauccgggaggcgcaggcugcagugagcugagaucacgccauugcacuccagccugggcgacagaguaagauuccaucucaaaaaaaaaaaaaaaaaaaaaaaauuaccucccuggagcuuccagagcccaggcucaccccacccccagaaggucggaacacaagacugccccuugacucaggucccacuuggguucuggcgacaugauggugaugcccuggccugccucccagaugcaccccaucauucuccuuaacccagcagcacuugcugguggcaugaacugccccacuuggcauccaguacuguucccucccagcaacacagcaaaaaaauccacugcuuuugcuacaguugagaagucgcgucaacaacugcuguuccccugcacacccucugacaaguuccaccaccagcacugacaguuccaguccugccaccccagagguccacagacccugggccacugaagaccucacuucugacacuggcgcaucaggccuacugugccggacccaucaucuguaauaaccuuuaggacaaacuguaagggagaaaaugugcuaugaugacaucaaauaauaaugaguucacuggcugcugaaaaccaggagaauguugcugaaaaauuuaauggcuacaauaaauaaaacaaaaguaauaaaaaaaacacaguacacauacuggggaaacaacugaaaucaaguaccaagucccaccagucaaacuucuugagcuucccugccccuccccgcuuggggacacauguccuccacuggacagcuccuggagggccucauguguccuggcgcuggugcaguaggaagccugggggaagagacugcugucaggcagggcuccagaugccaucgaaucauuuugauugcccuuuccauuuuuuuucuacuucacucuugucuuaaacaauuaauaccuggacuugggugauauuucguggguuauacuuuucccuaguacccaugaaaauaaaugcauagcuaucaaaauaaaacaugcucaccuacaagcccauaaaguccuuuuucacggcaggaaacauggauccucuaacccauaggcuuugcuuuauuuaucagcagccccuucaaaucacagauaagcugcagacucuggccauccuaaacaaaugucacgccucucacaaacacagaguaaaugugauguguggugucuccagaccugcagguagcagaugugcaggacccaggaacagcugcagggaagagcccauccaagcucccuuaaauacuagcuuuugucacccagaaucccauauuaaaagggggugauauuuggugggagaggccagggaagaagcccuaaggcucugaugcauuccggcccucugacuccugaucacccucacuguugcgcccccucccuccaggagcagcccaggcuuaacggauucccucaggaaccccaguuccagccccugccaaaccgcuccccuacccugcuggccuggggcuggaacugggguuccucuguagcacccugcagcgcagcugggcaagccacuucucugugcaccacaggacacaccuguacaggggacugugccauugagcccacaggugcucugaggacaggagagaggcuaugugcaaagcaucugcccuggggccugacguagaggucucaccaccaaagggcacuaaccacuugccacagaagccucaaaaguuagaccuagauggaugcaaauucuacccucugcccucuuggugccugagauggggugaggacacacucuccaagcacccaccugugagaggggggacaggcagucaacaggcagccagcccaggcccaggcccaggcccaccaggagcccaggagcaccucccuggcuguggugcacccucccuagguccccccucauccccccgggcccuccugccacaggucccugcagcagcccccuccugcuccgcacagccuugcaugggcucuacuuccaccuccucuuggcacagcccuggaauugugccaggcugaggaaaggagagcagauaccacccccucuagugaugcauuaacacugaucaaugacugggaccccuggcccugaagcuggaucuggccucaaaauccacuuuuaccuggagcuucacugaucguuggggugcaggggggccugcccucuccuuuucagguaugcccagcaaucccccuauccaacugcacaucugcuaauacugccagaauuugacaacccugccucuccccacagaccccagaggcccugugaggaagccucaaccucacuuucuaagccccuaucagcucccuggguucucagccuccugccaguggccuccaagacugccuugaacugcaccacccccacugaccccaaguguaagaugaggccucugggauucuccuccccaaccugcuccucccaaagagaaucccacaggcccuccugcuugcuguaggagcucugcugaagauggacuaggaagagcugguucuucacagccucagugaggccgaucaggcacuauuuuauuuauuaagaaauucuuggccgggagcaguggcugacaccuguaaucccaacacuuugggaggccaggcggguggaucacuuggggccaggaguucaaggccagccuggcccacauggcaaaacccugccucuacaaaaaacacaaaaauuagccaggugugguggcgcacgccuguagacacagcuacuggggaggcugaggcacgaaaauugaacccaggagguugaggcagcagugagcugagacugugcuacugcacuccagcccuuuuacaagcagcuaaggcacagagaggucagcuaaucuaccugaggucacacagcugggucuggggcccaggcagccugguuacaaacacugacuuuuuuuuuuuuuuugagacagaguuucacucguuucccaggcuggaaugcaauggcaugaacucggcucaccacaaccucugcuuccuggauucaagcgauucuccugccucagccucccgaguagcugggauuacaggcaugcgccaccacgcccagcuaauuuuguauuuuuaguagagacaggguuucuccauguuggucaggcuggucucaaacucccaaccucacguuaucuguccaccucggccucccaaaguguugggauuacaggugugugccaccgcgcccggccuaaguacuggcucuuuuaccacacucucagcugccacucacagcaacacacagauaaagcacgccuguggccuugaaggugcuccuggccuggcaggcgagcagacaugugaugagagagcuucuaaguguguagcaggcagggcugugacacucaggaugcucuggggccccuaggagggugacagagggagucugcgaggacaccuggagaguaagcaggaguccucuggacaagcuggggaggcaaggacccgggagcagcacaaguaaagggcugggcacacagcagcgcagcaugcgcagagugccagacaagguggggacaccucccggcaggccaccccgggccaugcucagcucagggagugacagggucagacugucguuuuaaauagcucauucugcuaugcagaagcaaacacacagcugaagcagggagacaguucugugggcgcuggccagccucagggagcgacauggugaggggcaggaagggacguggcugugggaagcagcggggcugagagagggaggacucaaggcaggccgggaagcccaccacucggcugugugccugcaggggugucaggggauggauggcgggauaccuguagccagacaccagggagccgccgucagccuguccuacugacgugcaccugcugguucauucauucccuauggaaaguucugagcacagacuuuuggcagaucacgcuguacccauucugggacaccaguacaucacugaccaugagggaaaaaauggugccgacuggaacacacagcuucuccucaaagacacagaaaugcgacugaaaugggcauuucauuccuucucacagcaacccugagcacuuggagguagguccagguggaaggucuuccucacacccugcacacagccuggaaccauaagccauccccacuacccucuccccucaacugucaugaaugggacccugaaugccacaccccuaccaccuuucuaaacuuaacucagaaacaaccgcuacaggcaauuccacuucuggguauguacccaaaagaaccgaaagcagggacguggacagacauuuacacacccauguccacagcagcauuauuugccauggcuaaaacaugguggauacaacucaaguguucaggaacagaugaaugaauaagccaagugugauauaucugaacaacaggacaguauuucagccuuaaaaaggaagggaauccugacacaugcaacaacacagaugaagacugaagacauuaugcugagggaaagaagccagucgcaugaacacugcacaauuccacucauacucaguagacaaaaucagagagguggaaagucgaacaguacgugcgcccagggcucgggaaggggagggacgugaguguugaaugggaacagagcucgguuuugcaagaugaagaguccuggagacagauggugaucaugaccacacaaccaugugaguguguaagaccacugaacuguacaguuaaaaacagcuaagaugguuaaguuuuaugggauguauauuuuacaauuaaaacaaaaacaaaaacaaaaacaccagcgggacccuggcagagccccugcugccuaaguuccuaagagguccuccugccaggaccacucucccucaggcaucuuuuagguggcuccugggcccucugcuccuccugcacaggccacugaggcaaacgggagucucaugugcaaauaaauggacagggcagccaaagaagagaggggcugggcuuggaacugagaccaggaaaaccuccugaggcuguggagcaaguuguauuuccaagauaagcaugaacaucgcucccuugugggacugugggagggaucagauggccaugugggagaacuugcaaggcccauagucaagugccagccagcuggaggugggucucgaucugugcaaugggaagcauggaaaccaucaccucuagggccacuguuaagccaugagugcucaugagugcuugagggcuuuuuuuaaaaaaaaaauucuucccuucuuuucuucuuaacuucccacacuaugcugauguaucaagggccuuucugaaugcuaauaccacaucugcaggagcuaugggaagauccuggggaagggaccucagccccugagccgcagucuccccaucggucaauagcagggccccaacacugccuaucucgguaugugggggccagauguaaacagguacucucccccaggcucacucuggcaggccucuuggagcccacacacccaaccucggcuguucaaguaaagcagugggggaccaggggagcuagggcauuagggaagggucucuggcuccguaaggcuccaggcaguggugagaggaccccgagguuggaaugcacauccugugaguacaggcucugggcagagccauggaagagguacccauggaaaggugccucugccugcaaggggcacccacagaagacuccccuccauuaucugccacugugaaaacuaccacccagcacuuucacugccuggcagaccuaagcacaaguagaggcuccccugggugcacagggagacauucacaugaauaucugcaaaacaccuuuucauuagcaaaacucuggaagccaguuccaugaucaugaagcggcuucuagcagggaaugcuaugcugcaguuaaaggagugagcuagacccauguguaaccaagcacagaaagcugggacacacuguggagggaggugagcuagguguagagugauugcccugugugccagaacugacugaaaagccacaugcacaguauggcccagugcucugggcugugccugcacagcacaggaaaauggacucuacacuagugacauggguccucuccagagggauagaagaacugcaucagggacaggggucaaaggaggccuuuagcuguaacucaaacauuuuacuuuuuuaaaggaagacguauuuauugcuuguguacugaaaagucagugagaaaaaagggaaaagaaacauauuaaggagaacgacuaagcucaggaacgcccaggagugcagggccaugccuggaugugcaggcugaggcugggucccaggacgcuucaaagaccaugagccaccuagauuccauucugcauggggaaggcugguucuaaggacuguacacaaggauaucagagacaauggguugcagaaggccaccuuaggccagguuugcugggugacaccuguuacucacugucauucuuaauagcaccucauucaucugaaaaguguccuggucuugauaagaugcacagucacccuagcuacagggggcagggaauggcucacagcgauugcgccaccccuaccccugggagccggcucauggugacacaagcccacacaacuagguuggggaccacaaaaauauguguccgucccaagccucugugagccucaucuguucauaugggugcuguuaccccauuuucccaccacagguaagaaaaucaguaccuaccugcaguacucgacagcacccaccagcagugccaauguggugccgguggcggggugaacuggggauuggugguagccccucaguggggggagggagaacuuuuuaaguuacggaaauauucuacaccucaacuggaguaguuacacagguauacgaauuugucaaaaaugcaucaaaauguagcguagagcuaaauaaaaagacaaaugugaaagcaagacagacauaacuguuuaaugagggacuuccacugccaaauguacaccugaaauaggcacauuguacuguauguaaauuagaccucacuaaaggcaguuuuuaaauuguuggagguagaaucagaaagacagcugagaggaaagucccuaaguaugguuuuuaaugccuggaguuugagacaccagugugggcaggacacacugaugaggccaaaggggguccucagacugagaugagaacugaaggccaugagugaccaggugaaugaacaacgcccauggaaaggggaaauggauagaacacagagacaguggcagcagcaccuggggccaccauccaccugaggcagguaggauuggccaggcugccccacucacugcacacacacagucagagagagcagcaggaaaggggacaggcacagggcgcccugccaggagcaguguuucugcacugucccagccaggcggcacuagaggaaaggagaggagaggcucgggugaacagggugggagacauggcuuggugaaggcauaggggaacaaggaggcaggcgggagaugcugggcaaggaggggacugacaggcagacuccauggcaccgggaggaagaggcuugagcauucauccuguaaauggaugacccuuggaaaugaacagcugaggcugcauggcacccugccagucacaaagugcuuuuucaaaguugucuuccuaucgaacuccugguuacaaagagccaaagcucuacaucacugugugcggauauucgugcauggcaaaucugucauccagacaggccaguuuuccccuucuuccuucacucaaaacugaggccuggcaagggauagagcaucggaucacuaccacaccagacagccagacagagccaagcuguagcucuaccucgcccuuagcgggucaucuggaauccacacgccugggcccacggcagcaggugaggucaggagacaggcccuguggccagcaggagaggcugcggugacucuugaaucucaggagacuguauggccccauaaaugaggccagcacagucagcacaaagcagccugaagacacaauggggccgggugcagugacucacgccuguaaucccagcacuuugggaggcugaggugggcggaucaccugaggucgggaguucaagaccagccuggccaacauagugaaacccccaucucuacuaaaaauacaaaaauaagcugggugugguggcgcaugccuguaaucccagcuacucaagaggaugaggcagaauugcuugaacccgggaggcagagguugcagugagccaagaucaugccaaugcacuccagcuugggugacagagcgagacuccgucucaaaaaaaauaaaaauaaaauaaaaauaaaaacaaaaacaaaagacacaaugagggaggguuuccauuuuuuggaggggagcgggggauaagcaaauguggcauuagccacgaugaaaccuagagagauuuuugauggcucagugaugaagucagcaacagugacugccaccaucugggaggggaguaggcugagacagggcugcucguuucccaggggaggggugccuggcacacaccaagaagcaauguuggugucuggcaucaggagcacuuuugcagguuuggugggaacccaaacccaccugggaugcacaaugcaacugcugcagacacgagaauucauucagucaccuuuucacagaaggcucucccuguguuggucagucuggucucaaacuucugggcucaaaugauccucuugucucagacucccaaagugucgggauuacaagugugaaccacuguaucuggucucagcugcuauuuaucuccuggaaaaauaagaacguuggccaggcacgauggcauacaccuguaaucccagcuaagcaggcaacugaggugggaggaucgcuugaugccaggaguuuaagaccagccugggcaacauagugagacccugucucuaaaaaauaaauagauaauaaaaauaaaaauuuaaaaauuaaaaaguuagccgggugugguggcauauaccuguagucccagcuacucaggaugcugaagugggaggaucacuugagcccagaaauccgaggcuacaaugaucuauggcuaugccauugcacucaugccugggugacagagacuaucuccuuuuguggggaaaaaaaaaaaaaaaaaaaaggagcauguccauauugugugccucgugccuucugaagaggaacucagggagcagacagagggcucacacucauguuggggaaggcaggcaacagacaagaccauagccacacuaaaagccaugaagaaaauaaacagugugauuaaugugaguugaaggcuucccucacaaccacugggccagaugagguggucacuucaaccccggagcccugagagaacccggggagguaauacaucuggagcaagaagcagugcaagcuuguccaacccauggcccucgggccacaugcaacccaacacaaauucguaaacuuucuuaaaacauuaugagauuuuuuuuuaagcucauuggcuaucaucaguguuaguguauuuuaugugcagcccaagacaauccuucuuccaauguggcucagagaagccaaaagauuggacaccccgaucuagagcaaguugcaugauacccugccuccccuucagggcagcuggcuccucgugagccaaugaggggugcuagacagggccaaugggaaacuacgaucacgagaacugucccagcagccagcugcaaaggcgcagacaccaucuggacaaggaaccugucuguggccugaagcccggcaagcaggccaaggggcaccagggcccuggugggcaaggcuccaggcccaggccagaucuccgucugcacacguuccaauacaucuccucuucuggggccgcgagccuucagcauccaagccagguaaggggcagggacucuacccaggugugugcuggagccugcucacgccagcuuuacugagagagcaagcccguggugacacuuucaggaaucaaaggagccauuacuaacaauuacauuauauaagcuuacaauaaguugugauaagaacaaaggaggaaguuuucaguacuguguacucaaaacucaucacuuccuacuuauuuuaccaaacuuaguacuaucuagguuucugagguuauucaugacuacuguaugggcauggaggacauggugugcuacugagucucuuucccaaccucacauucagugaucucauguuaguggcuugaagccagccauggugagaguauuuccaccacagaaaucaguaaacacuauaaaucagggcuugauuuuaugggcuccaaacuagaaaucugcaaacuccugggccauuccauaacacugucuguuuuuguaaaugaagauuuuacuuuuuucauuuuacaugcuguuuauugagguaaaauucacauugacauaaauuaaccacaucaaguuuuacuggaacacagucacgcucauucacucacauacugucucuggcugcuuuugugcuacaaagauagcaguacaacagaagcucuacggccauauggccugcaaagaugaaaauauuuacuaucuggcccuuuacaaaaaguuagccaacuccugggguuuagacuuaagaaagugauggagaaaauguuaauaaugcaauuaaacuuaaaaagcgugucaugccugaagucauuacauugggaacaggacaauugagaaaauauucuuauaguacagguauuugaaaacuauuaucuaauucagcaaagacaucacuugacucauuaauacaaagauaucgaccaggcuggugcagcggcucacacaugugaucccagcacuuugggaggcugaggcaggugggucacuugaggccaggaguucaagaccagccuggccaaaaugcagaaacccugucucuacuaaaaauacaaaaauuagccggguaugguggugcacaccuauagucgcagcugcuuagggggcagcaugagaaucacuugaauccgggagguggagguugcagcgagcggagauugcaccaccggacuccagucugggugacagagcgagacuccgucucaaaaaaaaaaaaaaaaaaaaaaaaaagagagagaauaagauauuaaccaaagucaugucaaaaccaaucagaagcugauacaaaagcucagcaaaaaucaacggaagcagcuggugagaagcaauuggcuauauggaacugacaacaguguuguauauuucauuauuauuugcaaauuauaugccacccauccuuuauacuaguaaaacucauaaacuuacaugcauauuuacauauguauauguauggauuucuuuucuuuuuccugagagcugguugucaaauuuucaccagcacaccacugucuauaccuuaguauaugccuuauguaaauuagagcuucauuauuuugaagugcuugaaauagagucugaaugaaacuaaaguccauuugcauuauuguauuucaacauuacauauaaaugaaaagauuaaagaaucuggauuuuuuagaaaugccaacucauaaauuuuucaauguuuacuaaaaaaaaugcuuccaaguuuuaucaccuucuugugcaaacaaaauuucuccacaacaauuaucaaagucaagcaaaacagaaacaaaaacaaaacccacacccuaacauauaaaaguuauguucuuggacacaagcacucuuuaaaaaaaaaaaaaaaaaaaaaaaaaggcaauguuauuucaguaauguuauucaagccggguguggucgcucacacauguaaccccaacccuuugggaugccaaggcggccaggaguucaagaccagccugggcaacacagcgagaccgucucuauaaaaaauacaaaaauuagugaggugugguggcuagcacuuguaguuccagcuacuugggaggcugaggcaggaggaucccuugagcccaguagcucaaggcuguagugagcuaugauugcgcuauugcacuccagccuggacaaguaaaguuuuuagagcaagacucugucucuaaaaaauaauaauaauaagcaaaaccuugccucuaaaaauaauaauaaucauaauguuauucaacacaaguucaguauuaacuaugcucccuaacacccuguauuuuauuuuccuuauaauuucuuuuuuuuuuuuuucaagacugaguuuugcucuuguugcccaggcuggagugcaauggugugaucucggcucaccacaaccuccgccucccagguucaagcaauucuccugccucagccuccugguagcugggauuacaagcauuagccaccacgcccagcucauuuuguauuuuuaguagagaugggguuuccccauguuggucaggcuggucucaaacucccgaacucaggugauccgcccgccucagccucccaaagugcugggauuacagguuacaggcgugagccaccauccuuauaauuucuaugguagaaacagcacaugcacuuuccccuagucucgccuccaaauuacccauugcacccuguggaugccacuguuuccuaugugugccaugacauggaaggcugaaagcagugugacagcaggagggcaugggcucuguauaauggguggccaggagaggccugaagaaguccgacugucacaagaacuggaugagggagaagguucucccacaagaaugagggcaaggguucaaguuaagcugagaaaggaaagaagggcccaaggccuguagcauguguagaucaugacaauaaggaaugugggcgucuauucuaagggugauggaaaaccacugaaggaugugaagugacaguggugucaucugcuuaucgguauggaagggacaggaccaagagggaaauggccaggguuggacucgagauggagggcagaggagggcuggagaacaugcauccuggcaguagcccccgggccucacagguggaguaggugacuaaggugagaggaaggcagaggcauggaccacuccaggguguuuagcagagccaugggguguggcuucacugacuguguggagaaaaccagguguuguccagucauuuuuggugggauggaccucugggaacaugaagaacaugacugguggccuugacuggaguguuauguugcacacuaguguucugaaccuuccggaaacguaugagaggggaacuaauccucuccacugauugcaguacauagaggcccgcaauccacuccacagccgauugcucucuauagugcucaagugcucuucaggcuagagcagccuacuuuuauuuucauuuuuuuacaguuuaauugaaaagacaauggagcauaggggaaaacaaaccaacccauucccccugccccaaccaacacaagugcuuccauuuuaccccaaguucuaguucuuuaggcauccagccuauccagaugccugagucacaaaaccacuccuuucccccucaugguaaggccugcccauuuuucuauagagccuucagaaucacgcuuucggcuauaggcuauuugacucuguggaugcaccaugauucugaagcuucucccaugcuguuuaaaaauaaacuucauuaaaaaaaaaagaaguaaauggagacaaggucuuguuauguuggucagucuggucuugaacuccuugccucaagcgauccugccaccuuggccucccaaaguguugggauuacaggcgugagccaccaagcucagccuguaaauaaacuuccaagaguaaaauuacugggucacaggacaugagcaugucuaugccucuugcuacauaaauaguuuccaagagggugacaguggcucugagcuccugccaacagggugaugcagguuguugggggugggguaggagauaggccgggagagauaaaacagcaacccgcuggcuuaacauccagucuugauuacccaccaaggccauucugcccacauguuuuugugcaagguauauguuccagguaucaauuacgucaacauuuuucuguccaguaaaaucuuggagaucuuaugauuaugauuacuuuuuguguguuugguuuuuuucuugagacagggucucgcucuaucacccaagcuggagugcaguagcgugaucuuggcucacccuagccucagccuacacagcucaagcgauccucccaccucagccucccgaguagcugggacuacaggcacaugccaccagccccaccuaauguuugugauuucuacuacagacaaggugucacuauguugccaagguuggucucaaacuccuugccucaagcgauccucccaccucggucucccaaagugcugggauuacaggcuggagccaccaugccuagccacaauuguugauucuaaaguaugucucuacacaggaagaauauuggcuauugcuucugaaaggcagcuucaugugcacaaaguuguauuuugaucauccccaccugcaacugcagcacagagagauuuggaaaaguacaggcagcuuuuaaaccugcuugugaauuucagccuaagcaccucuuccaaggaagaggcucuggacccugacgucugggauuuuguucuacaaccaauuucuuccuguuuucccccgagggagcauuuagaaauguguaaauuaugcaauguugucuuguaacugcuccuugcugacacuaaaggaaagacuacccuugaaaaagaacagcauuugugaaaaucaaaguucaguaucuacaaacucaucuagggguguaauacccccuagcuccugaaaagucgagaaggggcuuauacauguuuaguaccuacuagguacuaaauuuccuuucaggcacuguuuaccuuuaguaggauagggacguccucacuuuauagagaguauuaauagcacugauaaauauuugaugugauuuguccaaggacauauaacuuggagacggagcuguagagauucgaauccaggucuaauucccaaacucuuacauauuaaauacuuuucuuucuuuccaucuuucuuucuuugggaggaggggagaggaggcuuagaggauuucuaguugauuguuaaaccuauucaucaaccuacucauaagaaaugaaaagccucccuucuccacaagaaaagaccucaucaacuggagcugacauggcucaaaggcucuagagaugucagaggccgugucuggcuggggaagggacacgggauccucugcacuccacagcagcucaggcacaaacucccccacuuccgagguggaaaaagacagcagaguccccagcucucuacccaaggcgcuugacgggcacugucuagguggcacuggcuucacaugcaucccccuucccucuacagugggcagcaguguuaucuccggaugaaagcaaaggcucugagggcagaaggagucgggcucacagcugugcagugccagcgaccuaaccucacuaugcuucaguuuccugaaucagcccaucuauaaaaugggauaauucuuagcacagagugagcacacaguaagaguugaugcugcuguccuugcaaccauuucuguuauggccccaggauaaaguccuuauagucccuuauagauuuacaccaaaggaugucgagcccuugguuugugaagugggacugguaacuagauucaaugagauccaugcccugggcuuggugacagaaucaaugauggaguuaaaauccucacuuccccccuuccaaccgcauggccucaggaagacaacaucccaaacucaucugucacaggaagacaguaccagcaucuucaugaucagggugacuaaauggaggcuaggcauugugccaggcucucaacauaccucaagccccacaggaugguaucaccaggugauggcaacaccagcuccaugucacaaguaaaaagacugaggcucggagacauuaagugaucugcuccaaggucaccaaaguagaagcagcugagaaggaccugaagccuuccagcuaagguccagaagcugugcuaaggguagugucuggcccggcgcacggucucacaccuguaauuccagcacucugggaggccgaagcaggcagaucgcuugagcucaggaauuugagaccagccugggcaacauggugaaaccccaacucuacaaaaauuacaaaaaauuagcugggugugguagcgugugucuguagucuuagcuacucagaaggcugagguaggaggaucacuugagccggggacguagagguugcagugagccgauugugccacugcacuccagccugggugacagaguaagaccccauuucaaaauaaaauaaaauaaaauaaaaaggugggggguggguggggagugucugcccaggccuggagggaggaggcacgugcaggcucaugugggccugagggguucaccaggccacuggguccugucgacggcuucuggaauccccaaaccuaacggaacugagcgauacacacaggacaggcucagcgccugggugcagaccaugccaguauggcuccaacagaccccucgaaccaugggaggaauccaaagggcugaagguuggagagagccaaguaaccaucacaggaagggggcuuccuccaggggucuggccaaauccagccgcagccaccucaaccccaauacuaaucagcuaaaugacuaagccccacuaagccugaauucuuacccccaagcccaacuggguccucccagguuaggcaaugcuacuucuguaaucugaagucagaaauggacccacauccauuuguaaacuggucacuggcccuaacagaaugaauggcucucuaaauaccagcaagaaaacaaccaaccagucuuugcuucaaggggaaugggggugggggaaaugacaggcaagucagaccgguuacaggaagcacugcgggaaagaucagaccaggaugccugcaauagucagaagacagggaugcuuauggaggcucuggacccugagaccagagaggcaaggagggagagagggcaggugaucagguggggugcacaaaaaggucaggagcugacugaugagcagcugagcauggcuggagcaggagaggaauaagaagggcuaccugacccagagccuggggcacaaugugcucagaugauucuuuacugacucucucaguugcaagugagggaaaagucagcucaaauggguuuuaucaagaaaggaaaccacaggcucacuuagcuuaaaaauuuggggcagccaggcguggggacucacgccugucauucaucccagcacuuugggaggccaagguggguggaucaccugaggucaggaguucgagaccagccuggccaacaugacaaaacccuguuucuacuaaaaauacaaaauuagcugggugugguggcaggcgccuguaaucccagcaacuugggaggcugaggcaggagaacugcuugaaaccaggaggcagagguugcaaugaacugagauugcaccauugcacuccagccugggaggcagagcaagacuccaucucugggggagaaaaaaaaaaaaaaaguuuaggacaggcuucaccucagaccagccaagccacaaggucuuaguccucuccacuccucugaccaggucuuaauccuggacaggcugccuccaggcagcaaaccccagcagaaaacagcucacauccucuuccauucaagucuccccaaccuacuccagcaaagugcuacaacuuucacaggcucugauugggucacaggucugucucugaaccaaucacugcccaggaagaugcagccccauuacuggccaguccuaccuacauuacuaaccauccaaugggcauggacuggagagaggaaggggcagcucucaggaaaacgaggaugcagagaccaggaggaaggccaugggagcuagaugggcucucuaccaccaagccuguguauuauuagguagcaugcaugugagcacccaggaugcuucaggcacagggccauguuccauucuuaaaagccuuccuaugcagcauuuuuuacaucuuucuggaaaaacaaaggcugcaaaccuaaccuugucgaagguugcaaggugaauggcagagucaaugguuccaacuccauucugcuuaaguccuccacccaggagaaagacugucuucuccacuauaugccaccuaaagagcugagacucuauccagccagcaacacgacaccaccagaaaagucaaacaucccuaucuguuuucagacacacagaggcaggagacugacuaggacacugcugcacuagacccccuggagguccagcuugcaggaagaaggacuccaggauggcccuaagguggucuacagagcaguagaucauggcaccaccaacagacacagcacagcaugacaaaggcagagaugaagaagguguauccacuuuggagugggcugucuagacauccaggcacaggagagagcaaguguccaggugccaacgaagcuguggcucugagacuaccuggggaaagucuuaagggccgaagaccgugagcagugcuacacaaagccaaaacgcuuagggggagcaggcaccacuggaaaggguuguguagagaaaaaagagaccaaugcagcaaggggcaagggaaccagguaggcagacacccccccacugcuaggccuugucauucauuccaagugcccauggugagcacagagaacagcgcccuaaagagaagacaaccuggcgugacaaacacaacaggcauccuugugcccaaggacagcucaucuuccuaaacagaugaugccacuuccuacuucccaacuugagggagcccaccacccgaccagauaggaaaccguguucacagugcucucaacacagaagaaucaucaccagggugaugaggaggugcccacucggucacaccccuaacuccuuguugggcugacagcguguccagagaggcaaugcacaagucuuccacauaccauccagcacaaauaccaccugccaacuacaccagaacaccuaacgugcccccuccccauuccaggccaggguuuucaccauuuuccuucagguacacagggcugcagcagccugggggcacaugcuguuucugucugcacaaaagguccugcuccuucggaaacaccucccugacuuacugugggcacugccacuuucuuacaagacccucccauggcaccccaaaccaagccagagugugucuccugaaguuuccggaacuggaaacuagaaaguaacuccugucuacaacaggucaaacucaggagcugcugccuuucccaacacaugaagcagcccauccacaagacaggcggacacacagacacacacacauaguguggaggaccagaaacagaaaagauucccucucccuucucuccaccccaauuucaaucccaaacagcacuuauuuaagcucagcucaguguuuagaggaaggaaaaagcuggggagcaaaugcggaggagcucacaggagagcagugcugaagcuuuccugggagaagacaggcuccucauucagaggcccacaaguucaggcacuugcuugcccaccaaccaucaaggugagaaaaugaaaugcuugagaagcucccuuaaggcagaagugaagguggaauacccauucacaaaacuuucccucacagacgagcugagacuuaacauguggcccguuuccgucacggccaggcaaaagggggagcagacaccaacaucaggugcuuacugagagcccccccagaaacacaaggugggguuggggaaauggaggcugcaaaagaaagaucacuugacucuaccccucuccauuaaccgaaggggaagaagccaggccaggaaacacagguacgaguuuccgguuacccagaggggaggcacagaugagaggaaacaggcaggacaaucagacccaacagaucucccagccucugcccaggguccacaaauucagagaagcuacaggaggggccacagcucuugccugggucacagcgcagucuccucaugaccacaggaggccuggugggguucaggccaccuggaccgcaccaccucccccagcaaugagcuccauuccaggcagugacugaagcaccaggagagacugucaagacagggaggaaaaaacagcaccauucaagacugucuccagcccaggacaggaucugaagcugcagcuggccagcaccugcacucggacagcgugacagcgagguccccaagggugacuacaggcaaauggagucugugguuuaaccagaacaagaagguacucacaacuccacgcggugaccucacaccagccaaaccacccuguugcuacucuggaccuuacauuucccauuuuuuuccccaaaaacucccauuuugccuucuggagccaaggcccaacuauuuggcggucacaucaggagaggugaugacaucagugcacauccauggacacuggauccacuauucuucucccguuaacaggaccuugaugucuccugggaacauccccucuauugugggacuguuuggguggaacccacagcagauucagggguaagccaaucaacuaauucaaucaaacugcuaauccaaucaaagcucagagaaggcauaaggaaacguuugguggggcuuccagcaaagagucgggaguucggugagggaaaauccugaaacugcugggauggagaggaagacacccuacugugugaaggcaacacugcaaaagagggagacagaaaaaccagguccucaccugaccgcagacuugccuuugggccugcaugaccaucagccccuuugugucuaagcuccugccaccagcacagugcuaaccucccuuuagggcuggacaggccacagaauuaguauaggaaguaaagacaagugcugugcaggcaaccaauuaacacggaaggaaacaaugugaaccaaugaccacccaaaaggauaaaacuguucuuauuuuauaucccuucacaucaguaucacgggucucccacugacagcacugaaaagccagcuugcugacugcuugccuaggcaccaugcaagaugcaccugggaggugaauggaguugggcagcaucuauaaaggguucuggagggcuggccugcagaacaggagagccguuagcuaccaugguaacuacuacaucacccuggggggaacgaggauguggccaccucuccaugccuaacucaagcugggccaggaaccugaugacuagaacgggggacaucaaaacaagucaucaaggggauaagaacuuaaacccagugugugcagggggcugcccagagagccaaugugaccaggagugugggugggaaacagaagagugcacuaccgugcugaaggcacaagcaggcaguggggcugccagggccugggagugcugccagcccacugggcucucggugugggccaugggucacacccaccugaguccucccaguaacucacccacugcugaugccugcaccacagaacccccaccagagucaaggccagccacagccaacgcccuauaaaaccaugcugugcacccagcacacgaauacccgagucuccacagcagccacgaggcugacccaccaccaggguguggccuggacaaagcagcacccuacuuucucaccauagcaaaugaaaaucuggggggauguguguccaggaaugccauguuuugucacaugaccaaaaaaggccgaaggaucgcuggggacccaggcuucacagaugaagugacauuugaacagugucuagggaccauggacaggcagaaaucuaagaucaagcgccgccuucucuauuagggugaaaaauaccugacgagaaagagaggaaaacacaccucacaccccuucuucagccaguuccagagaaagcacagagcauuuuagugaccacuguccucccagucuggcauaagagcagugcacagaugaauccagcauaaacagcuggacccaggcaagaaaggggagugccugcgcagcaagugcccacuggccucucacaugacaagggaggcagccagcagguggcuguguuccaaccccagccucaucccaucuagccuccuuccagcuguguccgcugagccucaguuuccucacuaguaccugccuccuguuuaaucuacaccugcuaugaagauuaaauguguuuugaaugcaggugaagugcugaaaaccgcuggcaccuaggaccugcucaguaacgcugacagccauucccaaaacuggcccuguuuacagugagagcaccaagcauuugggcacccacgugcuguggcaguucuagacacuaagggagcaacaccugcucuccuacuugggcacuucacaaucacauggaaaauguaaccaacaagaccuguuaucagcaggaauauaagguguuaaaaugaugaaugguuccugagggagacggucuuggauuaagccagguaagguuucagaaaagggaggcaguagggaugacaggaggcucccaacuggaggcagcacaaaggucaaauuccaggugucacacacauacagguaaggccugcucucagaguuacacugaugcuguuuugaugacaagacagaacuucauuucgaagcaugacuggauuaggaguagguucuguccucgaauuuucuuuaaaacaguuacucaaagcacaccuguuguuaugugaagcuuccagaagguuucugaugauaaaaaugaacccucauacucaaaaagguuuggagccacuaggcuagaggaauuuaaagggggaaaaguuguaggaacugggaaggaauggaauucaaaauguaacaugugaaaacacuucauguuugcaaggguacaccuuggaagacgcaauggaguucagcuuccaugcugggcaccaccgaugugggaagcggaagacugucguaguuaagcccucugacaucagaaccacccagugauggauucagacccaaggcuucugguucccuugucugcaauaccagacaaaucggugaaucucuccuagccccuaaaaugaagaugaagcaccuacccuagaaguaauucaaagaagcaaugagacacuccacacaguagugucuggcacuguguaagugcucaguaaacagcggcuguucgucuugcagccucugcugcccaacagagacugcugcuggcacacaggagaccgagccuaacucugcaugcaggggaaaccugaugagcccccugacguuuuccaagauucauuuuccugcaguggaugaacccaggaaacuuugcugcagucacaguaacauccaaaggccuuuaaccccaauugccuggcaauccuugggaugugaguucccagagggcugcugguacuucaccugacaugaccccucuccuuuugaauaggcuccacagagaaucgcagaaccucccgguacuuggauggucacagaauccaaaggccuauacacagaauccaagggccuggguauguccacauagccaucucacagugcccccagacuguguuaagucagcucugacaauaauccaccacuucccuaagcacaucacagaacucucaccuuccccacccuaggcuugccuccaaaagccacacagagcaaaucuaauccagaggguacaacaacaccccaaauacugaaaaccagugccauguaaugcuaccccaaggcccuucccauuuucucaagcccagacaccccaaccauacccacagacacagcucgacaucugccugugccccaucccacagcagagagggaaaacugugcaauaauuugccgacuguuccuuccagcucuguuccccucaugccagagacaacgcaagaagagccugccugccugacuacagaacuuauucugaaaaccuggaugauagaauauacuuaagaaagccaucucauauucuuaagaauucucaacuguuuucaaauaaggcacggggagaacuguuccauuuggacuugagaccugcggcaccaucaggccaucccugacugccgagcccacaugccacggcaccccacccaagcucguucaugaccaugcucuaucugcccuccucccuaugaggcgccaagccccuugggcacaggggcugagcaucuucaggucuguacccucuacacccagcacacgagcacuugcuaaucaguuagugacugaaauguaacugcagugccucccaaggcauggaauguauucagagaaggccuuuaaauacagcauguagaauuaucgguaugucuuucuuacucaggaaaugcuucccgguucagggaaucccgauggcaaauccacacccugcucuaagagugaaaagcggcuguuuuggaaggugcuccaagcaugggugcuagcgagaccacacuggaaugaaaugugcugccucuccuuuacucacugugccacaaacuuggccacccauucugacaaccagcuccugguccccaaaggaaccaggcagacgugggacagccuaccacuaggaauacaaaggaaaagcacaacgugcaguaacaaagcacccaguuuccagaaggagaugauaguggggaaguggccaggggaccccucccgcuggacuggagucaccuggagucagccugguuaaacuagagcuccaucugagaagaugcucgcagaccccaaaaccaagaaaaggaaagccaaguguccuccuucaccuaagagaccuuggcgcccuuaagcuacauguccuaucuuacacagcugcccaggggcugacgugaccauggugccuuuuuacaucuguauccagaacaaagccccugaccacaugcuggucuuggacaguccuccagggcucugggaccuccaaccaggacaacauauucugaggaccacccagaaaccucagugaggagagacuguaaaguccacuuucuccugagggacagaaugagucaaagacaaggacauacaccugugucacaggugauacuugcuaccuuuccauuucccgaagucagagaacaccacgcugcuccucuccuguguccuggccacaauauacagaguaaagacaggagagucccugaaucugggcaauuguggaucagguggcauuuacauguuuggguuuaggguccucuacuauuuuggauagggucagaaucaagaguccuucauuuugcaauuuacaccauucugcuuuucugcagaauaaauggcauuuuaaguuaauaucaaaagugcuguaauguugaaguagagagcaaacuggucacacagauucaugaaaaguuccacaucgguugcuaguugccacaccguggucuggcccagguuucugucugugacagagaccuuaagauguucacgggacaggcuaugucauaucaccacccuguuagauguaacauagguaaauccagccccaaucuguaaucucacauacacuuguaggggacguuacaggauccucacacguuuucuuaccagcucaaaaaugcugcccccucgugccucuuccggagccaucucuccaacuuucaaggcagcguggugguguucagaguugaaaggacucuaaggacugucacuuaaugacucuggguaagucccuaacuuugguuccaccaccucccauuaagucaguaagaaacaaaagcauuuuauccucugcuugccccuggagacacccacugagcagcaccuauuaccugaugcugcuggcuucugcaccugcaaaaggggagacuggcucccccacucacaaggcuguuggggagaagcagaacucucugacagggugccacacaaacuaacaaagcauacaccuugguuuagaauuuuguuaguugagaaacuucacacaauguaccuugcaaagauauauuaaaaaaaaaaaaccccuucuagaacaauugacauuagucucugcugucccuucuaggaucugaacuuagaucuggaaggagcuuuauggggugcauacaccaguucccaaucccacccuguggacaagaaaucugcaggcaaaccaagguaagcaacauccaaccuuccaauucuuaggugggaaaaugaucuuucuugcugugucucucugcagagugccucggucaccucucccuuggucucuguugccugaagagcugugaaaaagaaagcagcucccaaggacguuucccgcucagagccuggcagcuggaggcacugacacacgcggccagggcuaguucaagucccucuuugcugcgggaccuucucaggccucucccuggucugaacacagggcauucaccugcagcuagcaagcccugcccugugcgguuauuuuacuugccaugaggaugcaguacaccgucuacuauucgucggaccuuuccucuaaaagcuaaguuuguuaaucaucacuuaacaucuguguuccucacaguucuacugaguagcaucucaagccaccugugauucuuccacucuccaaaguucugcauuagaauauuccacgacugaacucuugggcauaaaguggucacaaaggcuucuugguaaaauggggcucaaauguagcuccucaggcacagguccaagauggaugcuaggguucagucaguuuaagcagcagguagaaagugugccuaaugcuucugcucuagagggagaagacaagacaggaaacauccccaagaagcuugcgugcugcacaggaagauaaagcucauaccuccacagaacgagugucccaggcagaugggaaccgaaucaccugcugaggagacugcucacuaugacugcugugcgagaguaagacacaguccuucacuuuacccacaaugcagugagaguaagcuggaacaaucaugcacacacugcgcuucggagagauuuucaacacccugggcugaaagggugcacgacgaaaagaaaagcuccaacugcucugaaaaacuguuaguagccuuuucaaaaggagaguagaggauuuacuuuauuacugaauuggcagaaauuauuaacucugagccugcugcuauaggaauucaaaugcauacuccaggggcuaaaagugagagcacagaaacuacuuuccuccuaagaauuccuuugucaaggagaugguugguaaacacgacuucgucacuucccuaacuuuccagauacuuguggauauuaggucaguuccugacaccgauuuugcaagcaauagcuaaguuuguuaaccauaauugcaugcccauaaagguaagcauuacaugacacaauucucugccgcuucucucagaagagguuuaauuuuaguguuggcucuucaacacuguccccguuuuuuuuuuuuucaugagcaucuuaaauaugugucaacuaaauauccaguaguggaguucaucauugggcagggcagagaggagagagcggcacgccggcagcaccugugcuggagccaccugcucucaccugagcccacauugauccaagagaaacugcagacgcacugacaugcccggcucucaccaucaccuccgccagcaauccuguccaccgcggcucuguguuucugcaugguguuugcucaaagcaaacgguccugucaaauggcccauaacagcgcucagagggucaaucacaaaggaggcacuuuccucauuguucauagucaagaagauaacuucccaaauccauccaccccauguuaguaggacucugcccaagaucaucacuaaagucccugaaaauaagcgguaugaaaugcaaauuccaugccagcuaacauaaccagggaccuauauagcauuucugcaugugcuaagacacacaaaacuaagauuuguuccauccuccuuucuucugccucaaggaacccuuuagauuagaacccuauacaauacuggaaacugugaggucacuggagugaccuaaucuacaacacugugaucgccugucaaagugccgccugaucccaaagcucucugagguggcauuaaggaucagugcuaauaucucagcaaccucucagacucuccagaaggaaagcgagugcgugaaauuaaaaaaauuaccuuccggcuccacaaaagaugcacaagucaccaaggcuauuuuuuucaugucacuaguuuuauccucuaauauuucagucuuaaaauugcagugacaccaguuacugcaaaaaggacauucuagaagguuuuauauagcuugugcccacuccacccccaaagucauaacaaaaauguacaauauaacauuuguuaaagacaauuaccaucaagucaauguuaaugggaccugaauaccagggauaagagaaguacuuauaucacagcaaccagagccuucgaaaaaacucauaacccuucagucuuaaccaaaaauuguauaagccaaugugaauuauucccaaaacaucaucagagugaagcauauugcuaagaguaaucagccaagcucauguaaaaaugaaagcaaaaaccccuacggugagagaaaccugaguuaccuggccaagccaaagaugauauuuuucuuccauucacagcacauuaaaaagugaucucaauggccacuuccugggaagcagggccuccccucauaccuggaugcuacugcaucuuccuaccgcccugcuccugccgcgggaagaaugaccccuacugccaagaaacucuuggagaaaauaugagaauagaucagucuucccccccacccccccacccccgcaacaacacacacacacacacggaaggggagggggcggucccuccgcaaacaguagccucagcaaaggggcacccgaggaagcgacacucuggaguuaaccccgacagucugggucaaaaaccaccaggcugagacccccaggugagggaaagagccuacugaaacagagcucuuggguaaacgggagagaaaaguccucuuuaauucacuaccuaaaaaauggagcucuggcuuggucagagacgcaauggguacugaggcccagaaaggcaacaggaaggaucccacccuccccgagaucaucuaucgucggcagcgaccccaagaggguuuuggcaaaggcgugucuagucacagaagggagacagacucuccacguacccuagguacccggccaggggcaaaacagacuggggguucucuccgaagccaggaaggugcugccagccgagaggagggggaagaaggacuucccugaucacccaggaggccaagacaugggagacauagguuccccgagucauaccccggacaccaguugcuucacagcccuucucccuccccuucccgcuccgggagggcuucccgggggucucgggucccggagggagggcgaggcagagaagcuucguccagagcagugagggucguagagcuggagcagaaagggaggaaaaacucuagccucagcucccccgucugcuuccuccgcccaggccgcacggaagccucggccucacguaccgagcgcugccgggcugcccgaccugcccccggcccgggcccgagaagcgagaggcagggauggcagcggcccucgaggggaggugggcgccagacgggucccccgaagcccggugggcgagggguacaggagagggggagggucccgggcccaugcggccuccgucccagcucgcgcggcggguacuuacguugcucugggggucgauggccugcagcagccggucccugaucugcugcggagacgccggagccgcugucauugccugggcgaggcgggggguugcggccgggccagcgggcgggcgggcugaggcgggggacgggggucacucacucgccggccuccgggagccggagccgcauguuccccgcggcgccgggggguugggggcgcgcgggguggcggagaggggagccggggccgggucucggucccgggccgccgccgccaccaaaggaggaggaggagccgccggagccgccgccgcucgcugccgccgccucgagaaccaaacuccagu

SEQ ID NO: 191902 - RNA, 14010 nt, Homo sapiens
uccuuuuuagaaaugagguuuauuuucaaggcuacucaguccuaaaagccugcauauuuacuuuuuuuccuuccuccagguuuaccuccaagucaggauuucaaaaaccaccaacauucaggcucauucuuauugguauaaacaaacaaacaaaaaaaccagacaacaaaaaacucaacaagcaaaucacacaguugugggauucagcgccaaccccgggcguuucauuuuggcaacaaaaccaggauucccuuucaaagaagcuucuggaaaaugcuguauuuccuagaugaaggccccugguuuuucaaccucaaaaucaccuacucaaaaagcagacucagaaacccaagguuuuagaacauggucccaauguaccacaucauaaaaucacucucauuccugcaacuguacaaugaauggcucccaaagucauuuuauuuaacaaaggggucaaggcagaggaaaguuucccuuaauauccccacaacugcuccacaugucuucuguggaaacacuucaccaggaacuagcucaacacucuugcuaacaauuuagugucuauacaggaaggcuggugucucuguuacagguggcccguuccuuaaagccuuuaggguuaaucgcagcugcacugaguggccaagcagacccuguugggaugugaaagcaguuuguuaacagggccccuggccgggcccagaggcugucagacucagcaaguaacacugaauguccaaaaauacggcuguguuaaacuaacaagccaauccuucugcucagaucucuggauagaaaugauuuuucuuuuaucuauggggaaugcaauuucaucacagccccuuacauaaacgcuccugaaacccuuucaguagacagcauuucaauucagagaccaaagugaaacuaucuuugaaaacagggacguggcugggaaaccaugcacaccucggcgaacacuuuuccacccaccacgagcuuggacuuucugggaagguugucgguuuucuggucaaaaacauucuugaagucaucaggaauggaggaauggagacucggcaucccgggaaagugaguuccugguuucaucgcugggauucaagagccgaacagccuggagaagucagagggcagaaaugucugugaggauaggaggugacuguucuaaaaauauugucagcgauuauuuuacaugacuauuaccuauuacuuagaugauuuuacaugauugucugauuuuuuaaaguaaccugugauccaccugugaauauaauuaacaauacugaacuacacaguuaaaagaagaauauacucuuuuuuuuuuuuuagacagagucuggcucugccgcccaggcuggaguacaguggugcgaucucagcucgcugcaaccucugcauccgagauucaagcgauucuccugccucaaccugcugaguagcugcaauuacaggcgccugccaccaagccagauuaauuuuuguauuuuuaguagaaaugggguuucaccauguuggcugggcugguuucgaacuccugaccucaagugauccacccgccucagccucccaaagugcugggauuacaggcgugagccacuccgcacagccaacaccaccacccuauaagggaaagcgguacagcuguuaaacaaaagauauauacaggaacuuucgguauuaucuuugcaacauuuccacaaaucuaaacucauuccaaaauaaaaagguuaucugaaaaaaauaagagugcagaaacagcuggauuuccacaugcaaaagaauaaaguuggaccccugcuuuaugucauauaaaaaaauucacucaaaauaggucacagaccuaacuauccuccagaauccaaacuacaaaacucuuggaagaaaacuuacguguacaucuuuguaaccuuggguuacacaaugauuucuuacuauaauacccaaagcacaagugacaaaaagacaaaaacauaaacucaacuucaucacaguuaaaaacuuuuuuuuuuuugagauggacucucacucuguugcucaggguggagugccguggggcgaucucggcucacuacaaccucugacuccuggguucaagcgauucucaugccucagccucccgaguagcugggauuacaggcacccgccaccaugccuggcuaauuuuuguacuucuaguagagacgguguuucaccauguuggucaggccggucucaaacuccugaccucaagugauccaaccgccucagccucccaaagugcuggguuuacaggcaugagccaccaugccuggccauucacaauaaaaaacuuuugugcuuaaaaugacaccaucaagaaagugaaaagacaacauacaaaaugggagaaaaugcuugcaaaauacgcacgugauaauggacugauaacgagaauacacaaagaacccuuauggaucagcaauaacccaauuuuuaaaaagggcagagaaucuuaagaagacauuuccucaaaggagguggacaaauggccaauagguacaugaaaauauguucaauaucauuaaccaucagggaaaugugaaucaaaaccuucgaacuggcugugcacaguggcucaugccuguaaucccagcacuuuaggaggcugagguggguggaucacuugagcccaggaguucuggaccagccugggcaacauagcgaaacccaguacuucuuguagagacaagaaguacaaaaauuagccaggugugguagugcacacccauagucccacuacuuaggacgcugaggccagaggaucacuugagcccaggaggcaaaaguugcagugagcugagauugugccacuguacuccagcuccagccugcgcaacagagugagacucuguuucaaaaacaaacaaaaaacuuucauaccuacuaggaugaccacagucaaaagauuaacgguaacagaguuggcaaggauacggagaaaguguaacccucguaggcugcagguaggaauguaaaaugucguagcuacuuuggaaaacacucugguguuuucucaaaaggauaaacacaggucggcuuuaaucucagcacuuugggagguugagguggguggaucacuugaggucuggaguucgagaccagccuggccaacgugguaaaacccuguuucagccaggcgcagugguucacgccuauaaucccagcacuuugggaggccgauguggguggaucaugaggucaggaauucaagaccagcuuggacaacauggugaaaccccgucucuacuaaaaauacaaaaaauuaggcaugguggugcacaccuguaaccccaguuacucaggaggcugaggcaggagaaucacuugaacccgggagguggagguugcagugagcugagaacgugccacugcacuccagccuuggcaacagagcgagacucugucuccaaaaaaaagaaaauuauaaacguagugugaucauauaacccagcaauuucacuccuauauagcucauaacuaaaaacauaaaucuguacaaaaacuuguacaugaauguucuugucaccacuuucauaauagcuaaaaaauacaaacauuucaacuguccaccaacugacagauggaaaacuggggaauagucauacaagagaaugauucugccaugaaaaggaaugaagcacugcuccaggcuacaacguggaugaaccucaaaaacaugaugcugagugagaggagcuagacacaaaaggccaugcaguguaugacuccauuuauauaaacuguccacaugaggcaaauccacagagacaggaagccgacgagugguugccagggacuaagggaggggaaauggggcgugacugccaauggggacgcgguuucuuucuguguugaugaaaauguucugaaauuggauagagauagcggcugcauaauccugugaauauucuauaaaauaccggauugugaagacagacuuccgccuuuuacuuguaaaaccucuccaugguucauuuucucccuaacuuuuccucuuguuauuuuaugaaaauuucaacacacagaagaguuguguugaaacacacugccaccaccuacauucugcaauuaacacuuugcuguaccacauaccuauccaucuaucuaaccauuuauccguauuuuugauguguuucaauguaaguuauagaugacagugcuacugaucccuaaauacucagggacguuucuccccuauuucagacuuuucauaacuucuuaaacuuuccaaagcucaaacaacacaagagugggcacagggagauugggcacgguggcucacgccuauaaucccagcacuuugggaggccgaggcaggugaaucauuugaggucaggaguucgagaccagccuggucaacaggaugaaaucucaucucuaccaaaaauagaaaaauuagccaagugugguggugcgugccuguagucucagcuccuugggaggcugaggcaggagaaucacuugaaccugggagaugcaggaugcagugagcugagacugugccacugcacuccagucugggugacagagcaagacuccaccucaaaaaaaaaaaaaaaaagaagaaauaggcacacggaauauugaaccaugcccaggcucugccaauuuccucagcaacugccacagggucaccucucuaccccaucuggaguggauccuuccaacucccuggcuaaacaguguuucacucccauacuuaaggcacucauuuaagguuuauccaugguuacugcaugcacauuacacagcugaaguuaggcugcacagacauaguacccuccggccuucuucacuuucagaacguuucauuuccccaugcagacagaaccuucuggcacaucaucagugaugguauugugacagccagucacaugggcauccuucaaguuaccugauccuuccccuguucuuggacacuuaggugauuuccaguuuuuaaauauccugggaaagccagucacuaccucccugagagggcccuuucuugagagaaucuucucucacccauggcccccagugaaagaguuggccugggucagagguuggcacauuuucucuguaaugggugacuguuuacuaacaguucuggcucugcaagccaugucaucucugucacacaacucaacuccaccgcugugacacagaagcagccacacacaugaacuuuugcgaaguucauucacaaaaacaggcaguggggagauuuggccuguggucugaugacccuugaccuaagugguuauggcagaaucaagaacccccaccccaaauggaccagagugacaccaaggugggucaaucagacucugccccaggaaacaaaaucaggacccugggcuacugacuaugcaggucuuggaaaguugagcugggaggaugcccgaggcugcuguucuggucacagacuagcagaugagggagugaagaugcuggucaaacaggagaggaugaugaagcaggugcacaggaaagacgagaaugagagaagcacacugacuucuucccugccccaggaccuuugcaaagaugagaaugagaaccaugcugacuucuucccugccccaggaccuuugcaaagacgagaaugagagaagcaugcugacuucuucccugccccaggaccuuugcaaagaugagaaugagaagcaugcugacuucuucccugccccaggaccuuugcaaagaugagaaugagaagcaugcugacuucuucccugccccaggaccuuugcaaagacgagaaugagagaagcauagaagcauagugacuucuucccugccccaggaccuuugcaaagacgagaaugagggaagcaugcugacuucuucccuuccccaggaccuuugcaaagacgagaaugagggaagcaugcugauuucuucccugucccaggaccuuugcaaagacgagaaugagggaagaaugcugacuucuucccugccccaggaccuuugcacaugccacuuccugugccaccaugcuuuucuccagcucugcaaauggcaaacgucuucuuguccuuuaggucuugauuuauuauuauuuguuuggagacagggucuucuucuguugcccaggcuggagugcaguggcaggaucucagcucacugcaaccucugccuccagggcucaagugauucucccaccucagccucccgaggagcuggaacuauaggcaggcgccacuacacucggcuaauuuuuuuauuuuugguaaagacaggguuucaccaugcugcccaggcuggucuugaacuccugggcucaagcaauucucccaccuuggccucccaaaguacugggauuacaggccugagccacugccccuggccguuccuacaauuucauguaaguuccuugaucuccucacaagccuucuuuguuccuaggcaagucucauacaugcucucagauccucucugccagguaggauaccuuggcaacagucuuccugggaauacaucacgguccuugugaugagggugaaaugccauccuccccagaucuccuauguccuggaagcaucuucgcaaacagccacugggguggcacgcagacuggacagcaaccccacauucggagucucaaucacucaggacagacaacuuuuuguccucucucuuucugggggaagcauacagggauggacccacagaggccaagaacaccagauucucccgucgugucuuuuccuaaauccauuuacagcaaaucucacaauucguuaacaguaguaucagaguuauggccccagugcuagauggaaaggcaaucugcuugaguuuucucagccuaaugagaaaaugaaaagccagaauuuaaaacaauaaagucugaauacauuucuacuggcuuccagcccagguggagcaggaucuggcagugugcuggacauuuaaaccauauuuuccaccucggcagaugcagaagaacuggugagacgugacagggccaugggcucagggacggcaucuccuggcagccccugcagaggugccgggcauagccgggggcuggagaacuccauguuccaauaaaaguuccagcccgguuugguggggacacagggacagaguuuaaccccuucagauacugguucccucacuuacuuauuuugaaaacagaaagcagggccgggugugguagcucacaucuguaaucucagcacuuugggaggccgaggcagguggaucacaugaggucaggaguucaagaccagccugaccaacaugaugaaacccugucucuuguaaaaauacaaaaauuagccaggugugguggugggcaccuguaaucccagcuacucgggaggcugaggcaggagaaucgcuugaagcagggaggcagagguugcagugagccgagaucacgccacugcacuccagccugggcaacagagcaagacucgaucucaaaaacaaaaacaaacaaacaaaaaaaacagggccgugcacaguggcucacuccuguaaucccagcacuuugggagcccaagguggacgaaucacaaggucaggagaucaagaccauccuggauaacacgauggaaccccgucucuacuaaaaauacaaaaaaucagccgugugugguggcacgcaccuguagucccaguuacucgggaggcugaggcaggagaaucgcuuagaccuaagaggccgagguugcagugagcccagaucgcaccacugcacuccaguuuaggcgacagagcaagauuccaucucaaacaaaacaaaaaauaaagaaaacagaaaccaggauacaagagugaugacugaaaagacagagaaugaccaucaggugggucacccuggagaaggagacuaagagacgacagugaaaggaaagggcaggcuggacucacacaaucaugcagaacaucaugaagauguuccacagggcgaugaagauucgaaaguaucugaggcucagcaagaauucccggauguugucaccuggaagaaucagaaagcacuuuuauggcacagcuaacaucccaucccuacugccaccucagcaguggauuuuugugacuuccacccacccggcgcuugcugccuccaacuucggcaacaguguggcuuuuccuuuugguuucucccucuucccuacccucaucaggcugugucuaccacugaccaauccccugaaagcaccaagccccucugccucugauuggcucaagaaggggcaugugacccaagucuguccaaugagaguccacccugggacuuuucccccaacuacugggaaagagauaccuucugccaggcuuacugagcugggaagauguaagcucaguaagcucagugcccacaggccaaauccagcagccucuuccaccuguuuuuggauggccuaugagcuaauaguuuuuacuuuuuuuuaaaauauaaagaugggguuuugcuauguuccccaggugggucuugaacuccuggcuucaagugauccucccgccuaagccucucaaaguguugagauuacaggcaugagucuccauacccggcugguuuuuacauuaaaaaaaaaagaaagaagacuauuuugugagacacaaaaauuacaagaaauucaaaucucagugucaaugaauaaaguuuuauggcacacagccauacccauucauuuacauaucauguccugcugcuuuuguacuacaacagcagagcugagucacauuguugugccagacagacaccauauggcccgcaaagcccucagauauuuacuauguggcccucuacagaaaaacaugccaaccccugcucuggggucaucuuugccaacccuaaccagucucacaguaaaaccaacauaaaagaaaggggaauugagagcugcagagagucagauacugacucuaacccuaacccuaaccccaacuccaaccccaacccuaaucuugaaggacugguuugacaccuaaacccagggugccugaaaacaauucuguuggauguuucaauuugcuuuaaccacuuugagcuggguuugcaguguuuguaacugaaagcauccuaauucaggcaagugaaagggaagguguuucuuggugaugacuuacucugguccccuugaaugccaaggaacagaaaccccuccgagggaaggcaauuuaguacgugaagacuccagagaccuggguucuagacccuucuuccaggguuuccagucaaucacucucccucucaagcccuccagaaugaaaagaauggguccagauuaggccaggcaugguggcucacacuuguaaucccagcacuucaggaggccgaggcaggcagauuaccugaggucgggaguucgagaccagccuggccaacauggugaaaccacgucucuacuaaaaauacaaaaguuagccgggugugguggugcaugacuguaaucccagcuacucaggaggcugaggcaggagaaucacuugaaccugggaggcagagauugcagugagcugagauggugucacugcacuccagccugggugacacagcaagacuccaucucaaaaaaaaaaaaaaaaaaaaaaaaagaauggcuccagauuaggugaucuacaagggugcuacccgaaguaucugcagacuggggcugcaugguaaguacagcauacacaacacaagcccagaaauuucuacuuuuucagggaugacaaccugacaucccugcuccauccgagcuugugcugaacacaccaucuugcugaaaacgguuuagacgagccuaguauuaucuagccgacaggauuagucacgugcagcacaaccuguauacagggcugauccagcacagacuagaaacauuaaaugcuuggucuguuuccaggaaguuuugagaggcgcugcucagcaagacccuuccccuagcgaaggaucgugaaaacaggaccucccaccaucaacagaugccaaucaaacguuacucauuccaggccgggugcaguggcucacaacuguaaucccagcacuuugggaggccgaggcagguggaucaccugaggucgcgaguuugagaucagccuggcuaacaucgugaaaccacguuucuauuaaaacuacaaaacaauuagcagggcgugguggcgcgugccuguaaucccaaauccucgggaggcugaggcacgaaaaucacuugaacccaggagguggaggcugcagugagcugagaucacgccacugcacgccugggcaacagagugagacucugucucaaaaaauaaaaaaagguuacucauuccaggcaacagcaguauacaggggauacagaaagaaacaaagaccgguggcucugccccaacaagcauauggggaggagaaauacuaaacaaauauucacaugugacugcucuggugggaaaguuuggguguccugggaauacacacugcagagacccaacauggcaugugcauggggaagggugggagguaaaaaaaaagccuuuccagccgggugccgucgcucaagucuguaaucccagcacuuugggaggccaaggagggcagaucaccugaugucaggaguucgagaccagccuggccaacauggcgaaaccccaucucuacuaaaaauacaaaaauuagcugggcaugguggugggugccuguaaucccagcuaauagggaagcugaggcaggagaauugcuugaacccaggaagcggagauugcagggagcugagauggugccacugcacuccagccugggcaacagagagaggcuccaucucaaaaaaaaaaacaacaaaaaaacaaaaaacaggcuuucugaggaagugccagagcuccaaguucugaccucaaacaugggcaguuuaacaaaugugagcucaaauccugccucuguccuucugcacaggugaccuggugaccugggaccaucccugcacuaucuaugugcauucccucuugugucaauaggggugucaggcagcuaggaagaccuuagcacacugccuggcacgcaugacgcucucaacaaaugcagccacuaugguauuacaguuaagccaggcaaagaggauggagggcaaagagcagcucccacaggggaagcagcaggugcagcaccugggcuggaaggagacuggacacagcaaagcaggaagcuccugacagagcacuggugcccugccuggcaucccugucacugaugcuccugccacuuugugccaaaucucccgcccacuggagcucugauucggaucuguacagugcaacucuagggccugguagugccuuccacguggggguuaaguaacacauggcugcugagucaauguaugaauggauggaucaauggauagacggacagauggucuagugauugagugcacaaccgcuagagucagaaaaacccagguucuaauccugauucucauugauucccuauguggccacaaaaaaguugagccacaucucugacccucaguuuccugaucuguaaaaugggaaagugaccauuaucuuuuaagaauggagggagaaugcaacacuaacaggaagcaccuaacugggucagcacccaagggcaggcccccaaaaaggggagcugcuggagugucuucaaaaucucagcucggccaggcgugguagcucaugccugugaucccagcacuuugggaggcugaggugggaggaucguuugagaccaagaguuggacaccagccugguuaacacagcgagauaccuaucucuacaaaaaacauuuagaaaauuagccaggcgugguaguaagugccuguagucccagcuacuugggagccugaggcaagaggaucucuugaacccaggagcucaaggcugcagugagcuaugacugugccgcugcacuccagccugggcaacagagcaagacccugucucuaaaagaagaaaaccucuguuccucaggguucccccauccuugggcagugcuccaucauggcauccaccgccuugacugugacgccgccuccucaaauggccuucccuuccacaccccagcaggagggcaaccccaucaccauccugugacucccugccucugucaccuaacgucaccucugucacuaucuauucccugcuuagaaaccaugugucccaccccaugguaaguuccacucuaucugucuuaccccugcuguaccccagcaccuagcacaguagccagcaugcguuagguacucaaauaucuggugaaugaaagaauuaaugaauggauacaauagucauguacagauccccuuaagacuccaaauaguuacacaaucaaauucagcaggaaguguaaauucuggggccuccagggcccaggcagaugauagacauaugaagggguuagggcugggaugaggcagagucuacaggccccaccuccucagaguccuucucaacuacacucaauagaugcaaacagcucuccugaaucuugaguugcagaauguuccaauuuuucaagaaaaaucagacaucuuaauuuuuauauaaaaucuccugauuaaaaaucuaauguuggcaucuaauuuuaaaaguggcaggucugcagcacucugaaagcaacagcuaugugugagguuguucauucauucauucacaggcaucggaggacggguacggcaagaacaaaggaugggacaagccaagcuagggccucuucucugaaguuuacagucauaugugaggggcagacauuagccagaugacagcaaacauaacagaacauuauaacgguaggaagugaugugagugcucacaucagggaggucugguaggagaaagaaauagaugacagagguaggcagaaaggcuagcacauucucagucaucucccacucacacacacgcucaauuaaagagaaaacuuguggcucacgccuguaaucccagcucuucgggaggccaaggcagggaucacuugaacccaggaguucgagaccggccugggcaacguggagaaaccccaucucuacaaaaaauacaaaauuuagccuggcaugguggcacacaccuguaaucccagcuacuaagggggcugagguggaaggaucacuuuagcucaggaggucgagucugcagugagccaugaucgcaccacugcacuccaaccuggacaacagagcaagaccuugugucaaaaaaaaaaaaaaaaaaaaaagagaaagaaagaaaacgaagguagggcuuggcgaaacagaacuguccucugaaguggaccaugcaauuccaggauccaauuagaccuuaccugugcugggcucccuggacuccuccccaaagcccugcguguccuucuuuuuccuacaaagaggagcagacaguguccacuuucaaugggacauagaguccucagcccccugacccccagcucagaaggccacaaacacuaaguuucagcccuggcccugccgcaaacuugcugugugaccucugacguucaauacccuucucugggcccccacugcccggacaaucacagccaggucagcagccaccgaccguuuacaaaguggcccgacagugcgggugcagggcggaagguccgcgguggggcuauuucuugggggauggggcuuaagcucuccaggaaggugaacagagggacaaccaaggaacggagaguauggguuuaaggucucucgggggguggggggcgaggaagauaaaccaggcuggaggcgugcccagagggcggauagggcggggccugcggcuugggggcggggccugagaagugcgccgagaucacgcuuaugagggcggggcuacggguuccccggauggagccgcaguccggccgcgaccuacucacagcuuaaaguucagcaccgccccggcauucaucagcaacguccugcagagggagaauuacaguuacuaggggcgcccccgcguccugccuggcucucucuucccagccucuggucccccuaauuacccgaacagcaggaugucuccgaucaucguuacggccgaagcguccgucagaaccggaagcggaagccccaggg

SEQ ID NO: 191903 - RNA, 647355 nt, Homo sapiens
gggggcgcggccgcgcucgucucgccgggcuguucgcgggcaggcccugcccugaagggacgaaucggcuuggagcgcgggagguggagucggccccggcggucgcucccuggacccaacccgaggcugacccaggccccugcccaugcggggcgccccuggcucggaagagucccccgggccgggagcagcuccaggcagcggccccggaggaagaggaagaagggacagugcucagcuugggggacccggacccucgccgcggcauuuggagccgggggcagucccgaacucugugcuuggcaccgccgcuccgaguagggcagcgccugccgggacccugacccggacccccugcgccucguaggcggcggcgccgccgcgccacccuguucuuccgugucucccucugccuggcggcagucacggccaagguaagagccccggagcgcgagagucgccgcgggggcgccgugguguguagcgccggacaaguucuccgaaccuguggcugguacccccuguacucgggaugccggcggggaggccgggcacacccucugcugccccggccgggagcccuggagaggcuggagguggaagcccccagucuccgaaguccccaggacccccucagggccugcucggcuucugggcacacaggcugcuggcagggagcgagccaggaggaguuucugguuaacaccacgagggcaugugaccgauacccgcacccccggcccucuuguuagcggugagcaccugugguucgcggagccugccguguuuggagagggcccuguugggcgguacgcaacuaccuuucguggugugaugcugugaauaacuuuucuuguuccuucuugcagacaguccugcgcaauuugggggcgagcagccacagcuugcgagucccucuuuaggacagagugguugguuggcauugcuaucuguaggggggaagcccagccagcauguccuuccuguuagucaaagcugcuugugaggagugaucaguguauagcuauccagacauucuuguaaaugucacugcuuuugaaguuuuggagugaggacuccaaaguuuguguauccucaaguuauuuuguucauugccuuauccucuuuuaaauguuccucuuaaggaaccucaguuguacaagccuguccuugccuguuugaaauuuauuaaaccugugagcuucccccagaacaaucugauuuuaaaugggucacuucggagggaacagauugucucuugcacacugaauccaucccuugggugacccuguuuaaugggguuggacucuuuuuuuuuuuuuuuuucgucucugugcugaugugccucgguugagcagguuucugcugaauucagaauccgugaauuuugucacucaguccauuaaaaugaucuccugagggagcaaaauagcagcuuacauuuuucgugaaugucacuggaaguuuuacagggucuuauguaagugcccagagagagagagagaggagggaguggggggagaucaggcuccugcuuccuucaaggggagaaacggaggggguggcaggugggggcguccgccucccugacaugcagaugccuuucuucucugacacagguguggagaccugaagugcuuaucauuccguggaggcagucaccucggguuaauuuuucuucucacuucuccugucuucccaccucaggagucagcuuugauagacuuaagauaaggaaagcuucuaaauuaagaagggaacaaguggugguuguuucuucucccaucccucacaaaugggugacaugaaugaauuacucacuggcacgcuugguccucccuagggguaaaaauaaaagaaauaaaaacgccagcuuuaagauuucacacaucucuuaguguaccuuuauuguucaagaguacuuuagugaaaauugcuuguggagaacacauuuaucgagccugucccuguuaauuccauaccaggaagaaaacucacucgaacagagaggcaaaaaucaccaagauuuagagguuaguggguuuucaagaguggcgaggaaaggaaucaaaucccccuggcaggagagagagguuuuuaacgggaagaucggauugcucuggagugagcaguagcugcugacaagugugggcccuccugcuucacuuaaugaagugugcugggguguggauuaacuuuuugaugugagccaaugcagauuccuuuggcuuuuaaaccauaccuggaagggccuuagaaaugaaaugaaagguuuuuuucaucucaucauaggucucggaagugcuuccaucucuugggaagguugugacgaagguuuccuuuguuucuggguuccugagcugcgcuuuaaaguugaugcacagugcagggagggugcguccuguagugucgccauccuucagccaccuacaguagcaggacacuaggggggacuaguuaucuuuuccaccaucgaagaagaaaacaccagggcccauguuacugugguuuaucuugaggguucaugagccugugguuuauguugaggguucgugagacugugguuuaucuugaggguuccugagaugaacuuuuugggaucuaguacaugcuugcacuagugaguggauucugagugccuaagggaugggccugcucacaucuaaauugucauuuggacaacucagaaccaguuaacugcaaaauguuaugugacauucugaaaagacucaguuauaaucucuaaguauuuaaggacuacaaaaaggcucuauccuuugaauauuagaccauccuaacuuuaaguucccuaacaguuuguaaucaacacuuuugguguuugguuuuugacugcauauucccugcagucaucauaaaaucacauggcuucaaaaugucucugcaguggacuccaucaaacuuaaaauuccccuuaaaaauacauuccguauacuuagagauguuaacauaacauuugacgguguaguugcacuuccaccucagacgcugucugcacuuuuaauaguaugaaaucauuaauguccacagcccuuccagcagaauuggaagauaauucuacuucccugaagaacacugacugccccauugccuagguuuacccaaguagcuaagucuuaucaaagcugaucccagaggugggaguagcggggagacaggaaagaugcaagguagaggccaagaagagccugcuuaguuuagaauacugucacaaaaacaggcagauaucaccaagauguuggucacacuggauucuaaaaggcccaguucagcauguagaguuagacucuguuugaaaccugugaacccaccugaguuauuacuuuucccuugaacucuggggucugguagacggcauuugugacccuuuacccauacguguagugcacauuuagguaguugaaggggagcuauuguuguggucuaggaaaaauggucagcagacagcuuuauuucuaacauuaagacuuuauagauugauucucuugggcacaguacagccaagggguaagagauuggaacaggaaaauaccaucgcauuugccauugagcaccaacgauugaagaccgauccuguggagaauauaugcugucauccugagacaugaaugaagucuuaugaauuugauggaagccagguggcagaaguagaggcaggaggcuggccuuccuuacgguccgugaacaagaugaaggugucuuuuuggcuagagauucucagaaaggaggagcauacugcauugggggugggggauauaagacccaaaaggcugagagcucuagacacccugccacugacacaccucggggauacagccaccuuggaaaaucugcuuaguguuggugaggucgcucuacauggaguauuugccauugagagguguucagcauuucucugucacauuggcguauggagaguagcaggcagcaacgagugaaaggcuucguuaaauguauuuuauaagacuuuucaucuuuucguuuaacaaauaauaauagaccaucuacccuguggcaggugccaugcucuguguggagguuacagagucagguuacauuuagcuucuagucuuuuaugggaggcagacauucagcuauuuguuuguuuguuuguuuuuucuuuuuuuuuugagauggagucuugcucugucagccaggcuagagugcaguggcaugaucuuagcucacugcaaccuccgccucccggguucaagcaauucuccugccucagccucccgaguagcugggauuacaggcgcccgcccccacgcccggcuaauuuuuguauuuuuaguagaggcgggguuucaccaucuucgccaggcuggucuagaacuccugaccuugugauccaccugucucggccucccaaagugcugggauuacaggugugagccaccgugcccgggccagacauucaacuauuauuaccagguaaguacuauccugcagacuuguucaagggaugaguuugaacuucccaggagaguagggaggaaggggaucacaggcagaaagaacagcauggaaacccuaaaguaucuauugugguguguauggagaauagucauaguuaguguggcuggaaggugggaugugcccgaagagggaaacgcgguguuagaagagaaauaauuuaauaagauuccaugcugaggacugugcccccgcuucuugcucuguguauucaaauaguggcaagaaugguugcgagauaaaaucugagcaugcuaacugguuaucccacauuguuauuaaaaacagaaaauuuuuucuuuuguccguuaucauucuacguacagcauuuugccuauucuuuaaaaaacuauuagcaaugcaaauaaagaaagggucccuuaucaacccuaagucugcccucuuguguacaugaauuacaccuggcacuuucauuaugucauuaugcagcagugggaaaaaugacaauguuacuugacaaaugauauaauaugaaaaaaaaaacacuuaggugagaacaaauuccauuuuaucagauaugcucuggguagaguuaugguuguguuuaacaccugaacaagauucauauuaugaucauuucaguucuagucuaaacuuccuuugcuguuagaaaagaaagaguuuugaauauugagaaugggaggguaggugggcaugugugcauauguguguuucuugggaugaggaaacuauggugaggaagagcaagcaacaguguaacugccugaaggauauuagauagagaauguggaaaaucacaguuguaaaagcagucuccagggccagguauauuuaguauaguuuuuagaaacagcagccagaaggauaaugggaauaaaaguuagaagccucucucucucucucucucucuguguguguguguguguguguguguguguguuuguguuuguauguuugucuugucucuaucauccaucccuauguugauugggagacaggaugcuuuaaucaagccccaggggaucagggguuuagucuuacagcauccugugcuaacuugcugugugaccuuagaauauuucuuggcaucucugggcuucaggcgcugucucuauacauuaguguguuacugaucuuguaaguaggaauuuagaggcccagggagggaaagggcuugcuucagucaguuagcuuagccucuacacugagcacucuuuagguugucuaguuuucuccuucuuaaauggaaagaaagaggccugaccaguucauaggugcacucuuccuugaaauauaaagcacugcaaauacacaaggcugaagaaaagaaucacaaagucuuugugauuggucauagccauuuucauaaagcagcagccagacuugccagcuaacuuauuaccuaugguggaaacccguuaguucugaaauguuacacuguucuuugaccacuauuugagaauuaagugcuuugugauuaaaaacaacagcaacaaugcugaaucuuguaauuauuucauaauuaaguaaauaaaagcugaggugaccucuccggauuuugcaaagcccugaauguaacuuggaaggggaaacccauucauuuggccugaacgggagauuaccuuguaggggagcugcugggugaauaucaaaggucuuuugaagaaaaacagaguagaagagcaauuggguagauacacaagucaggaaaaaugcaaagugacuuaguuugaugccuccaaaugugugaguugcuagaaagagggcuccucacuauggcugaucuccuggggguagaggaaagaggagaucugaaguaagugcaguguaaauagaagguuuguuacauucuuauuugggaguugaagccaaguggaggagugcuguauuuuaggagaagugggcauauaaaaugugaucuuaaaacuaaauaauuugagauaaguuaauugcaguacaaaaagauuuuuaccuuacuaaagggauucauagugagucuccuuuuaauagcuaauuccguuauuauauuucaaauuauuugaugaacacaaucaugauagacccuuuugggagccucaccuguuaugcaaaaccaaggacuuuucgguugggcacaguggcucaccccuguaaucccagcacuuugggaagccgaggcagguggaucacgaagucaagagauugagaccauccuggccaauauggugaaaccccgugucuacuaaaaauacaaaaaaaaaaauuagcugggcaugguggcgcgugccuguagucccagcuacucgggaggcugagguaggagaauggcucgaaccugugaggcagagguugcagugaguugagaugccgccacugcacuccagccuggggaaagagcaagacuccuucucaaaaacaaaaagcaaacaaaaaaaacaccaaagacuucucaaacauaaacgaauguuuuaacaaauaacccgcuaggagccuaauauucaacuguauugcagaaagcaguacagugguuauguaaacugucauuaccgcuaaccuaacacauggaguuacaucacuuacuuacuuuuggcagauuacuuauuuaacuacuguucugccuggagauaacaguacucaccuacccaccuucauaaguuccuuaaccacccgcacauucuaccucuaagaauauaucaagaacaaaagugguuuaaaaaguaaauuagguaagaguuuccaggauucugaguuuuuauaauugcagagacauggaauucauuuuguucugcuugaguauacaggagaggcgguguguaugagacauuaaaaaauaucaaaaucaggccgggcuugguggcucacgccuguaaucccagaauuuugggaggccgagguggggggaucaccugaggucaggaguucgagaccagccuggccaacauugugaaacccugucucuacuaaaaaauacaaaaauuagccgggcgugguggcgcacgccuguaaucccagcuacucgggaggcugaggcaggagagucacuugaacuccagagacggagguuacagugagccgagaucacagccauugcgcuccagccuggaaacagugagacuucgucucaaaaaaaaaaaaacaugcuugucugcugguucuuccuucacuguaacagaaauaucuagggcuuuuuuuuuuuucauuguuguucuuccuuuaucucuuaugaggcuuuccaaaaaagauuuuguucuaggaauggaauaaacuguagggcguuuaaggcuucagagguaauuuugggcaaccuggaguugcagguaaucacaggcuggggcuggaauugaaaaugcagucucacccauaauuugagccucuuuugucgcauuauggggcugugccuuggacaggcagcagacgcagauggagauggaacccugacuacugagagagcuuugcuuuuaacauaguccuuuucugaauuaccaaggccaauugggaagaaaggacuugccgaucuuuccagcucuccaugguagccauagaauuuaggaagauuuacagcagaacgugggcaucuagggauuucuuucuuccuuuucuuuuuuuuaaauuuuaaauucagaagggaaucuugggcucuugaguguuauucugugguuagggauugcugcggcuuccuuggauacauuaaaugcauauuuguuauuauugaguaagguuaaccuugcugcggcuaacucgaagccauccccuccccuuuuguuuuuagaacaguugcguagauccuucaugugccaacacuguuuguuuaagagccuucuugacugaugucagcucucaucuggaaauggcauuuugugguuguuucagaagccaagggaggcauagaggcaagcccauaggccgguggggcuuuaccuuucuucaggaguggugcuggugcuuaguaggucugcaguuaguaaguaguuguguccacacugaaugauuuguuuugugaaugaauggucauguuuucauuacugggguggaggugaugcgggagggagaggugggugaguaacaguagacuuaaauggugaugagauagacuugagcuccucaaggcgucuccuagcagcuuuuguuuuaaaaaugugaaggauauuucagaucagcagaaugaauucucugaaggaucauuguugugguucaaacauugauggcuuuguaaaaaggcaaggagaguacaauaccgaaaugcgugcuuucuuuccuccgaguuuguagggauuuuaacuuaucuggaaugagaagaauggacaugcuguaaagcuuguucacauuuacaugacaaguugccuugaaaaugccuggaaagacauuuucaauaugagaaacuuuaggaugguuguuguccagcauggaugacgaugauuaugaaaugacuuagguguagaccggcgcucccaugucaggaggaugaaguggacgugggagaauggagggagggacucaguacuugguccccagcaggaagaacucuccucgaccauauuggugucuuuacccauuucccaauaugacucccucucugcuggguuucucaguuacaagagcacucucugaugccuuccgucuguaaggcagagcuacuguauugagagacuaccaaggcuggaagagaccuuggagccccacuagaccaacaccuucauuuuacauccguagaaacuaaggccagaccuaagggaggucaagaugauuauucagaggggagguggaaccagaaccuaggcucccugguccucagcucucccuucucugcagcaugcucugcuuccauccaaucugcacccaaagcacguucuuccaguguuucuuuugugccaggcacucucucauucggucauuuuuguuauuucauucucacagcaacccugggagggggaugugcucacucucccacuucacagauguggaaacugacgcuugugcaaggcccacagccaugaagaaggagccaggacucaacucgcagcuguucagacuccucaguuuguuguuccaggaccgaccuugccccuggcuucccugccucucugaccucgcuguauuuccuaggacuccucuccagguuuucuuuguuccuagccuacuaggcuucaccuaaaaaugccacuuguuuucccacuugaguggccuuguuacgcugcuuuuuuugcuggauccaaccccccauccucucucuugucucuggcugaaaucguuccugacuguaggcucugugacacugucucuuugugggguuuccuucacuugcucagccaacguugaucaagcuccuacugugugcagguccuggcuugacagcggaacacagaggugcagaguuacucaucguccauucaggagccucgucuuggugagggaggaagagucucguaaggggaugagugaaagucaaagggcccagaggacaguguguuggguagcauucugcuugaagaagucaagaugagaauauuagauuugggucuuagugauuaggagaugggaggauaggguaggaggaggcgucaccaaacagcaaaccaaaucaaaggcugugcuuggccaucuucaacuaggcauugucaguaucuacauacuuuaauucuuauuccuucacuuagguauuagaggcugugaguacguuacacccauccuuauaucuaugaaagcaccuugcgaagcucuuaguacuuacgacuccuccacucaacauuuauuauauuaaauucagagcuuccugucccugcccucgagggacauaguuggagagcuugcaaaaaaugugucauaaguuaagcaacaauagaagauuaaaugaacaguuacgagcaacaauagaaaggagguagcaguguagugaauggaugugugcacugugguggcugaacacggaugggaagucagaggugggagcuuccuuuagcuucucaaacucaaaggaggggugggacuugaguugggucuuuggauacaagacaguuaaaaucugaauggaaggauuaagggaggguaguuuggcaagcacaaauauauuuuuuggguuggagaggaagccagcuuggguuucuguuagcaaggaguugcagaugaaguuggugaguuaggccgggcgugguggcucaugccuguaaucccagcacucugggaggcugaggcgggcgaaucaugaggucaggagaucgagaccaucuugacuaacgcggugaaaccccgucucuacuaaaaauacaaaaaauuagcugggcgugguggcgggcgccuguagucccagcuacucgggaggcugaggcaggagaauggcgugaacccggaagucagagcuugcagugagccgauaucaugccacugcacuccuccagccuggaugacagagcgagacuccgucucaaaaacaaaaacaaaaacaaaaaaaaaaaaacaaaagaagaaguuggugaguuaggggcugugggcuuugggaaggcagggugacuuuucaucagggggauguggugugcuaaaggcccugguuuuggaaggugcaccugcaucgugccugggacaaauugaagcggggagagauggaggcugggagacagcuggacaggauuuuguaccaguucauauaugaaguucuaagggccgccaggcuggaacuguuacaggaggacagaagcccagggaggcuugugaauuuuucucuguugaaucacuggcucacaaacauuugcuugauauggaagucugagauggcuuucauugcccacuguaauauggccuuguuggaauaaaguccacucgugacacaagcagcaagucuuaaaauagcgcuuucuccuuuggcuuggcuugggguagagcuuuggugaaaauacacuuuucggggccucucuuauuggggguuuguucaaaugggcucaggguuauagaacaaccuuuuuccuagccuuggauggcacccaauaagggguauaauagagaaaauucuucuuuuccucaugaguggcuccuaaagcagcugcguggagcugagagcaaagugcuuggagcucugacaucuggguucuggauucaccuuaaaagugaagccaauuucuuugcuuccugugacggcugguguuucucugucugaggaggagcuugcuuugagauuacgguacacacuuuucagcauugugggguaagccauucuggauaacagaauuucucaaauaggauaauccaaucccuuacagacagcaagucuuuauuuuuaaucuuuaaggaaugaggguuucucuaggauguucuguguacuuacccucacuggcucaccaucagccccuggaaaacuucagcugucauauugggacgcacaaagcuuguuaugaaccagcccugccuuucucugcagucucaccccccaccccuggccaccccccauuucaugcaucaucaaucuguaacuuaaucauuuucuucuuuacugauuuuuuucccccuagaccugucaagcugugcacauaccccuccugcccgguaagcucuuuccuucuuuaucugccugggacacuuguguuuuuccuucagaacccagcucagguaguccugccucuuaagcuuuuccugguacugagcacugaaccgcaucugcaccucagucugacuucugcagcugcacuuucugcgccguaaccugacuguuuugcuagagagcgggagccuuucaguaaaacugcaucucaggggaucuucuagguuuuaccguaugccuggaacaugcagucaauacaauaaaugguuguuguugucguuuuagauuucagugaauuugcuggccaggcauaauguaacccuuucugaugaaaccucgagugucauacugugcugcagugguggauggguugaugugaauuagccucucaaaguauuccggaaucuaaagaaaaccuucccccucucaccaaugaccagaauggccauugggcauuccugggguacacugaugccuucaggaaaucugguggugcuggugagguagaaugcaucuuagucaucacugcagaccuagaaaugucuucacacaggccgggcacgguggcuuacgccuggaaucccagcacuuugggaggccgaggcggguggaucacgaggucaggagauugagaccauccuggcuaacauggugaaacccggucucuacuaaaaauacaaaaaaaaauuagccgggcgugguggcgggcgccuguagucccaccuacucaggaggcucaggaggcucaggaggcucaggaggcugaggcaggagaauggugugaacccgggaggcggagguugcagugagccgagaucgcgccacugcgcuacuccagccugggugacagagcgagacucugucucaaaaaaaaaaaaagaaaugucuucacacaagcucucaagggcugaguauugaaguggaggauuagcagguaggaggacuugaagaaccuuguaccuuuuauguuuaauaguauuccccauuuaaagagccagaugcagaauggcagucauaauugauggagaaauuaucagacggugauggggacuggcuagggaggaucgaauaaauuuguacaggagcuuagcagcagugccuaaagacucuucuccacauaaccacauguuuauguuagaauauuuaguauugccucuaguauucgugagguccauuuggguuuuuauggcacugcccuuguaagccaggcgugagugcugcaugaauagguuugcuuagcaaaucacagaggagugacagaggagcccugggcuuaucagaagguuugugugauccaggcacuagcaaaacuuuaugaacuugcacuuggcacgugguguugguuauaugguucaggaagcccuacugcuucuccaguaguggucugauuuaauccauaccaaggggugcuuguucugggucuuagcuuuugccauuuuccuuuuucuucugcuuggaauuaucuauaacuccuuuggaaauacagcauuuuugagcucauuaaauuuguuaauguguguauuauguugagaaagcacucaguuauuuagaguugcuucauucccuuucccuucaucucuuugccuuccccaccuuagaguaauugugcuugguuaaccaggaaaccaagggcuccuggggaugaagaagaggccagucuuucucuucuuagcccuguccagagaucucagaaaauuugcagaggcccugaagguaaaagcaaaugguugcccacuaaucaccugaggcaguuuuucaggaguuuucugucuaccuugcacuuuucucucauaggaaauuugggcucugacaguuaagagagauggcagccaaugaaugggauaggaaaggccccuuccuuagcaguuuguaagaaaagguacugaggugugcuuuacaaguauuaugccuuuugacagcucucuaagcugaguaguuucauuuuacagcuaaggaaacugaggcuuggagagguuauuugcucaagcaauaaagcccagagacuggaaaugaauuuuguuuucagaauauuugcuuuuaaucucuguccuauaauccaacaacccagguguccuaauacuggaaauauacauaccccugggaaauacaugaagacuuuucauggaguaugcagauguggauacuucuaagaaaauaaauuuucacaucuccagccucacauaugugcccuucccugaaauugaucagccugagaugaucccugucugguccacgguucucccaauccuccuuucaugguuauccucccucauuuuguuuauuuuuauuuuuauuuaauuaaucaauuuauuuauuuuugagacagagucucgcuccguugcccaggccggagugcaguggcgcaaucucggcucacugcaaccuccgccucccagguuuaagcaauucuccugucucagccuccugaguagcugggacuacaggcgccugccaccacgucuggcuaauuuuuguauuuuuaguagagaugggguuucaccuuguuggucacgcuggucucgaacuccugaccucaggugauacacccuccucagccucccaaacugcugggauuacagguaugagccacugcaccaggcccuguccucccucauuuuauaaaggcacaucucuuagccagaacuagucuuauucuggcauguugcucuggguaugaaaaucucaagggucaccuaacaaagggacuauuugaaauugguauguugagguccuucuaaucacagcaaugccacaugguugccucuuucccuuuugucuuuuacguguugaaacuuggugccagaaacagggcauuuaagccccuuucucaugugagagaauaauauaacauuuucaguucuuaaaaaauaacuugcuguuggauuuuuaaaaugaaugauggcuaucagauugcuagauuccauuuaaaacugugaugugaaaguuuuauuuuaaaauguuaauguuuacaauaugcugaaaauuguauccuuagaaauuguguaguugaggaugaaaacuuuaugucagccuaaaaauaggcacggcaguacaaguuuuucaaauuucagaauucaagggcccaggcaugguggcucaugccuauuaucucagcacacugagaggccaaggugggaggaucgcuugagccuaagaguucgagaccagcccuggcaacguagugaaaccccaucuguauaaaaaacaguuaaaaaaaaucagcugggcauccuggugcaugccuguggucccaucuacucaggagacugggagguggauuccuugugcccaggaaguugaggguacagugagcccuggucacgccauugcacuccagucugggugacagagcaagaugcugucucaaaaaaaaaaaaaaaaaaaaaggaauuaaaaaaaaaaaacuuaaauaccucuguacuauucugucucagauacugaaguuuggaguggguaauuuuuaaguugauuucugccauagacccuuauacaccugaauauuuuuuuccauaaaauuuaaaggacaucaguauuuccuaaagcucauacauugcccuccugauuaagcacacuugaaauucuguuggguuucaggauaauguaaacauccuuuaaauguugaugaaacuuuuacacauguagcuagucaugugaucguguaugccagagugccucaauggcucacugaggacuguuucagguacaaauuauagaaaccuaacucauagugauguuaaauaaccauuccacuuuaucuucuuaagugacugaagacccgagggcagcgucaggcagggcuggaucuaaguccucgaacagcgucaccgacucuacugccccacgccuggcucugccuucuucuguauuggcuugguucucaggcagccuguccccaugggaugccaggagcccugggugcacaucugacuugccccaccaucguagcugagggaaagcaucuuuuucccaguacaucuggcaaaaguccugguuguggccaggcgcgguggcucauaccuguaauccuagcacuuugggaggccgaggcggggggaccacgaggucaggagauugagacugaccuggccaacauggugaaacccugucucuacuaaaaauacaaaaauuagccaagcgugguggcacacgccuguaaucccagcuacucaggaggcugaggcaggagaaucacuugaaccagggagucggagguugcagugagcccagccuggcgacagaaugagacuccaucucaaaagaaagcccauguuguaaucugguuggaagaaccuccaccacauccccggagcugguaggaggaagucaguccuauuugaauugcuugaagaguggggaaggagucauucuaggagagaagcuggguagacagaauggccgaaaauauucaguaggaagauuaaucugaagaucuagaagucauacaaaagagaccacaggucucuauaaaaccuuuugacuguccuguguguacuuccccuaccagcgccagucaacacuuucccugcuaggauacucauccgcccauugacacaguggugucagugauaccuucuauucccugcaucagucauuucaagacuuuuuuuguuuuguuuuguuuuuuggagauggagucucgcucugucaccaggcuagggugcaguggugcgaucuugguucacugcaaccuccuccucccagguucaagugauucuccugccucagccucccaaguagcugggaucacaggcgcccaccaccaugcccagcuaauuuuuguauuuucaguagagacaggguuucaccauguuggccaggcuggucucgaucucuugaccucgugauccgccugccuuggccucccaaagugcugagauuacaggcgugagccaccgcgccuggccaauuucaagacuuuuaaggacacggugaagaaucucugacaauguguuuugccauucuuuuuuuuuuuaacuguuaugugauuuuauuuauuuuuuaaaaaaauucagaaugguggaauuccaucuauuuuaguuugccaggguggccauaacaaaguaccauagacuguggagcuuaaauaauauuaauguauuuucucacuguccuagaggcuggaagucugagaucaggguguuggcaaaagccucucccuuuggcuuauauguggcugucuuuuccugcuguuuucauauggucuccccucugcgugugucugugcucuaaucucuuccuguuauuaggacaucagucauaguagauuagggcccacccuaaugaccucauuuuaacuuaauuaccuuuuuauuuuuugagauggaguuucgcucuuguugccugggcugcagugcaauggcuugaucucggcucagugcaaccuccgccucccggguucaagcgugucuccucccucagccucccgaguagcugggauuacaggcacucgccacugugcccagcuaauuuuuguauuuuuaguagagacaagcuuucgccauguuagccaggcuggucuugaaccccugaccuuagaagauccaccagccuuggccuuccaaagugcugggauuacagacauaagccacugcgcccagccuuaaucaccuuuuuaaagaccccgucacuaaauacggucacauuuugagguucuggggguuagaacuucaacauacgaaguugggggaggggauguaauucagccuauaacaucaucuguuguuuuaaugcugugaauggguuguauuuugaaaaacauguacauaucuuguuugaaacacaaauuaguaacagauucaccuaggcagugcagacuguuucagggaugguuaaguuugauguagaguuuauuauucggguacugcuuucccuuuaauaggaguagagagaagacaaaacguacagaugagaacugguuguggauuugcgaaaaaugcuugggguuggauagugagaaucuggaccuuucaccucccuaggcucagugcugccguguuggaauuguagcauuguccuugcaauugacagcuucucugcgauacucugaggguggacuuggguugugaaaugaguuuuaugacuuuuuggggaaugggauggguggcugcccuaaggcaggacucugucuuugagaccaacagcucauccuauucuucccacuggagcaguggauuggccaagagcucugcugggcacgccagcacucccgugugugagagagucuugucgucuuguuuuuuugugugucuuacggaccaaaguuuucaagugugggguuuuaugaguccauuuggcccacgucguaaaagugccacuguuguguuggaaugauuucuguucauucucagagcuaaucuuuaagguucugccugugacaaaccuguucaucguuccacuuuaucaagaaguugucauuguucucgcucuugcacuaauuacuguuuuaauguggcuuguguguucauugucuggucugucucuguuuagaaugaaacaucacagccaaaaagauguggggaguagguagcagcuuucaaauuguagucuuuucacauuagaacccaaaaauccgcuucccaaauuuugcuugccugcaaaccagaaauuucaguacaauuuuagaaagccauuugcuauacgaugugguuaaaguaugcauauguucagguugagggccugaauaagucauccauguaucaucaccccuuuaucugccaacaucgauuguguuaacugauuggaagauugucauuucaacauuuuaauuuaauuuuuuauagagaugcuaucucacucuguugcccaggcuggagugcaguggugugauccuagcucacugcagccuugaacuccugggcuuaagcgauucucccaccucagccucuccaguagcuaggacugcaggcaugugccaccucacccaacuaauuaggggauugucuuuauggaagacauuucacagugucugagagaguaggacauaggaucaagaaguuuuggcagaacaugguuuauuguuauuuccaugcuaauauuuccuggcuccccuuggguaaggugcuuacuuucuuugcauucauuuccuauggcagccguaacaauguaccacgugcugaaugaccuaaaacaacagacauuaauugucucacaguucuggaggccagaaguccaaagccaaggugucuggaggagucagcaggaccacacucccucuccaguggcucucggugagaacccuucugguucucacuagcuucuggugauugcuggcaauuccuggugaucccuggcugguagacaugucccuccagucacauagcuauuuucuucuugugugucuucacauugucuucccucuguacaugucucugugugcaaacaacccccccucccuuuuuuucugagacagaguuucacuagugucacccagguuagagugcaguagcgcgaucucggcucacugcaaccucugucucccggguucaagcgauucuccugccucagccucccgaguaggugggauuacaggcgugugucaccaugcccagcuaauuuuuguauuuuuaguagagacgggguuucgccauguugggcaagcuagucuugaacuccucaccucaggugaucugccugccucggccucccaaagugcugggauuacaggcgugagccacugcgcccagccagcuuccccuuuuuauaaggacagcaguuauauuggauuaaguuccaccuaaugaccucauuuuaacuugauuaucucuguaaaggcccuauuuccaaugaaggucacaauuugagguaccagggguuaggacuuccucaugucuuuugggggauuauuucaacccuuaauacugucugagcuucauuuuuuucuccucugugaaacaaggucugucaucuguucucgccuuuaauguaaggaucaaacacaaguuaaugagaaagcaaucuagaaaucguauccccugagugauggccggaugcccguuggacauuagaggcucuucauuccaagcaagugacaucuaaugagcauuugggucugacacgugauguggucugugagaauuuucaauuguaaguccuuuggagguaagaauguuguaccugagcuguguguuugguggaaacguagagugagccggggcugggcuugcaagggggagcaccacccgggagcugagcugcaucuucuuagacgucaggacugcuguguuccuccuuguccugacuugcaggccagugacugcugcccugugguacaauuugaguguaaauccugagauaucuguuccaacuccugaaucuuucauggagagugugggaauguauucugguuuuuugguuuguuuucaugagcuguauuuugauauucaacagagguucacuuggggcagaggcuaagaauguuuucagacugcauuucucuuuuguuucuuccuaauaacuugcaaugguuaggggaaaaagcuacaaaacaaauaagccaaaaacaacccuccaaacccacacacugacauuuaaaggauuugugccuuuuacuugcauuuacuuacagcauuguacagauugcugucugaauauauacaucuggauguauucuuugagaugcccaaagcacugcagaagucucacuucuuuguuaaauagauuuucauguuauucccaucaauuggaucagaauuucugagggcugcuggucaucgauguugcuuugcucagauucauuccuucauuugcugauucacugaacacacaguuguugacccucuguuauaugccaagcacuguacugggcacagugagggggcgggugaggaggagaacaagacaaagucccagucccugcuugcuuggaacucucauucuguguggcuugguucauugugagcagauuagguuggcccuuggcugucaugcuuccaggcaaagcuaucccuuuugucacuugccaccugcaguucugggcuaaaaacuaccauauguauaacuccucuugguauuuauugguuuguuacauccaauuuugcaaagccugaugcauuguuugguuagaaggaauccucuauucuacucccaagaggccgcucaacaggcuuugaugauccguuaaacccaguuccauuuuugacaugggagagccuguaacuuuuuugccuguuuugauuuugaguccuuuauaggguauuuugagaguugggcaccaucaggcggguuugaugucagugccucacaggugggcgaugaaguucugggaucaauuuuguuauauggccgccuuguacagugccacacuggaagcuuacauugcaagacauguucuuuucauggcgagauugagaugugguaauugaaaugggaauggcugaaaggaauacugaugucuccauacugcagggagggguccaaagccaucuugcugaagagcagcagggguuugugguccuguucacuucugauagggagcagcauaaauagcacauccugucacuucccgauggauacaguugcgugaggacuuguuuauaaugaaugguccuggaaaacaacaucucagggaaugaggaggcaggagggaacauuucugcagggauaggagaaggaggaacugguagaagaugucauggagaauugcauaauggguugguuuuaucuuaagaagaaucuuuuuguuuguuuguuuguuuuugaaauggaguuuugcucucguugcccaggcuggagugcaauggcacaaucucggcucaccacaaccuccaccucccggguucaagcgauucuucugccucagucucuggaguagcugggauuacaggcaugugccaccacgcccagcuaauuuucuauuuuuaguagagaaagaguuuccccauguuggccaggcuggucuugaacuuccaaccucaggcgauccgccugccucggccucccaaagugcugggauuauagacguugagccacugugcucggccagucuuaagaagaaucuuguaaugaucuuguggaaggagaggaggaaauaaaaguaggguuacgugguguaaagugcuuugcacucccucugcaucucauggaaaugcagaacuuuugggcucccaagagggauguggaccaaugggaugccuuaguuuguggauggggggcggggcacuugggcccagaucaagggaaccguguaggcucacaccaaguuaaugauaaaauucaggccacuugacuuccaaccuuuuauuuucucccucaagcccaggcugucuuccgcaucauucaggagcucuuuuaagccuggcucaagcuuucuuggggccugugggccgccaaagaaacugcauaguccucuugguaauuguuggguaccuuuuggguggcuacagcuguggccacguguaugcugaaaggagugacaggacugggucucuuguuuuuuaaacagggucucauugcuacaaucauugaauguauuuuuuaaagaugaauauaaaacagcuacccucccaagcaaaucauaaaacaaauuaugcccuugccacccagaacuacagagaaacagcaggcacuucguggcacagagaguaauggcugcaauauuaaaacaaugaugggaaaaccaggauccaauagcugaaagcagggaggaaaacagccucguaaucccccagggauaaugggucucaccgacaggucccugugauuuauugugcuuaauguacuuauuuuuauuuguccccuucaacacggagcuuugucacugaagagauuugauaauggccuguuugcagucacuuagacucucguaauaaagcgccacauuuuggcugucuguagguuccgcuggcuucauuggcauucccccucugauuucaccuucacuggcugagcugggauagaucuagauaagggcugccucccuugcguauucccgucaugcugcccuguccugacuucugccugauagccagccuuacuagguggcucuccaggcccagcuugccuccugcuuucguuuuaugcuacuuugggaccacaggaaggaaccccuuauucugccugaaauaauaauggaucccugggacuuuuaucuuuguagaccaccaaugagaguuuacugcuugcagcuuuuugggugagcaaaaauaaaagcggaggaguagguaugugggguuuuugcaaaagaaugggcuugauuuaaaggcuguagugccuucugaaugugguagccagcugcuuugcaaagaagggugugugggauucaacaguugugagugagucaaccugaggcuuucauuucagcuucuuccugggcuuugaaggaagggagguagaagcucuccagggagcuccacaaaggaggcaugacuggccuccuuccugcaaaacugucccugaucugcuaacguuggggugaagaaauccaggaagugagagacaggggcgauaaccagaaaagcagcuucaacuguuuuccagggcagcauguguguuuccucucuuugaggaccucucucugauaccccaccaucaggucuggucggcggggaagguucugugcuggguugcaucugacacuuggccccuguagcacagcugggggagagcauugcuuucauucugaauacugagagagaacgagugaguaucuaauuacggaaaacucaaauaguguaacugaaaaagacuccuuuaaaauguaggagcagcagcaaaagucaagcacaccaggggugggagccgggaguggaagggaucagugucgcuaggccucaguagauggagugcuguggacacugugaaguuugaacauucuagcaaggugacggcaucauugagggagagauggugcuaacaauaggacguugcucucagucacuugggcaccuuuuacuuuccuaugccucugucaaaaguuuuaacaggcucccaagccacuggaccccaguacacgguacacuuuggccucaaaugugccccugguaccuuaagaucuagcaguucugcugaguauauacccaaaagaguugaaagcacaguucuaaagagauauuugcauacucauguucauagcagcgucauucacaauagccagaauguggaagccacccagguguucaucaguggaaaggcuaaacaccaugugguguagacauacauggaauuuauucagccuucaaaaggaaggaaguccugucacaugcgacaacauggaugaacuuugaggacaugaugcugaguuaaaugagucagucauuaaaaagauaaauauuuaucauuccaccuauguaaagucccuacaguagucaaauuuguagagacagaaaguaaaauggugguuuccagggacuaggggaaggagagaauugggagugagcuuuuaagggggagacaguuucaguuugggaagaugaaacagugcuggagguggguguugguaaugguugcacaaaaauaggaaugugugugauucuaccaaacuguucccuuaaaaauggguaaaauuguaaguuuuaugugauguguauuuuacuacggugaaaauaagguaucucuggcaggcagacucuaaguuggcccucaugauccucaucuccugaucugcucuuguguggucccuuucacuuggggugugcaggggacuugugacuugcuucuaauaagaccagagcagaggcgaaggaugucacuucugugauuacauuuccuuauguaagaccccaucuucauagcaaacuugcccugaaggauuuccuucuuggcuugaugaaguuggcauguugggggagcccauguggcaaggaacuguggguggcuuugaggagcagagggugaccccugcccacagccagcaagaaggcaaggaccucaggcacaaggaaaugaauucugccagcacaggagggagcuugcagguggauucggccccagagcucccuggggacaccuuggcuguguagccuuaugagauucaugaaccauagacacagcuaagccaugcccaggcucacacugagcuauaggaacugugaaauaaugaaugugugcuguuuugagccaucaacuuugugacaguuuguuacacagcaauagauaacuaauauguagccucccaggagaccugccugaguccauuccauccuaguuuucuacucuggucaccucaggucuccaucuccuccucuuguccucugugagugggcagauggccugcuuuucuguuuucuguuuaugcucaagugcauucauaguuagagccaauuuguccuccuugugccuuccugcucucucugguuuccgguuugugugucccauccagagaccgagggugccaacucugcccaccucuguagagguguacucuccuccccaucccccacagcacccccacuugccucuccaauauaaggcucaugacacaaaauacaggugaucggugaucagauuuucuaggguggcucuaauugcaaauauucugccccauuuguuaucccauuaaaccauuaaacugucccaggcauuccacuuugguauauaagcucuuccgggacuggcucccaugugacaaauugagaagugccacugccauuuuuugagcaccuccugaaugucaaaugcuugauucaugauucucauuguguuuucccaacagccugaugagguggcugucauggugccugacuuacagaggagcacacugagaccaaaugagguucauuuccuuguaugaggucacacacaugugugugaccuuggaccagauauggguccagacaaggaugagaacuccaaagcccuguccuaacuugccuggggccacugccuuggaagagcacaguaguuuuucugccagcucccaugucccaguuuuguuugaaaaauaagaguugcugcacacagaggcuacuucgagguuucugauaauucauucugauggacagcagugggacagugucggguaggggacacagcuaaagccucaaauugaaauaagaagaggagacaagggggucaggaauaagguugcaacugggguagccacccuagugaguagaguagggguccacaguguuucucaccuaggauguguacuagaauccucuggaaagcuuuaacugaugcugaugucugggauccaccccuagaaauagugauuuuaaugguuugugaugcaucuuggggaccaggaucaaaaacuccacaggugaucugcauaggcagccaagauuuagaacacugggaaggaggccuccauaugguacagguugaacaggaaguagagaagacacagccuuaggauaagggcagggccuggaccaacagcacaaccucucuccccaucuagagggugacccugagugcucauagggucagccucuagauggggaggggaguugacccuuagacuuagagcauccaggucugcagggccgggagcccaguuuggggacccagugaggccugcucaugcuuuuccuguggaaucgauagauuuccugcaucuucagugccuucaaugcacuucuacucaacauguagugaaaggggcggaggugcccugugagacuugugacguucagcgggccuuaauaauaggccugcauggacugccuuuugucuuugcuuagaguucaugguuaaacgugggguuugugguguucccaugauaccugaauaccgcuugaugagagggauuagauugcaaacaccuugugaguggggaacccaauauuugugucugcuagaaugagugauaugauggcuuaccuguaccacuuaaguuaaugauugauuucaacagcuuuugaaaguugaagcacagaagucuuaaggucacuucgggaggugaaaaacuuggugauuaucacuguauuuaaaauuguggcucuccgauaacuccacacuugccuucuuuacccugcucuguuuuuuccuauagcaucaccguuuguuaauaugcugugcguuuaucugaaugugagcugaugacggcaggguuucugucuuuuugugucuuaggcauagagaacucucaauaaauauuuguugagugaauggaguaaaugguggccucuacuaguguuaguggauccagaaaggacauggaauaguuuaagauuuauuccuugguugaguuccaggaggaacugcaggauuuacugggguggugggaagaggaagggggacagugcuguggauacauuuuguuuuaccuacccuuuuggagcugguguuuucuuucucaauuaaaauguauuuucuuuagcgguuacuuuguaauggaaaaugacacuucugccaguuuuagucuuuuauguguucuaaaccgaguccuuuccuccugcuguggcuucaauaaugcaucguuucauaaguucacagaauuuaaugugcuucugcugaaccccuagucucagccagauaguuaaaugaaaauuaaccacuguagguuggauucaaagucaccuauucaccuucucccuuuuuaauccccuucccucacuccacguuugcaaagcaguguugcauuuuucuuuuuugagaaauagggcaugaugugugccugcacacgggcucuugugugugaaugggaauauugauuuauuucacaaucagagauccaugaaaaaauaacacugugaacauacacauuuuugaaaugcugccucuuccgcugaaguacaguggaguguagggaccuguagcaaacuaauauuuaacgagggugccacuguuguaccaccuuuagaauucacaguggcugcuagugaaacuggcaugugucuugacaaggcugugaaauguagucagucuucuuucauucauucauuuguucauuuauucagagccagaugaucauuuuguaugcaugaagcaccugagugguggaugugauaggcugauugcauuuguggccucaaaucuucacacguuucugauuuccuacccaacuccuuugacuuuugacuuuaaguuucaccaugugacuagcuuuggccugaaguaugagguggaggggaugguaugccaguuuuaagccuaugccuuaaaagaucuugagcauuucugcuuuuuugugucccugccuuugccacaaagagugugcccugccagcugcuggucagaagaagaguaggagaggggagcagagccacgcagccaauucaugggcccucagugagaaaccaagcccagucuagaucagccaagucccagcugaccugcaggugcaugacuagaaauaagugaucguugccucaagacacugguuuugggauggcucauuagguagcauuauuaugcaacaaaugacugaugugguggguugcuaacaugauucagacgugaauccuguuugaaagaagcuuuguaguuuugugaggguggugagaaggccaggacaagauugugaacucucguacgugguagagaagguacgaaacgucuuaagaaaggacucauggugagaguggcuuuugagaaggcauuuuuaggugauguugucaaagucgagaauagaagaacuauuagacuaggauccuaucagacuaggauuuugaguuaaaaauaugugauauuucaaaguugauuucaucacagccaaugcaucgaugccaauuuuccguuaaauuucuaaugacuuugcuuuugaugaaccaaaaccagcucuuacaacuuaaagcuacgcugcugucagagaacaucuccguuugauaauagccaacauuuacagugcuuaucacaaagaauuuuacccagcauguauuuggucuauguacugugugccagggauguguuugcuaagcauuuuauagguaugaucucauguaauccuccucaugaucugaagaguuguagguacuaauguugggucaauuuuccagguaaauuaaccaagccagagaaggguaaguuacuugcuaaagucaugcaguaacaucguauucucauucuccuuccugcaccugucucuccuaauagaauggcauccucucaauacaguuuuuuuuuuuuuuauggcuagcacauagcauggugccuugcacauaguuguugcucaaaaagauguuuuuguucaacaaaaagugaauaaaucuuuuaaaaaggaauaauggcuucauccauguccauauggaagucauagccaguaaggaaaugaauuucuggacuaauucauauaaaacaaaggggcaaguuuagugguggagauauuggaaauuuuuauaggcauuugguagagcacagaggagagccucuugauucagccuugaaagauaacauuucuggagcuggugaacucugaaaugacucucaaaugaggggucugaaugaggcaagggggaagcaaggggccugccuguugaggagacgagaguucacagaaccguaugcagcuucccauaugcacagaaccguaugcagcuucccauaugcacagaaccauauggagcccaggguagcuucggggacagguagcugcucaguuguaaauguuuguuuuucugagcuguugcaugccuuggcgcuagggcaguaaaucucugagcagcuaugcccaguaaagucaugaaaacuugagucucuguagucucauaaccccuuauuuccaccugccuaaugcuuguugcuuuagggaaacugaggcagcacccccccgcccccaccccaaaauuaugaccuccucuguccugaacaaccugaggaauuguugccuaugagggcuggcuuaucacgaagcucaugguccuuuugaauagaucugagaauuuugcagauauaaaauaaauuugaaauagcuuguuguaguuuaaaccuugacagcauuaugugcagugauucuugguuuuugaaacaauuucuugaugauucucaacuugacucagacuccagcauguaccugugagauuuuggugaaguucuguugcagaguuuugagccucaguuuuuucauuucuugcagcuuuuugagccucaguuuuuucauuugugaaacagagauaaaauaugccuccuagaauugcugugcggguuaauuugaaaaaaauaugaagaaaagcucauuuuuuuuuuaagcaccaacuacugugccaagcacucuuuuuagccucuauaugaaugaauucauuugacauuuuaaauccucacauaaaacccuaagauggaauaaacaggagugugagccccgccuugcaucugaggcauuguggaguuugguaacuugcuuagggcuacagggcuggguaggggagaaacuaggauuugaacaccagaauuaugcgcuuaacccugaagcuguaguagcucuguuccuagaauguggcaggugcacaugggucgcuaguuccccucuaucuucagaccacugucguuguucucucccaggccugaggagccagugggccagcugggcugggagggcuuggcagggcccuggccuggcuccccacuuauggggggcagaaaccuggggccucccuuucagcacugacauggcuggugguuugcauuugccuguguguuccucaucugucuaucccaugagguuucacacuacacaagggcgggggccauuuccguuuuccugguucacacuguguuucuggcaccgagcuucacauccuucccucauugaacacucagaaaguuaugaaugaaugaauacauuuuuauuuaguucuccccuccucuaucuucuggucacuccagaccacucucccuuuaagacccaguucaaaugaccccauccccuuguaggugccuccgugaguauugcuugcaucuccuuuguuuccuguccaugagccccuccgggacccccugcaaacaccagacccagagccugccuccccauguuggauguucccaaucaauggucuuggcgugaguugauugaacagagucccuauuugagaagagccugacuuaugucucugcuagacuuuagaggggaccaagaauaaagggucuauuuaaggaaaccauuacacaaaauuuccagauacguauuauuccagcuccagaaucucaaacuucugaauggaugggcuccaaaaaauacacuuucuuuucucucauugaaaaagaugucauaaauggcgcuaagaaaugcugccggugugcagaagucugccuagcccaggagggagcuuccuggaccuuugccacgaaaauugucagacauacacuugcaaaccugacaauuaaaacggaagacaauacaauagaauaagaaucuuuuccauuucuguugaaugagggggcuugagaaaaagcucacgaaauuaaaaggagaaugaagacgcuucugaagggagcucgguaagaauuuuaggggcagguggcaucuguuauuuauugugccaguuuugauuucagauuacaguauaugcuuucuuuuggggaagugaggugauauccugguugaaagcucaggcuuuagggucaggcagaugcugauuuacaucaggaacuuaaauguguaacugacuuuaaguaagcuacucaaaaaccaccagucucuucaucucuaaagggagugaaguauguuacaaaacucgugaguguuguaugaagauauauuuguuuuuuguuuuguuauugagacagagucuugcccuguugcccaggcuggagugcagugcugugaucuuggcucucugcaaccucugccuccuggguucaagcgauucuugugccucagccucccgaguagcugggauuacaggcacgcaccaccaugcuuggcuaauuuuuuguauuuuuaguagagaugggguuucgccauguugcccaggcugguuucuaaguccugaucucaggugauccucccaccucggccucccaaagugcugggauuacagcggugagccacugcacccagccugugugaggauauauucgaaggugcuuuguagguaguuggagggcuccauaaauguuacccaccucccccgugugugauacaaauauucuuuaucaugagcuuuauuaguacaguuguccaccacgugcacaucauuucuugguuggaagggaaauggaagggcauuugcaaaugcagaaggaagggauuuucaugaggucauugaagauggugacaaaauggaagggaggaaggaguuuguuucucaaacaguguuccuucaugggcucauggauguucuguaagacuuuuuuuuauuacuuuuuuuuuucguuuuuuaaaaauugaccuuuugaugucaucuaaaauuaauauaagcaucuucugggucaugaaugugacuacuuauaaccaaauacugguccuaggugaggcauugcuuugguacaaaguggucccucuucaauugaagaaagagaaugaagugcagaggggccugacuguggaacgggagcauuggugguuccacaguguuguccacauugggaaggaacgauggaaugagcuccaugcacaggguggggccaccaucuucaggagaaccuggccagccugagcaaaguggaccauauuccuucugggaaguggugguuuaggucaggggaauagaaacaaacguaugugacguucacugaaacuuguauuggcguugaucuucaagguaaaccuuguaaguuuguuuugauuucaagauuguuuuagagcaaaaaucauaggcaugagaaccuuguccuagucuguucagacugcugaaguaaaaauaccaucaacugggugauuuuuuuuuuuuucuugugagauggagucuugcucuugucacuuaggcuggagugcaguggcacgaugucaacucaccacaaccuccaccuccaggcucaagcaguucuccugccucagucccccgaguagcugggauuacaggcacccacccaccacgccuggcuaauuuuuguauuuuuaguagagacaggguuucaccauguuguucagacugaucucgaacuccugaccucagguuauccacccgccucggucuccgaaagugcuaggauuacagcugugagccacugcgccuggccaggugacuuuuaaauaacacgaguuuaggucucgcagugcuagaauguuggaauuccaagaucaagauaccagcagauucggcaccugcugagggccugcugucucuuggccuucucauugcguccuuacgugaaagaaggggcgagggagcucucuaguguuucuguuuuaagggcaguaauccuauucucgagggcuccaccuucaugguaugaacagcucccaaaggccccaccuucuaauaauaccaucacauugcggguuaggauuuugacaaagcaauuuugggggggacaucgauauucagaccacagcagaacucauucgauguucacgugcuguucuuuucacuuggaauucuguuuccuucacuuccccacccuggccucgauaaccccugcucugacccaggucucuguuuaauuaccgcuuuuucacccuaccaucaccaccuugcccagaccaaaacuugccuucuguauuuguaaagcccugcgaggcacuuuucccaguugacuuuauaggcuuuuaugggauguucugguuuauuuguuucuucccugcuggacuggaagcuucacaagagccaggggugucuuuuugucguuuuccuugccacuguauccugcaguggugagcgcagugccugguacuuggugcucaguaaacauuuacuauaaaaauaauuuuuuaauuuuaaugucuuacauguuuuucucuucucuuuucuucucuuuucccucccucccuccuucccucccucccuuccuuuuuuuuucuuuuuuuuuuuuuuuuuuggcagaaucucacucuguuguccaggugcaugaucucggcucacugcaaccucccgaguucaagcaauucuccugccucagacuccuaaauagcugggauuacaggugugggccaccaugcccugcuaauuuuucuauuuuuaguagagacaggguuucgucaugauggccaggcuggucuugaacuccuggcuuaagugauucaccugccuuggccucccaaagugcugggauuacaggcaugagccauugugcccaguccacuuuaauguuuaaauaacauaggaauaaaaacaguuuaagcccaaacuagauucucugccaguuucuuuucucuaaaugugcccccuagucacacaagucacaggaacauccuguaggacggcuggagggccuaagucagagugucugaguccccaaguguaggagaggaaaaugggaggugggaauuuacuggguccuuacugagcaccagggagcaggauugcugugggcuggcuuccauggaucuagccugcaccucagcuuggcugcgugguuaccugagaugcucacaggagggaguuuuaauucagugauacccuuccuggggcucacaucuuuuauuuuauuuauuuauuuauuuauugaccagagucucacucugucacccaggcugcagugccacggcaugaucucggcucacugcaaucucugccucccagguucaagcaauucucauacccuagccuccccaguagcugggauuauaggaacgccaccacgccuggcuaauuuuuguauuuuuugguagagaugggguuuugccauguuggccaggcuggucucgaacuccuggccuuaagugauccaccugccucggccucccaaaguguuaggauuacaggugugagucaccacgcccggccacaucuuuuaugaucuuuuaugagaaacuugggcuccagcggaaggugaacaggaaguuguagguugggugguucaucucccggaggguagcugagcugcuuaugccugcagugagaccucugaaugggugucacucacuagauuucauuauaauuauaacuuuguuuuaauagccuuucagaguuuauaaagcacauuaacaagcuucauauugcucuaucaauaucaguaguuacguaaggcugccuuaugauacugauaugagauaaacauuccuauuuuuguagauaaacagacugaggcuuagggggauuggugugaacuuggggcucgggacuucacguguaguuagccaucugaaguacugguguguaccccaauucuacuccugggaugaagucucagaggcaggaguuggagcugcccccuccgcagagggucagcuaagauaucagcuugaaauaaaguggcucaguagcaauguaauuauauuuucagcaacuuaaaaagugauagagucacugguauaggaagcaugguaucgccuguggaacacacacccuugugcccugcaaaccuggguuugaaagcgagggcugucacuuucuggcgcauguggauuauuuagccgaugagccuuaguuucugcaugggcaaaacgaggaugauaaugguuaaucagagcauuaggaugaagugaguuaucauuuaaaaacugccuaacucagcauuuaaauaaguuccaguaauuauucguauucuucccaagguuuuaccugcccuuuuauuaauuccucccccccauggaaagccucacaaauacaugugcuguuggugccaucaugggcucagggugacuccgccuuugugugcuuggcagcaucucagaagcugcagagagccugagcuucagaaaacaggaggggagguugauuugugccaucaggaaaccuaggguugcuccugucauuguccuuuguagacaaagguugacuuuuggaguaagugcacgcaugccacuaagagggugauuugcaggagguggaggcuuuccuucccuggguaggcagauuaaaggcgggguugccggcccuccgcaguguaagccgugaccucgagaaucuggcagcuccgcgggaugguggcaucuggccuuucagggccuccccaaucuggucuugcccggucucccacagauucccugcauaguugugacacuccagccaaacugacagucacuuggauguggcacaugccuucccauagucaggcccuuugcgugggcuggcacaauaugggggccucagaagagaagugggguuugauaagugggcugcuucucccacacugacucacccugaaugauagcagugugugaagagcacacucguuaaugccaucagaggaaagagggucaacguacagugacccaggauaauguucccugcaagcgcaugaucgcuuuaaagugcuguguucccagcaguguggacggacagcugcaguaaugauucguacacagaggaagcuggcauugaccgaggccaaccgcauggccuugguuucugcccugaaugagcugacauucuuguugaaggugagacagguggugugguuggugggcagagaccaccugacuuagauagguucaagucuuuauuuuucucauugauucaucacacaacuauuuacugugcacuacuguauaugaggcacuguucuaaguacugugggacuguuaguaaaccaagggacacgagucccugccuucauagaguuuguguucuggcagagggagauagacuaacacacaaaacaaggaaaacauacugugucuccuguggugguaaauacucggagagaagaaaauacagaagggagagagagggaggguggaguguguguguuggcaggaguggguuaggguuugcgguuuuaaggagguugguccgggaggguuugcagagguaauuggaggagaugccugaagguggugaaggaaugagucauggggcuuucuggggaaagagccgaggcccaugccagugcaaaggccuucaggccauuucuuaauugcuaauagagagaccacagaggggucgugugccuggaagggcgcaagccccuaggaaaguauugggagaggaugacagagaggaacccaauuguucugggucuccugggcacagugugcauuggaagagaugcaugagcugauucauguuuaucaggaucacgaggcuacuucuugguugugcauuggccccagguagcaaaggcugaaacagggagacugcggagggcuguacuucaggcaggagaugagggugacuugggccagggagcaguacuggaaggcuuugagaaauauaugagucugagucucugcugcuuacauucucuaugacccugguugaguuacuuugucuuauuacacuuuaauuuucuugacucugcaauggaaauaauaauacugaaacuuccuggagaggcugcaaggugguagccaagcaucacccugcuugcaaagcagcgcuccccgacacugugggugcuggaggugugugcauggcccuuugcaucauaucucacuggaagggucuuaagcugcugaggcugaaacguaaagauaacagcagcuuccugccgcacagacuucuccggcauuggcauccgagcauaucuuuagaaaucuucuaacccauucuugguuauuauuugcaauccagggcccaaagugaugaguuuucccauuuucaacauaauucaucuggcugugugucaugucucauggccucuuggauuuguggagagaugggggugauuuguagacgcacgugaggaaaauuggauuauggagugauuaguuaaaagagcgcuccaucagucuauugaaaaccccaucguuuggggcucuuggaguucaaguuaaucauagcaaagguaggagaauggcaggagaaaaguaaaauuccugcccauuuauguaagcaggggaugcauaccuguugucccaugaucaaaucucacagguuuccuagacaugcugaagugagguaauucagugcauccuuuuacucuguggaauguaugaaacuuuuauuugcaaaauaccuuauuuguagucuuaguugccuuauaugauaaagauuagccuuccuguuccaguguuacugaugagaggcugaguuucaucuuugguguuuuuccuaagcuuuaacaaugccccccugcugagaggucuccuggcuggcaucugcuucccucaccugccccuuuaucacugcugaggguggaacugggugugggggggcaucuugguaugauuuggauauagucugcacugacuugaaacacaggcauuucauuugccccagguuacuggccuuuuuucauuucauagaaggcaaagagaauuggccgggugcgguggcucaagccuguaaucccagcacuuggggaggccgaggcgagcggaucacgaggucaggagauugagaccauccuggcuaacacgaugaaaccccgucucuacuaaaaauacaaaaaauuagccaggcaugguggcaggugccuguagucccagcugaggcaggagaauggugugaacccgggaggcggagcuugcggugagccgagaucgugccacugcacuccagccugggugacagagcgagacuccgucucaaaaaaaaaaaaaaacaaaaaaaaacaaaaacaaaaaaaccccgcaaagauaauugauagcauuugcggguguggcaaagguguuaguaccuccucuccucuguuaaagugcuauuggagacuuucauucagccauauuuggccuccugguuacaguacugcccugagggcuuugcaguguuagccugaugucuggagaaccugccccaugugccacuguuuucauauucaggcucaugaagaugaucacucacuuaaggguuccuauuuccuuaaccuuuuguagugagacauuguaacuuguuuccugaaaccgcaaggcuuaacaugagugaaauauacucuguaggugggucuuuuucaaaauaagguccaugggucuauauucuguauguuuuaugagagggaacuauuuaaacaaaacuguucaaauugggguuuauauuuugaugaaucugaaaaacaaauggcugugauucuuugcugugauaauuugccauggaaacauauuuuuguaagacucugccuuuuaaccacacuucucuucuuuaaaaagggucaaguuauuacccacauuugauaaacccaauuauaauucuuauuucuuuaccuuucauuucucaaaaauccuuuccaggugaugagguuuagaccagccuucccacacagaugcucaccuuuccucugaguccuccagcugcucauuuggagagcuggaggugacuucgccugggggauuuagugcagggacuucugggggcaccagggcccgcuacaggcuuugagcaaguugcuuguugagcuggacaguaagccaugcagcguguugugugugcagagcuucuuuuucggccccggggggcucguaacuguguucuggaaaccugguacacaagaaggcaucuggaacgucagacucuccauaugggagccugucagagaaugucgucgcguuuuggccuagcagccucuguggcaucuuuaucgaaaguaaaaaaaaaaaauuaaaaaagcuacuuauuaaguagacaaggacaguuuggaggaggacaguuuguaagaauagcauuuauucuuugcaaucagaaggcuaaaaaguacauuaacauacauucaaaguauauuaaacauaaaauauauucuaauaaaaaguacauucacguauaaaauaaaucucgcuuccaucccucugcugcuggguuggcuguccacagaaugggcacagcgaggcaggugugagggagaagcauauacuuauguuaauauguaugucaaaaguaagaggagcagagggaaugaaaauauccauaugaauuuuuuuuuccagaauuuaaagcaacaccuaguugaagauucagaugaaaacgucucagucccuuauggcugggagguuuagcaaagcuuucccagaggaaagaacacaucauuugugugggguggcucugcuucacugaaaugaccagaacguagcuguuaagccugggaggaugggucaggccacaggaucagguaagaguguacccuucaggccgcacauggcagagacugcacaugacuugugcacggauaaggucugggccuuaucucugucucuucuggcucuggaauauaguacauuucucaauuaagccucaguuuccuuaucugaaugcuggcaugguaauggcagucuugcaggauaguuagaauguucaaaugagagagucuaucauaguuugcucugcuguuugcuccauagaagcugcggaugguugagauuuuggucaagaccuuucuuucgucugaucugacuuggguccagauacuuggaaaaauauggcaaucaugcuggguccaaaaggcugugggauucuuuuacuucagcuuaaaccuguuuuauuggucuuccggaaaugcuugcagaaauaagagcauguuaacguggguggacacaauuuggagugcuugauuaacucagcaauuaauaaaaauggagaggugacaauugguguuaccaagcuacaguugaaagcagugcacuuggccucucuccaugcaagcagauugguggagaagccacccauggggaagaacaucagaauucagaagagugaagcagguugggaaaaagguacucagaacaaaaaacagggugucaagaugagcugguugcuuauuacauucauuuaaucagcagaugcuuacugaguaauucccauguaccugauaccgugccaggagccgaagauaccuacaugaauuaggcauagccucuucuuugaagagaggcugaugcuguuuuggagguaacagacauauaagcaacacauucuaauacacuauggcgaguacaggauagaugguguuucaaguucaugcguuaccaaaguaaggagugguuaauuaauuuuacuaaaagggagagaacaguauuggcuuuaaagaaaaagugguuugagccagaccugccagaauaagucgaugggaaaagauauucuagcacagaggacaggaagagcaaagacagggaggccuaaaaugaaggguggauuugcaguuguuaagugggaagacuagauauagacuggguuugaagucuacucugccacuuacuagcuggguggcuguggacaaagcaguaagccuuccugugagugguuucaucaucugucaaauggggaugcaggauccaugccucauggggcuguugggaggauuccauguuaguuuagugugcuugggauguugugaccccuccugaacauuacagcccugaggcauccccuguucuuugaugugcuguauauaagaaaagagacugggcgugguggcucacgccuguaaucccaccacuuugggaggccgaggcgggcagaucaccugaggucaggagaccagccugaccaacauagagaaacccugucucuacuaaaaauacaaaauuagccaggcaucguggcgcaugccuguaaucccagcuacucgggaggcugaggcaggagaaucgcuugaacccaggaggcagagguugcgguaggcugagaucacgccauugcauuccagccugggcucggaacuccaucuaaaaaaaaaaaaaggaagaagaagaagaagaaaagaaacugggacuagaaaugucacuauggccaaguauugaaagcaucugaauaucaugcauccugaugauaucucugcaaacauuuacccucacucuuuuaaaaccauaucuuaagcuaucaaacacuuauccuauuaaacacagcauccaucggugaucccagugacaaguaauugaauguuaguucuggagucuuuccuggggugauggccuggagaagccucucuuuuaaggauuagauucagagguagagguaaaugaguguugagcaccaggaagagcugaguucagcauugaguuagaucuggggucagauucuggccuuaccuuuguuagccgcuugaccucaggcacaucaucagguucauguuuaguuucuacauccaugaaguuaauguauuuauauauugagauguaacauuuucucugaagagcugggauugaaaauuccuuugagaaaggaauugccuucguuuaggaaaacaguuugauaagcuagaacagcauuuugucagauagaaauacaauauaagcuggccggguaugguggcucaugccuguaaucccagcacuuugggaggcugaggcgggcggaucacaaggucaggaguuugcgaccagccuggccaauauguauuuguauacuaaaaauacaaaaauuagcugggcgugauggcgggugccuauagucccagcuacuacuugggagacugaagcagaaucacuugaaaccagaagguggagguugaagugagccgagaucacaccauugcgcuccagccugggcaacagagcaaggcucugucucuaaaaaaaaaaaaaaaaaaaaaaaaagaaauacaauauaaacaacauacauaauuuuaaauauuuuaguggucauauuuuuaaaaagguaaaaagagguaaaauuaauuuaauaauauguuguauuuagcccagcauaaccaaaauauauauauauaaauucaaauguuacauucuuuauuucauacugucuggacugugguauguauuuuauuauuauuauuauuauuuuuuugagacagagucucgcucuguugcucaggcuggaguggaguggcaugaucucggcucacugcagccucugccucccagguucaagcgauucuugugccucagccucccgaguagcugagacuagaggugugcaccaucacgcccggcuaauuuuuguauuuuuguagagacacgguuucaccauguuggccaggcuggucucgaacucgugaccucaagugauccccccaccucagccucccaaauugcugggauuacaggugugagccaccgugcccagccuguauuuuaauuuauagcacagcucacuucagagcagccacauuucaaguguucuguaguauuuuccuguaucaucguauuacauccuuccagaauucuaagaaguaaucauuucucccauuuugaaaaugggaaaacugaggcauagagagauuaagaaacuugcccaaagucauucaaugaagguuugaacccagauaaucuguccucagagcccugcugugcuaguuucuuacaaaaucuugggaaaaaaaauuuuuuuggaggauacuuggggcuuucauuuggcguagacuggguaguuuauaccucaaauggagggauaaucuugacuagacugaaccucgcaacaggguuaacaauaaaauuacauggcagaugcacccccagggcaccauuauuauacauagcagggccucaguaaaugguauucuuucccuucucuucagacccauaaaaucagcuuuuuuuaaaaagggacuuucuuaguuuuguuuaccucuggauccauuccugguacauagaagacgcucaguaaauacuugcggaaggcagagaggaugcuuuggggucacuggaugugaugaucacucacaguuguuggggcaucugcaaauacagugguaccauuagaugguggguuuuauaaauacagcccugggugaagggggcuuauguggagagaugaccagaguguucagaucuggaguucuuucccugagccgaggacagucauaaaggccaguuuuugugucccaugccaaugcuuuuuuuuuuuuccaguacauuuuuauuuuauauuuuauuuauuuauuuuuuuauguuguuuuaaguuuugagauacaugugcagaaugugcagguuuguuacauagauacacaugugccauggugguuuccugcaccugucgacccgucaucuagguguuaagcccugcaugcauuagguauuuguccuaaugcucucccuccccuagccccgcacccccgcaccccgacaggcccuguuguauguuguucuccucccuguguccaugcauucucauuguucaacucccacuugugagugagaacaaugcaguguuugguuuucuguuccuguguuaguuugcuuuuaaauagaaguauagcauauuauaccagcagcaaagcacagaaagcauaagugugcagcuuggugaauuuucacaaagguaacauaucuguaucaccagcucccagaacaagaaauaggacauuaccagugacccgagugcaccucccccucucccaucacugcccccugugucucuaaggguaucugcucuccugauuugugacuccauaaauuaccuucgugggcccacacuuuugagcaaaucccaaugguuggaguuaucauggggaccaguauggggguccaguuaguuucaguccuguuuuauccccaggccugggguucuaaccugguucccguguucaugguacagaugauaaacugugcccacagaggcccacccaacugcugggucucauggugagagaauagaucagugauucagacacagaaauuacaugcuccaaagccugcauucuugaccauccuguauguuuucuucuaugacguuuuguucuaaaaucccaagauugggauauuuagguugagaucuuuggacugaauccuaucugggaguggcugcuggaaaacuguggaggaggaacccauagcucugcaucccagagcccagaugcagcaugcuccuggcccccgggcacugaaggcugcaccucaccuaccagaagugaccuggcuagcagagcccaucagguggggcugccggaggugucagagugugggacaggcaggcuucucauuguccuguguuucccgcuuccacuuccugcugucaagcacucucaggcacuggugagggaaacuuccaauuaaacgaaaucaggcggcuuccucccaccaaagugaaaaugcccugugcugccaagugcgagcuaaauucaucggucaccugcuuugcggcaugggacauggcuggggcugcugccuguugguugcuguggauuuuagcaccagucacugcucagaggaugcagcaggcauggcgggcuggggagggccaucucugcucagccuggaguccccuuggcaugguuggagaugggcauguguguucuggaggagcuuugcucucucuguggcacagcccucugcccccaugguuccccagucaagagggacaggugguggcugucauucugcaguuggcccuggccacagagagauuugccaacaauucugggauggagacacccccagcuucuuuggcccagagacugcagcuugacccauaaagcugcaagcaggcaguucccgcagccugccuuucucuccagaauggugagggugggguguggguagagauacauauuauuauagcacgagggucagugcccuggcucugaaauuuaauucaaaagccagaauaaaauugccccucuggaggcaaugguucuuauaaaaaugaagccaguaauauuuauuauaauccuagugagugaguuguugagcagcuaauucuuugcuggccacugggccuaaccucauagauggagugguguaucucuggagcuagacugccuggggugaauccuguauccucugcuuagucaugucaucuuggacguuuuucaacuucgcugaccuucuguaaaauggggaucacaacagucccuaccuuuuagagcugugugaauuauuaauccauguaaagcacuuggaauagcaucugacaugucaguggcuccauacacauguauauaauguuggcagagucaguuacaguccucugacuacuuuucuauggugggaacuuuauuauuccauguuuaacagacaaggaaaccgaggcacagacaggcuaaguuacuggccugaacuuucaaagacaguuaaguaccaagguggaauuugaacccagggggaccugacuccacacuuuccagugaucguuggguggaaauagugucuugcccaagauuuauuaccuaaaaaugaaauauauuucaaaaaagauacccucaaacucuaacauuuccaguaaaagcaggacaaauacucuauuuuauaauccauuuaaaauaauaaacauagcugcaguucguugagcaaauugcuccguuucagcugccacguguuacauugccuuucuguuugggucacgcccugagaccuuugugaaaaaguugugaggucagaucaaagcggcggcugaugugcuccuggaagaggagguguccuggggagugaggacaguugcaguagccucuuagaggagugaaaaccugaagaccagcuuucuacccuuugucugcacaggguuuccuugaggugaggcgugccugugguccuggccugcuguaucccucuaaccucagcaugucuuagguccuguccccggauucagucaggcugucacaaaggaccgaguuagccaggaaagaagagguuuugcguuggacagagguaggaugcaaaaagcggccuguggaaauaauguaccauuuucuuauuuaaguucccugagcagaggcaggagaauagaggacaggaggagaagaauaaaggaggagggagggaggggaagagagacggaggagggggagagagagggagagagaauacagccgggugggguggaaggaagaaauaucaggguugggaggugagaggagaagggaugcagccucagugggggaggaggaagaagagguggaggaaggugaaaccagugacuuguacuuggcuucuugugacauggagugaggagggcagggcaggacccaagugggaggcagauccuaggccugguggaaaggaggaggaggaggaaggaugugagguagcagacagugggaggguaaagaauggcauaugaaucugagaaaggaucauacaaguuuuagugccagaauuggugaugggguguuuuggauggguaaacagaggcacguuguuggacccuggucaguggcuguuucccagguucuaugguugugacaugcuaucuuccugggugggugaagaggcuggaccccaggcagacgagcacgcugagugccaccugcuccaugcuuccacucguccuguguugccugccugcaucucagcuucccggaaggccccaggagcgacacggccuucagggcuuucagccgggggcaggaagugcuccaucugacaccauucagaacagacuagacaaauaacuccacagcaugucucauuaggccaggaacacuccagcuaaucgaggcgugccuuugucgugcgcugcucgugccaggggaguuaaaaaaagaaauaggccugaucccaagggugugggcagggcagagauaauaaacccaaauacaaagucaggccacccaggaaugagguggugugcucuaucggggccggauucccccagcuccagaucaucuggccaaaucugcacccuccucccgggccucccuuuugcuggggaugguuugggcagaggugagugggcaugcuuucugguaaaaggauccgauuuuaauguaagaggcuugcuuguguguuuucccagcuaguucacuuccauggcuuuauuuauuuuuuuuuuugagacagaauuuugcucuuggcacccaagcuggagugcaguggugcaaucucgguucacuguaaccuccaccucauggguucaggcaauucuccugccucagccucccgaguagcugggauuacaggugucugccaccacacccagcuuauuuuuuuguguuuucaguagagacaggguuuugccauguuggccaggcuggucucgaacuccugaccucaggucauccacccgccucagccucccaaagugcugggauuacaggcaugagccaccgcgccuggccauggcucuuuuccgugcuccaaauucacucaguuucuggcucuuccugccagugugcuccauaagaccagcucccagggagcccuacacuuagcguuuggucuguaaauuccaugggacuugcuucauagcuguagaaacucagguucaagggcguaaaggauguguccacagcuagugugucgcuggggggguggcgguguugguggugaugauggggauggcgaugaugacacuggugaugacgauggauagcagcugcuguguauuuucuuaggagccguguuaaauucuuuaauggcaaagaucgugcuaguaauaauaauaauaauaauaauaauaauaauaauaauaauagauagcauuuacugcgugucugcucugugccauggaagguucucagcacuucugguacacucaaccugagaaugacucugugaaguggaugcuggcgugcccauuucacagugcaaauaaugaaggcagugucacgucagagucugcauucuuacugcuaagccacgccgccacauggcagucaagacagcgugcuguguguggagugaccagccucugugggugggcgagugacuggcugaaagguugacgucagagcaugcucuauuuuagguucuucaacucgaaggaacccccuccaucacucccaccuccugccacccuaguuccucauuccuuuccccaauauuguuuucuuuucuuuuuuuuuuuuuuuugcugauuuagaaauagacuugacuuccuggugcugagacuguuuagaucaauuaacacuaaugaacauugcuaguuagcuauggacuuuaguucuucaagccucugaccuuaaauuuuuuuuuucugaaggucaucaauuaacuauuuacuucauuauggauuaguaaucauuaguuaaauauugccauuuguucuguaggucaccggugugguucaugcagugaaaaaaucaaguguuucagugaaaaguugcagagagaaagaaaaaagagaaugagggaagacagaggaguaugugugugugugugcgugcacgcuuaugugcaggggaaggagguugguaguagugguguuuagauuagccuuaaaauaagaagcuugaaauuaaggguaaaggucugguuccagaugcucuaaagccaucuguuauuuaccuggacagauuuugauaccucucuucuguccucuaauagcaucuguguucugacuuuaguccugguacuuaccuggauauaugguaauuuggccauuuccauguccuuccagauggagcaccuggcaggcugagucugugucuuuuguaucccccuuaccugacacagugcuggcacacaauaugugcucauuaaaugcuuacugaaaugaccuagcacauaaaagcuuuguaagacaggagcuuuauuuuacucugucugcuuuguacucuagacaccccagguauuccuauucugauuucuguugcugcuauagaccugggucagccuuaaaaugaauauaaauauacguuaauuugagcuaaugggauguauggaaaccacugccuaucuaauuaauuuauuugugccaugaaauaaauguuuuaaggugcuccugagugcagagcauucuaucagcagguggaauacaaaguuuuaaaagaggcuagggaugugggcugugucaccagaccuucugaguucaauucuagaucagacacuguucugguuauagugggucagagcacagauucuggaucuggguuugaauccacauuagaccacauacaagccuugugcccuuaugcaaaugauuuaaucucuguaugccucaguuuucccuccuuuaaaaugggacaggccgggcacgguggcucacgccuguaauccuagcacuuugggaggccaaggugaacggaucaccugaggucaggaguucaagacagccuggucaacauggggaaacccugucuguacuaaaaauacaaaaauuuuacgagugugcugguacacaccuguaaucccagcuacucaggagguugaggcaggagaaucgcuggaacccgggaggcagagguugcagugagccgagauugcgcuacuguacuccagccugggcaacagaacgagacggucucaaacaacaacaacaacaacaacaacaacaacacagacagucauggggauguugugggguuaggguuguugugggaauaaaaugaguuugucuguaaagcacuugguaccauguugauaccugucacugguauuuguuguuaaugaagauuuagugacuucauguguaaaacccaacugugucaguacuugucuucauagaauuguggugaggacuguaucaguuuccgaaggcugccauaacaaacuggauggcucaaaacaacagaaaugagacaauaaugucucuugauuccagagaccaguuuuguguuggcagggccaugcucucugaaacuguguccuuccuggccucugccuagcuucucuuuggcacucuggcugguagaugcgucccucuaagccccugucaucacuggagcucuuucugugugucucaucacauggccaucauguuauaaagacaccagucagacuggguuaagggcccacccuucuccacuaugaccucaucuuaacugaauuauaucugcaaugaacuuguuuccaaauaaggucacauucugagugggguuaggacuucaacacaucuuucugggggauacacaauucaacucauaacuagggugaaaugcgagacuccacaugaaguauugaacccagaaccucuaacaaaacagugccuucaacaucagcgguuucuguuuuuacuuccccauacuccugaugacggcccuuugugggguggcuuugggcaguucucugaacaucuuugaauuucuauuucccaucuuuucaccgugauguggcacgucuuccagcaacacugaauuauguaguuuuccuggucugcauugccucaucucugaaauggggagaaaggagaaccaccucccagaagggacccccuucccaggaugacaugaggguacacaccuaugugcugguggucuggacaugcgagugcuucccacgguugcuaccccuccuuuugugccugguguuuucucgucagugaggacaaauggcuuuuguaguaccccugcaaaccacugcacagacccgaggaggcuccucuuuuccuucccauggaggugggaagccagaggcgcauccagaugugaggaggcuucgauuuuucagaccccuggguugcuuugcagucagaauggagaauacuuuuuuuuucccuacuugggagggagcugaacacauuugcuacagagaagucuagauaucuauggaaacaguccuaauuuuagccuugccacacuuaaugccaacucugagaguguuguuuugggucagggccuggggaguagggaaggugaguaggccugcaggggucagaucaagcagggaguagccaaccgacagacaagaggaggaugcaguagaaaucuuaaguggauccaaaggagcuggcuccaaggguaagagagggccagaaugaugagcauugaucagaaaguuggauuucaaaugaaagggucucccuucagaaaguuggauuucaaaugaaagggucucccuucuuucccccuuuugcucucccugucuacauucugcucauuuuuggagccucguucauggcccuucuuuccacaaccccacguuuggaaucagccaguccugcccugagugccuggcaucuuagaauucuguugaaguacuaguggcugcccauuuaguuuugccgugaauccguguaccuugcaacccccuuuccauuuaguuuugagccccucaaggucagccauggucauugucaagucugugugcugugccugccaugggguagacauacaguaaaugcaugaugaguugggauuugacaugauaggugauuucugguugaccagaccagggcgugggcaaucacuagaaaggggcaucaaaugaaggaguuuuuaauaagaggcacagaaauguuuuugaugggaggaaucugccugguuaggggaguggaaauugccuguaauacaauuaaggacauguuagggagggccaugggcaagaggaggucaugguguggcagaugcuggcugggauggugagggaagugagggacaguaaugguuuuaggccacguggggagcaucaccuaaccucauuucagcccuguccuccccaccaggugaacuccuagcaggaauccuuguagaucagauacaggaagacccuuagacaucaucucgucucgaagugugguauucaagacaggcauuuuuacacuaaaacuuggcucuuaauuuuaguacauguauaaaagccacauagaacuagcauuccaaaccuggcguuucucagguguuucugcuuccgacgaggccggcugugguaguugccucucagucccauggauuacagggugcuguucccacacacccaugcacaugugagaccuguaaugagcacagggccuguugucaccauuuggaacgaagucuuaugcagauggacgagguugcugguaugaauucuugcacugaauuuucauaugcuuuguauucuuuucagcaggaugaaauguaccgugguugugggaaaauggagcggguagugugcugcaagagauuacaggguaggcugcuuggauccgguuuggcccucuccucuugaaugaggagggaauugggcaagccgcagguagaccagguggccccgauagauagugaccgaacugguacuugagcugcaucuccucuucuugucuagccaucuugguguucuagguaggacaugagcuagguccuaccaaagacuugggcacuuuauuuaaguucucucauguaauccuacuaacaacguugugaagcaugcacuauuuuuacuuacuaaacaaaaaaggagcgaucgggacuagaggacuugaaauaacuuucugaggcccagccugcuggugcgaaguagauccagugauucaacguggcuccaucccaugacauuuagcugucagggagcugcaaaccuaugaaacagagcuuucagauuuuggaaauagaaacgcaggcagcauagugccacuugcugccuccugggaaagccccuugucgugaauaauagaaccagcgcuagaaggcacguugcucaggccggcaggugaguccgagggcuggggagggguuuucugggcagugggacaccucccucuuaggggguuucauuuguccagggccagugaaaggcuguuuggucccucugcugagugaacagucccagcccacaggaugagucagagcagaguccagaacagaaggcagagggcaugugugcaaaggccauguuuaucccaggcauuuggaucuuaagauuccuguucaugaugauuaagguuuuauacauaacacuguuuacagacugcuuuaugaucauuuaugagugucaccuggcaacagcugaguuagccacauccauccaccgugggguaauuaacucugggcccacccagagcccaguucauugcuugugcauuauugagccuccuccccacacccucauucauucaucuauccauccauccauucauucauuagagcccuuuuugucagaugccaccuuuguggguagcuuugugguuggcauuucuuuuucauugcugagaauacguaauaugcuggacauguugguguuccuguuagcguaagcaauaaucaaccccuuuagugagacuguaagcuccaugagggcaaggccuuuguucauuucuaugucucuggugccuagaagaaugccuacccauaguaggugcucugugaacauuuauugaaaaaaaaagugaauggacugagugucugcuauguuugggccugugggaggugcuuucuauaaaagucuuucuaauccucgcagcaauccaccgugcaccauaagggugucugucguccauucuagggcuccaucugguguguguuuaccauuaucauaagcauuauugugagugcuuccagagcagauaauccuuauuaugacugaauaauguagcuacauuauccccauuuuacaaaugaggaaaugaggcacagagaggugaaguaacucacccaaggucacacagacccucaagcuucaagcuacuccuucaccuucauaucagcacugucuuacagaaccuucugcaggauggaacugcucuccaucugcaccauccgauguugucaccgcuagacauggguaguuacugaguacuugaaagguagcuagugcaacugaggaacugaauuuuuaauuuuguuuaauuuuaauuaaauuuaaauagccacauguggguugugacucccauacugggcaaaacagcccccuauaugcugucucuaaagaacaacaggcuggguacaguggcucauaccuauaaucccagugcuuuaggaggcugaggcagauugcuuuaugaucauuuaugagugucaucuggcagcagcugaguuggccacauccauccaccaugggguaguuaacucugggccuacccagagcugaggccggaggcugaggcaggaggauugcuugagcccaggaguuggagaccagccugggcaacauggugaaacccuaucucuacuaaaauuacaaaaauuagcugggcaugguggugugcaucuguagucccagcuacuugggaggcugagaugggaggauugcuugagccugggaggcagagguugcagugaacucagaucaugccacuggacuccagccuggaugacagagcgagacccugucaaaaaaaaaaaaaaaaaaaaaaaaaaaaaaaaaaaagaauaacagcuaacauugaaugcuuacuauauacugaguauuuuuuaaauguuuuacauuuaaaauccugacaaccacaaaugaauuaacaagagucagaaguuaaauaccuccuuuacucucaagauuuuauggcaagauacuaguguagcuggauucuccccaaggaugcauucugccuggcccagaguuuucaacuaucacccuauuuuuauccuuauuuucccugcguacagcaagggauaucaccauggaaaggaucucauuguucauaauauuugucagccccaaacacaaugcuaccugccacccuccuugguaaaggggucaaccuauaugcaggcuugcgaacucacuguucccaccaaaugacucauuuagguugaaaacauuuauuugcacaaaguggaguugugucagugucacuuugaaaagaaaaagacgccaauauucccuaccaggauguucugucaugaaaacaaacagaugaaacaaaaucuacuucgaggucagagugagaagaagagaagguccggcugaaauuaucugcagucuugcuggagggaacaaaugguugcagcucauggguauaguggcauuuuacggcucccagcugugccuucccuucuugaagaugggugaaggggaguagguucugggcuagacuuggggcuauggagcaaaagcagagggagcuuguccugcacagacguggaagcagaggucacugaauucuguuccacaguagaagucagcaguacuuuaugauaacagugcauccaaacguguucugucugcugggcugggccugacacccacggcugugacucuuucagaaacugcgaaccaaccugugggugggccagggauccaggucaggagcagaaguagguuaaaggugaucgagagagacaugugagagagugagcgagagauagaggccugcaggauaaggccacaucaggaguacaguccaaauauaggcagugauugugaaacccagggacugugggcuaaaagugcuguagauucugaaaguaggaagaggaaaaauguggccacgggccucuggggaaagcccuguucugugggcuuuggccacuuaaaucuauaugucuucugcugcugucucaaggcagugaugcagcccugacuauccuucugcccaucuauccauucauccauccaucaguccagcauuugagucucuauucuaugcaugguacuggggauagugugguaaacagggcaccaucccuacccucaaggagcuuacagucuugccugguaaaauguacagaagcaugcauuuuugaaacaaguaaaggaagaagacuuaggcgcucuccacuccaaggccaccugcaccuugccuauguagcuuuccccagcaacacgaagccagcauugguuucuuaaguucccuucuugucuuuaucauguauguacuuaguaucuguauugugcuuugggcuauuuauuuauaucagcauagcacuuuauugcaucuuuauuguaaauaaccuuccugaacauaggggccuccaugucuuugcuggguccuagcuccaugguaggcacugaugggggcuccaggauuauugaaguaaaugagagccccuuaaaccuacaaggaaccuuaauggucaucaguggucugaagggucuucuugaccuuuccugccucccagcuuccuccugucucugucaggucaagacucuaccugccugguagguucuguacaaaccauugccaggcaauggaagaagaaaggggagcugcaccccucacuggaguuggaacuucugugaugcuugucauagcuccauaugccucacauucaccuggaaacaugggaggcguuaguuaggccagauuaacagaugugggaugccauauaaugacuuugccuucaagugaaacugcaguccaaugggagcaggccccagacauuggccuccucaaaacccuggguuacuuuuagugucuuccaguucaggaaccacaguuuucaauuuuuugaaaauaaaaguacuccuaucuccuuucauuuuuuuuuuuucugagacagagucucgcucugucauccaggcuggagugcaauggcgcaaugucggcucacugcaaccuccgccuccuggguucaagugauucuccugcuucagccuccugaguaacugggauuauaggcaugcgucaccacauccagcuaauuuuugcauuuuuuuuuuuuuuuugguagagacggggguuucaccauguuggucaggcuggucucgaacuccugaccuugugauccgcccaccucggccucccaguguugggauuacaggcaugagccacugggccuggcuccuccuuuguauuucuaauaaaguuuaccugaacuuacagggucuucuagaaauggggaugggauugaccaggcauugucagccauccccuggccccaucgugaggcaggagacuguugggcaagccgagacggcagggaccccacccucuugacugcuaaaggaaauaaagacaacagcauuauugagugcuucuccauggcaaaugcuuugccucaauuaccugaugagguuggauuaaccuccauuucagaaaugagggaagugaggcuugcagagguggcacgcccgagauaaaggagugacugaguggcaaagcugagacuugaacccuaaacugucggcucccguguuccugugugccacggugcugugugagaagugggaacggugaguucccugcugggcucaguauggaggcaaaccgcuuucugcaacacauuccuaugcucucggacagcuuaauugacuucugugccuuaauuuucucauccgugaaagaguauaauaauaacaacaauaauaauaauagacuagaaauuggccaggcccuuggugaggacucggugcgugcuaccucugauagauacuaauauguagguauaguaggaacaucaaucaucaauauuguuuugacucuuuugaccucugauaaaaaauuuugaccauggacugcccuuuuuguguuaauagauuuguuaggucaaugaaaacacagcucucacaagaagaacuuauguuuuauaacaccaagcccacaaacgaacgucaugguggcccccgaggacacgugacagagcugggauuugaacccaggccuaucuagccucuguguccccacacuguuucucuugggacccagguguccggcuggcccucagcuuccugcguuccuggugauucggcccuggcggucacagugucagguacacccacucagaguggguuuaugauacaguuaggaaggagcccaggccacagcacuggaaaagacgaaauuguaguguugaucaaggccaggagccucuuugcucagcgacugccgucaauccucuucccugagaagaucgccuguauuguucaagauguucggauauaaccucccccaggaaggcuucccugaugucacacacaccucugucgaaggcucccaggugggccgaacagagucuuccuuugcucccauggcagcuuacaggaucuuuggcagccuuuuccaugauguuuucuucccagggguuuguguagcuugucuucaccacuugccgugagcucucgaggacagaggauuugucuguguuagaaacaucugguuccugccgggcacgguggcucaugccuguaaucccagcacuuugggaaggugaggcagguggaucauuugaggucaggaguucaagaccagccuggccaacauggugagacccucugucuacuaaauauacaaaaaaaugagccgggcaugguggcgcgugccuguaaucccagcuacucgggaggcugaggcaugagaauugcuugaacccaggagacagagguugcagugagcugagaucaugccacuccagccugggugacagagugagaccuugucucaaaaaaaaaaaaaaaaaaaaagaaugucugggucccaaaauccacuuuucuucuacugaggacauaggaauggucaccuucccugcccuuuucuagggccauguggcucauucuggccgaaggguggugagcagaagugaguugcauaaucccagugaaagcauuuauuugcgggugcaagaucuccuggggcuggcgcgaagugcuggggggcaggacugaggaguggcaccaaaugcugcguaggagaguucuccagauuugacagucaaggauccucauggcagcauggagaggccaggcgugucugcguggccauucugugggugaggagccugaggcuuagugagguuaauugcuuguccaagggaucuugugcaaauuccauggcuuguucuauggcaauaugcuacauucgcuguuaugauuucuuguuguugcuguaaauuguaggcuaaggguguguguguguguguguguuuguguguguguguaggugggugaggagugggagugaggaacagcuagccgaguugcagugcuugguccuuuugcagaauggguguuagcaaaggcuggcaugcuuagcccaggugguggcuguacucggccaccaaguuaacgaagagaaaaacgaguuagcuguuaccuccucucagaugucaguuuuccuuuaauguggagcuuuggagagaauaccaagauagggcugugcuuacugaccuuuuccuugccgcacagaugggaauaagggggguggaagaaaaggaggaagaagagagguguucgaggcagaggcugccugggcgaugccgcuucguuacccacucucagccuaaggaagcguugcccacccugagauucaggguugaaaucucucuagcgacagugcccaggagugcaggcuucacacuccaaggaccuugcugagggugcauggauguacgggcaagggucgugguugugguggcagugcaguaggucaucagaaaggccucaggcuggcugcgcccacgguguuccccgugcugacuccagcuugcaggcagaugcaccauucuaguuguugugggcagcuggagugggggacuggcccaggagggucaggguaguggccugguaguuugcacguguuggucuugcccccgcuuugcccuggugagcgcugaagucauguuugugugagccaggcauucuccugaucacgguugcacgcccauccucagaagagcccccucugaggugcugaucccaccaccaccuucacagcucaggacgcugagugucagagaggcugggucgcuuuccucaggccaugcuugcugcugaguagagaauccaguguggagccaggacacugugacccuggaguucccaaccacuaggauugccccuccaggcccuuaacuucucuggccacaacuuuauuucuuauuccgaaaacaaagacagugggagaaacaaauauuuauuugaacaucuaugguaugccaggugcuauggguuagacuguguacauuauuuuauuuaagucuuauuucaagcccugggguuaaguaucagcuucucgauuuaaaaaaauucaaaaaaggccaggcaucguggcucacgccuguaauccuaacacuuugggaagcugaagcgguaggaucacuugaguccgggaguucaagagcagucugggcaacauagugagacccugucuguacaaaaaaauuuuuuuuuaauuuaaaaaaaaauuuaaaauuuuuuaauuguaaaauacacauaagauugaccaucuuaacuauuuuuggguggacaguucaguaguguuaaguaucuucacauugucgugcagccaaucuccagaacuguuuggaucuugcagaacugaaauugugcauccuuugaacaagaacucccuauuuuccccuccucccagccccuggcaagcagcauucucuauggguuugaguccuccagguacuuuauaugaguggaaugauauaguauuuguuguuuugugacuggcguauuucacuuagcaugagguccucaaaguuuacaucacaugguguagcgugucgaugauauuuccuucuacuuuauauguaugccacauagcaccuugguuugcccauuuaucuguugcugaacauguccuugaugaaccauacaugucauaauggguugcuuccagcucuugaccacauuuuguugauuucguuaaucauucaagaccaagaaaacauaccuggauuuaagccccggucucuguuugauaccugacuucugacugcuuuuuacuuccaaggauccuccagcuuuaggaguugagaagaauuuuauacaauguggccuuuguuaagccugaaacugcuuugggccuguugaaaacucccuuuuauuuucugagucccuacucagacaacacuucuuccagaagccugguggggaccaaguuuauaccgccagaggccacaauguaaggugaaggcuuuuuguuuguaucuguugggugcccguuguuuuccuagugucauuucuaccuuuucccaaagcucgugcguuuguuuccauauuuuaaaaaugacuaugaugagaugucguucugaaauuaggaaguacaguaauacaacauuauuaucaugauacagguuugcauuuauaaggugagcucccuuggggcuagucauuuuuauuuuuuuuaauuauacuuuaaguucugggauacaugugcagaacgugcaguuauguuacauagguauacaugugccauggugguuugcugcacccaucaacccgucaucuacauuagguauuuguccuaauguuaucccuccccuagcccccgacccccuacaggccccagugugugauguuccccucccuguguccauguguucucauuguucaacucccaccuaugagugagaagaugcgguguuugguuuucugaucuuguguuaguuugcugagaaugaugguuuccagcuuaacccaugucccugcaaaagacaugaacucauccuuuuuuauggcugcauaguauuccgugguguguaugugccacguuuucuuuaucuagcuuaucauuggcauuuggauugguuccaagucuuugcuauugugaauagugcugcaauaaacauacgugugcaugugucuuuauaguagaauaauuuauaauccuuuggguauguacccaguaauggugagagacaggacuagcuggauuuccuaggccaacuaagaaucccuaagccuagcugggaaggugaccgcauccaccuuuaaacagggugcuugcaucuuagcucacacccgaccaaucagguaguaaagagagcucacuaaaaugcuaauuaggcaaaaacaggagguaaagaaauagccaaucaacuaucaccugagagcacagcgggagggacaaugaucaggauauaaacccaggcauucgagccagcaauggcuacccucuuuggguccccucccuuuguaugggagcucuguuuucacucuguuaaaucuugcaaccgcacucucuucugguccggguuuguuauggcuggagcugagcuuucgcuugcuguccaccauugcuguuugccacagucacagaccugccgcugacuuccaucccucuggauccagcaggauguccacugggcuccugauccagcaaggugcccauugccgcucccgaucgggcuaaaggcuugccguuguuccugcacagcuacgugccuggguucauccuaaucgaguugaacacuagucacgggguuccacgguucucuuccgugacucguggcuucuaacagaacuauaacacucaccacauggcccaagauuccauuccuuggaaucugugaggccaagaaccccaggucagagaacacgaggcuugccaccaucuuggaagcgaccggccgccauuuuggaagcggcccgccacgaucuugggaguuggaacucccgguuccaacuugggagcaaggaaccccgguaacaaugggauugcugggucaaaugguauuucugguucuagauccuugaggaaucgccacacugucuuccacaaugguugaacuaauuuacacuccuaccagcaguguaaaagcauuccuauuucuccacuuccucuccagcaucuguuguuuccuggaggcuagucauuuuuucucaagcccaggucuuaagcagauaacugcccugggugugcaguaauaugguuuauggugucaaaggcgagaucucuugugugauaggcuagagauucucucugaugcacucgauuaucauuuucuauuuaaaauaggcauuuuguuuaucuaggagagcauuaauuacuaauuacuaacauuuaccgauaaacaacuauaagaaauauuuaaguaaguguuuuguuaguauguguccuugaaaacuuacugcaagugaacauguaauuuaacuuggccuuuuucugauugcaucguuucuugccguugccuguccagugggaguauuuauugaauucuugcccuuuggggcuucccagcugucuggguaucaaaagcucccaauggauuuuuuucuccugcccuugaggggagucuguuccuuuuggcuuccagcuuagaauaaaagagccacuaaucugucugccccaugaaccuuuacuuaaagauguucuuuuaggcugggugcggugguucaccgcuguaaucccagcacuucugggaggcugagaagggcggaucccucaaggccaggaguucgagaccagucuggccaacauggcaaaaccucaucucuacuaaaaauacaaaaauuagcugagccuguaaucccagcuacuggggagacugagguacaagaaucacuugaauccagaaggcaaggguugcagugaacugagaucacgccacugcauuccagccugggcaacagagcgagacucugucucaaaaaaagaaaaaaaaaaguuauuuuagcuuuuucugcuugcucuuggaaaaacaaaaauuagggagcggcggggagacaggagaggauaaugacagacagguucaucugacaacuaaccuuaaaggggccuugucuauuuuucagaaccuacauuaagaaacgcauucagaugcaucagccguuuguaaagcaccugucgugagccagguaagauguguagcguuuucaaagcuguuuuauuaaauccucacagaaaccuuuccaaguugccguuuuucagcagggcgaucugugcugaaguaagcuaccucgcuuggcucacacagcuaaaaguagacgcaccagccuagggcuuggcguuguccgccucuaaguuuagggcuguaauccgguucuuucaccaaagaagacacaguggcugccucacagggaccuggaaacagugucuaauucccaguucuggugggauuuccccugugucuuacucucuuggcugaugaucaguagaucuauuuaucacuucuaggagcugcgccuuaagucuucauuucagccucuucguauggaccucacugaggcucugagggggaagugacugcuuagacccaccacccacccacccagcuuguucugucgggaaugguucugacccucuuccauggagaggcauguguuugucuggguggagaacauuuccagaggagcauggcccccugagaacugguccggguauggccacaguucagcacucugguuggauucugcacaugaaacauuuugaaaucuuuucaguggaaguuugguucuuggacagcucucuucugcuguccccuaaacccccuauuccuacugagaucagaggccauuuguuguacauagucaucgcccaggugccagcguagggcugggugcccgggaagccuccaguaagcagcacagaggugcggggugcgucucaggaugccaagacuugaucccgacuccaucauuuauuauuccuguucucuuaaccuuuuaagcuucaguuucuuugucuuaauaaaaagggggcaugugaagagaugacaguaguccuucaugguuuugcuguaaggacucacugagcaaaaaacguguaaugagggcagguaugggcuuuauuaauuuuuguauccugagguugguauucacuacauauucaucagaaugaugaugaaaaaguaaggaacccccccacucugaguuucauuugcuccacuucgaaaacuaagauacugguguuaaucugugguuccugggggcagagggcugcucaucagaaauuccuugagggccuuucccagaagcacaggaccaagccccaccucugaaauucugauuccugccaucuuggcuggaauguggcauuuggguucugaaacauggguccuggggauuguaccacacagcccuggugaggcgugaugggcccuccagacccugaggucucucgccugauccuuucuggguugggcagguugggggcacauggaguggcuagcaaaugguuaggguucugacaguuucccacuccaccccucuaccuuccacccguucuucaaggcccacuuuauuuuuauuuauuuauuuuuuuugagacggggucccgcugucuugcccaggcuggagugugguggcgcgaucuccgcucacugcaagcuccgccuccuggguucaugccauucuccugccucagccucccgaguagcuggaacuacagguaccgccaccacacccggcuaauuuuuuuguauuuuuaguagagacaggguuucaccguguuugccaggauggucucggucuccugaccucauaauccgcccuucucggccucccaaagugcugagauuacaggcgugagccaccgugcccagccuaaggcccacuuuauaugccaccuucuccagaaugacugcccgggccuccugagcuggaaagugcucucucucucugcugaaugccuugugguccugccucugggguuuuguaaugcugcaaucagccauaagcuugugaaggacgcggccucgcuugaugcaacauggcaccccacagcaccuucgccgggcucuugcauccaguuggcauaucauuauauauuuacauaugucaccgauacauuuaugaauaacuguuucaacagcuaacucuuuggcuuuauaaaucacaacugcaucucccaagauuccuucugugucucuucagaccaguaacacagaaugucuuuguuaaauuggaccuuuuuuuuuuuaaauaaacuggagacacuuggggagaauaaaaugauguacucugcuuuuguaauuagcugugaugauuagacuaucuucuucauaaugucuuauuuuuacuugcuuuggaauuuaucaagugcucucuuuucuaugaagguuacccuucaagugaguaagggggcuugauuagaacacugggggauuuaccuuguacuuuuuaaaaauaagacucaugauggagaaggcugaugugagccgauggugaaaggucagccuggagcuauaaaaaggggucucugagcugagaaacugaaaccgaugcucccagaccaagauuuuuuuuuucugccaucaacugcugaaguaauuaauagucacuuuuauuuuagaauuuguuuuauauuuaacaaagcagccugucauggcuucucuucaugcccagggcaagguccuuucuuuuuuuuuuuuuuuuuuuuuuuuuuccccuuaagugcauuuauaauuacauugaucagcucugaguuugugauaugccaaguccuugaaugugauacucauuugcuuucacguuuuugaugcaaauggaucuuggaauccauucuagagugcuuugguagauuuuuuaauccacaauaggcaauuuaucuuguucagccucuacaaggacugucugguauggccggucugggcaucuggcuggccacgagccugcccaguagggacucaguugggaccugcugagagcaguuucacuuucgcauuugcuuccucuuguccacagcugaacugagagguguucucggggaucccuagaguauugagaacaaagagcagaaggaagagcuugcauacuucuauuuuccauccauucagugaauauuuagugccugccccaaggcagguuuugaggauacagcagacggcacaacaggcagacauauccuuguggacgugcucuggcaccaagcuguuuccaacucagcacaugugggaaaggaacuggcacuuuuuuguauccuugcuaucuucggcauaugugggcauacuuauuuaagccucacaacugucugugaaguagguauuauuaaggguuauguaggccacauguaucugugaacaucauacuggugugugguguuuugcauaauagagcuaugaaauuaugcagcugggguuugaaaauaaacccugccuuuggccaucuagauguugaacaagggacuuaaaugcucacagccuccuccucuuccccuguuuugaaugaggcuaaagguuggaccucucaggaucauuugguaguuaacacuuugcaaguuggcauggauacacacagguauuguaaaccugugugugcuugaaaagcagcggcuguuucugccugugauucuggaguuacuucuggauuugauccuauacagaaugcucuuauauccuguucauuauagggaaggaagcuuguggcagggaaucugcagacccacguuccaccugguucuaucaucaaauuguguggucucggacaaguuccuagaccucucuaguucucaguugucgcauaucugaaaugagacgauggugcugauuucccuuuggauuaauuucuccuuggauuaauuucucuuugguggcuuuguuuaggcccccccuucauuuccaucaagacuuucucauguuucaguuucauauggcggagggcuugccuggcugccucauugaucacugugacccucgccuggcauucccaucccucuuuacccuguucuguuuuuucuuuauuuucauagcacuuaucacuuuucuuucuuucuuucuuucuuuuuuuuuuuuuuuuuuuuuuuggagacggagucucgcugucuugcccacgcuggagugcagcggcccaaucuccacucacuguaaccuccgccucccagguucaagcaauucuccugccucagccucccaaguagcugggacuacagguguacgccgccacgcccggcuuauuuuuuguauauauguuuuuuuaguagagacgggauuucacuguguugcccaggcuggucucgaacuccugaguucaggcaaucugcccgccuuggccuccaaaagugcuaggauuacaagugugagccaccgugcccagccuuuaucguacuuagcacuuucuaacagacuguauguuuuuuuaaauuuguuguguuuauuuuuauagacaaaaaacacauguuaccuuugcuggaauguaaccuaauuaaggggcgaaaucuuuaucgaucuugugcccagaccaccuugaagccaugaagggaugcucaggaggcuuuguuaaauauaaaacaaauucugaaauaaaagugacuauuaauuacuuccacaguugauggcaggaaaaaaaaaacuucaucugggagcaucgguuucaguuucucagcucagaggccucuuuuuguagcuccagggcugaccuuucaacguuggcucacaucagccuucuccaucaugagucuuauuuuuaaaaaguacaaaguaaauaccacaaacagguauugugacuuguggaacaaguugucgagaaaauuacaaagaauaguuccuucugcugcuaucugcuuagagccagccuggcucuaauagcuggggccuuuguguguucucuucuugggcauaaagaguuucacagaauacaauauagagugauggagucacucuauguugguaauagaacaagacaaaaacaagaccacucaaucaucaacacugagcacagauaaaagcaagaucacugcaaggcacaaaaacaaccaaacauuccccagucucagcucacacgaauguuucuuuaccgauuauggcuuuagccucauucuguuccuccugccucuuagauaaaaauuaggaagcuacgucaucauaaaauuucugcucuguugacagcacccaauucagagcaaaacuacauuucccugagccuaccccuaaaucacugaacacaguccaaauuguauaaugagcuccuccugacauccucuugcugagaucucugaaauucugccuguuguaguguccaccuugcugcagugaaccaaugaacccaacuuuguuugaccacagguauguuccugguagucuuuaacuggagccgguggcauagucgcuuggugaauaaaacuuuguccuaggcaucacuguagaaauguguagguuauuuuacagcugaaugguauugaauagacauguacacaguuuaauuggagagcugagucacuugauaauuguggaaacagagcaggaugugacagaaggcagaaaugcaaagguuggguaagugugccucgaaguaagugacuugagagaaggagaaagccuagaaggcuggggcgguagagagaagguagcuagggcuggaagacacaguggggucuugaguaaaucgcuuguuuaggagucaagagacccaaggucuuauccuggauuuacugcauaugagcuguuaacaaguccaauuguuagguuuuucauuuguaaaaaacagggucaguaaucucuccuccuuaucucacaugguaguuaacuugugugaaacaccuuguaaagugucuugugcuggaaaaguguaaggccuggcucuaauuguggagagaauuaaaaaacaugcaguuucaagguguuucacccauaagccaggugccaaaugaucccucucugucuuccaccacccaaacuuuagaaauggggguugccauaggaaccuugucauuaucauucagcagcuauagacuugcucagguggugucuuuuuuuuuaagaccgguuagguuacuuauagggucuugggagcaggaguguggugggaggggcauaagagagaggcagggauagaauuagaauggggagccagcaaaacucuuccuccaucagaugaggggccugggauccagcugcuaccuuuaugcccuccgcccuaucccccuccacucugagucagacuugguuguucaaggauuuaaaugggaaaauguguuagccagauuauccuuccaaauaagguuauaaagucuaccguauuaaagaggggaagauuuccuucuguggaauuucagaucuugauaauaguaaugguaauaauaauaauacgacugucugucauuuauuagguguuuguuauaugcuggacacuggauucagcauuuguggguguugcuuccuuuaguacuugcaauaaauucauuguuauccuucuuugcaaaugaggaggcggaaaccuagagguuaaauuacccacccacagucaccagccagcuggccucacagcccagaguugaacuaggucccucugaccucaagugcggaagacuuaagacucugcucccugguuuccuugcagauaauccuaggauaugagagcuauuaucuagaacacucgucuuuuagaugggaaaauagggguuagaagaggugaaaucccuguuugaaggccguguuauugcugcugcuggugguagggccuggguguggcccgagaucuucugauccucaguccagagagugaauaggacuuuucuccugauggguuuaaauaugagugguuguggucgcuggcaguuucugcaacagaaguaugguccuccuuuuacuuuucuguggaaaaggcccucaagcuacagaaccagaucauugcacccccacccccuaccagccaucugacccugggcuccuucuuuaaucucuccaucccuuuguauuuccucguauggaaaauugggauaacaacuguaccuauaccuuaguauuguaauaagaacuaaaggaguccgggcgcaguggcucacgccuguaaucccaguacuuugggaggcagaggcgggaggaucgccugaggucaggaguuugagaccagccuggccaacacggugaaaccccgucuguaguuaaaauacaaaaaaguuagcugggcaugguggugcucaucuguaaucccagcuucuuggaaggcugaggcaggagaauugcuugaaccugggagguagagguugcagugagccaagaucgcaccacugcacuccagccuggacaacagacugagacucugucucaaaaaaaaaaaaaaaaaaaaaaaagagaagaaaagaaaaaagaacuaaagggauuaauauguugaaaacucauagccuggugucuaguacccaguagguuaugagugaguacugccuguuaauaauguaucgcaucccucguuugaaggauguaguccuaauuugaguuuuuuucaguagacuggagcuccugcccucacccuauagcauucguauccucugagauacauggauacuguugaaguuauggugaagaugauggggugcugggagguggaguggaaugggauugauugaugaaaaaacgacauuagcuugcuaaggacacccaggugguugagauguucugcgaagugggccugugugucugcuggaccuggaguugaggggacagcuuucuucugaggcagcgucuuauccuggggugacuccgggaggcaaaagcauuaacuauugaugagacugaugacacacuaucauuccuagaccagaaauggugcaagaacagagaggauuuauccugcucuucuuucucuacacagucccugugucagagaaggugucugcugaguggacaggccaagaacuguucucugggacggagugcagaugaaguaggggguguaaacccaugaagaacaaugaagcagagcgagugaagcaggacaggcugggguggaggagaaagaauuugccuuuauugugcaauuagccuuuucgauucuuuaaaagcuuuaggagauagugaauaugucccuccaaucuacagacccgaagaggcaucucgggaaagugauuugcccagggggacagaucaaggaccugaccccaggucccucucucugccucagaggcccucugggauccauuaaagggucuugucuugaguaauuaacugaauacugguuuauucagaaugaggggucuuuaauugggggauaggcauaccuuugguaaaaccacuggaguuuuugggcccagugucuggcagugugcaaggagcguggggcaucuuuggcacaacgcggcuucaggaagagcccuccuucccuuccugaguaaggcagaguuugagucaggcuggggugggcuccugguguggggacagguuauugugggugcuggagggaaugacuuucacucugagucauucaguggccugcaggggugcagggcuggggguggagagagaaauagagggcuggccaaagacucucagugccugcccuuucuuaccccuagggcccaugagccugguuuaaaaaccgcuuauccaccaccucguuuucauucucacacacugaguccuuuagacguaagccuguuggugaggaagacuguugcaguggcugagaugugcugggcgaaagauuuucaacuagucuuuuccuaauaagcaccuacuuguuuauauucugagcuuucacagcagcauucuagaaaaaagaaauacggaggacucaaaaaaaauacgcugccugauuuaguuuugauugcucacgucucuggcuucuuucauggaacuauuaauugacuauagggaguagcugcuuuucgcacaauaagcuccuagucaugaagcaaaauggugacauugaucauuuuggggucccucagacucuggcaacguugaaacaggcugucaguuuuuuuuguaaccaccaguuagcaugaguggggguggcagaaauuaccaguuugauuuuugaucaggggcuauggcuuauacuuaagcuauuuggagggaggagaaagcgugaaugagcgaguuaaggcaguagaaagauggagccaugcuggguuuuuaggcaguuguuucaaaaacaacacaaagugagaaauggugaaaaccaggaacuguuuggcuuuuucuaguuuacaaugagagaagaaagauguuuggggaauuuuagaagacuugagucuaucguguaguacaucugguggaguccuuguacaggucaguucacagcguaccacugcuuagaaguggacuggauuuaauggggcuggcuauuuauucagcaacaacuuauuauucaccuucuauguauaaagcacuacucugaauaaaugucuucuaaauuguuagaaucuaaacuauacucaauauuguuaccaugugaagcauaucuuauggaauuaugauuuuuuaaaaaacuguuacucccaugucauuaaaugaaaaguuucagaacaaugguaguugaaugcaguuuggguaaaacugugaauaucuaauauucuauauuuguguaugcaugaaacauuuuggaagauggauaagacacuguaaaauaaucagucuaauaaagucaguguuuuaauccaugguugccagcaucacaaaagagaaacaaccagaugucaugugccucuugauggaacuuuaucggggaaccugccccgauagucacguagguucuuuucuauuuuccuaagcgucggcuggcuugagaaauaaaggacagaguacaaaagagagaaauuuuaaagcugggcauccgggggagacaucacaugucgguagguuccgugauuccccacaagcugcaaaaaccaggaaguuuuuauuagggaguuucaaaaggggagggaguguacgaauagggugugggucacagacaugaaguacuucacaagguaauagaauaucacaaggcaaguggaggcagaacgagaucacaagaccacaggacaggggugaaauuaaaauugcuaaugaaguuucgggcaccauugucauugauaacaucuuaucaggagacaggguuuugagagcaaccggucugaccaaaauuuauuaggcaggaauuuccucuuccuaauaagccugggagcgcuaugggagacuggagucuauuucaccccuacagccuugaccauagaagaugggcacaccuagugggggccguuuauagaccuauacccccaggcauguauucucuuuccgagggauguuccuugcugagaaaaagaauucagugauauuucucccauuugcuuuugaaagaagagaaauauggcucuguuccaccuggcucaccguuggucagaguuuaagguuaucucucuuauucccugaacaauugcuguuauccuguucuuuuuucaaggugcccagauuucauauuguucaaacacacaugcucuacaauuugugcaguuaacgcaauuaucacaugguccugaggcgacauacauccuccucagcugacaggauuaagagauuaaaguaaagacaggcauaagaaaucacaaggguauugauuggggaagugauaaguguccaagaaaucuucacaauuuauguuuagagauugcaguaaagacaggcauaagaaauuauaaaaguauuaauuuggggaacuaauaaauguccaugaaaucuucacaauccacauucuucugccauggcuucagccggucccuccguuuggggucccugacuucccgcaacagaacuuggaucuguucaagacccuagaucuagcuaugaagucacaggaaguauacagagggcagagaugcagguuaaaugacaaacagagacgcugucaugaaaauucagacagcggaaaacucuguagaaaaacagcucuguucuucaccaaggaaauuguaaaggggaaaauuugauggcacugguggcuuguggauuuuagaugaaguuaaggaauuaauguucuuuucuuagugugguaaugaaauugagauuuaaaaauaaagauuuugaaacccucaggaccaagaugauaguauaucgcggauuugcuucaaaguaaucacggggcggggagaaagggagucaugggaaugaguagguuagagaggaaacaaggcuguaauuaucaugacuugauaauuacugauauugggucauagguacauagggacucucuuguuuuaauguuuuuaacauuuuucauaauacaaauguuaagugaaauaaugauuuagucuauuucuuagccauuuccuaaagauaugcauuauaagguccauuauaggccaggcgugguggcucacacuuguaauuccagcacuuugggaggcugaggcggguagaugaucugaggucaggaguucgagaccagccugaccaacauggagaaaccccgucucuacuaaaaauacaaaauuagccgggcauggugacgcaugccuguaaucucagcuacucaggaggcuuaggcaggagaaucgccugaacccaggagguagagguugcggugagcugagaucgugccauuacacuccagccugggcaacaagagugaaacucugucucaaaaacuaaaaauaaauaaguaaauaaauaagauccauuauacaucccauccuggaauuuuucaacuugaugugaugcuacaaagaugaucuaguucccuaauaucauuccaugaacuucuaggauucuggguuucccaggggcugggggagguaagggagagagacucagguaagugggacuuuagaauccuguaaauacacuucaaucacagaugcgucaccuguguguuuuagaucuuugcauuucccggaagauuuuauuggggacaaaaagggggcuuguuauuuauagaaagaaaaguuugaggccaggcgcgguagcucacgucuguaaucccagcacuuugggaggccgaggcggguggcucacgaggucaggaguucaagaccagccuaaccaacauggagaaaccccaucucuauuaaaaauacaacauuagccaggcaugguggugcgugccuguaaucucagccacucaggaggcugaggcaggagaaucucuugagcccgggaggcggagguugcagugagccgagauugugccauugcauuccagccugggcaacaagagccaaacuccgucucaaaaaaaaaaaaaaaguuuggaaaccacacucuuauuuuauaaacaaggaaaccaaagcacacagaggggaggugauauacccaaguucgcacgguaggcaagucgccaauccccagaccccauggcagcuguuuuuaugcucuucagucaugccgguccccagucauuacccuucagaccucuugcacaggggccccaaggaagauaggucaccugcauuccagcuuccagugcugccugaucguccuaaguggaagcugugcugaaauugaaaucacuuccuguguucaaagcaccgaaaggagagccccauuggagaugcacuuacugcaugcucccagcucccagcuugcucuuuacuaaacucccugugccagggagcauuauagcaggaggaauacauugaauuugggaaacaaacagucucauugggacucuuccugggcuagaaagccuguauguugaacacuuaaucauuuuuaaugcuuguuucaccugcucucaucuuuauuugcccucaauaaaaccaagaaaccuuggacggucucaagagguauccugucuuucaggguuagggacacuguggaacacagaaucuaggguugcaagucuugucuguaaauuggagguuuuuucuugucuuuuuuuuuuuuuuuugagacggaguuucacuuuugucacccaggcuggagugcaguggcaccaucucggcucacugcaaccuccgccucccggguucaagcgauucuccugccucagccucccaacuagcugggauuauagguucccaccaccaugcccagcuaguuuuuuguauuuuuaguagagacggaguuuuaauguguugggcagccuggucucgaacugcugacuucaggugauccgcccgccuuggccucuuaggaaagaaaggagaugaguaaacuagaagugggaggaagggugccgggaacagacugugggaacagaguugcacauauauucucuuacggccauuuuggaccaguggccuuuaaacuucuuuuacugcacucaaaccugcaggauaagacuuguuuucaucaguaacauuugaguagagguuuggccagguuguggguacagggagggcuuggggcaggggugggaccucuggagaggaugguggugggacugcuagaggguuugagugcgguuugaauaaacccccauaugcauuuuggaucuuccugcauccgcuacucuuucccugucuaccucuguugagaccucuuuaauuuuuuauuuuuauuuauuuauuuauuuauuuauuuauuuuuuugagagggagucuugcucuaucccucaggcuagagugcaguggugcaaucucgucucacugcaaacucugucuccuggggucgggcgauucuccugccucagccucccaaagugcugggauuacaggcaugagccacugugccuggcccaaagugccaauccuuacagccacccucucugccuuccagucuggaagggacauacucccgacccacugcaguauacugaacaaagauguucacacgcacagggcgguggggaaggagagcugacccauucacaagcagggaagauagaacggaaaaucaaggacagcuucacagaagagauaaagccuggguuggguugugaggaugaaaaggaugucuuccaggaaggcuaggaguauggaaauccagggccacgugaacaacauagacaggacccccccagaggaacaaaacagaugcccuguuuggagaacuguagguguugugguuuuuuuguuuuguuuuguuuuguuuuguuuuguuuuguuuuguuuuguuugugcuagaaugggaaaugugagugagagagagcaacagguaaaaugcuggagacauucucaagaguaacaucccagcugcccucuagaucaguagccauuagcggcauguggcuacuuuaaaugaguugaaaugaaauaaaauuaaaaauacaguuccuuagucucaauagccaccugcagcuaguggccaccauauuuuagagcacagauguagaaaauauacaucaugacuguugggcagugcugggcugaauguuuccuuauuuggcucacaucugucaagcugcaccugguguuucgugacaccugcacgcgucagguuuuggaguggcuugcuucguuuugguagaagagccuguacuggcugcucagggccacaguggaugugccagagagauugaauguauaguuagaagcaauguacaauugcucaagauaugaauauuaguaacuuuguuuuauuuuuuagcacugcucagaugaauauauaaaaauccgaagaaauauguuauuuccccucuaagccagcagagcuacuaguuuuauuaagcagacaauggcaaaucuauuuuuaauuuaauuuuuuauuaaaaaaugcccuacugcuugagauucuaaucucuagcugaauaguaagugucauuuucgaguugcgaaucgccagagcaacagcgugcgucgaaggcacuuaauaaauaggauucggugcuuuacguccguguagagacaaaaauagaucaaaaagcuuuucgauuuuacuuuugaguacaguguucugacuuucuagaugguaaggaaccauuuagaacuauaaagggauuucgauuucgauaacaguaacuguguuuaauguuacaaacuuucuauuuuguaaguggcuuucuuugaaguccuguuggcaguuuguuaaauauuuuagacuguuauuugugaccaagagguucaguuuggaggacuuuuugugauucacccgugugcuuuaaaauaauuugccacuauuuuuggaguacucggucccaggagauuugugcaugaguccugauuuugucucuuaguagcagugugacucagggcaagucacauagccugugcugaggaucucuuggcuuucugacuuuguauuuauucacccugcuuaguuuucccagggagacccacacucacacccacccuuuagcccauggacuuugguggagaugauauugugcagggcuucagggggagacauaggacucagauuauuccuaauacuggcuuauaguaauuggcuuagaggugguuucaugaccuaguuggagcccacaagaugugaugaggcuuuuguuggggcuguugagagguauguguguucuuucccacuggccuugaacucagagguuggagcugcggauauuguagcuacauccaaccuaguagcugucuugcuacugcauggcaucugaguaugaaguccguguggaugagagcagagcugagguggagagggaccaggccaucuccuggacccagaucaaaccuugccacaggguagauucaccucuggaccuuacagauugugaacuauucaguccuuuauuuugccugcauuaguuugaguuggauuuucugucacuuucauuggaaagcucccucaaaaacucugaaacauuuuuuguacauuuguaagaggaaaaaaaaaugagaguaacagaacagacgcaccuuggcuuagcauagauugcauccugcuaaacccaucguaaguugaaaauaucaaguucaaaauuugcguuuaauacauuuaaccuacauuacagcauaguuuagcuuagccugccuuaaacaugcucacuuucauuggccuguauuugggcaaaaucaugcaaccuaagccuagguauauuaaauacuguacugaaaaugaaaaacagaaugguuauauggguacucaaguauaguuucuauugaaugcauauugcuuuugcaucaucauaaagcuggaaagucauccaggugcaguggcucacgccuguaaucccagcacuuugggaggcugaggcggguggaucacuugagcccaggaguucgagaccagccugggcaacgugacgaaaccuugucuguauaaaaacuagaaaaauuagauggucaugguagcaugugccuggggaguuuaggcugcagugagccgugaucacgccacugugcuccagccugggugacugagcgagacccuuucccagaaaaaaaaaaagcugaaaaaucuaagucgaauuauccuaaaucggggacugucuguacuuaccuuauaucuaggguugcuguaaagaugaaggagggcaauagauccaauaguacuuuaaaagugguaaaauacuagauauuugcaagaaaagaugcuagaaccuuucacaccaaauuuugacugugugagaaauaaaucaacaauguaguuucacagcuccaagcuaauagagauuaaacuauauuacucucaguauuuugccaaagugaguuggucuucaaaaauaguuuuaaaagaauguauguauaaaaaguuuuuaaagacaggaaguaaaacugcaacaggauuucuuauucauuuuuaugaccauuuuugucuuuuaaaaacuaggucccuuuuuaugcauggauucuauuauuuuuccuagauuuuacagugaggggaugugcauuuucuugagggggugccgauuuggugcagugcugcuuugcauauauuauuaaaucaaauaguuuuauaauugaauaugaaguagggcaaaauccuaaaccuaguuaguaugggugugcauuuccugcguauucauuuuccuguguugguuuacauaguuucuuaccaccuucaauucggaggcauuuuagaggcauuuucucuaaugaucuggcccauagaucguuucauaaguaaaugggaucagcaggguuuuaugucuccuacagcagaaggugccugggcuuuaggguugaaugcaucuggguuugaagccuggagcccccacguuuccuggguccaggugaucuucucuggaacaaugaggggcauaguucauuguaguaggcaugcaugaaaguuagaugaggugacgcaagucaaagugccucauaccugguagguaguuaauaaucgcuuuucuuauuuuuuuauuucauguaaacgugugauuugaaggcagucagucugucucuagggaaauuaagaauuuuagcaaagaaucaauugguccccauagcauucauauuuuaacuguucaggcuacuaaaucuuauucucacuaguuguucuguuuuugugaucuauacaggcugcgguagaaugagaauguucucuauuggcaugcuaacauauggucacuuauuuguucaguuauuuauuuguuuguuccaacauauguguaaauggggaucuucucugccagggguugaggaaaacaugcuuuuuucucgcugauaugguuuggauguuugucuccuccaaaucucauguugcagugaaauccacaguguuggagauggggcugguggaagguaauuagaucauggggacugauuccucaugaauggguuagcacugaccccuuggugaugaaacaguucuuacucaugagaaaucugguuguuuaaaagaaucugagaccuccucccucuuucuugcucccacuuuugucaugugacgugucugcuccucuuuuaccucccaccaugauuguaaguuuccugaggcccucuccagaagugcagaagaugugggugcuaugcuucuuguacaagccugcagaaccaugagccaguuaaaccucuuuucuuuauaaguuacucagccucaggaauuucuuucuagcgaugcaaaaaugaacuaauauccuaaauuauuucuugacuuuuuggugggucuauggacugggcuauuucugaagccacuguuuagguaaaagcauugguuucuaucagaaauucuacauucacuuccucuccuggcaaagguuuuucuauuaugggaguaguucauuccuuucauuuuuuuccucccugauauaaacaaaaaacguggagagccgucacggguaagauggauuggauuaauucugcagacacaaucagggagacccaggagccuuugggggagugagggagaugaacaucaucucaggaagaacuuuuaaccucuggaacuccccaccaguaggacggacuguuccagaacgcaguggugaucuacugccaaagauguuuuauuaggauagaaaucgcuaaaggacaauuauuuauuuauuuauuuauuuugcuggggacaggguggagugcaguggcacaaucauagcucacacugcagccucaaacucuugggcucaagugauccuccugccucagccucccaaguagcugggacugcaggcaugcucaacaacauccagcuaaucuuuaaacuuuuuguagagauggggucuugcccuguugcucaggcuggucucaaacucuuggccuaaaggaaucuucccaucuuggccucccaaagugcugggaauacaggcaugagccacuacaccuguccaauuuuuuaaaacacauuuuuugagauccuaguggcuguaugagucacugaagauugaauagacgagauuucagcagccauaguccccacauagaaugucagaagcuugaaguuccauguuacuagagauuguguagggguaaugauugagagcaagagucugcauucugugggccagucugucuuccuuuagcccaugagcuaagaauggcuuuuacauguuuaaaguguccaaaaaaaucaaaacaagaguacuguucuguagcacgugaaaauuaaauuucacuguccauaaauuaaguuuucuuggcacacaaccaugccuguuuccucuuaucugugguugcuuuccuacuacagugauugcgaguugccagagagaaaguauggcaugcagagcuuacgugauuuacuaucucaccuuacacauaaaaauuuugcuggcccguguucuaaaguagaauauccucaacuuucccacccugaaacuuuguggaaaaugauaauguuuguucaguguacugggauaaguggaagauaucuugcuggccuggggcugaaggcaccaccuuagcacaccugaggcucauuuggggcagagccucuugaaguucucauugagagccggcucuggccauaggcuucagcccuaccugcagcuguuugauacgaacacacucaccugggucagcucuucuuccgaggcauccugaagaugccucauggacucagaugaucauagucaucuauguagcugacucucacaaggguuuucacaguuuacaaaugcuuuucacuuaggcugcuugcuuuuucucuguuuucaaugguuacguuugucucucacaauccuuuugguccuggucucucuccacuugaauuagccuuucuugaagauguuagggcaugcaugaaaguguuuguuguuaaaaaauucguaauguugcagggggagacaggacaggauauauauacauacacacauguauauauaaacacauauauguauacuauauauguguguguguauauauccuguucguauccauauguacacauauguauguauguauagguguguguguguguguguguguguauauguaauacucucuacuccauauauauauauauggaguggcaugugaaaauuaaauuucacugcccauaaauuaaaaguauugcaaaaucccugugccuuuggcauuucaaucacaaucauggauguagcagugggacaagaggcuggagaaagcagggccagaucuuauagaguuagcuggaggcgaagcucacucucccacauggaggucccgugugcugccuggguucuagccacauucuucuauauugcuugguuguacuacaguuacuauucugggauucaugcacgacccaucucccuuuucguucucaguauguucaugguaaacugcuauuaucugaacuggcuuauugagucucuguuucuugugaucaggucauaaugguaguugguacuuacaguguuccaggucuuggccucacacuuuacauggauuaauucuuuuuuuuuuuuuccaguaagguagauaaugauggccaucccuauuuuacagauaaaaaaucugaaucacagaaggguuaaguuacuggucuaggucaccagcuaggaaaugagaggacugaggcuugaacccagguggcuuguugcugaagcucauucuuuuucuaccuugggcugccacucgaagccauggaaugcagcugagaugccuggguguggaacuuggugggaacagagggaacauugaaccuuaaaugggucacaaaccuagauaagugagaucgggccuggucugguacagcaguuguagaaguugcaggguucuuggugugcaggaagcaaauggacaaaaaaauaugacaaggcugguccuugguccugcuggccugagggaaccuuccaguuuucuggcagggacugugaauggggagacuaacacaguugacaccauugugugccaggcauuuguuacuguauuuaauccuccuaauaacucugcaacugguggucuugcuuccauuuucccauauuacauaggagcuaccaugcucagagagguagagagcuccccuaggaucaacuagugaaugggggccagagccagaauuuaaacuuuggaaccaucugccuccacugucuuuccuuuccaucacaccagcucuguaggaagcaggcugaacuggacugcacucuagucacugucaaccuuuccuggucacggaucccuuugacagucucuugaaauguggccucuuccccagaagugcuuguuuguguacauguaugcacacagaauuuugaaugcaaaaucuggagcuuuacagaaucccauuuauggguucagagcuguuucugacuuuguaaagucaagcuaaaccggagcuaauacaguugggaggaagaggaauggagugauugcuauaacuacuggcuucaucuggaucuuuuuccugauuagcagugacuuugcucauucugguaguuaacgccuaauguguguuagguuccagacccagaccucacaugcucgauuuuauuucaggacugcuuuaaccguaugccucaauuuccccuauuuuaaagaugauaaaaggaagcuuggaauuuggacauuuauccaugccaggugagcuggagaaccuggcuucuaacuuagcucuucguuauaacgacuuuccaaauaggccgcaguuagugccagcaagucuuuagcaugaauaagugagugcuugaggauauugccaggcucucaaaugucauuucucaccugucucuguuaggcagcucagauccaccagccuggggaaugcugcugaauuucgguuuuuauccugaaugccauccgaugcauuaauuaacaugacugugaaagcaccucacacucuuggaggguuauagaacuaggaaguccuugcagccucuauugcaggcagcagugcaguuaaucccugcugagacagugccaagcuguccagggaguugaaaaucacaggagguuugcaaagacuugccugccuuuacagacuccaaaguguagaauuguaaaugacaggacacuuaaaaaugccacauauugugugaaugcuucucuagcaguaaaauauuauaccaccauaaagcccuuaugaacauguaauaauaauuucugcauaagcaccagcaauaaagugaaauucagcuccauccaguuuugcaagaauuuucccugguggagagugcuagccauugugugaauucucaucugggugaagagaaacaaaauccauuucucugaacaugguuauucuuuggaaauagcuuuggccucaaacuuuagagcaaaaauuauccugcaugggaaaugcuaacuguaucauuucuaaagcuguagcuuugucgcugaggcauauuaacaugauagaaacuuuuccuuggggcucaugacuugccucugccugauuuuuuucauaaacuuaaagaccagugaauggagugagcagugcucucuugaaaauucacuuuuaccauuuggcuuuuuuaaaagaaaauuuuguucaucuuaaauguuuauaguaaaaacuauagaaugggaugauaaagaaaacuugcucauauuccuaccacccuccaguuauugccgaagguacuuucacucgcguccgugugaagagaccaccaaacaggcuuugcgugagcaauaaagcuuuuuaaucaccugggugcaggcgggcugaguccgaaaagagagucagcgaagggagaugggguggggcuguuuuauaggauuuggguagguaguggaaaauuacaaucaaaggggguuguucucuagcuggcaggggugggggacacaaggugcucacugggggagcuuuugagccaggaugagccaggagaaggaguuucacaagguaaugucaucaguuaaggcaggaaccugccauuuucacuucuuuugugauucuucaguuacuucaggccauuuggauguauacgugcaggucacaggggauaugauggcuuagcuugggcucagaggccugacagguacauauuuuauauuuucuugauuaugauuauuuuugcucccuauuugucugaaagcucuacuagagaagaaauuuuguccguuuuggcugcuguaguauccuuagcccuuaaaaagaccuuaucacauaauagaugcuaaacaaauauuaguugaguaaguauuauauucuuggugauagaaggagucaggcuuuauuaccuugaaucccagcuuucccacucgguggcugaguggcuccaguaaguuauucagcuuccccgaauuccaguguucugcuaaaaugacaauaauugagcugggcaugguggcucauugcacguaaucccaguacuuugggaggcugagauggguggauaaccugaggucaggaguucgagaccagccggaccaacauagugaaaccucgucucuacuaaauacaaaaaauuagccaggcgugguggcgcaugccuguaaccccagcuacuugggaggcugaggcaggagaaucguuugaacccaggaggcagagguugcagugagcugagaucacgccauugcacuccagccugggcaacaagagugaagcuccaucugcaaaaacaaaaauaaaaauaaauaaauaaaaaugacaauaauugugcacaaagacugaccucaccuaguguguuaguuugcuagcccuaucguaacaagguaccacagacuggguggcuuaaaugauaaaaauauauucuaucacaguucugcaggcuagaaguccaagaugaaguuguuagcaagguuggcuucuuccagggccucucuccuuggcuuguggaaggcugucuuccugugccuucauaugguuuccccucuguguuguauccuuaucuccucuucuuauaaggacacuggucauucuggauuagggcccacucauacauucccaucuuacccuaauaacuucuuuaaagauccugucuucaaauacaaucauauucuuagguacugaugguuagaacuuuaacauaugcauuuuaggggaggcacaguuaagccuguaaccgagggucacugguuugauuagacuuuauaauugguaauccgccauucagauguuucaguauuacauuaguuucaaaucuaauugaggagauaauguaauaaaagguaaacauaaauaaaagucagcuaccucuacaggcugagacaucaucugcuuggugagcacagugcucuugggguucuggaguugacugccaccccugcacuggggcauccugcaguucucccgaaggaugaaggcacaggugccucugagacuuacugaaucacuguggccuguguuuacccaccugagggcagucaccacaccucagaccagaugggcccguagugccugccaggccaugucuggcccaguccaacaacagucgucuaauaacauuuagcacuuauugagugcuuacuguauacuggacauagauccugggccucaguccagaguuccaguuaacugcaugugccagaccacacagcaugugccagagucagugucaggcucugugcucucuugccugcugagcuggaccgguucccagggaagauaucuuuuugcuggcagcugggagccccagccaguagcaagucuggggcugcagcuuaaacagccuaugcacaguggguacagucagcugauuccgagcccucugggguugccgcaucuuaaucgacccuuccugacuuccaugcuguugaggccuguauuggaggguccaagccacagcuugcgugaagccugggggcucuggguccaggcucccuuggucacugacagcacugacagcacugucccuuaacacugacaguguguuaaggcucgaguuugucccaugggcccuccaguuguguuuuggaccucuguaccuccauucccucucaguucuguuccugaucugucuuguucuuuagacagagcucacaggguaccucgggcuugggcuuugcugucugggacuuuucaccgaugagaaugggacuccauacaugagagaggaagauggcugugugcugucuucugguucuggagcucgagcuaagugagcucugcauguuugagcuuccuaggaaucuggucauuaugacugauaggugccaggacucaugcugaagguacuccaguaagaaaagcacgguauuaugggagcccaggaaaggggccacugacuagaggcuuccagggagauguuugauuccugaaucuugaaagcugaguugguguuagcugggugaaaggaagaagggagggcuuugcagccagugggaacugcaggaacagaaaggugagaaacguuugaggugugaaagagagcauuauucuagggcuguuacuacccauguccagaagcuuacgacuuggaaagguggagugguugccucgggauuacgccugggccaggcugggaggggcuuugugugcuaggccaagcagcuugaacguuauccucuuuggaggcucaagucuguguauguguauguguguguguguguguguguguguguguguguguacaugcauguguguguguuguguuaggaccugacccuguagcuuccacuguuugcuagugguaugucuaugucugaguuugcaaacugcaaguucuuguccaguuaucuuuuuuuaaaaacuuaggaauacuuuuccaauccaaucgcugguuuugggaagccacugugaguggcuugagagugcuccucuggccccaggggccacuuagggaccugggcaggcaucgguccuagggcaagaggagaagaggcagcuuccgaugagccucccacuccguccucacggcagggcuccccgcccucucaccugacaucuuccagcucuccaggcccuggcuuccugucuucagaguguucuggaggaacaggaaggcaaagcagagggggggugcauguaugcacgcacaugcaagaucagaagggacuuuuuacgaauucuuuccuugacacuccuuuuuuugugucgcaacuuugccugugaacccuuagaaucucugcuaaugagccggucgcaguggcucaugccuguaaucccagcacuuugggaggcagaggcggguggaucaccugaggccaggaaccgagaucgugccacugcacuccaggcuaggcgacagagcgagacuccgucucaaaaaaaaaaaaaaagaaaaaagaaaaaaauaauaucugcuaauaugugagcaguaucaucgucaucaccaccauugucgucuacauugcuguggaccaaauguuugugccccugcaaaauccauaggaaaccuaacuuucaaggugaugguuuaggccuuuaggugacacuuaggucaugaaggcagagcccucaugaaugagauuaaugcuuuuauauaaagagaccucagagagcucccucaccucuucuucuacgugagggcacagcaagaagacugcugucugugaagcagcaagggugcccucaccagacacugaaucugcugcuuccugaucuuaagcuucucagccuccagaauugugagaaauuguuuauaagccacccagucuaugguauucaguuaaaguagccugagugggccaagagaacaaccaccaccgccauugucaucauuuccagucucuauaagcuugcuuguaucagcuuugcuugagguguguuuaauucucacaguaaccguaggaguuagauacuuguugcauccucauuucacccuugaggaaacugaggcagggaaauguucaauaaauuguccaaggucacacagcugauaaguagcagagcuggaguucaaaggcaggccaucuggcacaagagucagcuuugaaccauuuccuccugccucucguggaggaaaugugucccugacaauuccuucaccugugagcuggaaggaaggaagaacucgacagcagccagcucccuuugccucggcaucugcaugguguugguuucuucuucacuguagagcuccccuaaguuuuauguuauaaucaaauguggucagcauuugcuuauggaauuugauuuagcuggacagugucucucuguaaauuuuacagauggagugucucuugaagacagaguggccaugggucucaggccuugggugucacggugggagcacacacgguugcuuuaauaaaugagcagagagcaugguuggcacccggcccaaaggaccuuguugacuggugggcacaugguauguuacaucugucauugugagagaauuccucaucuucccacagacauuaucuugccaaagcacuuuugcuuccaucucauccuuuccuuggacaagucaucuauaaucucucaagcaggggccuggucugccuccugccuucacccuuguagggaauggugguuucuucuuaggaugacugggagcuccuuggcucagaauggguuaacuccaacccgggcugccuccugaggaccugucccccuggaucacuguugguuuuaaucuucauuaucuugaauggcaaugcuguuagcacccaggagggguccuugaacagccagaugguggcuggauuuuucugccagucaucaguuuucaucugauugcagugcaggugcagggaggaggagggguuuuaguaguccccaugccuuccaguguucaagcacauuccuccaggaaccauuaaaggaacuauuaaggcugggagaauuuuugagagguaauauaguggauucauucacuuaauaaauauuuauugagcaccuacugugugccaggaacuguacuaagcaccggggauacaggaaugagcgaagcaaagcccugucccaguggaucuuauaguaaacaaacaaauagguaugaaauacgucagguggcauggaguggugagaaggggaaauauggcaguuuaaugguaguggggucagaggcucucugggccaugcgugaagggugggaugaugcuguuuuagaaaaagagacuacaagaccgggugcgguggcucacaccuguaaucccagcccuuugggagacugaggugggcggaucacuugaggucaggaguucgagaccagccuggacaacauggcgaaaccccgucucuauuaaaaauacaaaaauuagccaggcacgguggcacgugccuguaaucccagcuacuagggaggcugaggcaggagaaucgguugaacgugggaggaguugguugcagugagccgagaucacgccacugcacuccagccugggcaacagagcaagacucucucaaaaaaaaaaaaaaaaaaaaaagaaaaagagacuucacaaagcaucucugagaaaguagcauuugaucuagcacugaaugaagugagaaagcgagccucugagauaauugaggaagaacauuccagcgagagggaauagcaaguacacggaccuugauuagcaaggaggcugugguggcugaguaaagcuagggaaugcuauacaccaaauuuaugcacaaagaacuuuuuuccuucucuucuuguagcauuauuauguuuucucauucauccguuuaugcaugcauucauuuaguaauucuuuacugaagcuaacauugguguugggcacaacguuagggacugggacuuuagacuucaguguguuccuuuggggaaaccacaggggugcugggugcuggcauggaagguacccucagaguugucuuucucaacgucgcuuacuucucacuccuccuucaucacuaggcuucaaagaagagccuguggcuaaaguuuucacuuucuuagcuuugccacccaaaccuggcuuccuucccacaagcugcugcugugugcuguugaugaccuaguugucagaucuaagcaccuuucuucuauccucaucuuuucugaacucugcaguggcacuucaugccauugaccaucuccuuccuuguuuagaagccuuucugucugccuuccuugaagaggacucucucaggaugcccuggauucuuuaagaacucccauccaaucaccugugucagcgucucucuuccugcccuucaaaggcaggucaccugcagguucuguggcuucuucucauggaucaacuuacucccuugguaugugaauuaccccaucuguccuacuggcaccuuuaaacuuagcaucuucagugcagagcucaucuucuccccuccugagaauucuuccuuuacacugcgucucuucuggugaauacaccuuuguccccuuccgccaucucauuucuucucaucugcccaaaucuuagcaauuucuguaauacucucugauaucaucucuuuuauucuaguucuucugcucccugggcuaagucuuccauaggacaauggcuuucaaacugugcuucucagcccugcaguaugcaucaccugggaacuuguuggaaauccaaauuauccaaucccacccucgaucucuauaauccgaaacucuaggggaggagguguugaggggagggcagcaaucuguuugaacaaagcucuccaggugacagugauguuccuaaaguuugggaaccgcugaaguagacaguggaaguagcuuccuuccccagucuccgugacgggcccacuuggcucuacaccacgaugucagcuuuuucuucgaaaagaacagcccugaugugaugccucuucucaucacacgcccucuguggcucccgcauuggccacgaugggacagaugugaguucguauuguccaggagugaauucaggccagaacuuuugcacuuauuuccacuuuucggggcuaacccagaauugcuuuuuaaauguacauuauaucccuuuguaaagaugugucucauuuuuugcaguccaugugccaaaaguuuauguguauuuuuuuggcggggggacagaggggcgaggaggguaauaggaccuucuuuucaguaaacucuuuuuuuugagaccgggucuugcucugucacccaggcuggaguacaguagugcgaucucggcucacugcaagcuccgccucccggguucacgccauucuccugccuuggccucccgaguagcugggauuacaggugccugccaucaugcccagcuaauuuuuuuuuuuuuuguauuuuuaauagagacgggguuucaccguguuagcuaggauggucucgaucuccugaccuuaugaucugcccgccucggccucccaaagugcugggauuacaggagugagccaccgugcccgguccagugagcucuuuuaaaugucuuaggagaaagcauugauaaaaguagcuuuuguuugauaggcugcaucuucuggguaauccggggugaauugccuccaucccagacccuuuucagguggaggaggcugggguuaacugauuucuaaggcuauuuccagcuuggauauucuagggugagauggguguugacucucauuuaucuguuuuaaaggguuaaauuuuuuuuuauuguuuuuuuaaaaaaugaguuaagaugagaacuauuguaggccaaugauaacaggcuccaauuccugaaaccuguagcuguucccugauuuggaaauaggaaaagacccuuuguggaugugguuaaguuaaggauccugagaugagagaagcauggauuguccagguggguacuaaaggcaaucacaugucuccuuauaagagggaggcaaggccggguugauggcucucgccuguaaucucagcauuuggggaggccgaggcgggcggaucacaacgucaggaguuugagaccagccuggccaagauggugaaauucuaucucuacuaaaaauacaaaaauuagccgggugcggugguggaugccuguaaucccagcuacucaggaggcugagguaggagaacugcuugaacccaggaggcggagguugcagcgagccgagauugcgccauugugcuccagccugugcgacagagcgagacuccaucuuaaaaaaaaaaaaaaaagguaugcaaagggagauugaacacauaggagaaggcagugugacccugaggguagagacugcagucaugcagccacaggucaaggaaugcuggcacuuaucagaagcugcaagagucgaguaauagauguguuuucccuggagucccuggagggagcacagcccugcagcaccuugauuuuggacuucuggcuuccaaacuugugagagaguuauguuucuguuguuuuaagccaccguuugugcuauagcagacguggaauuuuaccacuauauuaaaaaaagacagaagugaacacuccuguguugaaaugugaucuggacagcgggucucucuguccuuggcauugagguuccuggcaggauguaugucuucagcacugcccuccccagcucugugcucuuacucaagaguggcaguuucugucucccagccuugucccuccauuauaacgccuucccacauccacaccugcuguuuuguuuuauuaauugcagcuggggaauguagcagcuuccagucucuguuggagucaggauugauggguagugggaaaaagccacagugggcuucguucccucucucugucaccaucugauaugguuuugcuguggccccacccaaaucucaccuugaauuguaguucguguaaucgccagugucaugggagggacacagugggagguaauugaaucaagggagcaguuacccguaugcuguuguccuuguguuaguggugacagugagugaguucucacgagaucugauaguuuuagaaggggcuuucccuccuuuuggucagcguuucuccuugcugccaccaugugaagaaggacauguuugcuuccccuuccaucaugaucguaaguuuccugaggccuccccagccacccugaacuaugagucaauuaaaccucuuuccuuuauaauuacccagucucggguaugucuuuauuagcaauuacccagucucggguaugucuuuuauuauaauuuauaaauuacccagucucggguaugucuuuauuagcagugugagaacagacuaauaccccaucccauauuuggggacuggauaaauauccguauucugaaaugaacaaacuguucucuggaacauuccuuuacaaaggauuuccuucauaaugcaaagucauuuggggcuccuccauagugcuuuguaguagaagccagcauucucugcagagcaaacugggggaauugucugagaagcucagucuuuaaguugcucaucgacugaucaacugcuggaaugacaaaucauagcauuuuaagacuggucccuggagaugaccaaauucacuucccucaucuugcaaauaagaaaacaaagacccaaaguguuccugggaugagcuguaguagaacauagcauuauacuuggcccuugcugaccaccugugucugucccuucuuccccaaaacugugcaaaaauauguugcuggacaauagcuguuauuauauucaguguuauaaacugacauuuauugaagccauaucguguaccaguacuucucuugacacuuuucuuguauuaagucauuucauuuucauuauaguccuaugaguuacaugcuacuauuauuagaaaauguuuggacuuuauaauuggucauauuuuuaaauucuggagucaccauuuugugguuaaauauaaaccucguguguagagugggggucaugugguuccagcacagguccucaaugaaugucuacaggugaaaggaauaacaugaaugaguguguaagugauaugguuuggcucuguguccccacccaaaucucuugucaaauuguaauccccauguguuggaggaggggcuuggagggaggugauugaaucauggggguggacuucccccuugcuguucucgugauaaugaaugaguucucacaagaucugauuguuuaaaaguguauagcauuuccccuuuugcucucucuuucuccuuccaccaugugaaggcaugcuugcuuccccuuugccuucugccaugauuguaaguuuccugaggcuucccagccaugcuuccuguacagcuugcagaacugagagucaguuaaaccucuucugcuuauaaauuacccagucucagguaguucuuaauagcagugugagacuggacuaauauaguaaaucauggacuuggggaaauacauauaaugaagaaauguuggucaauaaaauguuagcaaaacucaaucgggcauguggcaucaaccuuuugggucuaucauuuucucaucuguaaaaugaggauaaugauaucagccuuaaaggauuguucuaaggaugugaugggauaauaauauaaguacuuaccaugauggcuugaaguuacugagcacucagcuaauggcaauaauuacuauuaacugguagacacuuaacagggcaaaugaggaaugaaccaucacugggcugugggguggugcucucggguaacugugaagcccuguaucgagacgugcccuuuaaacaggacagcauggaggaaugaacugcagaugacucaguucgaacaaagauauccugaccccaaagggcagcagaaagagcucucuccauaaaugggccuagcuggaaaauuccucacuaucuauggggaaggcacaaugggcaggagaagucauuggcugugugcagaugcaucugucuacagucacacuguguauagggaugagucauugcuguguccucagaugcggagggcaaggacagggacaaaucaugucgucggaccuaucugaggggugcgugaggcuguguucuggaaguguggcuggaccucauuuccuuuuccaguuacaaguuccauguaaacuuagauaagcuauuguaauuauuuuuuacuuccugauagauagcaagaugguuaacugagaugaauauuuauugaccucuacucuguaccaggcacuguaucagauucugggaagacaggaugaaaacauaaggcuucuguccuugggcagcuuauuacacaggcaaggaagccagcauuaacagguguaccaugaugcugugaaagcauuuauacauguguacauacacacacacagacacacagccuuugggcagccaagguaugugcuauggucuguguugaagcucaugaauuuuucucaugggaagaccucuagacuguugagucaugacuuguuauucuuuuuuaauacaucauuuauauuugucaggauggauuagguugugcuauuuauauggacaaccccgauaucucugugugguugaaauaacaaagauuuauuucuugugcaacacauucaucugugguagguguauaggugggguguuuuauucuuccccagguaacuuauacccugggaugcugguguuuccacuagcuggagugucauagaucacuguggccagaggaaauuggaacuugggggaucauguucuacuucuggcuuuugcuuacaguucauuggccaaagcaaguuacauggccacugcucacuuccaggcgcugaggaagaucauuccuacgugugacuggaaggauagaaaccagaggauuucugauagccuuaacgacuuccccuuuguucugaccagcuuuuuacauuuacauuucuuucuuuuaauucauauuacuuuuuugagauggagccuuauucugucacccaggcuggaaugcaguggcgugaucucggcucacugcaaccuccgccuccugggcucaagucauucucuugccucagccucccgaguagcugggauuacagacgucugccaccaccccggcuaaugguuguauuuuuaguagagauggggcuucaccauguuggccaggcuggucucgaacuccugaccucagguuaucuuccugccucagcuucccaaaguacugggauuacagguaugagccacugcacuuugcauuucuaagcucuuacugugccugggcuacauuugcauuucuaagcuaugggagaucagcacaacagugcauuugaaaggggaacuucagaugccggccagaaaccugagcaagaagugacaaucugaccucuaagagaaguauaggaaagcccugccuaccagcuauaagaacucaaacuggggcagaauggaaccauggcauaggguagggcugauuguccagacauguuuguagcucccaagggcacacauagugcuguuggcagcuuagugagauuuaaugcuacauagugccuauaccaggcaucaggccaagguugggaauacauaauuaaccgggaucauuaagaaaaauuuagaauauauuuauuauagauuacaagaucagggaaguaucuuuucacuuaguuaaaacuaaauauacccgcaauagaaacagcucuuuaaaaaaaaaaaaaaaaaaccuaaaaaagucacuuaaacggaaccugagugauugggacaucacuguuuauaguuuuccauuuccuucacaugaaguuuuuaaugcacuugggcaggcuuuucagucuaauuccucuguuccuauuuuuuucuuauccaucauaaugauuguugaagauuuccaauaauguauugaaaauugaacuccuuugauagcauauacacacauguauguauacaugcacacaccuuucugcugggaaaaauauggacuucaguggucaaagggagucauugauuggggcuaaggaggguacaagucaucauuggagcagacuugccuguuaccuccacucuguuccccuucucggcaugcucuuagacgcucuuuacgcaggcugguggagagaaaucuuucuaaauaccuuuggcucacuuucuuggacauccuuaccaucucauuagucagacaaacauuugucagacgugguuuauaucuguaaggcaugguggggaaagaaugagaaguguaagucauggccucugcacucuaggaguuuaucauuucaggauggggagguaaacuaguguuugcuugcugugugucaggcacuguuccaagcuuuuuuuuuggcugcaccaucuccuuugacccuacaguagcccucaguagcugccauuuuuuucuaacuucguaacgaugaagacaucgagacuuggagaagauaaccaacaucgucugugcuuaggaagugacagcauuugugggugaagcugggauucuccuaaugcccucucugccuuugucacaacaucugccagccaugaagcaauuagagauucuuaaacuggaggagaaucuugggaggacagagauauuuguuuguucucuucaccacuguaucccuggugacuaaagagaagucugcaauagauacgguggugauuaaggaagauuccugcccucaaggagcuugcaguccaggguugugaaacugacgaguaaauguauuguguuggugcagggugucagcuacccuggaacagagagccaugugggaggcagaagaggggguggugcacuuagcccaggaggagccucuggagguugguuagacagcaugugucuccugagcagcagcagggacaaggacuagaagaaaagggcaaguguggauauagcaagccugguucaggugccacgaugaaugagaagguggugaaucaaaugguagcauugggguagagaggaaguauagggccuggcaauauaauugcugugugauuaauauuuuucuucuuuauuuuauccuauaguauuuagcuccaacacuuuaaaaugagaggcuguggaugguggcucaagccuauaauccuagcacuucgggaggcugaggcgggaggauugcuugaggccagaaguucuagaccacuuugggcagcaccacgagacccccaucucaucucuacuuaaaauaaaaaauuagccgggcaugguggcaugcgcuuguagucccagguacucaggaggcuaaggugggaggaucuguugagcccccgaguuugaggcuauagcgagcuaggauugugccacuacccuccagccugggugacaaagugagacccugucucuaaaaaaauuaauaaacauaaaaugagaauagaaguuauggcaauaugcuaugggagaaaauaaagggaagaaaaauuaaaaacaucuauugucaggccuuaugucagaucuuauaugggggguuuugcaaauuuucauuauuuaaucagcauaacuauuccuuuaggcaggaagaaugguacauuaguuaaagcaggcugaauggacccccaaauucauaaugacccgggauguuuauuuugcacucacagaaugaguaacuauguggggugagugaaagcaggggaggugucucugcuccacacagugacccuggccuaaggaaacacccuggaccauccacaugcaagcucuagacacugauguccagccagcagagggcauuaccugcggguagggcccacaucacgcugcacauguccuacuggcuaggacuuggucacauggucacaccucacuguauagaggcuaggaagugucucauccugugcccaggcuuuggugaacagcuagcuguccacaaauggcccagaguauaggagaagaaacugaguuucuuagaaacacacaaauuuccuuaggguuacagagauuuuuuauggaguaggcaagguucagauucagggcagucuuucaccccaugggaaaguggaaagggugguugaggagguggggauuaaaugagguggauuuagugggauuagguaauuaauaaagguaacuuaauuauuugaagucaaggcaguugacuucaacccuuagaugaugucaagggcuggagcuggugcuaaggaggcucgguggggagguuuguugguaucagggaaauuaaggauuuggugaaacagccuguggauggauagccacaggccugcuggaguugcccuggauggugacguaguuggcaaggggagaaaaaccugagauuguuagaggacagcagagggauagagcuugugaccagaaggucugaacuuuaaaaaugucauccagagcauucauauguguggaauagcucauuuuucagcucugccaugaacuuuguagaauauuagcgcaaugaagagcuuuguacucacacaccacugggagaagacauaaugagauaugaugaugggacugacaaaaguuggcuguugugauccauacuuuuggaucccaaagcccccaggagcccgugugaacucugaagugguuugacaucugggacugggcugcuggugacgucacuccauccaguccuccucaaacugguggccuuugaaguuguuuuugagcaugaugauaaaucagccaucaguugguauuuauugagcacauaccaugugcccaaguaauuaggcacccguuucugggauggugcugggaaauaggaaugcgguguagccugcagcccuaaucagaaucuaguuguggagagacuaauagaacuuucagcccacccaagggagaccacaguguacagacuuccugaaggugggggaaguccuggacucuugcccugcugaguucuuacccugccaauuugccucgaaaaagccacugggcucccugguccuugggugucuaaaguguuuaacaaccaacaaaaaucacaggcaaaucugcuuuguuuucauuguucgguagguauuugcuguguaucauuucuucugguccaugaagcacagcagggcaggauacagagaggcugcccucaagaagcagaaggaacaauuuuaauuuauucaggagggaaaaguuaggcuuuuacaggcuaucaacaaauacugauugggaaccucccuuuuucuagggcucuucucagggccacagucccccuucuuucucucaggucaguuacaagcuggugcagcugcugaaugaacuuccuccccuccucuuuucucccucuuauucuuccuuccuuccccuguccuauauuuauucagaaaauauucauugaacaccuacaauuuaucaggcucuggaaagacaucccugagugaguugauaggguuccuguccuuguagaguguauguucuccuugcagcgacagacuacaaacaaacuauaagcaaauacgaugauuucggauuuuaacccaugcccugaaucaacugaagacagcaggguuugguaagugacuugagggggcacagcuggaugggaaggugugagucucaagaagcccuaugagaaggagcuaccauguggcuggaggaccagugccuaauccaaggguggagacaugaaccauccccauuuuuacaggagagaaacuaaagcauagaaccuguccaagguuaaauuaguuguggaucuggggucugaaccuaggucaucugccuguaaaggcccuuccuccacagugugaagcugccugcaccaccaugcuacccuguucuuccuuccucuccucccccuuuccucccucuccucccccuuuccucccuccuucagcuucuccaucuaucaugaguggauaaugauuuuguccuaccuuaccgcugacccccuugauaauauugaccuagcggggaaguuguaaggcauaacuaauaaaaaugacaaugaagcauuugccaacagaagguguacuacugaaugcuaauaucggugagagccugucugugaugcuagggcagauuuauuagacagcuguuuagccagcaugaguuucccugcccccaacuucaccaggcagcugaguccaguucgagcagcucugugcucuagacuuuugcuguuaccucucuguggucccuucuuaucuggaugugcaacaacccaaacacucuuuucugcaguggauugggcuuggcugucaggagaacaauggauagcgugcuggguaugcagccaugaagguuguggggucugccccacggguccccugcgaaagagagagagagagaaacacaaacgagugaucugucuauggcuguaaaaugggguggcaguacugacucccucauagagcuauuucaagcauuaaaugaauuuauauauaugcaaagggcuuagaaaguaucuaauagacaagugcuuuaaauaccucuaaguggaggugucaguaccugcaagucuacugauauuugacuuugaaaaugugugccuucaaaggggcuagaugggagacaaggcuguuggcaagcaccagguugugaagaaacuugugugccuggcagaggcgaaccauagggaaacugccgagccuccaguguauauauuugauuguauguauauguguaugcauguauguaugucuauauacguauacacauguguguauguauagaaacacauauauacacauauaaauguauauguguguguuuguauauacaugcaccccuccaccccgacuucccagggucuuagcuguaggggcagauuguggugggugaggucagguugaggagaaugacuugagugagagaggcacuuagaggagguuggcagugcguuagacucacuuuuccuggagagcauccuggaauuugaaaugauugagaaugaacacugcguugugaaaaggauauuaauuuugguggccagauaugccugaauuugaaucuuggccccaaaaacauugucugucuguaucugucuuucuguaucugucugucugucugucugucugucugucugucugucugucugucuaucuaucuaucuauccauccauccgugcauccgucugucuguauguccacccgcccucccgccugccugccugcuauggucugaauguuuacacccccucagaauuuguaugcugaaaucuaaccugcugugugaggguauuaggagcugggccuuugagcagugaggucuugaggguggagccuacaugagugggauuagugcccuuaaaaauagacacaagggagccuuucaccaugugaggacguagcaagaagacggccaucugugaacagaaagcagacucucaccagacacugaaucugcuguugucuugaccuuggacuucccagccucuagaacuauaagaaauaaaugccuguuguuuauaagcuaccuagucgguggcauuuuguuuuaacaacuugaacaaauuaagagucugccuaccuaccuggaagccagacugcuuauggaggaugaaaccaagcaugaaaauccagaugcuguccugcccuguucauggaugaauuuuugcucuucauuucuucgcccgcagcccacagagguugcucgcugagucaggccuggaguucccaucacucuuagaccuuuuuuauuuguaaaaacagugugggcaucagaacaccaggccaugucuuuguuugcuuauuuaaugacaacauugaaugcgaaagaggaaaaguuuggagauaauuggacucaggaggguugccuguguuuuuggaggugaugaacaguugauagucucauaaguaguacuuaugaugaucugcaaaugguucagcagcugaaucucuuacuuccacggcaccucuccucgugauuuuacucuccccacaaacccuuucugguucucugcagaugcaugagacugcacacucacagggcucugcugagccgucugcauggaugugaauacauacaugccuuccggugugguucacagaaagacagaguucagauccuugcuacaauucucugcugagaacucauggccaggcagucucuucccugaaguggcaagcccaggugugugagucccugggcuggguugauagacagauguuugcacuuugcacacuaucagauuacuaagaaugguucuuggcugaagaguccuuucugguuguagaagccaccaucaaaagccagucccucaaccacuuauuuuaaaacagaugaaggcaacccagugcuuuuucucugauggcacauucuccccgcaugaggaaaggaacauaauuggaaaaugggcaauauucacagaacaauuacugugccucuuaaugagguuugcaugaaggcuuccagugaauuaaugaagagcaaugauuuugccauucacguugaacagcuggacaacaaugauaagggugcagacugugaggucucuggcuuagacgaggugaugaggaccggaggaaguucuagcuucugcccuucuucaguucuccuuuggucucacuacuguccugggagaaacugaacgugcuaggcugccagacugugccgccccaacaaaaagugagaagaaccaguuuggcugggcugugggcuugcaucuuccuuggacuguuuuucuagauauauucaguggcagaucauuaaaucuccuccuuuacugggcuauucuuauuaggaauuauggugacuuuuggagggcagugugucuugcggaaagcagcauaccauguugaguugaagauaugagucuaaauuauggccuugucguuuaaugucuguguguuccuugcacauguuguuucgcugcaggcagggagcugcaguuucuucacuugaacaaaaggcgaucauacuuacauaggugaccuguugugaguaucaaauagccuguaugaaauuacauuaugcauauguuaguaucagucaggguucuccagagaaaugacccaauaggaugguguaguuguauaaacacacacacacacacacacacacacauauaccuugauuuuaaggaauuagcuuaugugaucguagggcuaaguccaaaguuguggguagguuacacuggcaggcuggacucuugggcagaaaaugaagcugugguccugaggcagaggcagaauuucucuuccaggaaaacucaguuuuuccucuuaaggccuucagcugauuagaugaggcccaucaauacaauugaggauagacucuuuuacuuaaagucaacugauuguagauauuaaccacaucuacaaaauaacuaccagagcaccuggacaguguuugauuaaguaacuggggaccauagccuagccaaguugaaacauaaaacuaaccaucacagucauuauuauuguuacugauaugucaggaaccaaaguauuugacccuguugggcccuauuggggacuguuggaaaagcaucauuugcuugccugacaugugcucagugucuuagcuuuagggauagauuuucaggggcgaggucagguugaagagaaugauuugagugauagaggcacuuagaagagguugacaguccaucugacuagccuuucuuggagagcauucuggaauuugaaauggucgaacaagagugaauacuaugucauggaaaggauauuaauuuuggagacgagauaugauuuacacucuuggccucagcaugucuuucuucccccaucgagauacguaaguuaacuucagugaugcuuuuuaaaguuuuuucucuaaacaggaaaaauuaauauuuacguuuuaggcuuguugcaagaguguggaguaucucuggcaugauuuaaacacucaguaaauaauuguuucccuccuugcauguuuguucaguguucauugaguuguucuaaugugacguuuguucuuauguggagauuuuccuauaagguauuuaaggcugaaguugggagcaucguagaaugcaagaguuugggaaaaacuggagauaccagucaagauggagaaaaggauggaguucaaggguaccugggcuuccugucuucacugugaagauggauuucaccaugagaucuuuacuaggcagaaaagauggaacauccugcaguaguguuuugucaucgagcccacagccgaggccgaacagaagcuguauguuguuccucaaugguuguguccaaaugggaaugaguaagacuucaacauuucugaagauggauggucaccauucucaauucuguuuuauguaucuggugggccguugagcagaagagaucccagaugucagacacaucuguccuccaccaagaugugugugugggacauugcuggaacuauguuuuguuucuggucuuguggcauuugacuaucggagaugaacaaaagagcauacaauccugauuuauuuccacaagcuucucaggacuagggcuugacagucuugccuggggaagcuuguugauucuuagaguggcacuaauuuuuuuuuuuuuuuuucuugagacggaguuuugcucuuguugcccaggcuggagugauggcacgaucuuguaucuuuacuagagacgggauuuugccauguuggccaggcuagucucgagcuccugaccucagaugauccaccugccuugaccucccaaaggaguugggauuacaggggugagccacugcgcccggccuagaguggcacuucuuaaugcaguagauguacuucauaccaccauuuaaaccaauacuaagagaauagucuguauucauaugccaauuugguaccaccuaauaggagaaaaccagaaagcaaacagugcuaguugcauuaauuaucucuguuuuauuugucuuuuaauaucuuugucuccuugaggaggcuauggacuucuugaaggacagacaguuuucaucucugugcuucauugucuagcacagggccuggcguguugucagggcauaguaccuguguguugaaugagcaaauaaacugugaagaaacuucuugaucuuuguuggccuggacagcuguugaggcuugacugugcuuauggaaugaaauauccacacaaagggaaacuugguaauagcccagaaccccaaggggaucauugcagagggacugauagauggacaggauggccuggugaggccugcgccaucugugccuucaacccggcggaucaaagaugaaugugugauugagugaggccucacugaugacaaugcacccuggcuggaaaaugcacagcaggaggcucugguuugaaucucaguuuuccuaggagaccugaaugaagagaaaaggcaccgcaguaugcaaagagagagucaucacuugugcaugugucugggggaaguaacgaauagaagacauuacaugucaaaaagagccucguccaaaaugaagccaagugacugucacaaguucugggcaggugagaugcugugucagaaccgugagaaggcaggggaggccaggcacaauucccaauauguuuuagagcauaccuggagcuuagcauagcccuaacuucaugguccagcccuuuggggcaugugcuccuggaaccuuagcuauuaagugcccuugagugggaaaauaaaugaguuuuuaaugucuguguguacauguuguuaaucguuuucugcauuugccaccuggguugaaccugucaaauuaguuuccaguagucccuuuuaaugcauuguuauauacccaagguggaaaucucagucauccuuagagacuuucuguagccaauuuccccuuuccuuguuccucucuuacuuaggucaugcaauugagcgcuaagcccgggucagcccauuuccuguguucuggucuuuuucuuuccauuugucacaguucugggcugggcucccauuaucccuggccugaaguauuucacuagcugaugcuccggccuccuccuuccugugucuccuaauccaucauucuuauacugccagaaugacuuuucuaaggcucagagcagcucaugacauucccugcuagagccucuuugauuacuucuucuugccucuagaaaaaguuugaacaauuuaccgugacguaauaaagcuguucccaguugggcucuggccuucuuuccuggucuugggccccaccucuauauaccaaaucaugauuuuaccacuuccuaaauacagcaugcucuuccacguugcgaauauuugggaaaucuuuuuuuccuuggaaagcuguuaacuuuuucucccugucagacuccuaguaauccuucaagacucagguuuuguugguugaacugaagcucaugcaaaugaucacuuaagaggugcugagauuggcauacuucuccagagugccuggcuuuaguguaguggaaauucucuucagccacgagcgucccacaagggagccuaguuuguucaugucuuuacuugcucugcuaaauuauguuuuauuaaugugugugcuuguacuguugcucaggcuacugugcuaaugacugauaauugccuuaaugagcuauuuguaagaaauacaguaauaccaguagggaugaaaccagaccccaccacagcugguggucuaauagccuuuugacugacuuuauggaggagcagacugcaggguuauugcaguuaacauaagcaagagcucagaaucacccacuuuucccugaacacccaauuuacccaucuuccacucacgcauuaaucauguuuauaugagucgggggcagguuagguuaugcugcaguaacaaaucucgcauagaacaaaaaaaucacuuugggaagccgaggcggguagaucacaaggucaggagaucgagaucauccuggccaacauggugaaaccccgucuguacuaaaaauacaaaaauuagcuaggcacgguggcgcacaccuguagucccagcuacuugggagacugaggcagggaaauugcuugaacccgggaggcggaaguugcagugauccaagaucgcaccauugcaguccagccugggcaacagagcaagacuccaucucaaaaaaaaaaaaaagaaauucaucccucacccuguacuacaaguccaucacaggcuacucauggcacugcugcaugcugucuucacucugggauccugauagugaggcagucucuaucaguacucuugcuaguccuuaagauagagagaaaagggcgcauaaugguucuuaaagcuugcagugaguugcaugcauucguauuucauuggccagaguaggucccauggcuguucuggggcagagaaguucuaccuugaugugcucagagcugaagagcugauauuugugaacaauaugagaaccaccacaccaugguagaaucuuggauucaugugccuuauguaauuugcuucuggggagucaagagggagauuuuguugccuucagcggagguccagagaguacugugggaccaagaguaucgggcuauggcuuuggguucagccaguccuugguucagauccugaccagcacuugcuagcuauaugaucuuggucaguguaaacucucucaaccaauuucuuuaccugcaaacgugaaaacagcaauaccuauuuuauaggauuguuacauauuccaugagauaauggguugaaaaguuuuauaauuuugucauaauaaauguuaguucucuucccaucccccaugcugugucuuguucagagugagagaucuggugucuguugcaugcagacuacuguaguuuuuuuucugugcucuccugggugguagcaacacccgccuauaacuacaagugcuugaaauguggcuaguaccacugaggaacugaacugcaaauuguaaaaucuuuauuacaucuaaaaagugaagcaguguaaaguuuuuuuguuuuuuuuuuuaacacaagcuucugguuuuggagguacuauuucacuucagucauugaaaauuuagcaccccaauugagauguacuuaaguguaaaauaugcaucugaucuugaauauuuaguauggaaaacuauaaaauaucucauugguuauuuuuauauugaugauauguugaaauaauauuuucauacauuggaggaaauaagguauauuauuuaaauuaguuucaccuguuagcucuuuuuaaaauguggcugcuagaaaaugaaaaacuauacauguggcuaacuagcauuauauaauauuuccauuggaaagugcugguuuagacaugcagaaugugaggcccacaccucucuggaaauucagacuauucauccaucuguccuugcaucuaauaauacauauuuauugacaacuuccuaugugcuaugcacagguguugugcuaagcuuuugggaaccagugcuggucaaaacaggcauauucucugagcucacugcuuauugagggcauggaacauauaguuguguauguucauaaguauaaaugguagcuccaucuagaaaagugcaggaggcuagggaaauacaucacacaggaccugauuuuuuuuuuuuugagauggagucucacucugucaccaggcuggugugcaguggcgcaaucucggcucaccgcagccucugccuccuggguucaagcaguucucuugccugagccuccugaguagcugggauuacaggcacccacuaccacgcccagcuaauuuuuguacuuuuaguagagaugggguuucuccauguuggccaggcuggucuugaacuccugaccucgggugauccgcccaccuuggccucccaaagugcugggauuacaggugugagccacugugccuggcaggaccugagcuuuuuaauacauggggugggugggcgggguuagggaaggauguacugaguuucugaauaaggagagaagaauggaugaagaugggucugggauuugagacccaccagacaguguuaagagcuugugcccagguucugaggcugagggggaaauagguuuaauggugcuacugggucugucuucaacuacugcuuuggaaguucacaaacaguucaugggaaaaugcgaagaggauagacuuugcaugaaacacugguuccuuuugcuacauccucaaagaagugcaacuccaguguacucgucacugugaaauugauccggcucacaugugggguggugagcauugucagggcaggggaauacggggcuuuauucuucuuuacgaucccagcgucgugcagggugccuugugcuuuguaaacauuccauaaauacuguuugauuucauuugcauauuacuggagaagacuuacuaucuggauuucccccaaccuauuugugccaagcaccuuggugguaggggcagggaggggcugcuuuuguguucuugcugagucucagcacucuggcaaggcuucaucuuucuuuucuccccauaaggaguuggaugaacauaacaagaagagaacagccuaauuuaaaaaguggaucaaagacuuuaacagauaccuccccaaagaaaauaugcagauggcagauaagcacaugaaaagaugcuccaugucguuugucaucagggaaaugcaaauaaaacaacagugacguacugcuacacacuuauuagaauggccaaaaccuggaacacuggcaccaccaaaugcugaugaggauguggagcaacaggaacucucauuuguugcugucagaaugcaaaaugguauagccacuuuggaagacaguuuggcaauuucauaugcaacuaaacauacuuuuaccauacaacccagaaucucacaacuugguauuuacccaaaggagcugaaaacuuacguccacacagaaaccuucacauagguguuuaaagcaacuuuauucaugauugccaaaacuuggaagcagcuaagguguccuuaaguaggugaauggauaaauaaaccauagcacauccaggcaauggaauauuauucagcgccgaaaagaaaugagccaucaagccaugaaaagacauggaagaaauuuaaauacauaugacuaaaugaaagaagccaauuugaaaaggcuacuuacuguuuuccaacugugacauucuagaaaaggcaaaacucuggagauaguaaaaagaucagugguugccagggguugggaagaggaaaggaugaaucagcagagcucagacuauuuuuagcgcaguaaaacuacucuguaugauauguguaauuacauauuccucaaaaccaauaagauauuuaucaaaaaugaacugucauguaaacaguggacuuuaggcgauaaugauguaucaauguaggcucaccaguuguaagaaacuuaccacucugaugggguauguugagauugggggaagcugugcauaggugggagcaggagguauaugggaaaucucucuauaccuuccuaucuugcugugauccuaaaaaauaaagucuauuuuuaaaaaacuaaagaccugguuacgaaagugaaugcuuauugaacaccuacuacaugcugguuccuaauaauuaaucguguagauuaauuuauuuaaucccaaacaguccugugaggcggguaacaugacuguccuccugauugugcagauaaugaaacugagcacagagaaguuaagaaauuaacucagggucacauagcuuggaggugggagagcugggauuugcauacagacacacugucucuagggcuuugcuuuuaaugacuuguugccuuaccugcugcaaacaaacugccuauccagcugucuuuguggaaguugcaugguuugaaauugcaaggaagaggauuuuuuuuuuugagacggagucucacugugucgcccggcuggagugcaauggugagaucucagcucgcugcaaccuccgccuaccagguucaagcgauucuccugccucagccuccagagcagcugggacuacaggcacgugacaccaugcccagcuaauuuuuguauuuuuacuagagauggguuuucaccuuguuggccaggauggucucgaucucuugaccucgugauccgccugccucggccucccaaagcgcugagauuacaggcaugagccaucacgcccggccaaggaagaggauuugaagucagcucugagucuuauuaucuuccuccgaguagcacagcuggcaucauugcaucacugagagccuucuaagcccuggacacggcucuggguacccagauucaaagauggauuagcucuugccccguuuucaaggagcuuauaguugaggagaugucacauugcagguaauuucaauguaaugauacagccauguucucagaaaguguucaaggaacuguuuguccucuugauguaugugauuaugucaagaguuguuccugcagaagauccuguaaacacuggggcuggaaaaugugccaggcuuauuggugagacucuaggcugcccuggaggccagacuuuuggacugcagcuugcucacgugugucccuagcuccauuugcuucagcuacccacuucugguuuugguuucgguaucugaugcucccaacaccucacaugaagcuugcaaaacuguugccauaaacuuaauuucuagcaaagggcagagaaagaagucagauacaagagaucacauauuguuugaucccauucauaagauauauccagaguggguaaauuuauggagacagaacauauauugguuauuaccaggggcugggagggagggagaaagggcagaagcugccugaugggugugggguuuuguuuuggaguucauggaaaaguuuuggaauuagauugagguggugguugcacagcauugugaaugcacuaaauaaaugccucuggguuguuuaaaauagcucauuuuauuuuaugugaaugucagcuuaauaaauuucaaaaaauaauaaucauaaaauguagcaaggggagaggcauuagacaaaguucauagugacagugaacauuguuugaauggaagaaaacaauuggaagagaagaaauaggacauguuagguauaaugaugguuguuauuuuauuuauuuauuuauuuauuuauucauuuauuuacuuauuuauuuauuuuuugagacagagucuugcucugucgcccaggcuggagugcaguggugugaucugggcucauggcaaccucugccucccggguucaaggaauucuccugccucagccuccccaguagcugggauuacagacaccugccaucaugcccagcuaauuuuuuguauuuuugcagagauaggguuucaccauguuggccaggcuggucucaaacuccugaccucaggugauccgcccgccugagucucccaaagugcugggauuacaggcgugagccaccgugcccgaccaggguugagucuuuacucugaaugaaguugggagccauuggagugguuggggcagaggaaagagauuccuuggcuugcuuuucuaaaagaucucuuugguuacugacuugagcagagcuugcagacaaggauagaggaagggagaucaguuaggaaacuaggacaguuguuucauucaagcaggagaugcugguggcuuagaccaaguguaguggccaaaguguugggauauaguccaaauccaggugugucuuuaagguauauucagcaggauuuucugagauauuggauaugagacuaacagaggaagaagagucaagggugugucuaguuuuuuauuugagcaccuaaaggaacgaaguugguggaguucgggagcuguccauauauucuaacugggaagauugcaagagaaacaagcuugggagagaacauuaggaguucaguuucagucuuauugaaugaguggugcuuuuucgauauauccaagugaauauauugggccagacagugggauaugagccaggaguucuggaacaagguuagggugggagauacagauuggagguugcuggccuuugcaggccauugaaagccgugaaccugacugggaucagcuagaaaaugcaugaugguagagaagaggaggcugaacuugacugcacucucugcaugcucuggaaaaauaaaaccuggguugcacuggggacauugggggcuaguucagucauuuuuuagagcugggguuuuguuguuguuuuuguuuaagccaggcacuuuagucuuaacuuucagggaaaaucaaaguagguuguucaagguacccaaaacacacagauaugcagcuggcuuucugcaaaguguucaugugaagaggugccaggugugugccugguaaguguguguuuuacugagcagcagggagcugaacuguggaucucuugcagccucccuuuugauaugugcgucucaagcagucaaccugcaaauugcuuuguauucagaaggugccaaauacauguucauggaaugaauggauaaaugguccuugcccuuugugccugaagaccaugguagaaaggugcaguuuauuauuuuauuguugacuucugguuugaaccaaagagguuuuugcauauacguuggcuauuagagaucaagucugcguucaauguuggagauuuauuauauuuuggauagauagagggcucuaaaggcaauucccagagaaauccaaaacuauugucaacaaaggcagcauuaguggaaucacugacuaacuucccaaaaaguuauguuaagcaggccuuucuaaggauggcagucaggauugcuauguucucuucuguauagggaggagaguacaggauggcagccaggauugcuguguuaauucucuucuguauaaacaagagaguacagaagacaguuaacauaacaauccugacugccauccuucaacaggccugcuuacgagguuggcuuuggcuggcaucuggggacuuggauuuuaggaggguucccaucauucucagacccgauaagacugggucacugugcuuaaacuguugaugcaaacaauauaguuuauucugaacaucuguuuuccuucugggagucuacaauuuuggaugccugccuaaccaguccugggugaaaacccuaggcacggaaccucuaaugagcuucccucguaaacauguuuucacacguguggucacagcucauugcuggaggaauuaaguguguccugugugacucuacugggagagaacucuugaagcuugagccugguucccuccagacuuugccucauagaccuucuuccuuugcugguucuacucuauguccuuuugcugugaugagucauagccaugagaugcuguaagucauagccacaucuacaugcugagucuggcgaguccuccuagugaauuguugaaccucaccuccucugcauuuuugguuguugguguuguuaaacagccagucauaucaucuuacggagcuaugaauuccauuagcauuuacuggauuccagcuauguacaacauacuuguaaaacuccaguuugccuuagaaacugagucaaaccaccaaauguguccaggaguaacucguucccaagacauuuccagauaucaggcaauauggaagcuacagagaugaagucucugaagcucaauugagauaggaaauguaaguuguauagaaguuguauagaagcagaaccccuagaacauugagggaaaugagugcucuaccaauuccauaauguaauaguagcuuuuauuaagaggagggucaugaaugcugucuugggggaguuagagaagugacuuuaaggcauugguggacuuugcugguguugagaaagaauauuuugaucuuccuugguauccgucgucaucuuuuagcuuucauuuguguguugaucuauccacccaucuuccuguccauccaauugucugucuacccacucacccacccaucuaucuguccagccuugccaggcagcuuguuacauucaugagcuuugauuauguguuaggcuguguucaaggcacugaaguacuggggugaauugaguagggucccugcccucuugugcaaaggaaggauuugguugggugggagaugacuaaugaauccguacccuggugguauuguuuagggagagggagauagaccugggaauaaauauuuauuccuagauagaagugcacaauucuuucuagggauacacagguacacaugcccaauucaccuugguggguugaguggggagaggggcagggugacaaauaagaguuacuugucaccuuaccuacuguauaucuaagcauauuguccauacaaagagaucagugcaggagauguccugugucccugucuucauaaccagaacggggaagaaaaccuccuccugugaguuccccgaagguuaauuuaaaauauucuuuucauuuggcuuuaagauuacucagagccaucuuuaauacacaauuagggacauaaccauuccuaaagguagguggcagcugccuucauucaccugccagugauaaucaaaggaagacucccagccugucuagucuggaacauucagcagggccuaagagcucuucucuaagugaugaugggacugaagccaucucuguagugcuucccuugcuguucugagccauuugcagugggaauaagugcuuauggagucagcagcugugaguugggggaggcaaauuauuacuuuuauuuuuggcucugccuggggucagaauuucuuuuguuucugauuuaccuuuuauuugagaaacuuggcaugauaccuguguucagaggauucauuagucaucucccucucaaccaaaucauuccuuugcacaugugauuguuaaccccucuuuuuuuuuuuucuccagaguuaguuaucaggcauuuuuucagaggacuuucauaagguagucugaacaaaugaagauauuauuuucauuaguaaaaauaguaacagcaaacacuaggggugucagacaguguuuuaagugcguauauagcuuuacucuuuugauacaacuuaugaaguagaugccauaauuaucuucccuguguuacauaugaggaaacuagucacuggggaagcgggggguaucagguaauuuguccagguaccucuucugaucuuggauuuuaaaaggaguuggaacaccaaaagcacaauucguaaaacaaaauggaugaacuggaauuaaucacaguuuaaaauguggcuuuguaggagaaucuguuaagagggugaaaagagacgccacugacugggagaaauguguguaaaugacacauuugacagaggacucguauccugaauauauaaaaaucucuccagacucaacauuaaaaaccaaacaauccaauuagaaaaugggcaaaagacuuagacaugucaccaaggaaaauacacagaugggaaauaagcgcaugaaaagaugcucaacaacaucagggaaauauaaauuaagaccauaauuagcuaccauuacacaccuauuagaaugaauacgauaaaauuugcugacaauaucagaugcuggugagguugcagagaaacugugucuuuggugggaauguaauaugguaugaccaucugucaauuucuuaaaaaguuaaauauauaccauauguauuaguacauuuucaugcggcugauaaagacauaccugagacugggaagaaaaagaguuuuaauuggacuuacaguaccacaugucuggggaggccccagaaucauggugcgaggcaaaaggcacuucuuacauggcggcggcaagagagaaaugaggaagaagcaaaagcggaaaccccugauaaacacuucagaucuugugagacuuacucacuaucaugagaauagcaugggaaagacuggcccccaugacucauuuaccucccccgggucccucccacaacacaugggaauucugggagauaaaauucaaguugagauuuggguggggacacagccaaaccauaucaccguaugauccagaagucacacuuccagaaaaauggaaacuuguguuuauagaaauaccuauacacaaaucuuuuuaagaguuuuauuuguaauagcucaaaacuuauaaacuaccccaaaguccuuaacaggugaaugaaugaacaaaauguauauccuugcaguugaacacuacucagcgagaaaaaggaaugaacuugaugcgugcaauaacugagauggggcuaaaggcuauuacguugagugcaaaaagccagucucaaaagguuagagacuauaugguucuguuuguacaaccuucucccaaugacagaauuauagagcauaggaaaagaucagugguugccagggacuaggguggggugugaguauaaugggguagcauaauggaguuucuucaggaugauagaacaguucuguaucuugauugugauggugguugcacaaaucuguacaugugauaauauuucauagaacuacacacaaauacaaaaaagccugaauguaugcaagaacuaauaaaaucugaauaaggucuguggucuaauuaauuguaucuugcugauguuacuuucaugauuuugauaauuauaguuauauaaauuaucaccauugggaggaaacuggaugaaggguacacaggaccucucuguacuauuuuugcaacuucuugagagucuauaauuucaaaaugaaaauaacuguaaaguuaaaaaacacacagggagguagguauuuagcagucagagcuuuugauauaauccuugccugcaaggggcuuacuauuugauuggcaggguuugguguacucacauuaaacuuuuggaacggaaugagucaggggauagcaaaaagcuuagcuucaugucuuaaaugaagcuuagcuuagaugucuuaaaaauuaaagcaagccauaagugcgugggacagcgaggaucuucuucuucccuauuuccuggcuaaauagagcccaccacaugcacaugugagcacacauggucucagcaaauucuaguuccuacuucagauccuagcucuucuaugaccuuaucuauggagaggucuguauuuucauucuccccugaaccaacuauguccccauaccaauacacaaagucuucuuccuccauauuaccaaacucuccguuuucagucacucuugcuuuuguuugugagaauguuccuuauugaccgggcacgguggcucacuucuguaaucccagcacuuugggaggccgaggcgggcagauugccgagguuggaaguucgagaccagccugaccaacauggagaaaccccgucucuacuuaaaauuagccgggcgugguggugcaugccuguaaucccagcuaccugggcagcugaggcaggagaaucgcuugaacccaggagggggagguuguggugagccaagauugcaccacugcccuccagccugugcaacaagagcaaaacaacuucucaaaaaaaaaagaaguuucuuaucuguauauguuuacaaaaacagccaucccuuuuuguuaaggaguuaguuguagauuuguuuguccccaccacauggauuauggcuuuguuuucucagcagcagugccuggucauagcccggcuccagaaaugcugcuuaacugaucaaacagugggcagugguaugcccgucuccagaugcuuagucuaacuucacguggauaggcucgcauccuacccacgggauugcagguguuucuuuggcgugauacuccaccacugagaacauuuugcaagguaccaggcauaucucuggcucuccauccaugcauggaucaagcugcuaucaguaacuuccuggagaaaaagaaacuccaggaaucuggaggaauaauacuagauaaaauuguccaaauuauccaugcacaccagaagcucaaauugaauacuguagauggccaggguccacaguguuguuguuuuuaaugggaugcaguaguguuggguggaaagcugaaaugccugacuuuuaagguuccuuccaauucagaauuuuuaugguuuugcuguaggauguaugugcucgugcuccauuuuagagcagcacggaaagcccuccuggaggauuccuccggaugaaagauuuaggguggggucauggugucugcauuugcagccugugucauggacccaaugaagcuagugaggugccaguuuuucuuugugcauauucuuccagugugucaaggagcuuggggugcagggaccugaaugauuacaccauccucuucagaucauaucuuugaaaaacgugucaagguccuauguccgggguuuggagcagcagugccagcguggaacacuccuguugcgaaaaagccauguguguugguaaagauggagaaaagcaggauguggucauccagugagcacuccagugguugcuccuucugucagcucucccuuucaagccgucgggaucccagaagcuuucacuguguuccuuuuuaacuuguacauuucaucauguaauauacauguuuauuuguagagggaaaugcagaguaugugcauguguguaauaccuauacucacuauuucagacauugcuagguacuuuaauaucuagguacuucauuugauugauugauugauugauugauugagagacagaguuucgcucuugucucccaggcuggaguguaacggccagaucucggcucacugcacccucugccucccagguucaagcaauucuccugccucagccucugaguagcugggcuuacaggugccugccaucacgcccggcuaaauuuuguauuuuuaguagagacggcuauuucaguagagacggguuuucgccauguuggccaggcuggucucaaacucuugaccucaggugauccacccaccguggccucccuaagugcuaggauuacagguguaagccacugcacccggccaaugucuagguacuuuaauguguagguacgauagcauuuauugcuuuacguaauucaugcaacaccucugugcauuaggauuaugauccucauuuuauaggugagccacaugggagugaggcgaggagggaugguuagguuacgguuguaaauggcaaagcugagauaagacucaaaaucaguuuaucuucagaaccauuuugcaaguaagggaggaucccagaucucaaagugccuguaucaguuaggaugccuuugugccuuugguugugagaagcagacucuacaaacuggcuuaugcaggugagggaauauacuggaaguuugccauaacugagaacuccagaggcagaaccagcuuaggggagauuggucagggcugucacuugucuccugcgguuuccuaggcucuguccucuuccaugugcuucuccucugccuccaaccaccguuggcuccuccaucauuggaguaacucuggcucaugcccauuggaaucagucacuauggcaagggagcuuugauuguacugguuguguagguuaacacgaugguuuuacacaaccaucuguaaaauuugggauggugggauaccuccccagacccagacuucuggacacccuagaucguuuugggaagaagaaagaggagaaaauaccugucaacaaugcccaaaggcagagaaagguggagcuaagggcuuggugaaggggagcugagaagggaggaggugcaggcuagggaaggcgaaugaacuggcuggaggggugcccccuucuugucuuuuuccucugcuugcuucugugccaacuuacauaccuagccauucacggguccaucacccucuucugucccugauguucuuugccaagcucccacucucuuuaauuaacaacuuuggagaugcuuuuagaagagcccaagucuggccaggcaugguggcucacgccugugauccuagcacuuugggaggcugaggcaggcggaucacuugaggucaggaguucaagaccagccuggcaaacuuggugaaccuugucucuacuaacaaugcaaaaauuagccaagugugguggugugccccuguaaucccagcuacucgggaggcuaggguaggagaauugcuugaaccagggaggcggaggcugcagugagcugagaucuccagccuaggagacggagcgacaucccaucucaggggaaaaaaaaaaaaaaaaaaaaaagcccaagucuuacugugucaccuuuaagguaaaaaucuccccuccuccuccaccuggcucuguuucuuugcauuuuccaaggucuuccacaagagggacuuugcuguuuucuuucugcaguuucuuuaaugguguguugguauggugcuuuuggugggauaauuuuacuuggaaaauaauguuucugacccauguccuucuuugauugauuuuuuaaagauuuauauuuugcuuuucuuacgagucuucuggauuauuuuggguguuucucucuuuuuuguuuucccugggaauuugagucuagcgggggcucaaaagagguucauuucgcuaguggcuuugccugguguccucccagucagaagucggcgacgcuggucaguggugcagccuucucuccaaacucugucugccuuccucuuuucugauauucugaaucccuagcugcguauucuccacuucucguugaaaccaacucuuagaaaaagggcugaugacauguuaaauuagcuacuuugaguauguauguguauggauguauacccgaguaauacucaaacucuuaauuuguuuuaauuauuaugccuugauuagguuauuuaaacuucagaacuccugugagguacauacaaaugccacauuuuacacaugaagaaacugaggcccagagaugucaauugacuugcaucaagucaguuuagaaauagcaaaggugggauuugaacccagguagucucuggcuccacagccuauguucuuuuuuuuuuuuuuaauacuuuaaguuuuaggguacaugugcacaauaugcagguuuguuacauauguauacaugugccauuuuggugugcugcacccguuaacucgucacuuacauuagguauaucuccuaaugcuaucucucccaccuccccccaccccacgacagaccccagugugugauguuccccacccuguguccaaguguucuuauuguucaauucccaccuaugagugagaauguacaguguuugguuuucuguccuugcaauaguuugcugagaaugaugguuucuagcuucauccacgucccugaacgcauccuuuuuuagggcugcauaguauuccaugguguaugugugcuacauuuucuuaauccagucuaucauugauggacauuuggguugguuccaagucuuugcuauugugaauagugccgcaguaaacauacgugcgcaugugucuuuauagcagcaugauuuauaguccuuuggguauauacucaguaaugggaugguccacagccuauauucuuaaccacuaugucuaguguguuucucucuuugucucucucucucccucucccuccuaaaacuucuuauacauagauccguuaauguguauauauagucaugguugcugcaaggaucaaguuauuugcgucuguguaaaccuacauauaaguaaguagugguaguaauuauuauggcuguuaaugaaauacuuacuguauaccagcaauuaugcuaaguguuaaguacuuaaauucucccaugcugagcuuucagcagcccuacaacuuguuacuguauuuauccuacuccuacuuuuuagaugaaauuggguuuuaggauuaauuuauaccagauuacacaguuuacaaagacggagacugaauucaaaccucuuuaaagacuaguucucuuaaaauaggaucagcaacaacucuuaccauucauugaguccuaugacaugcugaagguaaaggaaaacaaugcugacgcagucucacuucaagcauccucugagggaguuuggccucauuuuauaugaauaguguuccuuuuuacucuugaaauugucccauuuuaaggccgggcacggugacucacgaugguaaucccagcacuuugggaggcggaggcagacggaucaccugagaucaggaguucaagaucagccuggccaauauagugaaacccuauuucuacuaaaaauauaaaaaucagcugggugugguggcacguaccuguaaucccagcuacucgggaggcugagucaggagaauugcuugaacccgggagcggagguugcagugagccgagaucgugccacugugcuccagccugggcgacagagcgagacuccaucucaaaaagaaaagaaagaaauuuucccacuuugaggaaaugagucugugguuucuggauggauaagaaaacugaguuuagagaauuugugccacuuguccaaggccacacagcaguaaaaggauagacugggguuggaacucuggucugucugaagaggccaggcucuucacccugacaguugccuggcuucugguauuugcugccuucuugcuccucuucgagagcaguucuggcuuuaaaaacaaguucugugggcagagguacuccaugccccagccugagcccuuggggcccaccugggauugguggugucugggcgaucucaggguucccuucuuucuucccucccuccugagaagaaucagacucagacaccaucuuuuguggucuaguguuugggaaaagacggcugcacagucuccaccagcauuugcaaauuauucacaaauuauaugcacagacacauggggcccaacuacauacgucgcagacuugaauguggguccugggaagcuucuggauaugugaguuuggggguugggcaucccaucuagcauaaacuuaccaucuucaugcuugcagccuugcaauauacaggcccuguuuuccccucaacauuaauaaacuuuauuuucccugcaguuguaggagacagaggcucuauagaaaacuuacaaaugaaaacauauucuuuuggaaaaaaaaauuaugguuaucaauuccuucuuuauuaguuuucuuuuauuuuuagauccauuugcaugaaagcaagagauucucacaccacccccucuuuguaugauuaugacagagaggcaauaagaggacagauucuuaugaaaaaaaaaaaguuggggggugcuugccuuauuugagaaaacagagaucugcagugaugaagcuacacauaccacauagcuuaagagaggagcuggaaaaaguucuauuuagggagaaggauuuuuccuguguucuugcgggagguaggagggacucuggaagugacaguagcuauccguauucuggaauaaaagcuguucuccugagaaaagaagcaauauuccucacuucucacagccugugccggguuucagguuugggagugggaauuggacauuugaaccuuucauuuccuaaauggauuugcaauaaauaaaacuagaguuaaggccucauuucaguaaacaugggggagcuguuggaagcugcugcucccuguuucagacgauuaucucccacucaguccuggugggcauuauguaugccaggugggagcggagacugauuuuguccuuccucauugaagccuggaaaagucuaguaucuuuuaucagauguggggugguuggcuguuuccuuuucuccuccagccaugauauuuuuaaaauugacagccccguugugauccagggugaugagagagagacugacauuuuaaaguuucagaacauguuuuucagcucuucuuuggauugcuaaugugaauaauaaugccacauugaacacuuauccugugcgaugcuguaggagugugguaaacaucucauaaaucuucauggcacugcucgcugcagcauggccagucguggaacucccugccuccgucuccuccucugggcacgcucagcagcuuucgcuguuuggguggaaagcuguuuguggauauuaaaggagaugguacuuggucuagaagaggugcucaaugucagugucuucuuuagccccuccccuggccccaccuucuccuuucuuuuucccguggcugggguuuuggggaagucccugaacacagugagaaaggggucuguuuucuccugaguaauuugaaaaucuuggcuaagaaugggggagagaaaggaggguguggaugcuacuaggugagggcuugggaacuccuacauuuccuauggaggaagaguuucaaaacuuguguuuuuuugcuucugugcuuuguuuuuuuuuguuuugaauaugugacuugauuauucugguuuguaacguugucuuuaggaaaugaaagaugccucauuauuuucugauuccccaauauccugcccucuuagggguuuccuaguaacagauuuuccugguuagaccuugcccuccuguguuaguucauucucaugcugcuaauaaagacauaccccagacugugcaguuuauaaaggaaagagguuuaauugauucacaguucagcaucacuggggaggccucaggaaacuuacagucaugguggaaggggaagcaagcacauccuucuucacauggcgggagcaaggagaaguaccagcagggaaaaugccagacacuuauaaaaccaucagaacuccugagacacacucauuaucacgagaauagcauggggguaaccaccccuugugauuugauuacguccuaacaggucccucccaugacauguggggauuaugggaacuacaguucaagaugagauuuggguggggacacagccaaagcauaucaccuccuaacaaguauaauccuagguugucuguggccauagugcguucuguuuuaccgaauugacgucucugagucugaacacugguucugcugcuaagugcuccuggacucugaggcucugcauuuaggcucucugggcaucuauuucucacauagaaaagggaacagauaauaaaaaagccuacccuguggggcuguugugaguaguaaacgagguaauguuaucaagugccugucuuagcaugcaguaugcacuucacaaauaagacacauaaaaauuucuuuuucccuuggacacaagacuuagaguauuuuuccuaggaugauggugguaguugugaguaguaauaugaguagcaauggcacuagugcuggcaguaauagugguagcacuagugcugguggucauagaaguaguaagccuuuggcuuggcuuccauaaugaaagucuauaaugauuucuauauaauaaucucugcucuuuagcagcauuuuuccaacagaaauuuauccauaaagugcccaauaaccuaaugauaaggcauuguuagcagugagauauuccauacaaaugaauuuucagaugaaguggcacuuuucccuuuaggcagcaacauuucuaaacacaaaaugaaaccaaagaggcauaaugauuuuguggaaaauguucuaagcuaguauuuuucuuccuuugcaaacagaaaagacugaaaauaauuaaauuuuuuuguaauaugacucaguuccccuuugugccauauuauaauccauggaaauuacugaguugugcagaagaguuuacuccuaggguauacggccccaaaggaucaugcuuuuuuaauucuugagacugcucuuuguucuucuuuuuuaauuuuuuuggccagccauaaggauacuacgcagacaugcucaccauuccuaaacuuccuggggaaaguuuaaagguggcuacagccuuuccaguguacagcacaaagacauuuuaauuuuaaugauuuaucucgcucaugagcuuuucucauuuacuuauagaauaaaguuuucauucuucauuuagaaggcuuuucuuuauaacuaguacaaguuauaaaacagaccaucuauccuuuauauucucuuaagaaauuuguguuugugguagguaaaaugaaaaguuacugccguuguuuuugguagaauuuaccugguguucaccuugaaaggauaugugcuugugggccuuuuaaagcaaaaacaaaauaaaaaaaggauugaaacuucugaaguuaucuaaauaaauauucuugguauguauugcugugaaaacaaaauucaacagagcuuuuagauguacaugucaguuauaucuuauauuuuguagaacuugagaaguuggcaugucagauuaguagaugcucuggaugcggaguuuuucaaucuuugugacagguaggauacauuuaaacuuuggucagcuuccggagaggcauagccuggucuuucaucauauaucugaaggcaaaaagauagauggaaaucucuaagcaguaugaauuguaaguauuucuguugaguuauaaauaccucaaggaaaagaaccaucuuaguuuucuuuuauucacuuaacaaauauauauuggcuuuugaagugguugaguguagaguucuagaguuaaaaauauuuuggacuuaaagaaaaaaaaauugguuuaaauuccugcuguauccuuggaugauucaguguaggccaguuucccuucacaauaguuauugaggggcuacugggugucaguugcuaugccagguguauuagcauguucucacgcugcuaauaaagacauacuggacaguggguaauuuauaaaggaaaaagguuuaauggacucacaguucacauggcugggcaggccucacaaucauggcagaaggugaaugaacagcaaagucaugucuuacaugguggcaggaaagagagguugugcaggggaacucccauuuguaaaauucucagaucucauaagacuuauucacuaccaugaaaacaguaugagggaaacccccaugauucaguuaucuccaccuagugccgcccuugauguguggggauuauuacaauucaaggggaguuuuggggacacagccaaaccauaucauucugcccucagccccucccaaaucucguguucucucauuucaaaaccaauuaugccuucccaacagucccccaaagucucaacucauuucagcauuaacucaaaaguccacaguccaaagucucaucugagacaaggcuagucucuuccaccuauaagccuguaaaaucaaaagcaaguuaguuacuuccuagauacaaugggaguacagggcuuggguaaaaauucccauuccaaauuggagacauuggccaaaaugaaggaacuacaggcccuguguauguccgaaaucauauggggcaguuaaaucuuaaagcuccgaagugauuuccuuugauuccaugucucacauccucuaggucaugcugaugcaagaggugggcucccauggaguuggguagcucuaccccugugacuuugcaggguacagcccccauccuggcugcuuucacaggcugguguugagugccugaggcuuggugcaagcuguugcuggaucuaccauucuagggucuaaaggacaguggcccucuucucacagcuccacuaggcagugccccagugggcacucugugugggggauccaaccccacauuuccauuccacacuguccuagcagagguucucuaugaaggcucugccccuguagcagacaucugccuggacauccaggcauuuccauacauccugugaaauccaggcagggguucccaaaucucaauuauugacuucucuuuacccccaggcccaacagcauguggaagccaccaaggcuucagccuugcacccuccgaagcaauggccugagcucuauguuggcuccuuuuagccacggcugggacacagggcaccaaguccugagacagcagaaagcagcaaggcccugggccugacccacgaaaccauuuuuuccuccuaggccuccaagccugugaugugaggggcugcugugaagaccucugacuugcccuggagacauuuuccucauugucuuggcaauuaacauuuggcuccucauuacuuaggcaaauuucugcagcaggcuugaauuucuuaucagaaaaaggguuuuucuuuucuauugcauuaucaggcugcagauuuucaaaacuuuuaugcuuugcuucucuuguaaacauaaauuccaauuccaaaccauaucuuugugaauacuuaaaacugaaugcuuuuaacagcacccaagucaccucuugaacgcuuugcuguuuagaaauuucuucugccagaugcccuaaaucaucucucucaaucuucucucucaaguucaaguuucuacaaaucucuagggcaggggcaaaaugucaccagucuuuuugcuaaaaccuagcaagagucaccuuuauuccaguucccaacaaguuucuuaucuccaucugagaccaccuuaaccuggacuucauuguccauaucacugucagcauuucgguccaagccauugaacaaguuucuaggaaguucaaaacuucccacaucuuccuguccucuucugagcccuccaaacuguuccaaccucugccuguuacucaguuccaaaguuccuuccacauuuuuuggguaucuuuauugcagcaccccacuucugauaccaauuaacuguauucaucuguucucacacugcuaauaaagauacacccaagacuggguaauuuauaagggaaauaaguuuaauggacucacaguuccacauggcugggaaggcaaaggagaagcaaaggcacgucuuacauggcagcaggcaagaaagcuugugcaggggaaugcccuuuuuuauaaaaccaucggaucucaugaaacuuauucacuaccacgagcacaguauggggaaaaccgaccccaugauucacuuaucuccaccuggcccugcccaugacauguggggauuauuacaauucaagguaagauuugguugaggacacagccaacaaauaauaccaaguaugguggacauagcugagaaccagcuggaugcuuggucucuggccuccuggacuuuacugggcaggguuucaugaacucugucauccucauaucccuuuauaguguuuggccacaucuucuuaagaccuuguuauuuacuuaaauacauuaaagauauuaagaaguuuaugucauucucuauaaauagcagggaaccacaggaacuaaaccauguucaagucuggcuagaugcugcuacuagccaaaagcuaucugaauggaaacucucaguuccuucuuaccaaguguugaagggcuguaaggacacacuaacaguguauugaggcuugccuggaaugcauuagaagaauugucaagggaggggguaacuuucucacuaaguucuuuugaacugagagaugaagauuuuuaaggcugauguaaauauuugauuuuucucauucugauugagcugagugcaacauguugggaacggcuucaugcagaaagccuguggugaauggggucuggaagaagacuuuggaguugacuuggaaggaagauaguuuggaggcaggacuggucauaaaaucaccuuuauuugcuuuugaaauauuauuuuauaucaggugucaaauguagaaaucugaaauucuggaaauuaaaagcuguuucagaacaauauugagauaucacccaugaagauccugucuugguaggaggagcguagggaaaauguccugaucagugcacucacuuauugccagggacaauaacaucaccacugagaauaaggucaccagucuaacuagugccccauauucuguaaaacuugccucuccagugcuuuuccagagguuuagguuaaccagcaaaucagaagucucaaagaucuuuucuaguuccugcuugaaauuggguagaagauaauaccagcuguuacguggaaguauagcaugccauucacuuaacguggaaugaagcaaaacauucugagagggaagaccuauuacagugcauguguaccauuaucuuacuuuuucuuucuuuuuuuuuuuuuuuuugaaauggagucucacucugucacccaggcuggagugcaguggcacaauuucgccucacuucaaccucugcuucccggguuccagugauucuccugccucagccuccugaguagcugggucuacaggcaggcgccaccacgccuggcuaauuuuuguauuuuuuaguagagacggaguuucacuauauuggccaggcuggucucgaacuccugaccuggugauccgcccaccuuggccucccaaagugcugggauuacaggcgugagccacugcgcccagccuaucuuacuguuaagcuguaaugguguuauaggcaggacagguauuugguacugaggaaggcucuucaaggaugugagaauuaagcugagugagaccugagggaaaugccaggggacccccucaggaggggaggcucugaagggaggagaauucucggagacccucuggagggaguagggagagagagagguccccaaccuccuucugaggcaccucuuuauaagguuggaauauuuuguacuguuuccuaucucuuggagagaagaguccacccuuucccagguaaccugucucagcuuuggagaggcugagauggaauuccagggaccaaaucuaauuaauuccucaaaagagaagugccuuuugggaguagcaauauugaaucucacuuugauagcuccugguggagcaauuuggagagaauauauuggggaugcuuuuuuccaauuaauaugcuugaauaagaacuuuggugcuccuuugcaguauaaaaugaauguauaguaaaaauaagagccuuuuucuucuaagaagggccuuauuagaacuuggaaagccaccuucccugucuucccagcaccugaauacugugcccuacuuaugcccaaaagacaauguacuucuugaggaauuuuuguaauuuagaagcauguuuuugcuaccuacaggauuaaaaaaauaaaaauaauaaagaugcugucagacuuggccuccaggcaauuuagugcugccuguggcuucugguacugugcauuuuaaacaguccugccucuucuccuuuuuauuuuuuuaccacccugcccugguuauggcaacuuaauacagcaugucuaaauaucuaccccuuguuugcacagaaauagugcacaaauuagauaaaauggcauuuccuuucucucuugacagcuuggaauuuuuuuuuaaguggcuuugacaagauucagggccaaauuaugaaaucaccaggugacccuuuccguucaucagcugcuaaugaacuuagaaaauugagaucucaucuggcagacaaacucauuuuguuugacaagcagcuuaaaaguauuuguaaaugaacaaauuauguuuuuuuuccccuccaguuggcccugugaucacuacacauggguuuuacaguuuuguuuguuucuuuuuuaaacuugucagaggucuguagaaaccaggcacuggguuucuuccugucuugauuccuuucauguugugcauuguuagccuaggguaggugauucacacuagccacucugguaguaaucgguuaggguauuagaaagagugcuggaugugaaacaggcaggccuggggugagauacuguucacccguuacucaucgagugacuuuaugaguuguguaacaucugaauacuucaguuuucuaauucauaaaauggauggcuaauuuaagugggguguguguguauauauauacacauauauacguauauauacacauaugcacauauacacaugcauauauacacauauguauguauacacauauauguauauacacauauguauguauacacauauauguauauacacauauguauguauacacauauauguauauacacauauguauguauacacauauaugcauauacacauauguauguauacacauguauauacacauauguauguauacacauauaucuauauacacauguauguauacacauauauguauauacacauauguauguauacacauauauguauauacacguacacauauguauguauacacauguauauacccauguacacauguauacacguguauauacauauauguauauacacacacauauaauauacaguauauauacuguacaaauauaguauaaauacguacaaauauaaacugucuauguguguauauuauacauauauguguauauacauauguguauguguguauguauacuauaugguauacauacuguaugaauauaugguauauauauuguuuauguacaaauauaaacucuguauguguguauauaaauaaaauaaagauucauuuugugcauauuaguaccugugacugucuccugaaagcagaacagacuucuuugaggguagaaugccacuuuuauucuaacuuuucaauacauuauugaucuugcaccggagcaccuaaacucugaacugguuuaaaaagugaauuagggcacuagaaauccuuaccuuccauuuuuguucccucaaauuuaagcgagaaguuaguaguucuuuaguuaacuuccaggagcucccacgcuauacacaggccauauggugacaaauagacauucuggagucagauugcuggguuuauauuuuuguuccaucauuuacuggcuugugacuucgagcaaauugcuuuauuuccucuucuauacauuggggauaguauuaacuaauuuacaggguuggauuuuaguaagacaacguaugugaagcacucauguauguagagcuuggcauugcagaaagauacugcucaguauaugauagaaaauacuacugcaagucguaauguuauugguuuauucauuagcagaaagcaauuguugcaguuguuaaacaaaacgaaacgaaaagccauucuaauuaagcagagucuagugagagcucagaggagucugaguugguuuuaccaaagaggaggucucugaaggauggauuggagguaaucuuggaucugccaugcacuaaaaggggaaaaagaaaaaagaaagagagagauugucuuagugauuuggaacugauuggccuuaccaacuuggaagcuccuuuuaaacacauagguccuuuuuagagcccauugaggaaagaccacucuaaucucccucuaccgcccacuacuuccacuacuuccaguagagccugguggucaauaaccaccagggaaguuagagcccguucugcagcagugauugucagaaucaugcaguggcaccagcacugccauucucuuauccugcgaccauauccuuggcuggguugcaagcaauuucucauauguaguaggccacaauggauacuuguuugauuaaaucaacaacaacaacaauaacaacaaaacacugcucuucugucuggagaguacuuuuaguagacaccucuucuuccuuucaugauaacucuccauacaaauuuguguuuuuugagauggaguuucgcucuguugcccaggcuggagugaaauggcaugaucucagcucacugcaaccuccgccucccagguucaagcgauucuccugccacagccucccaaguagcugggauuacaggcacccgccaccaugcccagcuaauuuuugcauuuuuaguagagaugggguuuugccauguuggccaggcuguucucgaacuccugaccucaggugauccaccgccucagccucccaaacaaauuuuuaaauaucucagccuucuagucccuuuucccaugauuuggcuauaaucucaaacugcucuugcaaauuuuuuuuuuuucugaagaaacauagugcucaaagagacucucaucacucugaugagagagaaacagauccaguggauuaacguguuuugcuaagugcugugauaggagaccuagaaaacaagcuuuuggcccuuuauaugaucuugagggaaucuccugaccuuuuggauacuuagucuuuucgucuguaaauugaguaccauagcauuugugucacagcauuacaaugccaauuaaaucaggccgaagcacuguaguguauggccugacacgcuacggucuggaaauuucucaggaaaaauaagggugugaugaguggaaguggaacacucccucucucucucucuuuuuuuuuuuuuuuaaacuugauuuuguuuuuuuggagacagagucucacucuguugccaggcuggagugcaguggcgugauguuggcucacugcaaccuccaccucccggguucaagugauucuucugccucagccucccgaguagcugggauuacaggcacgcaccaccacgcccagcuaauuuuuguauuuuuaguagagacgggguuucaccauguuggccaggauggucuugaucuccugaccucgugaugcgcccgccucggccucccaaagugcugggauugcaugcaugagccaccgcgcccagcccaauuugauucuuuauuuugguaguagcuaaucuaugugaugaagcccugacucuucauuguucucgugucacugauguaaaacaacaacacauuuaaauguguguuuaaaauguacaauucauauaauguacaauuuagugguuuuuaguauuuucacaagguugugugauugucacaacgaauuccagaacauuuuccucacucccaaaagaaaccccauaugcauuaucagucacugccacucuccucuuauucuagcuccugauaaccauguucugucucuguggauuuggacugggagagacauaaaggauaggggcuacucucccucccgucuuaaaugcgucucagucaugaaccuugccauauuuuagugcuuuaaacauuuuuaaaaauaguugauuugaggaggaggaggauaaaacaaacagcagaacccaaaaagaagaacucggacuccagacuuaauucuauccuuugcccucuggcuaacuuuggauaugccaauucuuugucugagccucauuuuccccaugcagauaauuuacauuguauuagagaacuaccuccuccccaagcucucuuucaggcuuaaauucagugaucuugagucuguguguguguauauauauauauguauauacacacacacacauugauuuucuuuuaccaugugcugguucuuucagucucuugcugcuuucuguuauccacggagcuggcauugcuuucuauuuuuaucaguguacuauuuaaauauagaaauaaauaucuuauguauaucuauuugugugugugcauaaagcaguggaauuuauggacuaaugcggucacuuacguaaauuacuuagcacgggguuuggcacauacuaagugcuagauaaguauuauuugcuaggugagugaugggucacccugggguagaccaguugacauuugcucauauggaacuuguucagugaauuguccuaagugaucacagcuggaagcugccuuggucuuuggauggggcuucugcugucugcauucuuuccucuuugcuuucacuaguuucuggaacacgucagugugaauuuuuuuuuaaggcagagucucguucuguugcccaggcuggaaugcaguggugcaaucuuggcucacugcaaccuccaccucccagguucaggugauucuccugccucagccucccgaguagcugggauuacaggcacccaccaccaugccuggcuaauuuuuguauuuuuaguagagaugggguuucaccucauguuggccaggcuggucuugaacuccugaccucaggugaucuacccaucuuggccucccaaagugcugggauuacaggugugagccacagcaccuggccgucagugugaaauuauagauuuggaaaaacaaauccugugagaagagcaauuuaccguacccugcucucuucaagugacgugggaaaugaaaaacguccaaacuaagacaaauuuauuggauaccaaaaccaccaggcuauugauucuuaaagccagacaacaagguuaugaauugggugauaaaaauggaaagcauuuagcuugacuucuaaggcggggcagcuuugugcgcuaucgcaguuauuggguucuacugacagccccacaacuaaugaccuagcacuuauuaaccagaguguuuacucuaugugcuacaucugucuaauguguugugugagugagauauaucugaacaauuugauuuuguauugaggccggggugccugagacuuacucuguaacuuugaaggcugcaagaacauuagcuaaaaguucuuagcugcagcaaggaaagcaagaaauuguucuaagcccuaaauaguuuugcacugcugcagaggagggauuuaugucuccugauggguuuuggaauggauaagcagauguuguguguuagauguuagagaucaguuauugaacccacaguuauuuuaauuuggaugcugaaauucagagaggcuguguucaucagggucauagucaguugcugacugagauuuccuaaagcuuggcuucaugcuccuucuuucacaccauucagacuguugaggccuguggcagcugucaagaccgugcuguccauccuccagcugccuggagugagccccacugcucuucgacaggggcugcuggggacuggguaucacugaccccguggaacugaaaugccucuuuuugacucugucucacagugguuuacuugugucuuuuacucgauggugcagguaacuguuauggguugaauucugucuccagaauucauauguugaaguuccaagccucagugccucagaaugugaccuuauuuggaaaugggguuguugcagaugcaauuaguugaggucauccugaagccacuuggguccuuaauccauuacaaccagcguccuuguaacgggaaguuuggacacagacgugcacacaggcacaaugucgcgugaagguuggaguuguguugccacaagcuaagguccuaccaggagcuaggagagaggccaggaacagaucuuuccccagcgccuugagagugagcgugcccuguucacaccaugaucuugaacuucuagcccacagaacugugagacaaguuucugcuguuuaagccacccaauuuguagcacuguuguuauagcagcccuggcaaacugacacaauagcccagugagcauucuauaccaugaaaguagaauuaggagaggaagauacaguagacuguacccucuuaccacccccuaguucuucuuuuuuuaauuuuuuuuuaauuuuuuugaaacaagaguuuugcucuuguugcccaggccagacugcaguugcgcgaucuuggcucacugcaaccuccgccucccggguucaagugauucugcugccucagccucccaaguaacugggauuacagcacacgccaccacaccuccacaucuggcaauuuuuguauuuugaguagagaugggguuucacuauguuggacaggcuggucuccaacucuugaccucuggugauccacccaccuccgccucccaguguccugagauuacaggcaugagcuaccacgccuggccuuuuguuuuaaaaugaucaaacugucgcuaggaacuugauuacuucucacuguagagcugcugggugccagauuacaagcuagguacuuccugguuccacucuguacuauuguguguaauguauggcauauuauuuaaccuacccugagcugugguugucugauguguacaauaauggguggaauaaugauagacaaauauuaggaguuugggguggauuaagcacccaccauagagccagacauauauaaugaaauaaccaccguuccuugugugguucuagaaccuuaugugcuaaauucuagaaauuuaggaucauuaauaauaacaaagauaaaucccauguaugcagagcgaagagauuuagguaaacuuaagaaaaggcauucaucucaaacaaguacuuacgcgcaaauguuuguagcaaaacuauucacgguggcccaaaguaaaagcaugccaaauauaacaucaccugaugaauggauaaacaaaauguggccucuccgugcaauggacuauuaaucagcuguaaaacaggaugcuaggcugggugcgguggcucacgcugguaaucccagcacuuugggaggccaaggcggguggaucaccugaggucgagaguucgagaccagccuggccaacauggggaaacccuaucucuacuaaaaauacaaaaaucagcuggguaugguggcaggcgccuguaaucccagcuacuggggaggcugaggcaggagaauugcuugaacucaggaggcggagggugcagugagccgagauugcgccacugcacuccagucugggcgacagagcgagacucuuucuccaaaaaaaaaaggauacugcgcugacaugugcugcaacauggauaaaccuuggguacauggugcugagugagaggaaccagacccaaaaggccauguguugaaugaucccacauacauggaauauacagagcugcuaacucuguagaggcagaaagcagauguugguugccagggacgaggaguaagggaaaaugggaggugacugguuuucuuucagauugauggaaauguuuuagaauuagauaaaggagugguugcucaacaucgugaauguacuaaaugccaugaauuguacuuguuaaagugguuaauguuauguuauguguauuuugcugcaauaaaaagaaaaagcccgucucacuacaaggauauuuauguggcucaaaucaggggguaucuugaaacaaggguuaaagggcauugcuguuggaaaccaucacacgggguacaguucaagguucuuggaaucaagagucccugugcuuuauccuuauagagacuuuuucugugaccugaggaaacucauguuuccaucugucuaaaagaauuucuuuccugacucuuuuccuccugugguggcuuuggugacccuuugaugacuucuccuuucauugcaccucauaacuaagacugugucacaggucaucccugaaccaauucugggcaaaggagauguugcucuaaagcaugagaccagucaugguuuauccccugcagcuacaggccccacuccucagcauaguguuacccugugugacugaaucugcaauguguuaacaaggaaagccccccaaaacaggggcaugacuguugggagggcccccagcagggcaucccagaagaaaguuucacauuggccuuugggccuccaccuaaacaagccguucuugugcucggccucaaggucauuaguccuuccuuccucccucccuucaccugccuucccuucaccugccuucccuuccccugccuucccuuccccuucuccuucuccuuccccuuccccucccccucccccucccccuuccccucccucccucucuguugcccagacuggagugcagugguaccaucauggcucacugcagccuugaccuccugggcucaagagauccuuccaccuuggccucucaaguagcugggacugcaggcauguggcaccacaccuggcuaauuuaaaaaaugcuuuuuuuguagagaugaggucucauguuguagcccaggcuggucuugaacuccuaggcucaagggaucauccaaucucagccucccgaagugcugggauuacagaugugagccacgacgccuggccauugauugucuuaagcacagaucccaucauuccugcucggaaaucucgaguggcucccuagggacuguggaaggaaguucagauucuccuucacugagcauucaaguccugucccagucccauuaucugaguguucucuguaccuuuucuucuggaaggagcgguugguugccacacugugugguuccagccuuucauuuuuucuaaugguucuuucugccaggaaugacuucucucuccuucucacucuuuugaaauugugccaucuucuggcucagcucauuuuuuccugagaaucaugugucccuggcucccaacuuauguucauguuugugguguuugugucugccugacuauccuguacacucucuugaggccccucaagagcaggggcccaugugcugaccaucucugcauccccauucuccagcccuggaccuggccuagcauguaccccagucaguaggugccuuguggacuguagugaauggcaaagcguagagaaaagguaaagcaauagcugucuucccuguaucauuuggcaccagagauauuuguaugaaaucucccuaggccuuggaacuuggaagaacaauacacugcacguuagacaagucaggacccuucaacacuaagggaugccagagugcauuucccaguauugguccuugugaaaugcuuauguguauuugcuuaagcagaaugaaaaugugaggccugccugcuuacgucguccguuuccagaaugaaaaucggaagaacaaagaucgaaauacuccaaggcagggcuucauagguagucccauggaugugauuaagggcugauuuaacauucagaagaaaaacauaaaaaccagccuucuugaagcuguagucugaccuugggaagaauguauauccucaggaaagauaaauuugcguuaaagaccucuuuggcaaugcauuguugaaagagguuaauauuguaaguggaaaauuuugauuacuucucgauucuuuccucccauuugcuucuguaccugugucaccccagagagaucucuaugcuagaaguaauguccacaccaccugccugccuguggcucaauuaaacuugaguuccugcccuuuuaaaguacaauccagauugugugcaacaauacaaaggguggaaauuaagaaaacucauugggaugcagaucagugcacuucacuuccccaagccaagggagaugacucuggaggaaaagauaaagaugaccacagugaauuugcaggucaucuuuugugcaugugcuugguugaaacauccuuggaaccuuucagugagggaaagguccucucugaagaagugcuugccuuaaaccagguuuucucagucucagccuuauugucauuuggggcauaauccuucuuuguugugggacuguccugugccuuguaagauguuuauuagcauuccugaccuugacccacccgaugcugguagcaucccacccuccugagucuuuuuuuuuuuuuuuuuaagacagugacuuguucugucacccaggcuggagugcaguggcgcgaucucggcucccugcaaccuccaccuccuggguucaagugauucuccugccugagccuccccaguaacugggauuacaggcaugcaccaccauaccagcuaauuuuuguauuuuuuaguagagaugggguuucaccauguuggccaggcuggucucgaacuccugaccucaggugauccacccacuucagccucccaaagugcugggauuacaggcaugagccacugagccccgccaaccccccagucuuaauaaucaaaauugucuucacauugccaaauguccccugggguaaauuacccccuauugagaaccacugacuuagaggcuccccauggggaaaagcagaguuggugugggaaagucuagcaguuaaaagaggcagcagguggaaaggcagagaagugugaggccgcauagcagcuuugcccaugugguguuccuggauuagaaggugugauuuggaccaugccaggguaugaagcuggaaaggucaggucgacagggauccgauuuuggaggccuuugcuaccaaauugagagaagcacauucaauuugaagcuggaaaucuugggguuauucccagugccucucuuacagcugugggaccuaagccacuuaaccucuuugaaccucagugcccuucucuguuaaguggagucgcacagauggauuguaaaaguugagugaauuaaggccgugugaaagugucaguaugguaccuggguauccuaguugcccaauaaauguuuucuucuuuccuaagcacugucacauccaguuaaauccgguucucuauaguucugcugccacuaacuccugcugcuauuuauccagccuguauuacggcaaagcuuccugggcugucugccucaacuccauucucagucugauguaaagguuuagaaaauacugaaaccugcacaguccagcacgguggccacuagcccauguggcucuuaagcaccugaagcguggcuacuucaaacugagaugugcugucaaugauaagaugcacucuguauuugaagaccaagaugagaaaaagaacuaaagcgccucauuaguaaugcuuuauauugauuacauguuaacaugcuaauauauuaagcauacuagguuaaauaaaauauuaagauuaaugucuggcugggcauaguggcugacaccuguaaucccagcacuuugggaggccaagggggacggaucaccugaggucaggaguucgagaccagccuggccaacauggugaaacccccaucucuacuaaaaauacaaaaauuagcugggugugguggcacgugccuguaaucccagcuacucgggaggcugagucaggagaauugcuucaacccgggagguggggcuuucagugaaccgagaucgugccacugcacuccagccugggccacagagcaagacuccgucucaaaaaaagaaagaaagaaagaaaaaaaaagauuaacgucuccuauuuuuuuuaacccuuuuuuuaagucaacuguggagaauaagguaaguuuuguaagaguggccauugucuuauccaaggaagccuauugauucuucaugagagaaucauuuucuggugcuaaauuuugagacauaauuuguuucauagggguagucucuuuugaaaaauggauauggucccuucaagaagagcaguagcauauugaauaauguguuuggaggaguuuuuuuccauccgccccuccacccccaccccacccuucugguagauguaagaguauucuuuccuuuuucaauaguucuuccuuuuccaagauacacagccuugaggcagaaucagagcacaucuuccccaccucacacaugauuugugguuaucaaagcaaacaaacaguagugucuguacuguccuuagauuuugauuggucgaacagcuauagucaaucaauuuauuuuaguccuauuaauacuacauagcaucucauauuguuguuugauaaucguauuuuggauuucauuugaucucuugcaauccuugcaacaaccacgagugccugauauugccaugggcuuucccagaaaaaugacgggaggcuccaggauaacaaaucaguugccaggcuccugcagcuuguaucugcagagcugaugcuugaggccagguuuccugacucccagagcuuuguaaaugcugugaggcccaugugaaaugcagacugugccuuggaguuugcuuguuauauaacagagacaagaugggcacaauucgggugacaacuaaugugucuugacugcagagcuguaugaaaaugggugguugaggacuguguuggaugccucagggggccacugccccgaucugugacaccacagugguucugaaggcaaauguacauguuucucugcagccagagaauuugacuucgcagcaggaucaagacaaacugaguuggcaggaguggacccuugugguccuuucaacauagugaacucgaaauuuucaauguuuguuugagagcauauugcgugcggcuuuuaaauuagaguucacaugaugaaucuuuaauagugccuccaaggccaagugccauuaggaagugccaguuugacaggccagaggaucaccuucagggaggaaauuccacagagaugcucgcguggccccagacccggagggaggcaccaguugcuuccuguguggucauucccauggagcagggagaaggagagaaaguuaccaaagugaacuuugcaaaugaccucacgugcacgagagggugucugaggggcaguaccccauugccucagggaccugugugggaugcuguguggauuccauuucucauguuacagauguuguacagucagacagcuaguugcuggaccuuuguuuuaaaaggguuuauuggagcaguaugagagugacugcaggccgccugaugauggcacauucguucauucauucauucauucauucauucauucagcagauacucacugaaugcuucccaugcgucuggauauaccuugaauauaaaguagucaugguuuaugcccaaguagagauuaaaaucuagugggcgcagcagcgauuaagcaaguaaucaaucaaauaauuguuuaauuuagaaauuugaugaguacuaugaagaaaaugaccgcagcacggugauagacaaaguuggggagggggcuacugaggcauaggauugucugggaagaguucucugaguugacagcauucaagauccagucuagagggauaaggaugcaguccagcaaagagcccaacauaagcauuucaggcacagggagcacacuugcaaagacccugaggcauguuccagaagugaaggggucaguguggcuggaguagagcagagagaguggccagagacaaggucggagagaucgaggucaagucaggugcuucuagguggagcaaagaguuuggauuuaagaguugaugagagacacugaguaaucuccuuuuuuuuuugaggcagagucucgcucuguugcccaggcuggaguguaguggcgugaucucggcucacuacaggcucugccuccugcguucacaccauucuccugccucagcuucccgaguagcugggacuacaggugcccgccaccacaccuggcuaauuuuuuguauuuuuaguagagacgggguuucacuguguuagccaggaugauaucggucucccgaccucgugauccaccugccuuggccucccaaagugcugggauuacaggugugagccgccgcgccuggccaacacugaguaauuucaaguggaguuugaaugaggcugcuaaugcagaagccacgggcauggggcgaugguagcuucgauucguauaguggcaggagaaauggagagaggacgauguaugcgaggcauggaauagcagaaauuugccugaauuggagauugcguggauugcccaagaugagcuguuugagugaggaacugagaauggcucccauaauauguggcuugagcaauggaguaaaugauguugcccuuucuggagcagguuuggaggaggaaaucaggaguugaggucugagaugcauguggguuuauccaguggguauauaggaagaaggucauuguacacauggaccuggagcuaagaagagaggccagagcuacagggaggaauaugggagucaucagccgggagauuguuuugcaagcuguuggcauggggguuuucaccuagggagagaaagaaaguguggaucccacauugaauccuggaauaccccuaaaauuuaucauucaggaaggaagagguuugagaaaaaaaauguaugaaauaaguaucucagagguuggagaagugaguuuacuagagaaaggcaguagcauuucugagcaguugagugcccauuugaaaucagaaaugauuaacugaaacauaucugccagccugagagugugauuuccuaccccauuuggcuucacacauaaagcugugaagagcaaggaggguugcauucaucugaagcguuggauuuucccaggcuacugcagucugaaacaaaaagggccaagggaggggcgaguacuuacagaaggggauuauaguaacaaaccguggcagcaucuacgcugaacaagagagaauacaaaaaaaaaaaaaagcaaaaaaauagaccuggauagagaguaugauaaagaagggcaguggauuggggaucaugaugacaguaaagaaucuaugcaauuguagccuuggagggcuggcaacgggauugugggagauugugugggggacugugggggauauugacauuuuaaaccaugcagguugugcugcuuugggugaugacaaggccuagaaugugaaccugguuaaugugaaguggcagauauuuuggaugggcauuuucaucauggaaguaaguggagaggaggaagaaugugagaauggucacgcggagauuacaguuaucaagaaugggaggaguaaaugaccucccauuuggauuaugggcaguuucuuggugugaugugggggauuguauguacacacacaugcacacacauacacauaaaauuuuuuuuuaaucugcaguagcaauauaggauauugccuuucaccuuuuuugcuuuuuuauuuucuauuuuuuagagauagggucucacucuguugcccaggcuggagugcaguggugugauuuuuaguucacugcagccucaaacccuuugcucaagugaucauccucccucagccuccggaguagcugugacuacaggcagaugccaccaugcccagcuaaagucuuuacauuuuuuuagaguugguaggucucucuauguugcccaggcuggucuugaacuccuggccucaagcaauucuucccccuuugcccucccaaauguugggauuauaggcaugagccacugcaccuggcaugucuuucaccuuuuaaguucagggaacaguuucuccuggcuacacauacguuaucagugcaaugcuuuaugaagcuuuagaaaugagcugaugacuuucauaaauaaugaaauauaaacaugacauuauuuuaguaucuucaaacaaaugaucugaggaugaguuacacauuuuaauaucaacacuaacuuguaauuuguacauuugcauuggcuauacaugcaaaaagauuauuagcuacaaugaaauggauuccuuaauaucuaugacauucuaccuugcuaaugcuauagaauaacuugcacuuuaaaguacauuugcacacuuugcauauuauguucuaugauugcuucuggguuuuccauacagauuauuuuuguugauauuaaauggaaaucguagggcugaaauaugcuguucuuaugugaaguaaauuacuauaaccuguuggccuaaaaaaaagaaugagagcugugaccaguaguugccaaggacagggaggacgauagugagccacaguggaacaggggucuucauuagagagaguggcaggaggauccaggagagacagcuggaagccagaaggacagaggcccauuucuuuucccuuaguuggguacaugcuuugcaagaggguaacagaucuuucuuuuaggggaagcagugauuuaggggacagcuccacuuucacauaaaagcaagaggcagaaugacgugagaggaaggagguugaacauaaagaggaguuuucugaucucauaguguaaguuccacagcauuccauagauggacuuggaggggaagggugggcugagggguaucgugugauuggaguaguuuguaugauaaugaauauccagugagacugcugccgugauggagauagucauugauccauucaauaaauauuuauugauuagcuucuugucuauaugcuagauacugugcuaguaaugaacaaggcagcagugggcaaaaugaacaagucccugcccuugugacacugauggucugauaggggagauagaccguaaaggaaacaauacgagaauuugcgugccaggauuuccaaccacuaagucagugucuuuagccucucuuagucucaguuuuccauuugguaagguggguguaaugaaguggguggugcuggugcucuucagucaguauucacuugugggggaaguuuuugaugaaaagucgggcacaucaucagagccaacccuaguccguagauguuuuuguuuaguuagaaaaaggcacguguugagaaacucugcuuucaucucuuagaaagcuguuguaacaaauuugcaaucaaggaagucuaggaugugaacaguuugcccuacugcacuggcggauuccugcccuggugaagugaggagcagagaggagaagggguggccagcucuguuuauuaaccaguuauuuacuaggugcuuuaguacaggcuucucaaacauucguguauauaugaaucaccugagaucuuguuaaaaugccaguucugauucaguggggcuagggugaggccugagauucugcauaucugaaaagaucagcugaugcuaauggcuguugguucaaggaccacccuuugaguagagguggguugguguaaacauuccuuggucuuagaugcuggucucagggagaggcuuaaaacuaacccuggaagaccuagauccuuugcccagaagggguuuuagucgaaugaagagagaucaaguaaugcacaggaaaugauuagaagauaauuaagugauuaggagugugcugcugacuccuguugguguugagaagcaaaaagggagagccuccgggacuagacuugacagagaaguccuauagaagcagugaagacuugauucuauugaggucccagagaggaggaaagacaucuaggauacaguaggcagggcgggagacugugugugugugugugugugugugugugugagcgcgcgcguuggauuguggcuuggguaaaggugugcaguaggaaaauaauaaugacaguaauauaaauaaugauaauaaagcuaacaucuuucaaugguccaucugccauaggacuugguuuuuuuuucuuuggagugggacggagucucgcucugucgcccaggcggcacaaucucugcucacugcaagcuccgccuccuggguucacgccauucucuugccucagccuccugaguagcugggauuacagacaccugccaccacgccuggcuaaguuuuuguauuuuugguugguaugggguuucacuguguuagccaggauggucucaaucuccugaccucaugauucgccugccucggccucccaaaguguugggauuacaggcgucagccaccacgcccggccuauaggaccuguuuuauaacaaaaccucggugauguccagcucuuucucuucaggugcugggacagcaccuuguaagaaagguucacugaagacgagugacaaugugugaguggcaggauucaggcaaucuucuaguuagaaucagugguccaaauccucccacuguuauaugcaccuaggaucaguuugggauccuaagcaauucugaaggguuugagccauuuuguuuccccauauauguguguguuuguguguauguguguguauauauuuuuuucuuagauuuuuauuccuucuucaugugcaguguuucuagacaauccacacauccugaacacccaugaaaaauuauuucuaacauccaugaugcuaauuaaaagacagccucuggugcugaugagagauagcuggcgcacacgcuuggaauguaggcuucugacuggagucucucaaaugguaacuagccaccccuggaggguguauucccaauuaggacacgagagauguuaacucacugcacugagcuuguaaauuaaagcuuauauauauaauauauauguauauauauuaaagcuuauauauauacauauauauacaugcauauauaugcauauauauuuuauacugucugugcugagguauuuugaauugcaagcaauauaauuaagacauagagaucaaaacuuuuaaauaacauuuauuuaugagauggagucuugcucugucgcccaggcuggagugcaguggcgagaucucagcugauuguaaccuccgccuccccgguucaagcaauucuccugccucagccucuccaguagcugggauuacaggcaugcaccaccacguccagcugauuuuuuuuauuuauauuuuuuaguagagacaggauuucaccauauugcccaggcuggucuugaacgccugaugucaggugauccaccugccucggccucccaaagugcugagauuacaggugugagccacugugccuggccaauuuuuaaauaacuuuuaaauuguaaaagcaaugcaggcuccuuguauaaaauuucaggaaguauauauauauauauauauauauauauauauauauauauauauauauauauauauguauauguuuaaauuagucauauucuauaccaaaagauaauuuacaacauuuaagccuuuuuuucuuauauagguauauagguuauuuguacacguauauaaaauuuauugcuuuggacugaaggauacuugugaucacauuauauaauacauuuagcuuugaauccuguguuuguagcuuaacagaucagccaggcaugguggcucaugcuuguaaucccagcacuuugggaggccgaggcagguggaucaccugaggucaggaguuugagaccagccuggcuaacauggugaaacccugucucuacuaaaaauacaaaaaauagcuggacguggugccuggcaccuguaaucccagcuauucgggaggcugaggcaggagaaugcgugaacccgggaggcggagguugcagugagccaagaucacgacauugcacuccagccugugccacaagagagaaaccgugucucaaacaaaaacaaacagaucauggugauuuuuuuggguucauacaauguucuucauaaauguaaauuucauugguuaagacagaugggagacgacagauggaguacauguuuaggaggaggaguugaccagcuuggccgaagaguuggaucuuggaguugagggagagguguuuagggaugacucuuagacaccuggguuaacagguggggaggccucccucacaccagggagcaguagggagacagcagauuagaggcugguuuucccaguuaauucgccaacauuugcacauguucgugauguaauuuccagcccaccuccuguuucuuccuuccguucuucuuguguugauuucuguguugacuuccuggaguaacuucugauauagauugagauuuuucuuaaaaauguguuuuuaguacacagaggugucauuuaaaagugaaauucaugaaggaauauuuuuuaccugcuggguuuaauuucagaugccuguguuaucauaaaaggggaaccaccauagauucuguuuuaaaacuuucuacaaauuguauguguugauauuaacuucugcagauggagagaggaaaagaggaaaguaaguaucuuauuaaagaguuuuuuucccaguguuauuugaauauuauuaaugccaaaugaguucaguuccuauccuccucccuuccuuuaaaaguuuaaauuugucuauaacuuuuuuuuuuuuuuuuuuuuuugugagauggaguuuugcucuuguugcccaggcuggagugcaauggcaugaucuuugcucacugcaaccucugccucccaguuucaaacgauucuccugccucagccucccaaguagcugggauuacaggcgcccaccaccaugcccagcuaauuuuuuguauuuuuaguagagaccggguuucacuauguuggcuaggcggguuuugaacuccugaccucaggugauccgcccgccucagccugccaaagugcugggauuacaggugugagccacugcacccagcccuugucuauagcuuuuuaaugccuuucuauuguacuuuuuucuggaaugagaguuaacaguuaugauauauuucacccugggaaagaaauaaucauaauauucaauaugaaggauuuagguuaaaguaaaaggaaaaacacccucuggcaagaguucuuaggaucaauugcugagggagagcagagccugagguguuuuugccucuuacuaguaguguauaauccuuggccaguuaauuaaucucucuaggccuuaauuuucucauccguacaguggggacuggaaauaguguuuaucucguagguuauuuugagaauuacauaagcagcuauaugcaaaaaaauauagaaaagugcuugacauauaagugcuacuuacugcuaguugccuugacuuauugcuguaaguaaacugugaaaacaaaaauugugauuuuaauguugugauacagucagcccuucauaucugaggguuccacauucacagauucaaccaacugugauugaaagucuucaggaaaaaaaacggaugguugcaacuguacugaacacgugcagacuuuuuugucguucucuaaacaauacgguauaacuauuuauguagcauucacauugccuucgguauuuuuugguuaaguuuuuaaaaaauuuauuauuaccauuuugagauggagucuugcuguguugcccaggcuggagugcgguggcacaaucuugcucacuguaaccuccgccucccggguuccagugauuuuccugccucagacucccaaguagcugggauuauaggcacauggcaccacacccagcuaauucuuguauuuuuaguagagacaggguuucgucauguuggccaggcuggucucaaacuccugaccucaggugaucugcccaccucggccucccaaagugcugggauuacaggcaugagccaccuguaauacccggccugcauuagguauuauaaguaaucuagagaugauuuugaguaaaguauauaggaggauagguguagguuauaugcaaauacuaugcccauuuguaugagggacuugagccaucuguggauuuugguaucugugggggguccugaaccaggcccucacagaucccuagggagaacgguaacucuggaaggagaauugaguagguggauccuucagguuuaaaucaccuaucuggcauauugggcaauacuuguuuguuggaaucuguuuucuacccaauccugugggggaaaugugggaguagagagagaugaaaaccucauuaagggucaggugcgguggcucacgccuguaauccccgcacuuugggaggccgagguggguggaucacaaggucgagagauugagaccaucuuggccaagauggugaaaccccaucucuacugaaaauacaaaaacuagcuggacgugguggcgugugccuguaaucccagcuacucgggaggcugaggcaggagaaucccuugaacaugggaggcggagguugcagugagcugagaucacaccacuauacucuagccuggugacagagugagucucugucucaaaaaaaaaaaaaaaaaaaaaaaaaaaaaagcaaacuaauuaaggcugcuuuucugcccuccaggaaggaaggauugccccugaaauguacuuaaaauaucuuugguaagcacuucauuaaaggcucucucauuugagccucaaagcaacccuccaagauaaaggguaucaucuuaauuuauagaugaauaaggaagcuuauccagagacaggggacuuggucaaggucacagccagucaagugcagcaucugggcuugaacccacaucucucuaacugcacagcccucuuuuucugcacuuccugcuccuaagagauucacgggacuuggugguucuuauucucugugacugguggaauguguacguaggguuuguuuuccaugcuuuagacugaacauucccuagaggggacuuuuuuucaagucaacauucucuguucaaaaggauuuugcuuuuuucaguuuuacuuucuagucuacacccucuagccccguggucuuucaucuguuccaaaagaauuccauuuagaaaaucgugucagauugguugcagaagcaggcucagcauugacaguugugaucggcuccauuagguguuuauuauuggcaacucacugaacauaaacuccugaagcuugagaggguggccuuuggauagaaucugauuccauguauucauuuaacagacaguuaucaggcaccugcagcugacaggcaauaugcuaaguuuuaaagaaugcaagguggaucugaugggguggguaucugccuucuggaaaugcuaaggcugguggggaaaggagucaguccaaccagaccaccuucauggcgguauaaggguuacccaagagggaaggaugcauuugggaauauggaaggggagaaccaagccagcuguuuuauagacaucuguuccuugggaaucugaagcuuuuuauagcugugugcagugggugaguuccgcucuguuagggaagcaccauguggguuuaucuuucuuuccaccuauagucagcgugacaccuaugucaggagguggguagagaugaggucuuaggguccauugguuuuuuaacuccuuuguagguuucaugauucccuggucaaauaaucaggugaaagaucaugggccauccacuuugucugcaccaaccugcucccucuuccguugacacaucacggccagucuucugccguggucugaggauaugcccuccccaggcuguccguuuguucuuaucccuucucugcauguuuugaugguuucugugauucucuggaccucuucuuccauauugaggguggaagcuaugaagauagucccuagugaguguguuuaggcuuucaguugugacuaggguacagucccaugcacauggaggugguggccucucccaucuccuugccuuggcaugugcucuuuagucgauaccauugccuuucucagucuccucugcccagaaugcuggaacuguucugccauccugaccacgcacagggcagucagcaccuuuaucugcccuuccagagugguccaugcacaucucagcuugggguuguuauagaucuuuucuguuggucucuuucauuagacuacacuuuuugaauccauccucuggucuagucuuuuuuuuuuuuuuuuuuuuuuuuuuuugagauagaaucucgcucugucucccuggcuggagugcaguggcgccaucucagcucacugcaaccuccgccucccagguucaaguuauucucaugccucagccucccauguagcugggauugcaggcgugccaccauacccugcuaauuuuugugcuuuuaguacagacgggguuucaccauguuggccagcuggucuucaacuccugaucucaaguuauccacucgucucggccucccaaaaugcugagauuacaggcgugagccacugcgcccagccuauucuagucuucuuuugaaacacagcacgugguucauacgugguacauaacaggugcuaacuaaaugcuccuuuaaguauguuaguucaggucucgaaguuaaccuauacuauaaauugugcguguguaugugugugugcguguuugugugugugugugagagagcgagcuuacaguuuuuguuauuuacuuauuuauuuauugucucaguuuugaagacugcgagacggcagcaucaucucuugggaugaaagguuagcaggaagccuagaucaguugaaccccuuucaggaucuaugagauauuucucuuccauaacuuacacccaucuccagugcuaagaacucaggccuuccucuuugcucuuccuuucagagaguauuaugagggaggccgaggacuucaugcuccggacagagaaacggcgcugggauuagggauugccacuucugagaggaugcugggaaucugcagggggagacggaaauucuuggcugccucguugagucuucucugcaucccagccaucaccuggauuuaccuguuuucugggagcuucgaagguaagaauggaagccaaagugagagggaaggagggaagaaagggaacauuagcugucauagaacccuagaaaagaaacucaaagccaucuaauaggaauauguauuuccagucaugggaagugacuugucuagaaucacacagguaguuggcagcagucaacagugugaggagaaaaagggaaaaacaagcaaaauaaggcauaccuugauguagugggagugugguggguacagaaaugucaaaucaagucaauuacuuugucgauaaugggagaaaagguugggcccuggagaaauuacugagcuauucauggagccauauguuucaagaguugguccaucuuuucauucauuuauucacccauucaacaucguggugguggugguggugguggugguguuuuuuguuuguuugucugguuuuuuuguuuuguuuugguuugguuuuuuugagacggagucucgcucuguuaccaggcuggagugcaguggcgcgauuguggcucacugcaaccccugccucccgaguucaagugauucuccugccucaaccucccaaguagcuaggacuacaggugcccgccaccacacucagcuaauucuucuauuuuucguagagaugggguuucaccauguuggccaggauggucuccaucucuugaccuugugaucugcccaccuuggccuccaaaagugcugggauuacaagugugagccacugcgccuggcuguguuguuguuauuauuggaugccugcacuaaacuuggugcugagaauauggagauaacagaucuggagauucacaggauagcggaggagacagauaggcuaagaaaugaucgcggcacguugcgaugcgcguugugauggaggaaggcagggugcugugggagagguuuguuggagcugucagaccugggcuggggaugaaagaugaucaguuacaugaggggccgagcgcagggaggcaacaaaggauuugcucuccccaaacaaauaaaaacaaaugaugaucccugcuacuuuccagaaaucagugggaacagcaagacucaccauuuuucuagccagccguuucaaauacagugcaauguuuugccugugaagaugguuuucuaggcuucagagagagagggaacggcaguggugaagagcugacuuuauuuuuauuuacccccacacuugaauuucagaaggaagaucucaaaugaaaaucugucucaaggaagucacaacuguguuuuuaaacguuuccuuuaugcauaauuuuauuggcagcucaaggcuaccuuuuaauuaggaucuccacuucacuuucugagauuugccuugaguuagcuagacugaauauaaacaaggugaaacugugugccugucuagcagggagggcucaggaugcucagcccagugccgaggccaagugacacaccccugucccuguucccacccuuuaggugcaucccuggaacagucagaaccuucaucuaagcagguagauagagccaauuaugccauggcaguggaugggaaguuuuuggaaaagggacuagagagaggaaggggaggugauguuggucuugauguaaggaaacauucucccagagaucauggaaaagcccuuuuuauaaaagaaguuagagguaccacccgugcuaguauagguuuaauaaguagaacauugacuuuuaacuaagcugguaauaauaauaaugguauaacaaggacagugaugacagacacugugauucugucaucacagugaugacgacaguacaaacaacuaguauuuugaguauuucuacaggccagguauuguuauaaggacuucuacauauguuuacucuuucuucacaaugauucuuugugccaggugcguuuaauacaccuguuuuacagaugggggggaugaggcagauaagcuucagugaucugcccauggucccagagguggucaagauggagccuggauuggacucaagagcuugaguuguuaacuguaauaccaugcuauagauuggggccucaaugagugauugaacuuuggucagggauuugacagggugucacacaaucugggugaggaaaguuguagaauuuugauuugcacucuuuggcagaaagccaacccaaauugauuuuuggugaaaagggaauuugauaguuaauaggauuuguaaguucagagguagggcaggcuucaggcagaguuggauccaggggcuuguagcuaggucucccucuaucccuuuguucuauuuuucucugccuugguuuuucucagggugacuuuaucuacauagaggaaguuucaggcuugcauccuguccucaccaaccccaguagaaagaggauuuuuuccuuuugcuaauucacuaauauugccucugauugaauugccugugguaacuccuccugaaaccagucacugcgguuaugggaggggagugagggaggcugguacuuuuuuguuaacuuuaagcccugugccuauuucuggucacaggaugauggagaguugcuuaaaacacgcugggugagauugggugacugggauggccaccaaaggcaaauggcaugguuucccaaaaggaagagauuagaaguugaucuggauuauggagaauucauaacugucuguguuuaugguuagauguguugauggucaauuugaaggcagcuuagaaccaucguggccgguggagugaaugugaucacuaacuuugagcaauuucaccagacuggcagauagauuaugggaaacuggaaagaucaugaaaauacuuugaggcaacaugacagacuggguguaggugcuguaucuaucaacaugauccuuuagaaugaaccccacacuugggaccaaaucacgagcugcauuuaguaggggcugggugaugugggcauguuaacacaguauuuuagcuaggaugacagaggcaacagauuucuguuacugagugucaguuagugugcauucgggcugccgcauuuguauuuguggacucuaugcuguaaggacaaucuagaugaggcagcaugcuuaggaaaauccaggugagugacagugcccguucaaaucugguuauguaagaaauggugggaagaauugaggauguuuaccuuggagaagcagaggcucaggguguacaugcucagcuucagcaaacagacaaagggcuguccccugaaagaaagauugggauugcucugguggccccaaaccuauggagggacguggcaaggagccagaugucaagcuccucauaaugaggaucaugcugaccagagcuggaaugagcugcccaggagguggugaaauaccuggcaugaaagaugcagaaacacaaguccaguaucgugggagggagcugagcgagacaggcaguuacgcaaggugacccaucugacccugccugacccagagauccugaggcucugggaaagucugaguauuuaucagaacacaaaggcaaugccuccaugaagcucccugcugguugcuacagacaacagugcauuucccaaagggcccgcagagacguuauuuucuuuguaauuaaacaucacaacaacguuacaauccauuuauugacacccuugaguuuuugguuucguggcaggugaagccauaaauaaggggcagaguugcugccuguauucauggaaauacuauucauacuuuauguggguuuauuuauuuuuugacucuguuuaauaucaauggaccuccugagagcagagccaagaacucccucugagauguggcugcucucagcauaggguuuuggaguuggauuacacgccgcagcaugauauauugagagagcccuggagggggucagcugucucaggaucucaaaucaccucagccagaggagcuggaugaucuggggcacacuugcucuucaugguaggccuucguuucuuccgacgugaaaugaaguugucgagugcacuuagcagggugccgacauucuaccuacaagcuucugauucuaacgucugauguaagugaacugaaaaugaccagaaucuuccccgauuaaggggaauuaugacacuaagagggagucggcuuaggcuuacugugauuugcuccugagcauggaagcaggaucaaugcauaaauguuauggggaggcaggcauugucucccuguaagaaagaacaccuguuucagcgacucaguugucaggcauggaguucaccaucugggaaagagaugagauucccauuccuugagacaccuuuugaaggcccagugaccucuggugaaggacgcucaucaggugguguuuuuguuagugcguuaaccccuuaguucuuaaacccaacuccuugcuuuauuucuuucccaguccaccuuucuuucucuaacaucucagucagcauucccagcucuacgccguucaggcccuaaacuugggaguaauccuugucucccuucauucacuccgugucucgguugccaccuccuguugagucuaagcucggccuuguagcugcgucaguuguuucccaucuuucaccacugcugucgcccuggcucugccacuccuccuuugugaucaggacuaagcacaacagcccacuuucuugcaggucugcuucguucuucagacuccucagggcugaaucagagcaccgcucugcuccuugucagccccucuggcccauccccuaauccccaccauacugccucgcauuaucuggcauccucuacccagccacgccagauucuuuuaaguccugguguacaucgcccucugugggcucugcucuucccaccuguucuuucuucucccugacacccucuauugcucuuacuuccuuccucuucuuugucuggcugccuagauccuugggucucagcugaaacacaauuaauugcuccugacccuuaacuagcaggcuuccuuggcucccuauuuaccuaacuccuuguauguacccuuaauacucagggcucuuuauuuuucuuguuuuuauaaucuuuuguuuucacagcagauuuacaagcuuugggaauggagaaagcgggucucuuuagcucgcccuuccaccucuagcaccuacuguagugccgggagaagauuugguccccaaauguuuguucaaugaaugagugaacgaacacaugugcccuccuccgacuuugaguacugacaggucucaucauugccuccuggauccacuguggacuccuuaccaugacucuggggucuuccacaauuguuuuuuccccaaccuauacugucugucuucaggguauaauacccuguugaacuaccugaggaaacuauuucucugauucuuaauuuucacucuugcggucuuacugcccacuauucaguucuuuuuucuguaacccucccucccagccaacaccuucaaugcccauauucaaugucauuuuccccuaaugccagaucccauguggaaacaucuaugaccagcagucaucaagagauauuuugcuuguuugaugucuuucuaaccacuuaccuaugaguuucuugagagaaggaaguguuuuauucgucguuacacucccagugucuaacugagcacucgcuccuaauguguccuuagugaauguucccuggguaggacugugguauugagggacacaggaaccgcugguagggaagggcucuuggugcugugagcaucugugauuuuugagaccugaggacguggcuccuuucauuuggucgugauguuaauuccgggacuggagugaaucugcucaacuauagccccauuugaauuuagagcauaccuguuauuuucuaucagaaucaccuuuucucagagcccaguggguuuuauugugggaugugguucuucuuuucuguccaucaaggagauguguucggcuauuagagacuuaucagcauguggaaaaagggugcuuuucagccguucagaaaacucuucacacaugcugcccucugauaauucauaaccagcucggugcaaagguuucccauugucagggaggcaguccgggacaauguggguguuauuuaaaagcaaaugucuucagaggaugugaaguccugaacacuuaaaaccagugucaugaaaaggcagaggaucuucacuucugaacugauaucagccugcaccccuguuuugucauuccuaaagccugaguucccuguugcuuccauuuuuaucaacaugaacccccucugaaaugaauguuuuugaguguugucacaguaaauuucaacagaaaaaaauacgguuccgauacugggcuauuuugaagacuggcagugagagugaaagaauuguaaguuaaagcuuuuucuuugccuuauuauuaugggggaaucccagggcacuugugugguggaauaggcgggauggggguggugcauuuuauccaaggaggguuuguccagacaugacugauuccccagcccugugucugcucccccaucccucagccccucaucccagagagugugcuggaaggucugggaagucagauuguacaugguauuggugaauaaucugcuggagcuuucaguaucccccaagucuaggcuaugcagcagcuuuagcaggaaagccuauuuuugcuguccugccagugguccaaauguaucauuuaguaaggauauuauggaguauaagaacauaggaugccgaaugcaaaaugaaaugggacuuauaauacaaaaguuguguuuuuaaaaaauuggaucaaaaaugaagagcuggccgggcacgguggcucacgccuguaaucccagcacuuugggaggcugaggcgggcagaucacaaggucaggagaucgaaaccauccuggcgaauacggugaaaccccgucucuacuaaaaauacaaaaaaauuagccgggcgugguggugggcgccuguagucccagcuacuugggaggcuggggcaggugaauggcaugaaccuggggggcggagcuugcagugagccgagauggcgcccugcacuccagccugcgugacagagcaagacuccgucucaaaaaaaaaaaaaagaacuuuuucagccaauguuuaauaaguguuagugcugagcuugagcaaaaucuugcaacaaaugaaaaugugagcaugcaagugggcugcucugaauagugcccaggugacacaugcaucccaaagaaugcccagugcaugugucuguaguucuuaccuugggacuguuaagagucucuuuaaggucuuggcaucugagagggcaguaaagucuaucccaauuauuugcuugugagaugguuacaaagaugaccucuacuuuccuuuuacuuuuuuuuaagauggagucuugcucuauugcccaggauggagugcaguggcgcaaucucagcucauugcaaccuccgccucccagguucaagcaauucuccugucucagccuccugaguagcugggauuacaggugcccacccccaugcccaguuauuuuuuuuguuuuuuuaguaaagauaggguuucaccauguuggccaggcuggucuugaacuccugaccucaggugacccgcccaccuuggccucccaaaguacugggauuacagguaugagccacugcaccugaccugaccucuacuuuucuuauacguagccuuuggucuuaaaauaauauuggcuauccugcuaggguggaacaaauaauccugcugcauccauuggcugcaucuccuuuaagaggucauggcaagaggccuggaccaggaaucaagaaaugugguugccgugagucccaacaugcaacuuguaugaguuuccuguggcugcuguaacaaaccaccacaaacuuaguggcuuaaaaaaaaaccauacauuuauuaucuuacaguuccagaggucagaagcucaaaaucauucucacugggcuaaagucaagguguuggcaaggcugguuccuucuguaggcuccaguaaagaauccaucuccuggucuuuuuaagcuucuugaggcugcccgcuuuccuuggcuugugacgccuuccuccauccccaaggccagcaguguggcaucuucaaaucuuucucucugaugcuaaccucuacuucuguuguuauaucuccuucucugacugugacucuccuaccccccucuuauuaggacuauuauuauuauuauuacuauuuuuuugugauggagucuugcucuaucaccaggcuagagugcaguggugugaucucaguucacugcaaccuccgacucccugguucaagugauucuccugccucagccuccugaguagcugggauuacaggcacgugccaccacgcccagguaauuuuuguauuuuuuguaaagacagguuuucaucauguuggccaggauggucucaaucuccugaccucgugauccacccgccuuggccucccaaaguacugggauuacaggcgugagcugccccaccuggccagacccuuguaauuauauugagccuacccagaaaauccaagauaacaacccugucugaaaauccuuaauuuaaugguacuggcgaagcccuguuggccauggaagaugacauauucauuggccauggggauuaggauguggacaucuuuuggggggucauuuuuccgccuuccauaccacuuucccacagucccaugcucccacauucucuccauccucuucuuguccuuuauggacagagcagagauggugugccaugcacuuuucauauggacaucucauccuucccuuggaguuuuggguucuugcauuugaauuugacauauauguauccaacauuucauuuacagcucaugagaaaggcacuguauuuagauguauuggucugaauugucugaaugauuuaagaccauaauacuucaucuaugauagguguuuaaucaguaacugaugaugcguuaagguuuucugaaaagauaaguucagaaugucugcucuuuguugcagguuuccugguuuuaagucaauuuuauuuuauuuuuugauuuuggauaccaauuuaacaaaaggagggaggauuuuauucagaggguccuuuugauguuugaauaggucucuuaauuuuaaguaaaagauagccauuuauauaacuacuuuggaaaacuuacccaaaguauuaccaagcaaagccaagcauaccccaugaucccuuagcucuaccccuagcaauacacccaagagaaaugcauguagguggaaacaaaagacuaguacuagagugcucacaucagcguuauuuauaauagcaccagacaggaaacuaugaaauguucaugaacacuaaaaugagaauaguggggcugggugugguggcucacgccuguaaucccagcacuuugggaggccaaggcaggcagauuacuugaggccaggagcucaagaccagccuggccaauguggcgaacccccaucucuacuaaaaauacaaaauagcugggcuugguaguaauuagguaguaauuagcaugcuuguagccccaccuacuagggaggcugagguaggaggaucgcuugaacccuggaggcgaauguuccagugagccaagaucaugccacugcacuccagacugggcaacagagcaagacucugucuuaaaaaaaaaaaaagaauaguggcacguuuauauagugaaguacuauagagugaugaaaaugaaauuacucucaguauugagcaaaagaagacauacacaaaauaauacauacuauaggauuccaauuauaccaaguucaaaaacaggcaaaaauuaauguaggcucuuaccaauucagauggugguuaacucugguagggaggguagaacagagacuggggcaggccccaaggaagacuuugggaugcugcuaauaauuuaauuuuaauuuuuguuuguuuguuuuuguuuuuuuuuuuuugagauggagucucaaucugucucccaggcuggagcgcaguggcacaaucuuugcucacugaaaccucugcuccauccccagguucaagcgauucuccugccucagccucccaaguagcugggauuacaggcgugugccaccacacccagcuaauuuuuguauuuuuaguagagaugggguuucgccauguuggccaggcuggucucgaacuccugaccucaggugaucugcccuccucggccucccaaagugccaggauuacaggugugagccaccacgcccagccuuaauuuuaauuuuaaccugugugaugacuauauagcugggcucacuuuaugauaauucacuaaguauuucacuuaggacuuguucauuuuucugaauauguuauuuuaguuuucaaaaaacuaugcaaaucuugaugguagcagaauuugaagugauuuuguagguuuugcauuguuuuuagaugagaggaauuuucuuaaccuuugggauaugugaaucuaugucauuguugggcuuugaaguucaaaugcuuuuuaagaaugaaacuuuucuuuagagaucauuguuuaacacuucuauguaaugacauuggcuuuuuuccuuucugauauaccauuuggacagauauucacccuaugagaguggaucacagcacugauuucaagaucugaaauuuacucauaaaaacccuaaucuguaugaguguuuucaucaguuggaaacaagaccaguauucuuaccagcucuugcaaugacacggcucuaauuaauacuaaaacaauauuacugcuugauauugaccccaagccacauuagauaauauucuccuuuguguuauucaacaaacaugcauuuucauaaaauccuuauuccuggaaauggaaaaaaaaaaaaccuuuuauuauuguauuguggaagauauagaaacacaagaaggaaauguacuauuuaaacuauaacaauaauggaaacuguagcaaucguuucuauuuaucgcauguuaaaccaagauuggcugcaucuggcuugcacuuguguuggguuuggcccgccuacugcuuuuaccauuuuugaauuuguugcuaaugguuaaauauugggagauugcacauaagaagucaugauuuuuggcuuucccuaaaaaaagugaaaagaucugcaaaaccagacccucauuucaucauaguagcuacuggcuggagcugaguacuggcuguccaugugcacagugcucggaugauccauuuugucacgaucuccauccuuccuuguugauccuugugucaucccugcacugucguuuacauagaacagaauugagagggaagagcuucugguaucugcguauggcagugguugacucugucuggcucauuuagacuuugaguuuccaccuuuuggccuggugcugggcuaggaauuuuacacauauuaucucauuuauucccccaaacaacuucauccuugucccauuuuauagaugaggaaacuaaggcucagggacguuguaccguuugagcaaggccaccaagauagcaagggagccuguccuugucuaaaaagguccuuuauucugcagucacugaagaacuugcagauauagaaacaacugguagaugacauuucaaagucgauaugcucaagcuuuagacaaggacgagacaaacccugagacaagugaaaaugggguaucuuggacaacagagaagacaugcgaacuucuguggcuagcaggauucuuauaagccaguauaacgaaaaaauucaguuaauccuuuaaugcaguuugcauuuuguuucugucauagacucauauaaucaagagaaggaacggacaucaggagucaucuaggcuggcuuacagccuaaacagauaaaacuuuugaaaauuacagaaggacuuuuuauagggcaaauguugaugguugggggaacauagcccccaaggacaaguggaugggaguuugaauuuuaguagacaucauuuaaaucacagagugaaauagacaaguuacucaacaucauugcaggucaguuucuucuccauaaaaaggagagcacagggcugggcgcuguggcucacagcuguaauccuagcacuuugggaggcugaggagggcggguaccugaggucgggaguucgagaccagccugaccaacauggagaaaccccaucucuacugaaaauacaaaauuauccaggcgugguggcacaugccuguaaucccagcuacucuggagggugagacaggagaaucgcuugaacccaggaggcggagguugcggugagccgagauugugccauugcacuccagccugggcaacaagagcgaaacuccaucucaaaaaaaagaggagagcacaaccuguagcuuacaccgcuguuauaaagacuaaaugaccuguuacauccgacaguggucauuuaacaaaucuuuguuuuuccuuucauucucauauuuuucuagaauccuggaaagucuccugggagggaugcaaaaacgucacccaccugguccagagagacccuuguuuuacaacugaggaacugaaaccuagagaacugugauauaacgaagcucacagccucagcagccuucuucaggcauuagaaaggggcagggagagacuuccuaacauacugcagcuguggucauaaaugcacuggcacuuccuugugaaugcauuggccauguuuggagaaaauuaaauuauuucaucaaaaugaccuguagugagaacuuuaaagaacaaagaggaaagggccauccucugaugcagaguuuaaucacuuuccuaacagauauguuggauggggcugucuaagucccaguccuccuuuuaaaugcuguguguccacauugagucacuuaaccucucuuaccgcaaauugacucugcguaaauugggggugcuguugaggguuuuugcaagaugaaaacgaguccauggugccuagcaugaauuagguuugcagagucauuuugucucagcagcugcuuuggauauguugacuguacuucuggaagcaacaggucgcucaaggagucaacagaguugaauauuuaaagcuacgggaugggagguggaaguggagaugggugcaucacgaggucuggagauugagaccauccuggccaacauggugaaaccccgucucuacuaaaauacaaaaaauuaggcaggcgugauggcgggcaccuguaaucccagcuacucgggaggcugaggcaggggaaucgcuugaacccgggagguggagauugcagugagccgagaucaugccacugcaccucagccuggcgacagacugagacucugucuaaaaaaaaaaaaaaaacaaaccugcauugauaggaagaacccuggccaugccaagauuccuucuuucugggguggagccuuagauaauggauaguuggcuuuuuuuuuuuuuuuuuuuuuuuuuuuugcuccagcagagggcacacagugccccauuucuggcacacagccagugauggaugcuugagguggugucccagcugggaacccucuccauugcaccuguugauaacaauuaugauucauuugcuuggcccucuuggacaugagcuuucuugauacagugaaauaauccccccauaaccuaauuagggaagaaggguuuaccauuucagaugaggucacugagcgccagugccauuggguggaucaccaagguuauucauucauuccgcacacacagucaggcacugucuagggcacugggcauagagcccugagccacaugggcaaguccccucuucucauggagcuuaguuuuccuaguggauggagagagaugaugaucgaacaacaucaugcucugcugaguguugauaagugcaacaaagaaaaauaaagcaaagugagaugauagugccagggcaaugggcuuggugaggaguggggaaagggaaaugcuguguuaauagggugaucugggcaggccucucuuacuggugacauuaagcagagccagguggugaggggaaggaaaagaguuucaggcagggagaagagcaagagauggagagugcuuggugcuuuuguaggaugccaaggaggagucuggguggcuggagagaaagagaagagaggagaagcaacaugguggaugaggucaggaggagaagcaacaugguggaugaggucaggaaggguaggcagggaccugucacacaggccugcaaaguggaucuuggcaccuuggccucuggcuucucauuccuugcucuccucuccucgggaagcuuaguccuuucaaucuggacuugccuuuagcugcuaaucaaaguucagaggaaccugagagaguauuuccucuucuugccuauaaggaggucaccuagaucucugguuccagcauuugcuagaugauaagaaucaccuggggcauuuguuuaauauauagacuuccaguccaccccggggcacuuaaugaacaagacagcccagaauccugcccuagaucuacuaaaugggguuccucaggggaggugcccaggugucuguauuuugaacaagugccucucuucuggcccacuugagaaguuugaccuggauuaagugcagccucuggguuccuggucucagcgcccccuccuccucuccugggcuccaggacuuggauuuaauaauaaccagcaugguaacaacaucgcugauggagugccuacuguuugucuugcacaacagccucacucccuauuuuaucuccucugacuuaaaucuuaguuuucacaccaagugccuggcaaauauauuguuuguacuucuguuaaucauuuauuauguugaauugcacuucauuuauauagcauacuuccuuuuuagaacuuuccuguggacucuaauaacauugccuacaaaagugcccagcacaaagugccagugccauuggguggaucaccaagguuauucauucauuccgcuggccaagucauuguuauuauuauuuguuuggauuucacacacuccagauagugaggacucaccuuuccguagucaucuccgaauccuuagucuuuggcaaaauaccugaaauagaguagaugcucaaugaaucuugaagugccagaaauaaaaauaauauuaguuacuauuuauggagcauuuauuguacaucaggcaccaaguccuugacuuguaguaacuaguuucuuccucagaacuguccuaugaaguaggugcuaauauucuuauuuuguuuugagacggagucuugcucugucgcccaggcugcagugcaguggugugaucucugcucacugcaagcucugccucccggguucacgccauucuccuaccucagccucccgaguagcugggacuacaggcgcaugccaccauacccgacuaauuuucgugcugauauucuuauugugcagaugggggaacagaggcacagagaaguuugaaaauagguaaagcugagauugaacccaggcaggcaugccuugugugaucucucuaagguuucuuucauuucuuaaauggguaugauucuagaucucuuuuuuuucuauguaaggucgcucccuccugguuaguucuccacagggaucagguagaguugguccucucccuaugugugaauaaugccucacagauccuaggaaauguacuaggucggaacuuccacccaggcucagugggcucgguugugucuuuuaucacuuuucaagccaugcauuuucuuugccuccugggauccugugccaguugccuuggcuucuguggcugauggaugauuggauccagccuuucagggcagauuagggucagccugcuccaagcaguagcgagaaccgggcccucgccuuuccuuuccuagaagcuguaucugugaguuaacgcuucucaaaaugcugcacuuagcucacuugagcgcaguuugggggcagauugguucuuggacucuucaaauccccagugcagacaugaacauaagccuucugggugcucagauugucagggcacacacacgcacugguucugagccagcacugaaggagacaggucugacagagacgagcaccucacccacggcuuaauuucauguuuuggauaaacacucagaggugaguggcaugaaggggcggauaagcaaagaucaccaagagugaguauuuacaaaauuuuuucauuuugcucucaccagucuucuuccuaauagcucuugcugcucugauggcucucugacaaauagaaaggaggcuguuuucccucugguccacaccuuugcuccaaacagucccuguauugcauuccagaugcuucagugacagguagucaucagaaagagacccuuggauugcauauuuucuuggcuucuucgcuuguucuguucccugggugaaaucccucggcuccuucaggcuuugaggcaauuccuucccucgguccuuagugugggauaauagaaauuaacacuugguggggcuuugccgugugugcugcucuaaagcacuugcauuuauguucaugacacaucacccagggaggcacuagcaucacccuccuuuuagagggaaaggcaggugcaggauguugagaaacuugcccuaggucccaaccugugaguggcagagccacuuguguggccuggagcccacguucucacccaccauauauacagugcaucuugcugccugucuuuccuccuucuccucccuccuuucuaugacaaucauuuggcuguagguaguuccuccucugugcugagcacuguaccagucaguaggaaacagggacaaugagguguuuuccagggcgugagcguggcagagccauccagaaguccaaguguguccccggugcaaugagaacacaguacauaaaaccuaauagggcccuguagggccagaggucaggagagggcaucacggcagcaggcaugcucugaggacccaugggaaagcacguugucauuuaggaagacacagaggagccacauagccugggcaagaggaagacuagcagcucccagguacgccaggcauccccauuccauucccaucacagaggagcauccaccuccugggaguggggauaguaggacuggagcggacaggggcuuugcagucagaacacucaggguuugaaaccugucuguuccacuuaccagcugggugaccgugggcuugucucuugccuucucauguguaaguggaaacaacaauaccguccucacagauguauuugaaagucuaaagaaugaugaguuuugcaggcaacugacacauauuaaguucucagcaaauugcagauacuuguuuuauuccuuucguuuuugaggagaucauguauugauaaacuucagaucugugauugcaaauaaaauagaguauuaaaaaaaucuguugcggcacauaguuguugcucaguaaauauaaagcaaaggcauaauuugcacgcacuuggacuggauucacagccagcggggcaugauggaaaaagcacaaaaugagaacugagaguggcugaguggauugcucagggucacucagcugguaugugaaagagcucacuuucucauugaaucuccacaacagccuugugagucaagcugggcuaacguuaucugucucuuagagaaaauuaaaacccagggaaggugaaugucuugugcaagucaaauuacuggauuguagaauaaugaacuucaucacuaaauagccaugugacaagucgaggacucccuuucaucaucuguaaaauggggguggugauaucugcccugacuaccucaaagaguugugguggaggucagaucgaagagcaauaauaagccuggcuucuauauagagaaugaucuaugguggacaggaauuuaggccagaucaccggcuggguagccaacauacuuuuacagagaagcagugaggugaccugaacuuagauggugguaguggcaauggagaugaggcagaaguggcugccuggggauagguuuuggagguagagguuuuaggccuuggugauguuuggguugugaaggagagagaaagaaagagucagugaugacuccagguuuugaccugagcaaauggauacuggcagagaggucggugggaagagcugugugggacgagugauccauggcugguucaggacauauugauagcugaucaaagaucugacagugaacuuccaacacgcuccuaccuggguauauuaagccauucuugcguugcuacaaggaaauaccuaaggcuggguaauuuauaaagaaaagaggcuuauuugacucacgguuguguaggcuauacaggcauggcaccggcaucugcuuggcuucuggggaggccucagggugcuuacaaucagggcgaaaggcaaagugggagcaggugugucacaugaccagaggagaagcaggagagagaauacggggaggugccauacgcuuuuuaaacaaccauaucucacaaggaucgcaccaagagaauggugcuaaaccauucaugagaaaucugcccccaugauccaagacccucccaccaggcuccacugcuaacauuggagauuagauuucaacaugagauuuggaggggacaaagauacagacuuuaucacuggguguuggaacucuugaaccagugacauccaauagugaggugagcuagaagccagugucaaccaucuuuacuaggaaaauuaaaaaaagacauuauuuggaaagaaagauagggaugccuuuuuaaaauuuccaguggaaaaaagacauuguacuuuuguuuuuauuauaaagaaaaaucugguugaaguaaagcugaagcaucugcgugguuuuauuaggcagugcucucgccaugugguaggguagaaagugcagggguucuugcaccagaagaccugggcccugaaucugaugcugcgacuugcuggcuacauggccuuggagggguccccugaccuuucugaaccucagaccaagugggcuccuaguccuugcuuuaggggcugguaugccaaguaagggaacucauacuacaugacaguuccuugcacacauugugcucggugcacgaagguugaugagugagugaucgccuccuuuaugagaacaggauagaaaagaacagcuacaucaucacaugaagaguagucacugaugcuuguggagcacuugcuauaugcuaggugcuguucucugugauuuacuuggauuaacucauuccauccucacaaccacccuaugaggcugguccuauuaucccugcuuacaggcgaggaaacugaaguauacagagguucaaugacuuucccaaagucacuccccugggaaguagaguuggggggacuccagggcucaccgucuugucuccagggaccaugauuuugcuuaccaggcuguauugucucagccuguaaagaggaacccuuguuagccccaucuuacauaugagcaaacugaggccccaaaugguuaaaugaacugcagaaacacagccgguuggugacaacugguacguucucauuugugagugguuaaaagugggguaucugaagcugguucugcugggacccucagccaaggagcaguucuuugcccgaacagaggcuccauccaucuggagggugggcauggaacccacucacguucucuugcacaccccuccuggcucugggcuuuggaaagguuggauuucuugcaaggugauugcaggacagagcucuuucuucccgcugccauuccaggcgcuuggccugugcuuucucagugucucuguuucugugcagucgcuuucacgggguccucaccucauccugccuguggcaucgugagaaauuauggucauggguauuugcaggcuguguuggugcugccagaagccugcucuucucgcaacuccaagcccagcgguguugggugcaguuguuggcuccgcauuucugcacuuggcugcagcacacuuggguguguaggagagucucagcucccuccaccagaaauguuugcaacuaauccaggugacuaauauuugaugcuucaguuguuggucuuucuauagauauuuauauugcuaucaaccugugccuugaagguuaaaacuggcuuuugggccucuuuaaaccaucuccugugcuuugcacuuagugggagugcauucaguaguugaggugguguuccuauuucugacacuuaauuugcauuuuuaaccuacccaagggagcuuguuauugcaugauguaucaggugagcuauugucaagacuguaaucuaauuaaaugcugggguccagaagccucagugcuuauaauguugcagcguuuauuccacacguguggccuucgugcucagagugcugcuuaucauccacacagcagacauauuuugacaaaggcuugccuucuuuuaugaaucccaaacuaguagccuucacauuugcaauuuuccuucuauuuaaugaagugguuccagaucauucugugacaaucgaagguaaacauugcucugcacaaggccuacucuucugggauucuuccaugccucuuucacauuucucaaacucucaggcccaaaugucagauggugugggauuuggagagucgggaauccugagcauauuugaguugaaaauucacacagagcuugagugagugaggauggcgguggcgggggagggcaugaacuguuuuugcuuuuauuuaauggcgcaccuuugagaaugaucuuguggcuuuugagcagguugcaggacuucaaggucuccauagugguuugguuugcaccuuucuuuuuggauguggagguuuccccuagguggccagcugauuuuuuggugccuccauuuaugcccuaaccccuucuuuuucucuuagaucauugcauaccgagcacauauuuauuaaguaccaaguguacgucugauacuggacuagaguccgagaaagacacuaagauuaagacauaguuucuguccugaugaaaauuguucuuuuguuagucuuaggugauaaugacccuuuucugaagauaauagguccucggaggaaaccaggagaugagaugauggaaacacugauuaaugaguaaaaagggaaauuauagaaaggugggaagcaagaauuuaaggcugagagcaaucuucuuuugcagggaaggacucacuauugccauuuagcauacuugcuauaauagaaguauguaugccgguguucaggaauccagaaaaaggggcaccuaaguaucuggggacauccaagaaagcuuucauggaagaagaugccuccugggcugaaucuugaagcaugacuaggaauaggccaaggagaggagucagaagaccacgcuugaguccugccauuguugggcucuccaggaagcgauggucaaggucugugugcugagaucguaugccagaugugguguuagggaucggcauguuuaacccaaucagucagaugaucccaguaggaaaagcaacacagcaagucugaaacacuguaucauaccacacagugccucagcucucaaauuucucuauuggcuuuugagcccugcagaaaaucagcugugucuuucuacauucaggggguccuucuccgcuucuguacucauaccuugaggugcucucaucucaucccccgccuccuuccaugcccucaucuuuggcucucagugauucuguauuaauagcagcgauuaaacugccucaucucaucagggaggagauauuaaucuucaucaggcccaaggaagagcuuaauuuuuuccugcucuucuccucuccccaggcugccccacugagcucaggcacugucagcugcaccacugucugugggacauuuagugaucugcuucugcagaugcguuucagugaguucacuucucugacucccucccuuagccucccugcacccagagcuucacaggcuguuauugaagaccacugucaggagagggagagaaggggaaaaauacucccucaaauagaaauucccaacuucauugucuugcguggcugcaggguaaauuagaccaggacaguaccgcagcugaaagcuguagguuuuuugguuuaugaaauccuauucagcccuuggagaaguaugccuuuuuucaugcuaugauucugcaguuagcugugaacugaggaugucagaugcccaggggcaggaacaggagacagggaggcucgagaguucaucaagaaauuaggauggaaaagagcuauucccaaagccaggcaucccaggcugguccugccggugugcaccaacagccagugauaacucagcgcccaucaaguuucuacacgugcccagugagcccagggcuggcacgguaaaggacacaugguaucucuuuuaaucuugacaaacuugcgaggcauguacuguuauuccauuuuuccaauaaggaaacuaaggccugagagaguaaguacguacgcugagguuacacggcuugcaaauuuugucuuugcuuucuucacucuuccugucauacucugcccacuguaucuaggaugacuguauaaugucuuguccaaacuggaacacuguuaagaaugcgggggggauagggacauacauggggacauacaguuuccaguccauggaaacugggaagcauggucucucuuuuuuuuuuuuuuuuugagacggagucucgcucugucacccaggcuggagcgcaguggcgugaucuuggcuuacugcaagcuccgccuccuagguucacaccacucucuggccucagccucccaaguagcugggacuacaggcuccugccacugcaccuggcuaauuuuuuauuuuuaguagagacgggguuucaccguggucuccaucuccugaccucgugauccaccugccucggccuccgaaagugcugggauuacaggcgugagccaccgcgcccggcccuggcauggucucuuacgacugcccaaccaggaggcugagggaugcuucgugcuccuuuggaagcagagcuagccagauggacacuauucccccuuccucauuucccugcccuccucuccucccaucugagccaucugaggccccugagugcccugcuggcuuuccaaaugccugaugcuagagagccugauuaguuugcuuucacaaugaagaaucucaaauaaccacugccccuucgcccagcaagcagccuucauauccagaccaccuccuaggaucuauuuaacucccucuacucugugggauuggccuuuguucagccuuugagcacaccuggguuggggaaaugguuauuuuucccagaaugggcuuuauuugcauuccacgagcaaucuucuuacucggagggauuccugggacauuaaauuagcagaaaaugacauuagcgcuaagaaccaaauucgauuaccugaaauacauguauuauuguaagaaauaaaacaacgucaucuccaccuccacacccccagaucauacccucacacugaauuguauuaaugccaguuuccuuuuaguugcuggcuuuguguguguguguggcagguugucucaaaggcacagaguguauaauaauaguacaugucagcacaaggcaagcuugugcagaguuuuuccccauguaauuugccggcucuuguggcuguggugugugaaugugaguucuggcagaggcuuguacacucugccuuuacccagccccaucucccuagaauccagccacaucacuacucacuuuuucuucaacuugacaguuauuuuuaaugccuucauuguugucccacucuuugcuuuuucuccaggaaagauucuacggugaaagcuccacccacuucccccguacuugaauccuugggagacuuuucacucuuugcuccuggaggccucugcuuauuccucuguuagcgcugaucuuuagguagagugcuuugcacacgguuggugugugauauguccuggaaaauggaacagugauaucacuaccucauaacgcuguuauggacuuaaguaaugcaccuaaagcacaaaaauagagccagguguguaguaauuaauauuagcaguuaacgcuuguuaugacuaaauguugggaaaguguuaaaaugccaggacuuagcguguguuacuuccacaaaacugacagcucugggagggcaggggugugucgucuuauucaauuuugcauccccaaagccaaagccagaguaccugguaaaugcucagugaguucagcugagugaaugagacaaaagcccauguggggaagggaggcuuugaagaagacauucuauucccuguauaccugggguagguuucgaggguggaauguagggccugagauucaucagaaacaguuaugggacaaauaagaagcaaaugacgcagggucauuucaggcugcugcacaucugaaucugacuguuuacgugggggugccacagucuucugugaagagaggggaggaucccuucugaccuacacagcauccaggucuucgugcaugucagggagguuugaccuguacaucuuuugugggaagccagagucauuuguugacauugaggcagagaacuugcucugaguccaucgaugccugaaacuccuuuugugaccauggcaaguuauuuaucuccuuucuagaaucuaaaauaugguggcuugggaucgggggaguuaaaacacauuuuuuauggauugcuauccucuaaaaagaguaaaaaugaaaauaaaguaaaucaaccaaaagaucagagcuaaagcugugagauucuuagaaggaaacauaagaguaaaucuuugugacuuuagauuaggcaacgguuucugagauaugacacuagaagcacaaccaacaaaagaaaaaaauagauaaauugagcuucaucaaauuaaaaucuuuuguguuucagaggguuccuucaagaaaauuaaaagacacaaaauaggagaaaauauuugcagucauuuaucugauaagggacuuauguacagaauagaugaauaacucuuauaacuuaacaaugaaaagacaaauaagccaauuaaaaaauugagugauggauuugaauagauauuucuccaaagaagauacacagguugucaaaaagcacaugaaaaaaugcucagcaucauuaguuauuggggaaaugcaaaucaaaaccacaaugguauaccacuucacacucacuaggguggcgguuaucaaaaagaaauaacaaguguuagagaggauauggagaaaucggaacccuuauacauugccggugggaauauaaaauggaacagccacuuuggaaaacaguugggugauuccaaaaaaagugaaauguggaguugacauguggcccagcaauuccgcuccagguaucuaugcccaaaggaacugaaaacagguucucaaacaaaaacauguacaaaauuuuucaagacagcauuauucaugauaaccaagaagugaaaacuaccugaaugucuaucaguuaauaaauggauaaacaaaauguggucuagccauacaauggaauguuauucagcuauuacaaggaaugaaguacugauacaugcuauaacaugggugaaauuugaaaacacgcuacguggaagaagccagauaccaaaggccacauauguacaugugauuccauuuauaugaaaugucagaauuggccaguccauagagauagaaaguagauuggugguuuugaagguuugaggaaggcgggaauauggggaggguugggguuuguuuucugggugauuaaaaugcuacggaauuagauagcggugauggcugcacaacucugaauacccuaaaaaccacugaaauguacacauuaaaagggugacuuauuugguauaugaauuauaucucaauaaacguauuauuuaaagaagauaaauggagcugcugaaggcaaaacaggaccaggagacuuggaucccuucauucaccaguucuuucaacccucccuuuccuccacugcugggguauuuucugagauaccuuuguuggggaggaaaaaaaaaucaauuuuucccucuaaguucuuagcuaggacggaccucuguaacaaaagauagauuaacaggagaaaaucaaacagaaguuuauuaaggugugcauuucauguaugcaggggggacacccagggagugcaugguucucaaaggggugguuuagaaauccagcuuauauugcaucuucaacaaagaacaguaaguuuuuagguaaguaacaaaacaaaggaaaaaggcuucgagucccuaggugcagcaacugugggaaggcaaauaucaaauacaugggaauuuguuaagcagauuccuccagugccuucuccuggcugagaagggccaaagcuucuuucaugaucagccuuuguccuuccuggaagaaggagugaagggacacugcuaccuuuguaaacugauguccugcuuuuaggcagggcagagagcuuuuguucuguuucuucucaguugucucuuauucaaaauaaugcuuuugcuaaagugacauauuuugggcuggcagauucugaucuccuacaccuuccaaguuccaggaacauguuuuggaggacuucuaugguuccuuccaacuucgauauuauguguuuccaggaaacaggugugaggcauuccaugguagccagagguagcauggaagauguuuccuuuugccuaugucucugaaccccuuacucugaaggggcgugaccaccgacucucccaguuuaaacagaggugggagaaggucuuugugaugacuuuccacuuaguuuauagaccaguccuauaccagagcugaggccaggauuauuaggaaagagaagcaugaaccccaaacuccucucccucauugaaacaugaaagcuaaacagggcuuccaugcaauuucccaggacaaagagaaacaagcaagagagaaagcaaaaagcccucccgcagaugaacaaagaguguuucaaagcacaauacuacuguuguuuuaguuccucucguaaaacucuucaguggucucucacuacuaauaggaugaaguccagcaucaaggccucucaucaccagugucaucccucaccucugcaccagcucccccaucccauggucucccauucucuguuccuuugaccacaucaguacccucuucugccguccuuguaggcaagcucauguucgucuuucaagauccaacacaucacuaugauauggcuagaauugugucucccacaaaagauguugaaguccuaacccccuggugccugugaacgugaccuuauguggaaagagggucuuugcagauaaucaaacuaggaugaggucauuaaggcggcuguaauucaauuugacuguguccuugugcagaggggaaauuuggacacagaaugacauguacagaggaucagaugaugugagacacacggaggaugucauuuagaagcugaggacuccugagguuacuagaagcuuggagaaagcccuaagcguaucccucccugacacccuucagaaccaauccuguugacaguuugaucucagucuccuagccucuaaaacugugaggcaguacauuucuauuguguaagccacccagguugugauucuuuguuuguuaugguagccuuggaaaacaaaugcccaccaucuccaugaaugcuauggucuuucugcuucuccccagcaagccauucaacaagccgugucccccagcacuuugucguuugauuauuauacuaaauuuacauuauauucacugcuguuugucuaucucccuaaauauacugugauggcaagguuuaucucuuugcauucccaacaacuagugauuuaccugucacuuaggaaagauguggcuggauggauggauagauggauagauggauggauggguaaaaaauuagucucuugauuucuucauuccaaaagagaaaagccaaccuguaucaaagcucaaaguuucaaaugcaaauuaacaugugaaagauauaugugucaucucuauuugagucucuuuggcaggcagucuuaaguaugcauuucccaguguaaauaacucuggauguguuaaaaaguucaccaguguuuaaguucauuaaauuaauguugucauuuugagcugccgaguguguugcagguuguaagcuguucaucacauuucuuuaauuuugcaguagugucaucuucaggaaugugggguguauuaaaaauagaagaguuauuuuauaucaaagagcccaggaccaggaauuaaauuacuagagucugccacuuaaugcuguguggcuuuuauugauuccuucauucaggaaugcagcuaaaaucugagagccggccuucugccauggacucugucgggcaugagaggugcggagguaaaagcaccagcuuccacccucgaguggcuuaauacucugggguuguugcgagaugaaugaagccaaauucaugagcagaaugguaaaugauaugggggacauuaucauaggcggccauggaggcauggauagagggcacccggcugcaaguuggucaucaggaagggcuugauacaggagaugacaugaacacaggaggugcuuugccugcccacaggugagggggugggugguguuucagacucauagaaaggcgaaugcaaagacccugaggcccauucugggacuugaaggcaaaucccuaggaaaagggccgaggugaacggcugccacaggagagugugcgaguagacucugguggugagugcuucaaaggugacugcaaucuucuggaugcagagauuccagggggcuucuaauauaugcagcccuauacauucaaucuuuuccccauuugcgaagaauuugcuuacuuagacuuucauuacucaccuauucuuccauuucuggaacacagacucuggugucugguacuaugcucagcacugugcaugugucagugacucaaccaagcguccuggaguuucuguuuggagaggaggccucauauucucugucaacuucccaaaucuuguucacugcauuccuggaucauaggcugguuccuucuccccgcuucuccugcgaacuccugccccagggccuuugcacuggauucugguucuguucuacugcccuuucagaucuacucauucuucuucagggcauccacaggcuuccuggccccucagcucccuuuugugaggucuucugcagaagaucagccagaaggaaaggagggaggccagggauuccccagccccgcccgcuccccgaggcugcuucucugugggcagaaggaacgaagcaaugaagaccacagcuccugcacacgaccuuucugugcuguucuugugucucauuucugauguccuuucugggaccacuucaggccuagaggugacauggugccuacuaucacuaaccuggggcuaccgaagcucuuguuguuuccguaagcccugcuuuucuuuuuuguuucaugaauuuacugcauaauagauaaggugauuucagaagacauaguauagcugaauaaaagcaaggcauuugaaugcuuaaucauuauuuuccuguagcgaaauauggucugaauacaaggacuuuuaaguagauuaauuacugauucagugacuauaucuaaagcugccuuguuuguuuuuaaaacgacuuuauagaggaugaaagacauacaaaaagcuguacauauuuaauguguacaacuugaugaguuugcagauaaauguacacuggugaacccauuaccacagucuauaauccaucaccucuguuuccugcugcccucuuuauuuauuauuagugauagggcuuaacauaaaucuacccucccagcaaacuucgaagucuacgauacaguauuguuaacuauaggcucuguguuuugcaguagcucuguaggacuuacucaucuuguguaacuguaauauuguacccuuugaauaauaccuccacauuucuuccuccccccagccccaggaagcaccauucuacucuguuauuacacgcucuucaaauuacccaguuugaguauggcaucuuuuuccugcuacagcucugacgaauacaacuagccauucccuuuccugaauuuaacagcucugacgaauacaacuagcuauucccuuuccugaauuuaaccuccucagauauccaaguuuugccccaauaucacuaucucaauaaguucucucgggucauucuacuuagaaaugcaggccgggcugggugcgguggcucaugccuguaauccgagcacuuugggaggcugaggugggcggaucacaaguucaggagaucgagaccaucguggcuaacauggugaaaccccgucucuacugaaaauacaaaaaauuagccaggcauggugguaggcgccugguagucccagcuacugggaaggcugaggcaggagaauggcgugaacccgggaggcggagcuugcagugagccaagaucacaccacugcacuccagccugggcaacagaacaagacuccgucucaaaaaaaaaaaaaaaaaaaaauugcaggcugggcgcagugguucacgccuguaaucccagcacuuuaggagguggagguggguggaucaccugaggucaggaguuccagaccagccugaccaacauggugaaauccugucucuacuaaauacagaaaaaaauuagccgggugugguggcgcaugccuguaaucccagcuacuugggaggcugaggcaaaagaaucgcuugaaccagggaggcgcggagguugcagugagccgagauagcaccauugcacuccauccugggcaacaagaguaaaacuccgucucaaaaaaaaaguaauuauaauaaaaauaaaauaaaauagaaaugcaacccccucuccacuucucaucauucaucccuacuuaauuuuucuccuuaccacuuuuuaauauguuguauaauacagucauauuacaguugacccuuaaacaacaugggaacuagggacacuaacccccugcacagucaaaaauucguguaagcuuucaaaaacaauuuuauggauacauaguagguguauagauuuacagcgugcaugaguuguuuugguacaggcaugcaaugugaaauaagcacaucguggagaugcauauaacuuuugacuuccugaacauuugacucuugauaaccuacuguugaccagaagcuuuaacaguaacaguugauucacauguaguuuguauguauguuauauauuauauacuguacucuuacagugaaguaaacuagagaggagaaauuguuauuaagaacaucaaaaggaaaauauauuuacuauguauuaaguagaagcagaucaucauagagguuuucaucuucaucuucauguugaguaggcugaggaggaggagagauuggucuugcugucucagggguggcagaggcaagagaaaaucuguguauuuguggacucaugcacuuuaaacccguguuguucaaggguuaacuguauuuuggucucugucucccucaacacacacacgcacgcaugcacgcacacacacacgcaugcacacacgcacacacacacuucaugagggcagggacuucugucauuuccauaccccaacaaugagacucaugccuggcaucuuauagguccuccauaaauacuugaugaggggagaacggguaagcaugagagccucuacauguguguacgcuaacucauuugcuucucuugacagccuuccucaggaagcagagauaaagaucuuugcaacuguaggaaccaaggcuuagggaaggggcuagggccauguccauccuguguuccuguuguugaucuucauuguccuugauagcgccuguuguuugggaaugggcuuugcaggcccuuaaauaagggcacccagcucuuugagggauugguggcauuuucaguggaaguaaaugaaaagccuccuaauguggcuacuuugaagcagaccagagucauuggauggaggaagucugguguguuauacccuaacugaucauauuauuagcauauuuaucucucaugauauugagcacagcaaguaaauuugauuccucaucuucuggaaugcauuagugauaguuuauaucccuugaaaggcugaagcuuaacccauuucccaugacauuguucaaugucccuucugucaaaggagagagaccuaauucaacucaugucuuuuucucuuccuucugaggcugcugccuuaaaauuggaugguugauugcagucaguaucuuuggcugugacuucauguaauuauuuccuucccaauuccuuuccccauugcauauugccuuuugcuuaaucugcacuuugguguucuauauacauguguuuuaauuguaaguuaacucauuuugggggagggcaggaauuaagguuuauauuauaaaugaaacaagaauucuuaucacuauaucaucgucaguucaucaucucuaugcauuauuuuaugaugacacuacauaaauugguuucuuuucugaaauaaaagcucauuccaagaaugccuuuuuuuguggggaggggggugacaguuaauaccuuugagcuucuggaucuuuuuacaaacauuaucagacaaguaaagaaagcuggauauuauuucuuuggcaaaguagagaaagcugaggccaaccgcaggccaaggacucacucaccuaauacuauauuuacucccuuccucuauccguaaccguguguuuguagacuugauaauuauugagugucuaccucauggguguagaccuauggguccugcccucuaguagcuagugaggaagugggacacagcaggccagucuaguauagcauccuaccugccuaacaggcauugccuacugggagugugucuguccuggagugucagggacaacuucccacaggugguaccuggaagaaauccccuggaaaugugucucuguuguugguuuuuuuuuuuuuuuuuuuuuuuuuuuuggugguagggguggagacggagucucgcuuuguugcccaggcuguagugcaguggcgugaucuuggcucacugcagccucugccucccagguucaagcgauucuccugccucagccuccugaguagcugggauuacaggcaugcacccccgugccuggcuaauuuuuguauuuuuaguagagacgggauuucaccauguuggccaggcuggucuugaacuccugaccucaagugaucugccugccuuggccucucaaaguguugggauuacaggagugagccacugagccuggccguucuggaaauuuuuuaauuugugggauaaagagucuguaggcuggaggaauagccugcauauguguauagguguagaugaugaauacgggauacuacaaguggaguuggggcuacugaaguagacaggagccagaucauaugaauugaguagcacaguugaugugaagucauuucaagggcuuugagcaagacauugcuggaucagacuuggguuuucucucuguuuauauggacacuuggccuuugauaucagggcuugugagugcagauccaucuaccugaccccugaauaccccuuaccuguccccaguccuuugaucucaccucuccucccugcugaugucuuuaaugcuggcccugcucugcucaaaucucaccugcccuaagaagcuuccccugaccuuuccaagccucaggaagucccugccuucccugacugucguugccuugguuuucuguguuagccauuuagagagaggaacuaguuucaggucccagccuuaucagccaguauauuugugauaucacguguaucaugugauucuucugggucuuacuuucugcaucuauaagauggacaugauaauaauacuuuccagaccaagaagauaaacagacauacauuuguauucuuccucaagcaaaugugaauuugugcuagaucaccuuccucuuaaacgacauuccugguggggauugaagccacagggcucuaguaagcuacaucucucuccacguucuguuuuccaucuucacugacauugcuguaggguggugagagaaacagggcauuagauacacucuuuuacuuuauuugguuuagcaaaauauuagcaccuuuaugggucuugguuccucauugcgauauauacaagaguaauaccuacuaccuccuuuaaugagagaauugaaucagauggugaauggaucacccucuguucagugcccagccccaaacagaugcuaauuaaauggcuuaaucaaaccagcucaggcuguuacuggaugucaucccuuggcacagucugacauuucuugauucuuguuaacagcccuauaacaauauugucauaagaaauagaaaacaucauuuucuuuagggaccaauuuggagcccauccauaacugucuuccagcuccuccuggcuucccccugucaccuugaccuucagggagccuuguuucugcugccggcauugacccauccgugcuagccaugacagacugauucucccuacccggcuuuuccaaaucuacucacaucucaucucaaaaccucuuucucucauccauauugccuugcuuucucauuccuuugccauuuaguagguaaugauuucuauuaagaugaucaucaggauuuauugagcagagagguagauauugacacugacugggaggcaugauccgaguggggagggaauucugucccugcaccccaauucccccagucuugccugcugcuuauaaaguuagcuggagucccaguguagugccccaucugugcaguagggaaauugcccaccuuggggcuggccaaguaauggaagcuucacaaauacaccauauuaaaaaggacuuugcacaucuggcauuagaauauuuccagcccuggcucagugcuuggcacagguggcuguucacagauauuuuuagaagcaaggaaaggaggaggggaggaguauaucauaagacauuuggcaucuccugccuuugcugaguaaaggggaaggaauuuaggauuuguacggugaauauugccacguguuuacgaguauuuauauaaugcuaauauuucaguugcagggaaaaacuuguccugaagauguuaaagcuggaagucagugaucuucuacaccuccuggaauuuuauagcugugugcucucagguuuagagucaggaggggaaggcccagggccaugugucauuucuuggcagagcuuggcuuaggacuacuuuucauccauucccuguucuuuuccauauuucccaguuuucccauuuuugucucaaucugucugccugucuguugcacucuacccaucuacuuauuuaccugucggcuuccacugugcucuagaauguugcccacugugaucuuuugggcaaguuaaugucucagggcccaguuuccucaacuggaaaaaaaaaaaaaaaagaguagcugugaaaauaaauagugauuuauaagcgcuagauuuugggggcuggagaauccuuccuuauggggggcagggaggcugucuugugaacuguaugacauuuugcagcuuuccgaaccuacuauguaccagcagcaucucuccccugauuugugacuccaaaagugucuccagacauugccaaaugucuccgcggcaggggggcaaauugcccuuggcugaaaaguacuggcacagaguaagcaauuauuaaauauuguuuuaaaaaaaacacugucauuaugacuauucugcaguuauuuaauuuaucugaaaaguguucauuuggugcuuacuguauauacugcagagcucugagccgugagaggcaaguggaaaauguaagccugauguucuugcuuucuaggagauuacgaugcgguucacagucacacaccuguggaugggcuuccgagggggcuuugaacguuuuguuucaaccuaaauuuagcaaaaggacaauugugaggcuugagaggcaugucugcaugcucccagaccuucucuuuggguucgugguccuccccuacccugccccuuuugauuaccagugaaugcagcaguggugacagguaaaugaccuuguugguugguccucuaguuccugaugaacccucaacugggagggacugucugugaaucagagcagcuggcucuuugaaaagaaaggcacuauugcacaguugcugcugcugacccuugcauucagaauaccggccgaggccaaugggcaggucaccacccugucgccucugugcuccugccucccagaccacauccugggauucuucccucgccccaugcaguagcagaagggugucacaaagcgacucugcucagacccaccaucagaccugaccgcuggccuuuccagagcuuccagagccacucagcccugcccuccuggcucugccucccgcggcccccacccuugugucuucucuuacucaccucacacacaccugcucuccucacugugcgcacugcccuggccccgcuucugggaaugcucuuuccauggaucccuuguagccccuuuacuuccugcaggucuuuguuuacacuucaccuugugagagagggcccuuuaugaagucagaaucagaacccuccuccucccaccccaccuuuccuuccuuuauuuccuucacaacucugaucacugccugaugccuccacuguauuugcuggcuguugagacugucucuuuucuauguucucccgcuggacuguaaacucccugagggcaggugauugguuggucauguucaguacacuuagaagugcccagcuugucccagacacucaguaauaauugccgaaugaaugaauggaugaauaaaugaaugagccaagggagaagaaguuaccaugacuguuacaaaguugauaaaugcaugcagagccuuuguucaccauuuucugggaggaaugggucucccguaccauagccugugggcauggcuggguggaguuuggucuacauuauaucaacucuucccuucucuaucuggagauaauucucuccuggguaaugagccuacuggagcauacagaugagggcacgaaggugacccuuauagaacuguggcugagagccagggauucccacuuccaccuccacccccauagcaucaucagucuagucaagaaagacccguggucuuuguauuaugggacuuaguccuucauugucccuguggcucugcuuuucaccccugucucaugcucuccuccuucacccuucccaucugaugugugcugaauuguuaggagaacagcaaaaaugcauuccuuugcugacacuucucuaccugugguugucuuccacucugcgucaugugccguauccgccugucaccccggcacacugucagccacgcagccucucguucccuguguuuccuugcacacucgugcucugcuggccucugucacucucacugggcguccugccugccuucccacccccugcacgugucccuguuggcacuucccuauucacacucuccucuccaccaagcuuccuuugacgcuuccucuuucaagcugugcagccuucuucagcugacaguucagcaucguuccauuucugaagcagggaauugguuuggugggcacuagcuccaaguuugccuuugugguauuucuagccuccuucauucucuuuccuguuuuggcugcaaccaaaggcugggcucagugaugaaucgcaauuggguuugguggcccagccgggcccuucucagguuaagggugguauagggaguugugugaaugaaugaggucccgcagagagaccaucacacauggguagagggggaaaaaaggggggcucagaaugccuguguggauggcagucuccugaaauacaggaguuuuucucucuaagguacaccacaaauuuuaucuuccaacauuucuuagucauuuuccaaauuccaugucccuuuucccuugauuuguugauuaacuucauaugagccuuacccaaauccgccugauaucagugugugugucuguguguaagguuuuuggaaucagcaagcaccuuuuucauucuuguuuccacucaucaccuuacaguaccucacuggacacaauggauuuccaaagcaucuguagacaugagcugauucuagaauuucuuuguacaucacccacauccuggagcuguuucuugggagaaagaaagauggcaugccucccuuugccccuggacccugaaggcugugcucuuuacaccgugaaccuaaaucugggcuuggucugcagccaaccuggaaauucacuacugcaacuccguuuucuuuuuaacgagagcuucauacgguucuuuuaaacuagaaacuucucuuucuuguaauugucucuaauggcuuccuuguucgaacaagccuuugcuagcuucugucugaccccuuuggcuuugcuuucugccuccuuuuauccuccagccuuucguauagauuccagaggaaucuuccucaaaggcugugccacucccuguucaaaggcuuucuguggcuccucauugccuagaaagcaagugaguaaggccagauauuguuaguggcucacuuaccgcauuccaggaucuugcucuaauuucccuuuacaacgucaucaaaacagcucacccccaagcuccgaccucaacucccacuugcgaccccaaucagcagccuacccaugcugcggccucgaugguucccugaaugcacguguuccuuuucugucucuguguuguuaacucaugcaggguccacccccuucuuccuagaccuaccucaccuuuuuuguagagucccucuucacuguuucuuccauucugucuuaucaggauuauuuuucugucuuuggucuugccauuauacuucccuccauugggugacuuacuauaacgugccuucugcugugacucuguuggauguuuuugaguguucauucaauucuaagggcaggaaugauguauuucccccauaaugugcagcucgguuccaugcacaucauaggugcucaacacguuuucauucacuugaaggacuuuuaccguuguauuugucacaauauuuguuacuguuauuuuugucaucaccacaucauugaccuuaguaucuuccuaaugacuuauaauugacaaaguaauucccucccuucuuuccuuccuuuccuuccuuuccuuucuucucucucccucucccuccucuccucucccucucccuccucucccucucccuccucucccucucccuccucucccucucccuccucucccucucccuccucucccucucccucuuccucccuuccuuucucccucccaggcuagagggcaguggcgugaucucggcucauugcaaccuccgccucccagguucaagcgauucuccugccucagagucccgaguagcugagauuacagaugcccaccaccacgcccggcuaauuuuuuguauuuuuaguagagacgggguuucaccauguuggccaggcuggucuugaacuccugaccucaggugauccaaccgccuugaccucccaaacugcugggauuacaggcgugagccacugcgcucagccaacaaaguaauuuuuuacccaaggaucuccauuguggcugugacugcugccuauaaaacaauauaccaaagacaaaaauaaagacaaaaacaaaaauaaagaguacaaaacaguauggggguuguacauaaggcuuuuguguuccugcuuguaccaaggaaaaagauaccacucagaccaaucaggaugcacaguccagagcuucugugagaaguucuuuguccuucuaugccacuuagaguuuuucuacgauaccuuuaaccugcaccauuuaauaagcuuuuaaggagccgcacaugcauuuacuguguggcugcucugauucuuuggcaaauuuauaagcugcccuucaguugggggcauggauuugccuuagaagaucgucuuuaaagacacuugcugagaauguucacaaguguguugcccuuuuaugcucauagguguguguacuuucuuguucuuugccuuucccuauuucacccagacauuuaagguaagugggugaauuucgauauuguaugaauugauaauaguccucugugguuaucaagcauggcacccauaagaaacuugcacauucaaauucucaccuaaucgucauaauacaccuguggaaacaggaauuuuugcccauauucuaugaaugagacuauugccauucagaaggaauguguguuuugcucugauuuaaugucuuguucaggguccuaccucuggaaagccaggauuucaggguagaacuagcaagucuuaaguucaguccucuucuccuccacaauaccugguuccaaagucacuucuacauagguagccucacuaaauauuguagcagcugcaaaugauaaagcccaguuuuguuguuuaguugacaccacacuguugaauuccacuuccuuugccuccauuucuuuguuuuccaucaagaggauuugguuuacuuucaugcucugaauaucugguuuccuuucacuccuccaggaaucccguaagcacuaaggaccccaaaaauuacccacccaaagcaggcucucuuucccugcuugaggagggcauuccugggaauugggcugcucuuuuuccagcagcccccuggccucagaagccuuaucuuuucuuaggaaucaucucugccgugacaccagaucagcagaccagccacuacacucccuugcuuaaaccaccaguggcuuaagucagucuacacuucuucaggccuacaaggaucugugagauguaggcccuguccacuuuguagccaguuccuucucugauauuugcuuuuccaaucuuauguaaccacaggccacauucucuggacucugggacuuggaccucaagugugugcuggugcagucacucucaguaaagaaaacaaauuauuaaaaaguaauuguaguacuuuuguaguauagucaugcguaugacugggauacauucugagaaaugcguuguuaggcaauuuuguuguuauauaaauaucauagaguguacaccuagccuauauaguauagcccagggguccucagccccugguaccaguccguggccuauuaggaacauggccacacagcaggagguuagggacugccggccagugagagaagcuucaucuguauuuacagccacuccccaucacucccguuaccccgugagcuccgccuccugucagaucggcaguggcauuacauuauugcaaacccuauugugaacugagcacaagagggcuccuuaugagaaucuaaugccugaugaucugucacugucucccaucacccccagaugggacugucuaauugcaggaagacaaacucagggcucccacugauuuuacauuauggugaguuguauaauuacugcauuauauauuacaauguaauaauaauagaaauaaaguacacaauaaauauaauguaucuaaaacauccccaaaccauccccuucccccaaccuuugucugcggagaaauggucuuccacaaaaccgguaccugguaccaaaaaggcuggggacugcugguauagccuauugccucuaggcagcaaaccuguauagcaugugacuguacugacuaccggaggcaauuguaacacaaugguaagcauuuguguaccuaaacauggaaaagguacaguaaaaauaugguauagaugagccaggugcgguggcucacgucuguaaucccaguacuuugggaggccaaggcgggcagauuaugaggucaggaaaucaggaccauccuggcuaauauggugaaaccccaucucuacuaaaaauauaaaaaauuagccaggcguuguggugggcaccuguagucccagcuacucaggaggcugaggcaggagaauugcuugaaucugggaggcggagguugcaaugagccgagacugugccacuacacuccagccugggugacagagugagacucugucucaaaaaaauaaauaaauaaauaaauaaauaaauaaauaaauaugguauagauggcauaccuguauagggcacuuaccaugaauggagccuguagaacuggaaguuucuuucucugggugagucagugagugaguggugugugaaugugaagggcuagggcauuacuguguacuaccguagacuuucuaaacacugcgcacuuaugcuacacuaaauuuguaaaacuguuuugccaucuuuagucaugcuacauuaguuugcuguaacuuuuuuacuuuauaaacuuugaaauauuuuuaagcuuuuugacucuugucguaacacucagcuucuaacaaacgcauuguauagcuguacaaaaauguuuuauauccuuacacuguaagcuuuuugcuguuuuuaaaucuuuuaauuuuuacuuuuuaaacuuuuuuguugaaaacaaagauacagccgggugugguggcucauggcuguaaucccagcacuuugggaggcugaggcggguggaucaccugagcucaggaguuugagaugagccuggccaacauggugaaacuccgucucuacuaaaaguacaaaaaauagcugugugguggugggcaccuguaauccuagccacuugggaggcugaggcaggagaaucgcuugaaccugggagguggagguugccgugagccaagaucaugccacugcacuccagccuggugacccagccugggcgacagagcgagacuccaucucagaaaaaaagaaaacaaaacaaagauacaaguacacacuuuacuuuagcugagacccacacagguucaggauuaucaguaucacugucuuccaccuccacuuauuucacugagaggucuucaggggcaugaacgugcauugauuggaguuaggauagggaaggcaccucaccauaaaauaacuguggaucaggauggaaagaacuuagcccacuggccauguggcgagccaaaaagcucauguuguuuucacccaauaagaaccuaugucuauuaaaaaucauggcuucagcuucugugacuaccucugagaguccauucagcacauucauuaauuauccucaguaugaacagauuuccucuaaaaagccuccuguccuauuuucuuagccucagucugugccuuccaguuuguccaaucuaguuccucucauaaauuggucacuaucuuggauuuuucccagcaccuggucuggcucuccacagugcugucuuuggugagcagcugagguccugaugggucacacuuagccggggguucucagagcaggaggaugggccucuucuuuggucagccuguugguauugauccccagguguuuguucucuggacauagucugugugcuaauaagggaaccucaggugacaguaaauaacggcauauuuggugugcuugaagagaaagccuagauaguguucagaauuuucugcaaccacauggaaagguugucucuacugcaauauugugauugagccuaucuucaaauggcguaucucacaaaguauggcaggaaccuggagauuagaaagggaacuuuuagagccgagaugggaggaaugaaaacagagugaugccaaauaaagggauugcucaggggugacaugaguggugacuggucugggcaggccuggcacagaggccuggaguaggaguggacacucuggcucauggggacaaagcgacuuuggcagaaugcauuugaaaugagauuucaggaugguuaguuaagugguuuucuguaugauuuuauuaguuuucauccuucauuccuuguuucuuuuuucauuugucacaucacagaaauagugcuaguugguuucuugaguacauucguuagugcuugggauuguucacaaaagaagcaucuguugggucaagagccuucucagauaacuuguggcuucaagcccucgauuccacuguggggauuugaguguucucaaguggauuuauugaucuuuacgggcuccucuguggcuuucuggauuucuccaagauuauaaucugaccccaaggaaauacugaguagaugaggagaagaacugggucaacagagaguccaggaauguaucaauacuggaaaagaaaagaaaaagcucucauucugugguagcagcugagagcagauucacaaaauacuccuccaaaagaggccccugauggaaaauguuggugauuggcucagaaucagucagaagcacucacugguaugccucccaauaguucuagagccugguuucguuggauauugcaagaaaaugaaucaauaaauacauggugcacuguggggguagauggguggaugaauggguaggaagguaagugaguggguggaugaaugagugaauaaaugaaggagauggagggaggaaagaagagacccaccaacauguaccaugcagaaauagguguugauguauuuggagagggagaguacaacauauacagugaagagggguauccuuuggguaucaguugggaaucauuugucauuuccaauaacaacaaaaaacaauuaaguuguuuaaugguuuaaacaaguaagaacucauucauuugauauguaacgagaucuugguuguugacacugguuuugugguuccauaaugucugugcucugaaugggcaucucugcaggucuuuucgccuucucauauuugcaggauggcugcagggucuucaacuaugagccaacaguaaaauuuauccacuuccuaggaaccgguuguuaaacauuuacuaacacacucuggcuccaugucuuguauuuacagcaagugacacauaauagaggcucaguaaauauuuuggggguggccaggugugguggcucaugccuguaaucccagcgcuuggggaggccgaggcagguggauugcucuugaaugcaggaguucgagaccagccugggcaacauggugaaaaccugucucuacaaaaaauaauguaaguuagcuggguguggugguacuugccuguggucccagcuacucaggagguagaaggauugcuugagccugggaggucaaggcugcagugagcugugaucacaccacuguuuuugagcuugggugacagacugagauucuguuucaaaacaacagcaacaacaacaaagaaaacaaaagcaaacaaaaaaauuucugaacaaaugcacagaugaaguagaguugccauaugaaaauguaauucccucuguuaaauuggaauuucacauaaacaauggccaauuuuuuuaguauaaauauauccuaaauauugcagggcauauguuuaugcaaaaaauuuauuaucauaaauucaaaucuaacggccauccuguauuuuaauuuccuaaauucaucaaccugaggauauaggagucauuuuaugggaacagauuugaaggcuuaucacuguuucccaaaguaagagguaccugugaccuguguugaucauacuuaaguauauggggugagauggaaauuggaguguacauugugcaaggaacugggacaauguauugggagggaaacaugaauucggaauuaguaguuaguaauggggaauuaacucaaaauuaaauaaacuuguggaugguuuguaacucuuuagagaaauuucuuagugcugguuucagaacagugaaaggaaagccguugucagcugggaucugccgcguuuccauggaggcccuuugcucaaugaugucugugauccugugagcgugacaacuuuagccuagccugugcgaugccacugcaguugcaacugggggcucaucugcuuuccaguccuugccauguguuguuuggggagcuaggggaagagaauuucugaacugggaacuuguuugaaauacaaaugcuuggacucuauuucagaggcagaugcucuggggguuagggccuggcgauccuacauuuaacccagcccuccagaggacccugaugcuggauaaaguuuaggagccacugcuguagacaguacuaggggauggggcuauggaagaauguuuguuuugcaguuuaaaaggauagcugcauaugcaguggggggaugagagugcagccagcuaggaagaccacuuugagaaagucacccaggcguuacccaguauccaguuaccagccugcccuuaggaacauuaauucaaagaagcaggacgacauggaucuguuguaccucuaagaaguaugggaggacucagugagcuuggaaaaagaccacccuauugguggucaaaagagauucaugagugauguuaagacaugagaaacgccuguggugauaggcagguaacucuggguuguaggccugaccuagccaguaacuuaacugggugaucucauacaacuacuuaauuuucucuggacauccauuuuugauuguguaaagugaagauuuugaaggaacgacccuaauucugauucuuucuagcccaagcuucucaugcaaagguaggagcccaaagaugguggaagugaagccuccaucaauugagcauggaguucagauaguccugcuucuuaaauagucucuucuccuuccugauuucuuuccaccucuugccaacaaguccuucuggcagcaugccuccaaaggauaugagaggggacugccuuugaauuucagaggacaaucugaagcgggugaggaauguguccuauguucauuacacacgagguaaucaccugccaucuuuccauaaccugagauggcguagauuggaauuuaggguacauggagcagagugggguuugaaugggucagagaccugcgugugguugcuguucuuucacgcaaguaccugaggccaguugggccaagggaggccacaggccugagugagaacaaguugaguagcaacauaggaccaugccacagucaguuuuaccugagcagugaagauuauccugccaauuucuuuuguuuuuccuuccuucaauugauuuguuaucaagguaaauuuauauuacaguucuuaauuuggcauuuauaugauuaaagcaguuauuauuugucauuguccccaacagauuauguguugucuuuuaucucauuuuugacuuuggucaucuaauucuacuaagugaguguaauuaugucccccaguuuacagaugaggccucaggcuuagugaggguaaggaacgucuccaugguacacagccagagaagccgaggguugaaccagccuuaucugccucuagagcuggaguuuuuuauugccaugcucuugaaugugaggcuguucucugaacgaggggcuccucauuuuuccaggccaagaccagcuuuucucauuucuuuggaauuacaugaucaugugugugauggaagaggggcaacauuucuggccugcuggucaccacagugguaggagagugggcacuucagcuguaguagccaacuugguaggagggcaggagucagucugcauggaccaguuuccaggaugauucugcuuucauuauugaccacuggguacucauuuuguuuuauguuauguuauguuauguuauguuauguuauguuauguuauguuauguuacguuauguuacguuauuuacuuuuucuuugagacagggucuugcugucacccaggcuggagugcagcagcaccauccuggcucacugcagccucaaccucccaaacucaaguaauccucucaccucagccuccuaaauagcugggaacacaggcacaugccaccauagcuggcuaauauuaaauuuuuuguaggcacggugucucgccauguugcccacgcuggucuugaacuccuggggucaagugauccucucaccuuggacacccaaggugcugugauuacacauggaagccacugugcccagcccugggcacucauuuuaaaaugcugaauaucaaggaagaagaguaaacaaauacauggaucgaucauuuaugcauuaagaaaguuuaaccugaaaaaaaaaagagccuacaacagaaccaccaauuagguaauuaagagugccaaccugguuugcuguguccagcugugugugcuggcuuguguguuucaaauaaaccaccagcgaccgcggaaugaaugaauccugagcugugauugaugugcuucccaguagccagaugugguucucugcauuuauguacuaguggaauagcaggggggauuccuagcgaaaggcuguuuagggauacauuuuaaugugguuccagaagggaguggaaacagcccucucauuuuucuuuaucugauccugggggagcugggacuuuuuuuugaaaccaacucuauccauuccuuuaaugaucaucugaacagccaaaccuucugggacuauuaugcauaauccuucucuaagcugaaucuauuuucccucaucuguagauauaucuaucccccuacucuuuuuaaaauaaaacugauuaauuauaagaaaauagauaugaaaugaagcacugagcugcuucuuagcacaucucagcccuucagugaugggauuuugcucucaagauggagaggucccauaaaggggcaauuuuucagaacaaacacacaacagauuagccacaggguaggcaauuuagguaccuuuaaaaguguagcugucguccucaccguugacaaauacuuaccauauaccuucugugaguacaaagauuaugcagagcaaauuccuaaggcacagaguccgcaccauggaaacauaauuuaaauuucacucugguugaggcuguugaagaaugcugggggucaagcuuucuucccuguguuguugccucugcuuucuuuuuuagagacuaguagguuaguggcuuuucuugcuggccucagcuuuucaugcuacccacaugcagacacacacacacacacacacacacacacacacacacacacacacacacuguaccccucaccccucaauuucugugacucuaauuacuguuuguuuccuccacuucucuacccauuucuuucgucucuugaccacucagagucaaggagggguuuccugaugaauuuccauugaugauggaguggacugugugacucaccuaguuaccccauggcuggacccaccucauagccaguggguucauggccucagugaacaugccccucuugugcuggucuccucuagaagccuucgagccugugauccgucuucucgugccugccugaaggcuguuuagaugcucagugcagggccauuucucccacugaggcuggcaucuuuacuagcucaaggccauucauuuccaguguuaggccugcaauccaggcuccagcuucccuguccggguaggauuugcccuuuuuuuuucccccauccccaggguuccaggguugugccaaaugggauagugguagugguuaaugcucuccagacucaaacuuccugggguugaaucuuggcauuagcucuacuuguugggugguuugguugggacaaguuacuccacuuuucuggacuucugccuuuauaaaauggcacaccacucaauaugcagcacacguuagcucuuaccuuuauuuucugaaaucuggagaagauaaugucuguuuaaaacccguauuucuaggucaggcacgguggcucacgccuacagucccaacacuuugggaggcugaugcaagaggacuacuugaggccgggaguucaagagugaccuacgcaacauagcaagacccugucucugcaaaaaaaauaaaacaauaaaaauaaaaauuagccaagcauaguggugcucacuuguagucucagcuaccugagaggcugaggaaggaggacugcuggaguccagaaguuugaggcugcagugagcuaugaucacaccauugcacuccagccugggugauaaagugagaccccaacucuaaaacaaacacaaacaaacucauauucuuaccuuuucccuucucugugcucuuuccuuuuagucuggucucagagguguuucugcucauaucauuuggccauagguagcaggcaguuuuccuguacagcauccuauguaucggucagcugugggcagcucaccuaacuucucuccaguaaggaggucggccucauuccugguuuccaggguauccuucagacccauggucuauucaauauuuuaggacacauuugaacgaaagugugaagaauucuaaauugaggcguaguauagcagaggauuuuaacacagggguuagaacccuugaaagagaccaauccauucuaaccuucggaucucaguucuucccugucuccuauccugcugcagacccccuggacgcuucgcuccagcagguuacaaaacaugggagccugguggccaccccuugcucuugcauagcucccuuagcagggcucuucucucuccugccuugcuucaccuuguucaccuggggaaacugcuguaccucugugggauuaagcuggagcucgguguuugucacccuacaacugcuccuauaacacuuggcccucucuugcuugcuugggaucuauauccagcacagugccucguacacaguaggggcacaauaaaugaugagcgaaugauuucuuacguaaagauuugggacaguuuacuaccaaaggucuucugcagcugugucauuuguugcuuuggaaauuucuaaguuuuaacuggucuuuugagaaaaaacaucauacagcauuuaucguguacucuaaugccccuuuuucaaaguaaugacuucccauugaaaugugccccugguuuuaaagaauuuugccauuuccuucucuaauguguaggacgacuccguuacacuuggaucgauguaccugccauuguggugaucuugauuuauucuacucaaaugacagcagagcuguuggaauguuaugaauuccuuaggaauuugcaucauucuauuccucugcucagaaaaaucaaaugagugccuugugcccauuguguccagucuaaaugccucugauuaaaagaaccuuuuguggucccccaggaacucucugcaccugcugcugucauuuccauucuccuuucuucagccagccagggacgaguuguuccuuuccccuugacacacaguauggcuucugagccuuccuugccacugucuuccuaacuuguucagcucccuggcugguucaucaccaugaucaugcauuagaccaugaccuagccauuuucuggggccaauucuuccaguuuucauuuuuaauuugauucuuugauucacugguucagucucuucugagaagacguuagucuuuaaaaccuuuccccagacugcuuauuccucaaaggcuuaacaccgaauacaauuuguauuacauuauucugcauucuuaaguuuuguuuuuuuuuuucaaucuccuugaauugcuuguaacugccuugcugucaugagcuauugucuucugcuucuuuggaaagugcccaggguaguucuuugcucguauagcuacucaaacagacauuuguugaacggcaguagcauuuuccaagugggaacauagacaacagggacaguggaauuauacggugaugaugaaguuuuccuuuuuuuuuuuuuuuuuuuuucugccuagcaaaggucugaugagagaggaaaguacaucaaaguagcauuggccagcugagcgugguggcucacgccuguaaucccagcacuuugagaggccgaggcgggcagaucaccugaggucaggaguuugagaccagccuggcuaacauggcaaaacccccgucuguacaaaaaauauaaaaauuagcugggcuugguggcgcaugccuguaaucccagcuacucgggaggcugaggcaggagaauggugugaacccgggagguggagcuugcagugagcugagaucgcgccacugcacuccagccugggugacagagcaagacuccgucucaaaaaaaaaaaaaaagaauuaaagaauuaaaauggagaguagguaccucuaaacaaccacgccaccuggaccacccugaauagaggagaaugaguuaugaaggaagcgcgcuacugccucaccaaggaugaguuuaaauccaagugcagucuuggcgugcauucaaugcaaaugacuaguagggguaaagcuagauagacccuagauaugagucccagugccacucuuuuuagauccaugacccucugguaaguuccuucaccuuccucagcuuuggcucucuuauuuguaaaacagggccugacgccagcaaccucacaggucuaggcaccuucguggcguggugggaucguguuuucagggucuuggaggucuggauuuuaaaccuggcucugcugcagaugagcgggguggcuucugagaaucacuuacuuccugugugucucauuuugcucagugguauaaaagugguaaugacugugauuggcugaauugcgccccuccauguccgaaguuguguugaagccuuaaccccugauacccaggaaugugacuggggauggggucuuuacagaggugauuaaaguaaaaugaggucauuaugguaggcccuaguccuauccgacuggugucccuauaagaagaagagauuaggacacagauacagaggaaagaccccaugaagacacuagcagaagauggccagcugcaggccaaggagaggccgcagaagaaacuaacucugggcugggggugauggcucgcgccuguaaucccagcacuuugggaggccaaggcgggcggaucacgaggucaggaguucgagaccagccugaccgacaucgugaaaccccgacuuuacuaaaaauacaaacauuagcuuggugugguagcacaugccugcaaucccaccuacucaggaggcugcggcaggagaaucgcuugaacgcgggaggcagagguugcagugagccgagauagcaccacuguacuccagccugggcgacagagcgagacucugucuccuacacacaaaaaagaagaaacaaacccugccaacacuuugauaucagacuuccaaccuccagaacucuaagagaaugaguuccuguuguuucagccccauagucugguauucuguuagggccgcccuagcaacauaguaugaggacaaucaccugaagguaugaaaugccucaggcaggcauguaaugucuguguuauggcgaggggcacucaggagggcuucuggcugggcuggguaugagggucucugucuacgcauuggccaccacaacccccuuccagagcgucuuuuccccauagacagccucagugcccagugcacugucauaucccuuagauuuuucuuuucucuuucccucccucccucccuccaauagcagcuccauaucagcaacuccuaacuucuauucaguccguggaggcuggacucacgacagugccaagcuugguugaaaacacucuuuucuccucugggauaggugcuuucuuaguccugagccugacauucuacacaguggccaagggaauuuucccuaaggguccuucugggugauauuugggacuggauccuucucagcagcuuggacaucgucagccuggucaagugucauccucucuaaggcccuggcucguuccauccugugugugugcacagauguccauauccugggucucugcuuggcaauucugcagacacuuccagagcuaagcacacucugguucccuaguuucucucuggcuuucucagaugugcuugauauuguugauuuuuauggggguucucgcccccagggcccucacagugcuacuaaaaucauaacagugacaucagccacuugggugugugggucgacugugggaggcagcuccaucuggaaacuaaaaagagacacaaaauccucuucuuuugcuucccccggacuuaucuguaucuuugcagguagacagggccaaauggagaauuuacaaauugacacuuuucuaaagcagcuugauauuuuagaaaguucccuugauuccaaagaacugagaccagggaguaagauuggcugcaaagccagagcaguuggagaaaggagggagcaugaugcgugugugcuuggacagucuugguuguuuugcaucagaaauauagccacaaaccccaucuauaggauuuuaggaaccuaauaaccacuuccagcuguuaacaccuugagacuuucuaaguuacagucaaagaggaucccuggcaagcuaacauugauuuuauaaauuuuguuauagggagguugaauguuuuucccauucaccuggauacucccuguauuuuacuaauggacucacaguaaaaugaugggccugcuugugccagggggcagguguggccccgggagcucucccuuucucaccugacagaugcaucuagugucagggcagugagagagggaagccagcauguuuuccccauucccucccacaucuuuaguagccaugauauuauucagcuagaauuggucucgcgugccaguucuggaucuacugaagaugacagaauucuuacuggaugauggggugaugguugcuuuuucaggcugcuuucuggugacauucuggaagacacaccuuaacacauauauguuaguuuucuguugcuacuauaucaaaucaccauacacuuaguggcuuaaaauaauacagauuuacuuuuuuauaguucuggaggucagaaguccaaaaucagucucacuggacuaaagucaggguguccauagggcuguuucauucugcagugguuucaggaucugagaugucauggauuaggaagaauuugagauuguaccugccugagggcagaaaagggccaauucacagggauuuaugugucucugucuuuugacgaaaagaacuucuaagaagguagguuagcuaugcaaaugaucugaggcccagguaucuucugucuggauuugcugaaucauuuccuuucuuuaaagcgauuuaguugauuuuuacuagaaccucuuccauccccuuccagaaggagaaucugaaauuacaucaaguuacuuguuuaauaauuuuauuaguuguccugugaccaagacugacuuaccccagguaacacauugaguuaugggccgaguugggacuugaaccuguggcuucuuuccuagccuugaagcucaccccuuauaccaggauacucuugcugcuuucuaggagcucccccuuccuguuuccuccucugcagugcagauggugccaugagagggagcuuucccucuguucucaggcccugacgaggucccucuuggccauuggaggcgguacccuggaggcuugugugggggugugggcugagccgugugauccauguuugcuauaaugggaagcagcucccagaagagaaagacaugcauuuguaugcagccagucugaugggguugaaauaaacucagcacugaucaaacgacacacagccagcacauugcagggaagacaaaccaacauggaaugcugauuuuucucacugucaucuuuagaaaccuucuuucuugucgcccaccggggcaguuaacuguuaggagccagcccuguguucaaauccauuuauugauggauguguuuuccauuuaucaucugugggacucuugggugauguuucuuuuccgagcuccaauucuuucaucuauaaacugggcauguuaaugguaacucauagauuuuuagaguuaaaguaaugcaagugccuuacacaaugccugcacguauuaaacauucaguaguagguaggugcuauuaucaucaucgaaaacauuaucauguuuauugccuuauugacuuggaugaacacgguaguguauauaauaaaguagccagucuagaaucuggccugugguuaucuguaauaaaugaaagcuguggaaauagugugggauaacucaaagaccugaauaauucagcagauacaauggaguuggaagauucuagggacuuaaauucuucucccagcucugucucaaaauaacugcauugccuuggacaagucgcuuugcuuuccauaacuucacuuuccucaucagugaaauggggcugagcauugugugguauuggaaaagaauaacugaagugcuuaguuccaugcuggaaugaaguagagacgugagcagugcugucuuaucugacuuacuggugggaucaacaucgcucuuccuggagagagccaggucaucacaagaaccauaaauugugcguauccuuuaacuccaugauagacccuucaacucaaugcuuuuauuuucagggaaauacugucuccaaauauagacucuaaaagaaaagauggaaggggguggaacagacucugcaagaaucuguucaugacaacgcuguugaaaacagcucaaaauugaggcuucagcagugcccaguguugccagguguguguuguguugugcuguauuguguguguuuccaccacagagcccuuuguggcugugggaccugucagacgcaugagacguguagcuuucuaauuuauggggugcaccaugguggcaaguguuggugauggccacacccuacuguuuugauggaaggacagugacuuggccaagguuuuacagccgugaaaugucucagugaggauuugagcucagguuucuugugccuggguccuccuuaguguggguccucugcucuggcaacaggcagagcacugcuuuagagccucugcgugucuggcuguggccucaggggucuagcagcagugcuagagcagacccagcuugucagauccggggcugcuuagaggccaccuaagugauuccuuuggcagcaagcaacauucggccaaggacauagcuggcgggggcccugacaaggggugugugagugcauaaagguugguguaucaggaguaagugagaaggaggaggccggcuggaauuuuacccuucagugcuuuucuguguguagacagagauugggcggagguagguagggaccauguguagguggauuaucaucuuuuccaggccucacugaugagugucgugccuugcaacaguagugcucagggaaucaggcucaguugcgagaggcucccggcagaugaggguacugcccagaaggaucauggagagcucaaugauggaauguucacaaagcuucuggcccuaagagagcacucggugagcauggguugccugucccguuccuggaguuggggcagggugggacauuugaacgaggucuuuguagccauacagcaaucaucaggccaggauucuggggagaaauccccaauuuccaguaaguuccccugucugcacacccgugcuuguacugggucacagcccugcagauacauguaugcaucuucaagaacauuagagugggauuuggaggcauaaaauagccuuccauauuccuuuguuuuauacaguauacaucauuacuuuguuuuauacaguaauuacagucuauaauaaaagaaaugagucaauaaaauggauaauuagacauguggucauuccuaagauuuaagaucuagaaauaugacaauucagcgcuuuaguaucccucugcuaagacgcuuuaguggaagcuccacauugaggauaaaacuuaaacucaggcuggugcacagauccucccaugacuuggccugagccugccuccucuaauucauuuuucugauguucuuccuuaacauucuggaagacacaccuuaacacauauauguuaguuuucuguugcuacuguaucaaaucaccauaaacuuaguggcuuaaaauaauacagauuuacucuuuuaucguucugaaggucagaaguccaaaaucagucucacuggacuaaagucaggguguucacagggcuguuuucuucuggaagcucugagggagaaucccauccccuugcccuuuucagcuucuagcagccaccugcaucccuuggcuuguggucccauccuccauccacaaaaugaaucacaccacuuucugccuccauuaucacaccaacauucccuccgacgccgacucuuccugcaucucucuuauaaggaccuuuguaauuauaucaggcccagcaggauaaucugggaucaucuuccaccucuaggucuuuaaucauaccuacaaaguccuuuuuuguuauguaacgugauacucacaaauuucaggaauuaucaggagguaaucuuuggggggcauuauuuagucuaucaugaugugucucucuagucuuuuuuuauuuuauuuuuuuuuuuuuuuucacuuuaggcucugggauacauguccuaaacaugcagguuuguugcauagguauacaugugccacagugguuugcugcaccugucagccugucaucuggguuuuaagccccacaugcauuagguauuugucuuaaugcucucccuccgcuuuuccuccaccccucugauaggcccuggugugugauguuccccuccuuguguccauguguucucauuguucaacucccauuuaugagugagaacaugcgauguuugguuuucuuuuccuguguuaguuuguugagguugaugguuuucagcuucaucaaugucccugcaaaggacaugaacucaugcacucuagucuuuguaccugguguuugcacuuccuggaacaccuuuuccugccuucuuugccaggguaacuccuagucacccuuuagaaccccgucucagggucuucugcucuacaagaagacaacuuuguaccuaaucuuucuccugcuccauuguucuggcaaucugccccucuuccuugcuuaucuaauaucuugagccuacacaucuaguaacauuuaccucacacuguauuguaguuauagguuuauuuuucuugccucuguaguccuuggggacaggagcugcuguaauuugauggaugcccaggauaacagggaccacagcaggaaccuuaucucacaccauagaggcaucccaaggagaagcccuuuguccugauuuccacguagccuuccuuguuggccuggaauuacauuuccuccuagaaacugcaguccauugggcuucagcuugucaaggucccguguuuuccugucccuucgacugucuaauucccucuuuguuggucugcuguagauuagccuaaguaaaagugaauagacaauuuccuauuaacauuuauauugcuuuucuuuucuauuucucggcaaggcccugaaaacuaggauggcuguggaaaaauguuguuuuaucuaaauaaugucccuacugggggcuagauucuggcuuuuggcugggccuuggagaaugguaggugugguggacacaugagccccaggaaaaaauuaaggcgcagaggucaguccagaagcugcagauuacauucagcaaaugcauauugaaugccuacuaugugucugcacccaugcaaggucuuagugcauguaauucauaucuagcauuuauuaagcgguuauuauguucccagcacauaauaugugccaagcauuguuccuagugcuuuaccuugacuuuuuggaacaacucugugaaaugcagccacaguuauuggaggagauggcaguggagccggcucuugcagaugagaaggauugggacagguuuuuaugacagaggagaggaacacucacacuaaugaacuagcaaaaucgcaagacacaaguagauucagacacccaugagcacaagaggccgacacucaaauauccccuaagaaucugauuacuucauugugcccuccccuuuugagcugucaccauggauuccacuugcagcaaggacugccauguugcuucccuauauccauugucccuuuucugcuuaggaacagacuucugcuuacauucaggagagcaaagcagccagauaaaugacugucucccugccccuguggcaguugggcauggccauggaacuucagggaauccacuuacaaucacuuuugcuguugagauguguccccguuuuuggccuucucuuccacuacuuuuggcugccagccugcaacaaggauguugaugcucuagcaugauauuggacacugaggggccucaaccuagagcugaggaugguaaagcagaauguugggauccagggaagucaauggcacuguuaaaucacguuccacccuacacuaccaaccuccugacuuucuggaugugagagagacauaaaagucccuuugguuuaagccacuguuaucaggaauuuauugucacgcgcugccgagacuaauugcaguggaugcacuguucuguuuccagcaaccuccuuuucaucugcagaaguccacauuccaccuuugcuuuaugaaaacuuuuggccuccaauucccauuuuccuuuccaucuguugccguucuucugaaaacaccaucauggacccauccaaucauguauccugacagcaauguaaaggcaucauuuccaagcaucuucagguacucucccuguagcaccugcguuccccuccaggccgugaccacuccgagugugauccagguacaaaaagcaucagcaucaccugggagcugcucaagaagacacaacugcaggcccaucccaagauuaugaaucagagcccgcauuuuaacaagaucccaggaaauccauguuccucuuacagggugagaaacacugcugucaacgucuuuguccucacugccagcugcucaccucagaccacggauguggaaauccacucucgggcuacacccuccugucccuccaggucucucaugccuugucaaccuuuccuacaagcuuaaaagguaccuaaacuacugcagauugcuacccacucuucccagaacaaaauaauugcuuucacacuucccugcuuuuguuucuguuuuucccucuacucagaauguccuucaagaccucugccuacuuauggguuuccuacucacucuucaaggccagcucagacaccgccuccaggccaccagcauuugggggagagggacugugccucuccaucaauaagagagcaccacagugggcucugaacagcuucuucaccuauaaaauucagagaugaaguccaccgggacucuuggaucagaaucaauccucuauuuccuugaacagagcauaguucuggcacccccgccagcccucaugucaucccauuuugcauuuuauuuagucauuuacacacauaccacuuuggauugugaggcagcauucagccuuccgcauagugccugguacacaauuaauucucuggacauuguaguuaaacuucagugaauggugacacuugaguggucaaguugaugguagauaguacuggguguuuuuccuagagcaucgauucucaaacuccagcaugcaucagaaugaccuagaaggcuuguuggaaccccuucuucuccccaagugucugaguuagcaggucuugggaggccucagaaugugcauuucuaacuacuguguaggugaugcugcuguucccaggacaacccuuugagaaccacuguccuuaaggaauacguagauuuguugccuuuccuggaggcaacaaaucucaugcuccuggagagaaggaaacaaaucuauguacucguuaaggacagugguuacauuagaaccugcaauguaagucagugguugcaucggaaccugcaauguaaaucaaucuugaaaauagacaaaauagacaugggaauuaaauacagagaaauuagaucaauggaugaaccaauagagaagugacugggaucaagagugcuuuggagucuuguuuuucaauuuuuuuccaaacaaauucaccuaaccuuagaugcugcugaguguaagacauggcauuguuuuacauaaagccaagaaaucuuuuaauuaaaucauggcacaauuuuuuuuuaucccuuugaaucuuucuuuuaugcuuauugaaagaacuauuuuagacuuggguuuuugucauauuuuauugcuaugccuacacauaaagaaaaguauaggcaaauauauugguucagauauugcaaaagcuucuuugcuuggaaucucacucuucagaaucuguuuuucaacucagugucaucuccugcaucugucuacaucgugccguccucugcaucaucaugagcauggagcauuucuuaugaaaauccugugaagacgacacuuaacccacuuugcagcucuguggagcuggccuccuccuggcucugcuucuaggaauguugcuaaacacaucugguucuccauuucuuccugccucuucccacaaccauuugguucauagcgguuaaaagaaugacucccuucauugucuccgggauuuucacugaagccugugacacccauucugcgaagaggugaaggcacuaguggaaacagcuguguuaccccugcuguguggucuccagugauugcucaaacuuucucgacuucagggauguuagaaugugaaaaauaguuuuucuuagaaacaauaaagcuuguaaaaugcucucuacuugccgagcagauguuuucaccaucauggguuuucauauaaccagucucaguucauauuuacaucgguuguucaaggucagcuuugggaggucagccuacagaggaggaccccgagucucugucaaacuugcaggcaggcauucguucacucuugaaagauuuauggaguucgugcuaugugccagucaccaggggauaaucagugaagaaauagguauauaagauugagucauuuaaguguuacggggaagaaaguaagucaggggagcaggguguuagggaaagcuuuuugaacagacacuagagugaagucagggugcacagcacacaaauaucgagaggaugcacguuccauccaguggacauugcaagugugaaguucccguggcaggagugugcuugucuuguuggaagaucagcaaggaagccagcugggcuggaugaguggacguucaguaaagguucaguaaauggcccuaccugggauguagcugagcugaaauguccauccagaucuuugaguucuaagcuaaggguuuguuggcugggcgcaguggcucacguuuauaaucccuuugggaggcuaaggcgggcagaucgcuugaggcuaggagcucaagacuagccuggccaacauggugaaaucccaucucuacaaaaagcaaaaagaauacaaaaauuagccgagcgugguggugugccccuguacucucagcuacucagggggcugaggcaagagaaucgcuugaaacuugcagauagagguugcagugagcagagaucacaccacugcacuccagccugggugacugagugaggcuaaggcgggcagaucgcuugaggcuaggaguucaagaccagccuggccaacaugucaaaaucccaucucuacaaaaaaauacaaaaauuagccgagcgugguggcgugcuccuguacucucagcuacucggcagccugaggcaagagaaucacuugaaccuuggagagagagguugcagugagcagagaucgcaccauugcacuccagccugggugacagagugagugagacuccaucuuaaaaaauaaaaaauaaguaaggguuuguccacaugcaauaaagugugagaagccacugcagauuacauccuucucuguuuacugcggugaguugagucuuuuaagaaacaaaugucuugauuaauccagccccaguagcaaggcauggcagaaagauaugcuuauugcugucaucuuugugcugccuaagaaacacccacagugucucauuccugagcagcgguuuaacucacccaggcaaggaugaccacacauguagggugaaaaggaugugacagagaaauacaaacauuucauucccaguguguguucucaaaauagaaugugggacuuucaacucuuucuucuuugaagaacauuguugagagaaagacucugcagcgcaccgcagaagaaggaacagagaucugaguuuugaucccagcucugccaauaauuagcugugggacuauaaccauuagaguucaguuacagacaagaggaugcaugagcuucaacagaaagagauguauuuccuuuuuuuuuuuuuuuuuuuuugggacagagucuagcuuugucgccaggcuggagugcaguguuggucaggauggucucaaucuccugaccucgugauccgcccgccuugggcucccaaagugcugggauuguaggcaugagccacuaugcccugccaauguauugccauucuuaagugccuugaagaauccuaagaggcuagagacaaaggugagaaccauauugaaccagaccaccaaggaaacugugguuaagaagccaugggguggcugcucccuuacggacccugcuguaucugcugagaucuguauaagcaggacgagaaccauacuuuuugauacuugagaaguuugggacuggacucagagcucuaacgacagcugccucaaaaagaaaauaacaucccuuguucaugcuugccagaaaacggcagcagaagcaggcccaagggcauccucuaccuccuggcauucauuuuugccucugucaucucaugcaggugugucugcuugguggaaacuggguuucacaacagaguccaagauguaaaggaguuuggaaaaugucuaauguggcuuuugauguauguaagggaaauauuuaaggcaauccuauuguaaaugagagaggauaaagggauacaaugggaguuaagugugcugcaguucacucgaacugguaaaaugucagccccaguugacuuugauaaauuaugcauauguaauauaauaccuagagcaacuguucaaaaagcuauacaaagagaugcauuaaaaaccaccauagguaaauuacaauggaauucuaaaaaauguucaagcaacucacaggaagcaggaaagaccacaaugagaugccauuucaaacccaccagcauggcuaaaauuaaaauaaaacaaaacuaacaacaucagauguugguaagaauguguugcagcuguaucucucacacauuacuggugggaauauaaaugguucauccccuuuaaagaaaggucugcugauuuccuauaaaacugaauagauaggccuguaauccuagcacuuugggaggccaaggcgggcggauugauugaggucaggagcucgagaccagccaggcccacguagugaaaccuucucuacuaaaaauacaaaaaauuagcugggcggugguggcaagugccuguaguccuagcuacucaggaggcugaggcaggagaaucccuugaaaccaggaggcagagguugcauugagccgagauugcgccacugcacuccagccugggcaacagagugagacucugucucaaaaaaaaaaaaaaaaagaaagaaagaaagaaagaaagaaagaaaaauacugaauagauaucuacccucugacccuucaguugcaguuguaguuaucgcuggacuaugaaacuguuauugcaaaaacagcccagguauucaucacugagagaauagauaaauaauuuguguuccguuaauaucaugguaugccacucaccaagcggucaguaaaaacagauuagcaauacaugaaacaacuugaaugaauugcagaaacuugauguuaugagagaaagcuuacccaaagaguauauacuucaggauuccuaauagaucgaguuuggggacaggaagaaccaaucuauaacaaagcuuaaucaauaagggauugccuauggugggaggaugcagauauugucagagaaggagcuugagggaacuuccucaucacuccagaacguucugcaucuugaaaaguguuuggguuacauaggaguaugcauugucaaaauuuucccagugauuugugcauuucauuauauguaacuuuuaccaugaaggcggggaaaaaacccauaaacauuauugaauccugguuaaugauauacauauuaaaaugccuaggaaguaaugugcugcugacuaucuuacuguuuugaaaugcauuaaaaaaccaaagauguguugauagauggauagaaggauaaauaugauagaagcaaauaugguaagagggucuugguacaucacaggggcagcuauauauauguucauuguagaauucuuucaacuuuacuguguauuuggaauuuuucauaauaaaauauuagggaaaaaucugaaaauaaaaucuuaggaugugugguaccuuccuucaucugcaucagguggcaguuguuuguuaagaaaaucacggcuggguaucccagcacuuugggaggccaagguggauggaucacuugaggucaggaauuugagaccagccuggucaacauggugaaacgcugucucuacuaaaaauagaaaaauuagcaggguaugguggcgugcgccuguaauccuagcuucucgggaggcugaggcacaagaaucacuugaacccgggaggcagagguugcagugagcugaggucuugcugcugcacuccagccugggagacagagugagacucaucucaaaaaaaaaaaaaagaaagaaagaaagaaaaaauuacugcagcuaucugaucauugcuuuaugggacaagggugauuuuugcugaauugaauagagaguauacaaaauuaaaauuuuaggagacugaaauaacugggauuggggaugcagccuggauauaguauucacuaaagaugcucacuaagcacuuaauuaauuuauuucuuuuacuuuguaaagauaagcccaaagguucauucucuaaucucauccuugcucaugcccccaaagucagugcuggcaugcaaacacgaccacuagucaucuuuuagauaagguucaaugcaaacauuuauaguuggaagagacuagggggcuaccugauccuauuuuuuucauucucccuacucccucccuucccccuccugucucuccacaccuucucucuccauguauguguauguguaugugaauuuaccuaaaucaauuuggucauggacaacucuuagcugaauuuguagguaauaguaguggccaaaaaguugaagaugguggaaccucaaacuagaacuuuacuaacauauugugaugaaaaaaaaaauauuccaccagauucugccacacaaagagacauuuauugaucaaacguucauuaguaggcgcacaaugauucaaccaacaguagagauaugucucugcccucuguccuuucagaugcucugaccacucucuuacagaaagguucacuagaggcaggugugacacugugacagggaccauugcugucacccucauaguuggcauuaggcaaacagaauuucuccuaagcagcagcuggaaacagaauagcuauggaucaccccuuagacagcaucgcuaagaauguuggugucagccucucuagauuuuccuucuguguuaugaaaagguggggaguaucucuaauauuacuguagccaguccacguuguugguagcacuuuaucuuaccaaugagagcucuuuccuaacaucuaacaugucauuugacaagcugcuaaugucaccaggaaaaacugauuccagaauucacuagaucaagacaguggugacagagggagccaccucaggacuguauugggccucaaauacugugagcagauacugcuccuuccuccagggugggucccugaguaaaauggucacuggcuacaccuggguugcacugcaaccuaagacuuauguaaagucuaccaugacacacaggcacacccuacagcgugcuucuggguugagguuuucuuuucuuuuuucucucucuuuuuuuuuucuuuuuuuaauagagacagagucucgccccguugcccaggcuggagugcaaugguguaaucuuggcucacugcaacuuccgccuccgggguucaagugauucuccugucucagccuccugagcugcugggaccacaggcgugcgccaccaugcccaggcaaccuucuguaucuuuaguagagacgggguuucaccauguuggccaagcuggucuccaacuccugaccuugugauccgcccgccucggccucccgaaggcugggaucacaggcgugagccaccgccccagccauggguugagguuuucauaguagaaugacucuuguuuguuuguuuuaauuugguaaauuauauauaacacaaugagagcucuuuccuaacaucucccuuccuucccucccucacucccucccucuuuuuaauuuuuuuuuuuuucauuucaguugcuuuaagguuacagaugguuuuuggcuauaaaaaugaauuguguagugguuaagucugagauuuuaguggaccugucacccaaguaguguacauuguacccagcggguaguuuuuuggcucucacucccucccagcuuucccgcuucugagucuccaguguccacuguacugcucuuucugccuuugcgaaccguaguuuagcucucacuuguaagugaaaacgugugguguuugguuuucuguucuugugucaauuugcuuaggauaguggccuccagcuccaucgagguugcugcagaggaggugauuuuguucuuuuuuauggcuguguaguauuccaugguguauaugcaccacauuuucuuuauccagucuacugaugauggacauuuagguuggucccaugucuuugcuauugugaauagugcugcagugaacauaugugugcaugugucuuuauaauagaaugaugucuauucuuuuggguauauacucaggaaugggauugcagguuugaaugguaguucucugccuuuuuuucuuuaauaccuaaacuucauaaaaaguacauaugucauauuuuuggagugauguguacauacagagaauuuauacuuacauuguaaaaauugauacaguacuuuuagcaaaaugaugugugugauaaauauugaguuacagaacugauaaaauugguagaaagucagaaugauauauacacauauugaaaaccuuaagcaucagcagaaggauaaugagggucuaaaauggugccauuggccgggcgcgguggcucacgccuauaauuccaccacuuugggaggccaaggcaggcagaucaccugaggucaggaguucaugaccagccuggccaacauggugaaaccccaucucuacuaaaacuacaaaaauuagccauuugugaugacgggugccuguacucccaucuacucaggagacugaggcaggagaaacacuugaaccugggagguggagguugcagugagccaagaucgugcuguugcacuccagccugggugacagagcaaaacuucaucucaaaaaaauaaaauaaaauaaauguugcuguuauuggggaaggccguguuacugcaugcauagccccuguuggcugauggcugcaugaauaguuuugagaucaggaagcaguguuuuaagcauuuugcauccuaacaagagaaguugucauuuacauacaacuaucuaaugguauuuucuuuuccauuuuggacauugauuggaaagggaagugggcaguuugcuuagcauacaauaaauuuuaauuuuuaauuauaauuuauaauuuuaauuauaauuuguccuacuuaaaauaauaggagauugguuccgugguagccuuuuggcacaaaacauuuuauuuucagaaacaaaucagugauguaaugagggagauacuuuucucuaaggucuauucaagauacuguaaacccucuucacuuaggagaaaagaaauacggggguagagggaggaagagaacugcucuccuagaguccagggagcugccuagagaagacgagaguccaccccuccuaggccaaggcuguucuaaguuccauaugggucuuccauugucuuccugugagacccauugaaggaucugacccagacgguaggaagaggcuaauuguuaaguggauucauggccuuugcaaaugcuuauuagaaaucagccaugaugguccaggacaugcugggaaucuuagauuaauggggcuuagcagauuuuuaugucugaaccugcguagagauguauggaugugagcagagaggcaugcguuuugcuugcugacugacuuguuuccugccccaugaggagccauauuccagucuugagcuugcguaguuucuuacugugcagucaauauuugcuggugagaaaugagcccacugguacuggugcaucugauccucugccgugcuuauucucucugugaucaaugucgugugcauggcuuguaguguuagggcagcaacaaaucuauuuuuaauucccucuuccuucccaucuuuuagaaaugggugaaaccauuucuccugacgaguaagccucuucuccuccucccucccucccucucuccucccucccucaaaaugucaauuggauuaacauuugcaguuguggcugccuccacaucugcuaacagagcguggcuggacuuuggaaaacaguugcccagagccauucugggguuucuauauuuauuucuuucaaugacauccauagcaaauuugcacugcucucaagccaaagguugauuuguuccaugggcugcccagucaaccuggggucccccuggagaugaggacuuggggucuggugcccugccagcucugguguagguuccagagcuaggaaauaacuggcaggcuuguuguggaggcgccauggcaggguccacaugagcgccugcucuguguuguggcacuaguucagcgguacuuuaugagaccaggagggugauggauggagccauggaaagguguggguggagggagggacaggcauguaggcagaacagcaagaaggugccagccugcaacaucgagugccagccucaucagcuagcggggccccuaaugucagauggagacagcccccaagccagccuccaccuuggcugccuuugucaagugggccucgggauuucucuuaccauuccuuuuuuuuuuuuuuuccucuucucuggucucuuugccuucucacucugucugcccucacccuacaaggaaagguccuucucccuuucuuuucuucccuguuuuccacacuucccucccucuuuuuccccaggucucuaguagaaggagcaugagguguguuugaauuccaccuccuguugaucuuugggagaguaacucaggucaggcuucuuccagccuuaccuggggauguagauaccuauuucugggguugcugggagggcugaaugacaaacuuuuauagccguuacguucacauagcacuuacuggugcuucauggguauacuuaguuaguccugaggacagcccaugagaugggggccauuaucuucaguuuauaaaggaggaaacugaggucuaagaacauuaaccagcuuucugaaggucacguagcuguuacuucauuuugccuaacuuuucuuucuuuuugucauuucuacuuuuuggguucuguauucccucuuccugucuccauuuccuuucugccuuuuucuuuugccccaggcaacucagggcagccuggccacagaguacccucucuuacccuucauacccugcggagcuuccccuuggaagcagccagcaugagaggaauggaggacggaugucuagugaucaugugggagugaaagcucuguaauguguaaugugaaagauguacauuauaaguaucuacaagauuaguuauucauaucauuuuucccuccuuuuuuuuuuugagacagagucucgcccugucacccaggcuggagugcaauggcaccaucucagcucacugcaaccuccgccucccagguucaagcgauucuucugccucagccucccgaguagcugggauuacaggcacccaccaccaugccuggauaauuuuuuuuuaucuuuaguagagacagguuuucaccauguuggccaggcuggacucaaaccccugaccucgugauccacccaccucggccucccaaagugcuggcauuacaggugugaccuucuguccauuuuaauucucccccaccucaccuuuuucuuuacauuuccuucuucugagcauuuugccuaucucuucuucuuucugucauuucuacuuuuuggacuccucaauauauuccuucuucccaguacccauuuccuuuuugccucuuucuuuugcauuccccaaaucacuucuccccuaacccuguuccuugccuguuugguuuuugccuucggucaccucugucugucucaucucucuguguuuuaucugucacgauauuggccaaaccaagcccuggaagugcgcugaaugcggcuuccugggcauucaucagggugugcucuggaguucuuccugcuugagcaacugugcagcauccacugcugcugagaauuuaaccucaccagagucaggaaaguucugagauuuugcacuccucauaaacuuagccagccugacacacauguguguacacacacacacacauacacacacaggaggggggagagagagagagagagagagacaguaaauuugucagcccuugcaguagcacgcauuucuaaauaugggcauaguaggaagagagaugguuacugugggaacuauaacuuuuaauuuacuggccugaagcgcuaaaccagggcuugauacuuaauguaguguuuuuacauuuagaugugugcuuaggaaaggcauaaaacuuuucaaagcuggggccagugcugggggaggucacugaaggagguucaggagugguggaaaaauuagggagguggagugggcccacugggaccaaucagcgugcccuaccaaucagaaguggaagaaauagacacauuauggacagcacaguuggucaggauaggaggcuuaaugaccagcccagcaagggaggaaggcuuuaugaccaucccuccacuugcaaaggagaccaagaucuggagagaaaggaugauacggccaggggaggaggcugaaggugcaugacuuuuggaagucugaguucaaaacaaugcagggccgggugcgguggcucacaccuauaaucccagcacuuugggaggccaaggcaggcagaugaccugagguugggaguucaagaccaacaugaacaacauggagaaaccccaucucuacuaaaaauacaaaauuagccgcgcgugauggugcaugccuguaaucccagcuacucgggagacugaggcaggagaauugcuugaacccaggaggcagagguugcagugagccgagaucgcaccauugcauuccagccuggguuacaagagcaaaacuccgucucaaaaaaagaaaaaauaaacagugcaaccugcaagggauuuggacucugacacucugagcuuaaaguaaugaugaacacuuaaccuacugcuuccuaugggcuagcacuguuuccagcaaguuaguacucacccauuuaaucuugaccacagcucugugagggagggacucuucucaccucuacuuuauagguggacauugagauagagacagcguucgaguaggaucucaucccaaggagccuggcuucaggguuggugcauuucauuaucucuguuuuguugcauuuaaauccugacauuguuacuuacuugcugcguuaucuuggaugaguuucaucaccucuuugagccuugacuuucuccccaugaagaugagggcaggaauaccuuccaugugagguuguggugggucuagggagggaauaagcauauggaaguucucuguagguaugacauuguauuauguuuaccaucaagagagaaggugaguggaggcuccgucagauaaagaauaggacaaauauuaguauucgguauuuuuacuuguuaaguggguagcacucagguuggcaucaggccuaccuggugaacagcagguucucuucccaccucccaccucuuccgucuuccaugugagugggugcaucggucccgagcgcuccucuuccccucccaucucuccacacuuucccuagcacgugacauaacugagaagucaauaacaccugcuggggugugucagccuggcagaacuucuggcguggcucucaagaacaugcgacgccuccuggaaccuucacucauucaacaaaugucugcuucgugccuacucugugcucccuguuguucucagcccuggggauauguuaauguccaaggcagaugcagucuuugcccucauaauacuuaguuuccaguaagagaaauggauaagaaccaaguucuaucggcugguaaugaauauuauuuaaaaaaaaaaaaagcagcaagguaaagggauggagacugaggcaucggauggagaguaggauuuuagaaggucagagaggacuucuuugaagaggucagcuugaggccaugcacgguggcacacgccuguaauccuaacacuuggagaggccaaggcaggaggauugccugaagccaggaguuugagaccagccuggguaauguggcagaaccccaucucuaccaaacaaaaaaaaaaaaaaaaaggaagagguggucaucuuggagcaggaagccaagcaaagaucugagggaagaauauuccagauggaaggagcagccagugcagugauccccaagacagaacaagcuuggcauguucaagggacagcaacgaggaagagaugggaacagagaguuaggucagcauccgugaucgggggccucacagaugcuagcaaggagauugagcuuuguuccaagugcagugggaagccacuggcacugggguugccagauaaaauagaagacagcuuguuaaauuugaauuucagauaaacgauggauaauuguuuaguuuggacauaauugaacauccuauauuuuuguuugcuaaaucuggcaacccuacacugaugggcucagagcagggaucugcuguaugcagagagcauugggcuggaaggaaaacugcagucaggagaccaggaagagaagggcgccauaguccccaagaccaaagcauggcuggucuaggccaugauaggccaaauggacaugcugaguaguguuuggauuuggggguauguugugauaccugugcaggcuuguuaaguuauucauaucauuuuuguuuuuuuuuuuuuuuuuuuuuuuugagauggagucuugcccuguugcccaggcuggaguacaauggcaugaucuuggcucacugcaacgucugccucccagguucaagcgauucuccugccucagccuccccaguagcugggauuacaggcacgcaccaccacggccuggcuaauuuuuuguaucuuuaguagagacaggguuucaccauguuggccagucuggucucgaaccccuggucuugaacagggguucgaaccagggguuguuaguggauuggguacaccagggaaagagggcggucagacagaaacaauccuaagcuccaguucacagggagggacauugagcaucucagggcccggucagcugugcaccaagucgccacuuguuugccugagcccaacccacauaucucuagauggguuagcuuuaggugcccacaaggaaagagagucggcugauuuaauuugccauggcuugcugcauuuuuuugaacucucagugaauuuauaugcacucuguauagauagaugagucgauaaauacuaccauaaaugaauucaucaucuuuugagcacuuauccugugccagauucucugcuaauuaauugcucugcauguuugucucuugguugagccucacaacaggugggguugugcagugaugguccacauuuuacagcuaagaaaaucaagacuaaggagagugugacacacauucuacuguauuugcuuuauagugucaugguuauuucuuuguuuccugaaguuuuguuggcacaugugucucccagaccuauagucagcucucagugggaacauuguuuagaugagggcgcaucuuggaaagcugccucaauccuaaaugcuagaauuagaacccaguucugauuccagaacuugauagagcaguguucacagacuugaguggaaauaaaaaauaccuagcaaauuuguuuauaauucauaugcuugagucucaugccuaggauucuaguucagucagacagggggcauaaccuaggaaucugcauuuuaacaaaaccacaguugauucagaugccauuauucuuguaucugcuuugggaaaugcuguaggacuuugccuuaauuaugccaaagagaaaacccugucccccaaaugcucccaaggaauaugacuggguucuauaauuuggauauuagggaugcacauuugacuacagguugaugucacucacauuccuguuuuuaggcauuuguacaugcuuuauuagaugccucuaggaagugcuuuguucagcauuucaggcaggauggcugggauuucuuuuguauauuaauacccccuggcauuuguucagcacuucauccagugcccaggguuuccaggucaccaucacacuaccucuguccacccucuucucaucuccagggcauaugccagcugccccagucacagucuugaagcucuugcccuuuccuugugugugugguuuaggauggguucccauuggcuguguuuccaucccaucucaucucaagggaaaucucuggugugaggagcuggcagugcuaggauuggucugugcuugguggcuccaccccccauacaccugaaaauccucagaaugaaaccaauggucauggagccucagcagacaucauucaucaccuugaagaagugaaaugaaaggugaacaaccuugguugaaaaagugggggaagaaguugaucugaaucaacuaugguuuguuaaaauucagauuccuaggccacacacccccuuuuugauggaaaaaagggaaggccaucgcuguaagaagcacaugggguuggguggcaucccgggaugagcuuuagaaugaguucucagcuucuuagcuccacccuggcuggcuuggcgauauuuuucuucauccuugcauguccuagugaggaacuuaucauuaugcacacaguagcuucuccugagcuagguucucaauuuccucaguuccgcauggaguuacaggcaaccaauaacugucccuaaaugggccaucccuuuguuaauaggcagcgugacucaggagaucagugaaauaccagauucauucucaaaggaaagguucucagggugacuucuaugggauuuucucuucuauccgucuuguuucucgggggcagaucagggccuguggaagccaggggugcgaaggguauaaaucacaugaguaguccgaggcugaggcccuucucuagguccuugcacucccguuggccuugauaauugugucauguuucucuuacguaaauuuguuaccaagguguuggugguggggagcaaggucagagaagggaguggaugacauagagaagggauuccagucacacaacaguguuccuuccccaaacacauuccacauucaccggguguacaacgugcaaugauuucuguuguugcugacuuaagagcaagcacguucgguacuaaaucuugccucgugucuuauuaaagagcagcucacuacaaaacuguuaguaucucagaaugguuuacucuccacaccuuccuacccuccuggcugucaugccaaaggacagucuuccagcgagggcugucuugcugcuauuacuacaaccacuggugaugcugagauugcugccauggaccagacugugguggcgcuuuaccuacaguaaacccccagcuccauucuaguacuucuggacccaggcugggcuuuucaucaagggcuccagagagaguauacucuguuuucuugguguuguauagucaacuuacugggaagagaaggcaauggacccugacuggcagaguucagauaguaucucugucauuuaguaacuaugugucuuuggguauauugccuaaccauucuauuccucaguuuuccucuaucuccaucuaucuucugucuaucgucugucugucugucugucugucugccugccugccuaaccauucuguuccucaguuuuccucuaucucuaccuaucaucugucugucuguuuguccguccuuccgucuguccauccauccauccuauugauucuguuauauauaauauauaaagagauuuauuguaaggaauuggcucauucaauuauggaggcugagaagucccaagaucuucagucagcaaagcuggagaccuaggagagccaaugauauaguuccagucugaaagccaacagacucaaaacccacagcuauauuucuguucaaguuuaaaggcaagaaaagaccagugucccagcucagcugucagacaggcaguuucuuuuuacucagccuuuuuauucuacucagaucuucaauugauuggaugaagccccuccccguuagggagggcaaucuucuuuauucauucuaccaaaucaaauguuaaucucauccagaaauacucucacaggcacacccagaauaauguuugaccaaaugucugggcacccuguagcccagucaagucaauuuauuaccaagacagauugcaucguauaucuuaugguguuauaaaauaaauuaagagcacaaaauggcuagaacaauucuugucauauaggagaccaucaguauauguuacccauuaucauuucuaucaucaucuuugucuuugccaucaucauuguuuucauuacuaaccugaaguggguuggagccagcaaacuugggaugggaccacuggcuuuguucccuaccauugguauggccuugggccugagccucaguaaaauaaaaccauaugucucugguuuuccucuggguucagauagcauagcagcaagcucacagcagagugccuggcucacagugggucauauacuugcaaacauauuuguaccaaguuuuuacucuaugccagccacuguguguguuacuagagaaucaguaauucaaagauucaugguuccugauuucagaguaccuacuauuucccaagagcuuagaugugaugauaaaggauuucauacaaugaaagaguugcggaaauggaagaugguaugagggcagaggaaccaaucaggaagugccaauguccaccagcaggagucaggaagauuucucauggauuuaugaugagggggacuugagaguugaguaagaauuucccauuugggggcaauggcagaagccugggugacagggaacagccugggguguccuggugcaggagaagaagugggaagggugggagaaggaggccagggccagaucacaggucguuuggacacaauuucuucaauuuagugucuugccaucccaagguacaauuuucacagaccacuguguuaacgucaauucuuuucauuuuaauauuacuuaaaugugcaauuuggugcagccucuguauagggagagccugcaugaacuggaggaguacaacagauuuauauaauaaauucuaagaaaacuauaaaacuaacaaaguuuaaguuaugagcacguuaacgugucaggugaugcuguguuaauaugguguggaucacuuuggcauggaauuugcaguguccacgcaccacaccauggcucauauuucuuuccagccagagagcacccaaccacuuugcgucagauucuuggucuuugcaugguagaagugcaucauuuaggcaucuagccuuuuccuguuaucugcugaucagccuggggcaguuaagguaguggguacaaccuggggcuagcaugagcauagacuuagguguaaaagugggcugugacauugggcuccgcuaaaagaugacuguccagaugacccugaaugugccucuguacauuuuuaaaaagauaauuaucaaaguaagaauugcaaauuagcaaacacuuuuagaaaacacagaaaccccagccacuauugcauuugagacguagcauugauaaagagaaauuuuggagagaucugguggauuaaaucagacuaauauagagugggagacugauuauuguuauugugcaaaugauggugaucuuuaauaguauaggaaauacuuauucuagcaagugcuuaaauuuugcuucucaugugccagguacuguucugagaacuuuauguauguuaucuguuuuaaucuucacuauaccuguaugagguagauguuguuaguauucuauuuaacagaagaggacgaugaggcccagaaaucuuaagucaugaaccuaaggauacaggguuaauaaauaccagaccugggacgugaacccugguaguugggcccuugacuccuugcuccuaacaacugaaaguaugaauuaacauuucaaugccuguuuuaauaacuuucuacacaaauaacuaauggcccauucacaucauccccugcaaauguuuuggggugacaacuuguuaaaauuuaauauucagagcaauacagccccagcuauuugacaauuucagauauaaaucuaccuuaaagauguacaaguacaaauuaugcaauuugauuuuuaagugcuuuucuagcaauauaaauaauaaaguguguuggaacuggcagguauaguacauuaaauugagugcaauuaaaacacugugauauuuuuaaauuaacaagaaaaaaauaaguggcgaaauuaagaaaccugaaucugucuuugcagccuccuccagcugauaacuggguggaugauugcagaggguauuaguaacauuuauacucuggauuucaagugugaugguugucacauuuaacacaaagagcacuucaauuucacuucugcauaacaggcagaugacauuucccacaacauaaucuuuucaguuuuuuuuuuuuccuaaagcagaugauaaggggguauucugagaagacaucugaguugaaauaaugacuugccuuguggauaaugucucaaugagacaucugaaagucaagauucucuuuguuagacgcaggaauaaucugcaucuuucacacucaugggcggccuucacccucuccaaaagcuaacagucuguucauuggaaaccaggaagauggugcaacuguugagguuguuuuucacgaccuucccaaagguuugauauggacagagugagaucugcucucagccgguaguuauuguaaaaauaaaggcugaucaauacaaauuugugcaucaaaggucucuucugccccccaccccauucuggaguuagaaaucucccaaagguuugauauggauagagugagaucugcucucugucaguaguuauuguaaaaauaaagccugaucaauacaaauuugugcaucaaaagccucuucugcacccgccccgagccccauucuggaguuagaaaaguucaggcguagaucauggacugauuuugucauacacacaccuguaccucugcauuguuucugaauguguuuucccuggaacggaccaucucgcuuacuucuccacuuacugccauuacuuagggcccuucaucaguguucacagacuccaagggaacucuguguuuaaaacuggauguaugaccugaagcacauuguuuugaguggaacaaaucagggccaugagccacuuuagacuggaaugugauccccuccauuugaaguccccacagcugccguaauaaaguaccacaaacuggaugacugaaacaaaagaaauugauugugucccgcuuguggaagcuagaaguccaaaaucaagguauuggcuaaaccauacuccuucuggagaugccagggaaggaucugugccaggccucucuccuaacuucuuuuuuucuuuuguuuguuuguuuguuuuuugagacagaguuucgcucuuguugcccaggcuggagugcaguggcacgaucucggcucacugcaaccuccgccucccggguucaagcaauucuccugccucagccucccgaauagcugagauuacaggagccugccaucacaccuggcuaauuuuuguacuuuugguagagacaggguuucaucauguuggccaggcuggucucgaacuccugaccucaugcaauccaccugccucgaccucccaaaguuugggauuacaggugugaaccaccguaccuggccuuucuccuaacuucugauaguucuuuggcuuguggcagcaugacuccaagucuucacaaggcauucuucgugugugugugugugugugugugcgugugugugucuguccccaaauuuccccuuuauauaagaacauugguuauaauggauucguggacauuucuacuccaguaugaccucaucuuaaccaguuaugucuucaacagccuuauuuccaaauaaggucacauucugaggugcuggggcuuaguacuucaacauauaaauuuuaggggugggacacaauuaaauccauaacgcucuguaaggagcaaagugucuggcacauaggugauugauuuauacauucauuguucauugauugaauaucugagugcuugagucaggcacuguucuagauacugagaauaaggggaugaccaaaauaaacagacuuccugaucuucagaagcuuuuauuuuaauggcagagauagauauuaaacaaaaaauauuaucuggagaguucugcagguggccgauucugggguccccaccgcuaccugcugaauugaagggauccgggcuugcuaucuauuuuuuauacaaagcucuaagguuaauucugcuacacacucaggguuaagcaucgcuguccuaaugcacuggcacuauuucuguagugaucaacuauuucguuagaugcgcaucagggaaaguggaugggcaauguacuucgguucccagcacagugucuugaccaucgcauggcaaaacggucgcagaugcgccucuuccucaugguagucaugcaggguucugucccauggugcgcucugcucucauucguggagggugugucaucuuacccacacucuccucggaucucugaaugucauuaagaaaugcugagagaucugggucagcuuggagaagcaggaaagagagaauuagcugcuagugccagugcugaaaauagaacuugagcugagguuuaucuucucgucuccuaagaaccacuagaauggagaaauuaaagacaauaaugaggcuuccuauucuagcaucuuccuagugcacuuuuauguaaagugaggaauucuuugcgaugucagucaccccuccucccccaaauguucuguguaugcauuuagguggugguuuauacuagguugucuguguuacuuuagauauuucaugguauccauuagcaaccuauauuagaauauauggucaaauucuuuaagucaaagaggagggcccagcucgagguauuguuccuucucacucuguccuuuguagggauaaaaagcagcuuuccgcagcuguggaaauaguaucccuuuacguaaaauaagaacccuuuccacaugcauaauauuguaguuuuacauacuggauuucucaucuauaugacugucacucuuauuuggucucuuuuugagcucuccagauucuuucugaauugaguaaauacgucccacuucuuuuacauaaauuuuacaaaugcguuuuuuauuccaguugguuucuguuccucugaucugucugcugguuuucucauauuguagaucccaaucgucuucucacuuuuccugauauuagacacauugaguugugugcucaccugucaagaauugacuuugucucuagcuccugcauucugaaauaugucugguacuggaggaccgcguuccaucuuuggccauaacuggacuaagauuguaccuauaacccaugccuagcuaacucuugugcucccaugugacuaaucgggucucaagaauuuggacagacaaacaggguguaagcuguuggucuggacaggagaggcugacucagggcaaugguaccacuuuggcaggcauccuuguucccaugucgacuggagaggcaggcacccuugggcaaaagaauuuaucagcugguagaaaagagagaaugcugcaaaccccagauaaagcacaagugagaaacccuuaggcuucugacugagggccaugguggggcacagggagagaagagagaaggagaaagaaggagagaggagauaaacagugauggagaaaaaauauggagacagugagggagggguaagggggagauagauggaagagacagagauaaauauggagagauaacugucguaauuuccaguggguuuccaguuccugcaagaaucagaauacuuuguuccucuacuaguuccauuguuuauguguuuauguuaaacuguccuuuuuccuugggccaguucgagugaguuuuucuuuucuuuuuuuuuuuuuuuuuuuaacuccugaaagacuguggacugaaucacacuaggagcuguuacaucuugagaaucauuuuauuauccucccccgucuuuuucacuaaggaauuguuucucauuuauuaagcaauuagcugcaggggauggugagaagaaccugagcauuaacacaucaacacaccuggguucuaaugcuggcccugccacuugugagcuggcuggcccugugcaaauggucgaaggucucugagccgucgauuuuuuucuucuguagaaugaggauaaaugauauuugcuuuacaacauaggguuuuaugaaaaguaaaacuuuuggaaacauuuuaauuuuccuucuuuugugauauugaagcucuaucuuauugcuuugaagaaucugagaggucuucuucuugaccuuuaaggacagguugccaaauucuggccugcagguuaaaucuugcucucuacaugugucuguaaauauacuucuacugaaacagaaccaugucucuaucucugguggccacuuucaagcuacaguggcaccacugaguauuuuggcccacaaagucuaaaauauuuaguauuuagaccuuuguaggaaaaguuugccaaccccuguucaaggaucuuacagucuugaugagaauuaauacaauguucuucuaauauacauguuguuuauuauuguugauuuucuuauuuuuuuuuuuuguuggugguguuuuucuuuuccuguaccugcugauggcagauauuguagauuuagcuuuuuauuuuauuguauaguuuucuuggucuuugauauguauuuuggcuuuucacuuagaagucugguauauuuuaugucauccucaguuaucuaucacuauuguuauaaaaugcuuuuaaccagccagcuuuuuuuuuuuuuuuuuuuuuuuuuuuuuuuugccauugaaucuguaacauaugauguguagguuuaaccugcuggacguauucucugaugugcaaauaauuugaugugguuggugacagcucucagaggauucucccaccugcugcugacuggcuucucauuguccaguuucaucuccagaauuuggucucuuuaggguaaacucaagcugugaccuaagucucugcagccgguauagugagcagugaaucugcauaagccacuuuuugauguuuugugcaaaaauaucuuuuguuacuaaaauaucacucuacaacuuguacugcuagugcuuuuaaugcauaaaaacauagaacucucuuuggaaccagaauuuaaauaaguacuuaaaaaaaaaaagaaaaccuccaggcuuuauaagagguaugguuuggugaaaaugucguggauuuuggagacagauuuuuguucacaccugaggcccuuucacuuaccagcugaaugaccuugggccaauuauuuaacuuuccaauuauuuaacuugucuuacuuuuaauaugcuguccucuaaauuggagugaacaccaauuguagaggcuguugaagggauuaacugagaagauaccuauaaagcaguuugggucauaaacgccuuuugugaggggagugguuauuggagaguuauuuagagacaauuccuuuggcaggugacucaaaauugugguaccagguauaauagaacuuccuugaaccagaagucuucagagagaaccaauuugccguugucauuaggucaggcagcucaucgcuggaucuccuuguucacccuguuucacccacacuggccuucguuuugucuuauuuuguuguuuuuuguuucccaaguacaucaaccucuuuccuaccccacggcuuuuauaccuguccaaucagagauaugugcugcucugccacagucuaugcccuacuucccaguuauucucuucuuauucauucccucuuguucuucaguucuuggaucaaaucucacuuucucaggcaugccuuuccugaaccagucuuggucagguucugcucuuguguucuuuuuuuuuuuuuuuuuuuuuuuuuugauggaguuucgcucuuguugcccaggcuggagggcaguggcgcaaucuuggcucaccgcaaccucugccucccggguucaagcgauucugcugccuuagccuccugaguagcuggaauuacaggcaugcgccaccaugcccagcuaauuuuuuguauuuuugauagaggcgggauuucgccauguuggucaggaugaucucgaacauucgaccucaggugauccaccugccucgggcucccaaagugcugggacuacaggcaugagucaccgcgccuggccucuuguguucauuuuuaagcaaacaaacuuuuuuuuuuucugagccccuacuauaugcuggauguugcagauagaauggaaauuuaaaacauacacucccucuccucauuugaaacuucugcacucagcagaagagagagguauugcgagcaugcaagcauacagauagauugugauaucacugcaauugagcuccacagaggagaaagccaugcugccaagacagcucaugaagucaacaaauugggcguguuggggauuucaggggagacuuuccugagguugaggaccaugggccuuuaucugaaggaccaaugggaguguguagacagagauccuggaagagugauccaugcauugggaauggcuugcaaaggccuggcagugggagagauggaugagacaguuugccauaccuggggcacugagagugggagugccaugcugggaagucacugucggcugagcaugcacggccuugagucaugcaaaagaguuucgccuuagucuuuugagaaacuaaagcugcauggagggcugacaagaucagauuggcauuuugaacagcucccgcugugcagagaauagauugggaggcaagaguggauuccaguuaaggacaugauaguaggugaaauaagccaguaauaaacaaguaaagacuauaugauucuauuuaugugagguuccuagaguugucaaagucagagcaacagaaaguggaaugguguccaccaggggcuugggggagggaagaaugggaaguuggcugggugugguggcucacaccuauaaucccagcacuuugggaggccgaggcagguagaucacaugaggucaggagcucgagaccaguauggccaacauggcgaaacccgucucuacuaaaaauaaaaaaaauuagcggggugcaguggcucacaccuguaaucccagcacuuugggaggcugaggcagguggaucacaugaggucgggaguucaagaccagccuggccaacauggcaaaaccccaucucuacuaaaaauacacaacacacaaaauuagcugggcguggucguguaacccaggcagguggaucacaugaggucaggaguucaagaccagccuggccaacauggcgaaaccccguaucuacuaaaaauacacccacaacacacaaaauuagcugggcguggucguguaacccaggaggcugaggcaggagaguccuagaacccaggaagcagaggcugcagugagccgagauugcgccacugcacuccagccugggcgacagagcaagacucugucucaaaauaaaaauaaaaauaaaaaagaauggggaguuuuuucaugggucuggaguuuguguuuuacaagaugaaaaaguucuggagauggauagugaugauggcugcacagcaguguaaaugugcuucaugcuacugagcuguacacuucaaaugguaaagauggucaacuuuauguuacguauauuuuaccacgauuaauaauuuuuuugacaagaauggaugcaaggggaucagcuggcaagcuguugcagcugucagacagagagaccugcugagaguuugggauguggaguuguggguggagauggaucugagaggugagaggggaugaauuagcuguggugcaguuggcagcauggaagaguacugcuucaagggagguugugggucaggcuuauucaacugguggggccauuuaccaacacagagaauuuuuuuugagacagaauuuucacucuuguugucuaggcuggagugcaguggcaugaucucugcucccugcaaccuccgucucucagguucaagcaauucuccugcuucagacucccgaguagaugggauuacaggcgcccgccaccaugccuggcuaauuuuuuuguauuuuuaguagagacgggguuucaccauguuggccaggcugggcucaaacuccugaccucgugaucugccugccucagccucccaaagugcugggauuacaagugugagccacuacacccgaccaacacaaagcaucuugauaacaaucucucagagcacccuguacuuaccgcaguguaacuaaauaauuauuugggcaaucgauuguccuccugaugagcuguaaagaacacacagguagagaccauaucugccuucuucaccaacugucuucagcaccuggcauauugucuugcacauaauaggugccguauagauauuuaugaaaugcagaugauuugggguauuuuaaaucuacuucucuaccaacuccuuugguucuuaagcuuauuucuagcauugaguuuuuacaugucagcaaugagaacagacugagagacacaggaccaggcagaaagagaucaaaauauuacuuuuuguuccaacaguuuagagaaugugucucaaccagauagacuuacuuccccacccaaauuggucaggagcauagcaaacaguaucaaguccucuccuaggaacacauggcacauacugucuacaggcagacagacccuggaagaacaggagagcagggcuggcugagcauggaaccaggaaagucuuucucacagacuuggcaaucagaugucacuccucuucccuaggaaggaagugggggcaagagguuaggcuuguugcucugcuagagcucacucuucauugaaaccucaggaaugagguggaaggguuaauagaugggauagcuuuucuugcugcaauuuucgguuuuucugagggagguguugugaguggccaaagucucugguccucugaccauuuucugucuaguauaagaaagagcgugagagacacguggguaccugucuccucuucugugcuuaucugggacaggcuuuauaacaucucucuucguaggucuucuucuuucuaaaacccagggguguacaugaugauuuuuuuauuaccuaauauguagcuguuuccuaacuuuuggaacugccugauaaauuggcugauagagcaaguguagcuuaagauugauaaguauuuuuuaugugugguaagaaaugucuccuaaacauaacauuugaaagguaaaacaucuucauguaaaauguuuuaggagaugaauugucaguauucuuuauugucaaguauaucacacauacagacaagaauggccaccauucuuaauccauuuaugcuggagguugcaauuuuuugaauuuuugcaaucagaccuuggcgaugaccuugaacgguaggauaucaauaacucccacaugcuuaguguuccaauaauggaacacuaggcauagauggguugaaaaucuuaaacgaugcuuaagagaaaggacaacauaacuuugauucugcaugcugaacauauugcaucaugaaguuaagcauuucagauuucaccauauagcucuuucucuucauagccaaauguuguguuagggauuagagaaugaacgguucuagcucuaucuagcauaagcuuugguaauaauauggaaccaggaaaggagacauuaacagcuugaggguuugaggcaggacucaacuuugcuguagauugacuaauuguagaguaugaaacacacauacgugaaugcuagguaauaacuuuucuucguaaagcauuuuacacuuuacguauaguauuuacuuugguucaguguuuagguguaauugcaggccauucucuagacaucucaugauggcuuucaucucacucaguauggacucagcagugugguaucugcaugauagauggugaaauguagccauucugggaacuggggaaauccaguaaaacucagguggugguguacuuccugcagcagggagguuuagaggacaacucuuuuuuagcucccccuggccucaggauaaaguuccaaguuuuuuggugugccuagaaggcccucuggaaucugauccacuugucuuuccagcauuuucuuucacugguccccacuucgaccagggcuugaguccuaucacaguauuuuauguucacuggaagcucuacucccucugaucuccaaccauaggaucucacauuuucucauuuuuuggugccuuuggcaucucaguaauuuuuucacagcacccguagguaaaaugaaauaccuauuuuguuauuaagcauuuauguccuaacaacuuaguagcugucugaaaaaaaggauacauauaaauugaagggaaaaauaccauuauuucacucuuauccacauuuauuugcuuaugggauguauggaccuguugggcacuguacaauuuuucaaacucuggaauuagauuggacaggcguugcacacugauuuccaugcaguuauuguuuuuuaucauagcaaguucugaaaauucagcuguguuuaaauacagccaccaaaggaauuagugcauucuaauguugaaacugugaacuaccucgagcuaauaguugaggcuguguccagcaugugcugagaauugcugcacuucucuagaaguuuuaaaguauccugcggugcccccguggguccacuuuggcacccuggggcaccuuggcacacaguuugggaaccaugguucuaagauguuguauaugccguuuccucugcuugaacaugucucucaaucuagcgucuuggugcucaccuuucuaaucucaacauguacgugaugaguccucgaaguuuuucccuuaaucuuuaagacugagcugggaggugcuuccaaaugcuacuucagcacucuguccuucacccugcuauuuuucucuuugcagugugauuuuaucuuuuuucuucuacuaggcuuuauagugauugauagggaaagggacucuguagugacacugcagauauuucauaaauguaugaauuuaaugagugaaugaaugagugaauaacugcuauuggaucuuaaccagaaugagcuuguuggcuggagaaaaucaaauaaacaaacagguugacaaguacagggcuccuuucauuuguaggagaagaguuuuuguaaaauccugaccuuggggacuugcagugucucuugcauccugcgaccucacauccucuuugguuacacacaacggcacucccuaguuauagcaaaaggccucaugaauuauaauaccaacaacagugcaggucaaugugagccuuuugcauuuauucauguugugagacauugacccauaugcaugucucuguugagaaauuguagguauaacuugcuucaaauguauguguucuuuccuuuagagggaaauauauuaaguugccugauggcucagacuccuggcauauugcagcauuacagaaaauacagaugugcugcaguaauuuaaucuagaggugauggaggcuuggggacucuggcgcagcuccagucacagggagcagaucuugggcuuuaucccacagcaggugggaaaggucuccccaggccucagcuagcagguauuucuguuucuggaacuaauagaacaucaggaaccuucugauaacaaugaguaucaaggaagagggaugugcauuuccuccuccagaccaaaagaacucagguggcuuuucugagcucuguggacauuguuuugcuuuaguuuugccuuaucccuauaauaggaggauacuaauguuauaaucuaccagagauggcuguuuuuauuacuaaauugaagagcauggugcaugaauguuggccaauaauaacaguaauaguaaucucagugaaguccugugcaucuccacuuaaggagaacaucauguccuauucccuuaagauuuccuguuuucccuaggccuuucccauaggcuuaaaaaugcauuuucaaaacagcccugaaagauagauggaaagcuauguucccaguuaauugaagcugagggauauaaaauuacuuccccaaagucaacaucgcuaguaacucuucugaguccuccuuuguaauggcucaguugcugcaaagcaaggggagccuuuucuccacucugcugccacucuaugggccugggagaugccaguaacguagccugagguguuaagacucaagguuggcugaaauguuucaugcagaaggacagaggucugcugaaggguccuugugagugcugcaaauuaacccucucuugcccuuccauuauugcgagggaggaucuguuucuauccaucuuuuuacgccauuacauacuuacacuacuuccaaaguuagaaaggugagaagaagcagcuaaauguauacuaaaagcagguucagggaaugggaaauaacaaagaggaaaggauuugauuaucucugggguccugcuuucaaccuuccuguagaucuuaggcaagugccugugagucucugggucucaccugccuuauguagagugggcacaaucacucucucuuccguaccugcaucaauggacaugagugaucaaugcacuagcacagccucagaugcuccaaaaucugucuccaaguuccgccgaucuaaaggaguauuauuuuucucagaagcauaugggaguuuauuucagagaagcacccauacuuuacagggaaagugacuuaaccgauauaauaagguaaauaauaaguugucaagcccuuaucucauacuuagcuggagcagcuaaaugccucuagugcuucaucucauuuauucgacaguaucacaagguaagugcucaguggaagauccuuaacucaucuccacugaagaacacauccaauaagcaaggauuccuccauucccucugguaaaggaguguucacugcccacugaauguggagucuccagcuaccagcuuacuuucuaguacuguuuagcauugcugauugcaccaguuaaacugugugcucaguuucaucaagcuuauuauagcauaucuuuaccuauaauuaacaaauacaguuuaauuaauuauuccauaaagcagugaaauaugagugcaggaaggaauguuucuauaaaaaauaauaaguuguguauuuuggaacaguagccuaaaagcaaauugccuuaagaagagcugucaaauaagauguuggcaagacaacugaaaaauggcggaaaagauaaaaauaggaaaggaauucuguacucugauuaguuuacacauaucuuuuaaguuuaccccacacuaugaaagaaaaagaaaagauaaaaguguguggcgaugucugugauuuaugccaggaaggcaagguaggauuuucagacagcgggcauguccuuauagaaaaggccuuugccccauaaccaaaaauuguccaauaaaugcauguuuguaugugauaaacuaaaguguuccuaguuuauacaugccuuaauggugcugguaagagcaugccuguuuuuacccccauuuaacagaugacagugaggaccaggggaucacgaucuuaaccaaugaugaagagacccagaguuaauaauuuauauuauguuuuuaauccuguugucugcuucugucuuucgaauguuuuaaguauacuuuuaggcaccuuuucuuggccccaguggcuuucucauuacaaucaggcuguagugccuacagcugacacugguauuuagaaggcucugauguuuucaagccaggcuaaggccaguguuccuggcuuuucuccugggaguaauggcuuuucuguuaaggcauccuuuccuguaggaggaggagcucagugacuuuccucacagacugagauaaacgucaugauagagauaagccaucagauacuuagaauuugaugcuguuugcauuuccuucuggcuuguuguuuggggcugacgcuucuuaguccacaggugcaaagauggaaaaaaagugucaggaauaugugagaaggauggaagccuucuuucuggagaaacucauauaacucucccaucauccagcaaaacaacccagguguguguauaugcgagggugugugcacgugggugcaugcaccgggcugaguaauuauaacccuuauagaggcuuauugugguggaaugcagccuucugggaucuggagagagagaggucuccuaugugagcucuggauuuugacaaauggcauauuuugggaugugggguuuauuucugcugaauaucuggcuugauuagcguggagaagcacaugcaaagcagacugaagccccacccacccaagccuccccagugcuguacaaucaggaagugcauucucacucccauuguggcuuuggagggaagugugcuuuacauaugcaaaugcaagccccaaguuucacuuaauaauuaucagcuggagauucuauugaugagcagcugaagcuacucaucaguagagaaacugugaauuaaccauuucuaggccauccuggagacugcugccucagaccagccucugaauccacuggcgguugcagaaaaagauuucugauuccuccugugugucacuucuccugucugaccugagccuggcagcugagaccuccugaccccuuuuauuaucaugugugcaucucuucccugcucccaccuccuuucuguuuuguaggcuacagaaggcagaauaggugcgucucuauuggcaguagcaggauugcuuacagcucuagaaauaauggccucaugcacucucugcgguagcucuccugcuuaggcagcugccaguguccuuuugaaagggcacaggacaacccaggcaggguagccaggguguucagauuaagaugucaggaaauugccuucuuucugauucuucuuuccuuucuucugcauccaugcuugcccucugaguguaauaauaguauacuugggcugcuuuaucagccucgcuuguucuugcugugccuugguagaguucagcagacuguuaaaaaugguaugauuuggauucucuuguuauucaucuuucugcaccaaguuccuuacuuuccugaaucuuguugaaacaaggcugcugcuucucuuuccugcaaguggcaucuugcaagaggguauccccagcuuguuguauagaaguacaaccuuuauuuccuggaaagagauauuuagaugcagaaaguaaaaugaaaaucgagguuuuuuuuggagucaauuugaucuuuuuuuuuuuaacuucuuuuugcaguaaaucuugcaaguuacuuaaacuuuacuuaagcccagugagccucuguuucugcuuuuuuuuuucuuuuuucuugagacggggucuugcucuguugcccaggcuggggugcaguggcacgaucucggcucacugcaagcuccgccuccuggguucacaccauucuccugccucagccuccugaguagcugggacuacaggcgcccaccaccaugcccggcuaaguuuuuguauuuuuaguagagaugagauuucgccguguuagccaggauggucuccaucuccugacuucaugauccgccugccucagccucccaaagugcuggaauuacagguaugagccaccgcgcgcagcccuguuucugcuucuuuaaaauggggacaauaaacccguuucagagaacugaaaucacuauauaagauaauguaugacauucaucccgccaaaguggcuggucaguaagggagcccuaaucuugauccucauuugaaauccgauucucaucacugaacuguugcaaaaguugcuuguauucaccugcguucuugauuuaguaucaagaugugucuuuugagugcuuacugugugcuugguuccagacccuggagauacuguuguugaaacagauccacagaagacucugcuaccauugaacuuguguucaugagguggagacaggcaaauaaaaaggaaacagauacguuuauacuugaggagaguguugugauuuguggaguggagaagaauaaaccaggggacagagugaaagaaacacuguggccucaggaugggcagagaugggguuuuaaagguuggcuuacagaugcugcucugaagaaugguauuauauuuaagcagauuccuaaugaacgagggaagaggcaacagcaaguguagaagcccugagugggagagugcuugcuauguaucccaggagcauaugccaggccggcauggcuggugcccagggagcagaggagcauuuugaggucggaaagauaacugugguugaugggaaggcagguucaaagcccuggguucgaacaggauagacauguggucugauaaccaguuuuuuuguuguuguugcuguuguuguuguuuuuuuaagauggagucucgcucugucaccgggcuggagugcaguggcgcagucuuggcucacccuccgccucuuggguucaagcguuucuucugccgcagccucccgaguagcugagacuauaggcaugugccaccauaccuagcuaauuucuguauuuuaguagagacgggguuucaccauguuggccaggauggucuugaucucuugaccuugugauccgcccacacuggccucccaaagugcugggaucacaggcaugagccacugugcccggcccugauagccauuuuuaaaggccaucuggcugugagugacaaguagaaugagugaggcagaguggccuguuagguggcuauugagugaguccagguaaaaggucccagaacuggggucauagugguggggguuguggggaaguguuuguauccaggguauauuuuaagaucaaaccaacauugcaauacauugcuaaugacauacaugugggacaugagggaagaaauucaggagugaguccuagauuuuuggccugugcaguggggagcaaaagugaugacauuugcugagaaaagaagcagaagguuuuggagguggaaauccaaggcugugguuuggauguggggacaugaaaggacuccuaagucaucaucuccuuccacaguguuguggcuguguaggaauggccacgguguauacacguugugccaggcacugggaagcacaggugauucagccuggcuccugcccugaacagguguucaguugacguguugagacaauggagguggcauaaagagcuguuacacauggggugagagccacuaccuuaucuacguuguggaagguaguaggaaauccaaggauggugaaagaagagaaggagccaacucacccugggcagauuggagaaggguuccuagaagaaauuauugagccagguguuggaggguccaugguaauucaccaaaugacaaaacaugcaaaggaaauaauacaacauuuuuaaugcuuauuccaacugccagcccugcauucaggaacuuggcacagggcuuguauauguaggggcuccugaaauccuuguuggugaagaucguugguccacugaggacucuucagagccaaaagauggaaguauaaagugcaguagauuucaccagcaauuucagaaaguuuagcaaggcuugaaccaggauauccucuuggccaaucagccgcgucauccccauccugacacugucucugagaucagucccucaggugggccucuguccugcaaggggcuuuucuuuuuggggucagaaauugggauccuguacuggaggcuucaccaucauaggcuuccccuugguccucugcaccuguuacuuccugcacucaagcgcaucauuccucucagcuugcagaggaaaauccugacuuugccuuauagugguauugaguugaggguucuuaguuuuauucuucuuacuuuuauaagacugcuggaagcaccuuauaaaaacucuccgguguaggacuuggaagaaaauacccguccgucaaaaguagagauggcggguuuugaccuuaauaaguauuaacacaagauuuuacccaaacaucuaucuugcucuugguaacauguuaucuuugccaagugcccaucccaauaaagcguuauuucugucaagcugaacuccugaugaaaucuucuauuccccucucucccugaucgguuucgauaaaaccucauuccucauucugauuuucuccuaagggaugguuuggauuugucaggaaagggugaaaaaagaggugauuuuuuuuuucauuuuccuccucuuauuucuuuuucuaauauagauacuuguuggaauuggaauauaacuuuaauguaagucaaacugauaaagggugguuggacacuacugugaagaaggaaaagaagauaggaaaaaggaggacagucacuuacaggcaaaggaauguccagccaggcuuuugcuuguuuucucuuguuuuuaauuuacaauggagcugaggaagauaacacugauuuaggugaaguggcauuuuacagcagggggaugccauugaaggaaucaaugacauucacaaaaguacuugcuuccauuuuuuuuuuuggaauggguuagaauauucuggauggcagcuacucaugccguuggauggcuauguugccacugcuaacuuuaacaaguacagagucccccuuaucuuugauaacuagcucuuucuauuccucuuuuuaccagccccaucauuucugucucucaucugguuccacuaucgaagagugaacacugcaggccagaguuggacacuucuggugaaguguggcuugcauagcagguggucuccauagaaggcuaggcaagggguggggaguuuggaugaagggcggugauuugucucaaagccaguugacuguagaggagaugggguaugucagagggccccgagaauauggugcaagucaaguccauccucacugaugcuggggcuccugaaaagauggggcagggccuuuccucccauguugaucuugcuuacaugcaguauaagggaagagaacuuuugcucagguuuggcaggugcaccauuucaagggcaguggucagauaggcaaacugaccauucuaccugacgcauagccuaaagaacacucucuggaccaggcuuauccaaccuguggacagcuuugaauguggcccaacacaaauuuggccacuuugaaaacacuaugagauucuuuuccuuuuuuuuuuuuuuuuuuuuuuuggcuccuaagcuguccuuaguguuaguguuuuuuauguguggcccaagacaauucuucuuccaguguggcccagggaagccaaaagauuggacaccccugcucuagauuuuuagucauguuucacauucaguuuucuucuuacagucccaagacauucauggaacaacugucuuccaaauacagagaaggauaucaaagucugaguggguuaucugguagucccccucccucccgaggacagcagaacaccauaguucaauucugaugcaguccaauuaaagacacacucaugauguacggucaucauucuguuggauccuuuuugaugagagucccuaacucuucucuguagaucugaauuucacuuggauauuucuccucucaagugaagcaggaggggcacagaagcccaaggagcaggaaugaauggggucagggcuuugcugauuugucuggcauccucaaauagcugcuguuugccauugaaaucuuucauccucuguaacccaaaccagacauuauugucagugcuccucauuuaaaaaaaaaaaaucacagaaaugccaggugcggaagcucacaucuguaaucccagcacuuugggaggcugaggcagauggaucacuugaggucaggaguucgaggaacaggcuggccaacauggugaaaccccgucucuacuaaaaaugcaaaaauuagccaagcaugguggcgcgccuguaaucccagcuacuugggaggcugaggcaagggaaucgcuugaaccugggagguggaggucgcagugagccaagacugagccccuguacuccagccugggcaacagagcgagacccuggcucaaaaaaaaaaaaaaaaucauagaaccuuuuuugguaauaaauauggccaaccagaaugacaguuugaggcuuacagcaaguauagauucacaaagugagaaaaggauaguuuucaacauacucaguaugaugaaugcaaaauaaaauugaaaaucuuugcuaaaaaaucaucccaugugggucuucugauuugaacaagauuuuagcuacaaaaaaaaaaaucaaaccucauuaaaaauuuuuacuguaaaauaugauucuuagcacgugugauucgccucacucuuggaacauuuuagugggauuuuauaagggcuaugaauauuucauaucaaauaacacauuuauugcaaagguuuuaaaaaauuaaaucaguggaaaaaacacuuaugaaaucuuucaucuugagugcugcuaaagagaaaauuaagaaauucuauaguauuucugcauuugauuuuauaguaaauagccacauugaggacacucaguugaugcuuugcaaaggauaaaaucguuaugguuguuuagcuuuuaguuuugaugaaucuaccaacaaaggggauuguguccaacuauugcauauguaugaaauaggacucaagaaacuggggaaggagaaaggaugcuuucucagacucaaccauuggagaccgucacuaacgcuggugaugccuucaaggcuguguaaaagugauugaaguuuaggggcuaacugggggcagaggcucuucaaagaugacuggaaugugaauuuauugugcucucacacacagaucaauugucaggauuugcggugaauaucuauucaccuuuucuaguauacacuguuaucauuacccuccaaugacgguuuucuaaaccaccuggugaucuaagagaagaccuucacucugcugucaaguccuuccauuuuucuaggaaacagagcacuaaauacauuaucuuuuuuggccuugguuggugacgauuugaaugcuacuaacaaagcccuuuuguccauacucagacuccuugaguauaugacgggccaguuauagaagcaggaagacaugguugccccaccaugguaacagcaguucaaagaccaacugccuccaacuuucaaaacuuagcauauuuggcaaaaaaaaaaaaaaaaaacacacacacacacacacacaacaaaacauuugaagcuuugaaaucauugaaccugaaguuucaaaagacaaaaacugguaucauugcucguuagaacacacuucaagcauuuguagucuaaacccagguauagguacagcaaauuggugcuaaaaaugucuucauuuucuugacuuaaugaagcucuuuaagcuaacguucuuggaaaugauuuuauggaagacaaaagucagaucucauucagccuauuauggugcagugaauccaggccucuuucccuggcacuguaguugcaaauucuuuuuagaagcuagugaggaacucuccuuuuuuuuuuuuuuuuuuuaacuguucuuccaucuuugucagaagaucugucuccagggccuuugcuggaacucaagugugcuuugguugccaaagauaacuuccagaaaaucacuuaggggaauuuuggggcaaaacauucccuguguaccucauaaaaagcgagcagccuuugugugucaucauugccauuuuccuucccacagcaaaucugauuccaugcuuuugaaacuuaagaaaauggcucagccuggaccugugucuugcugugacuuauaaacugccuagaaaagaaaagcugaugacacguuggcagacucagcucuccuguggacaucucaugaucaaaauuaacuuuuaagaucaaacugaguuuucuaaauuuuucuaaaaugacuuuggcugcaauauuuaauuuacuuugaaauaucaaaugauauuagauauuuggcauugaaugagggugugaaaucuuuauguuaauuaaaaggagggcauuuucuaacaaaaauuacaaauugcuaaaugaauauagucucauauggagaaugaaaaauugaaacauauauuggaauaaggugaccugugauuggucaagagaaaggaaccagaaaccggagaagcuggauagucaggcagcugggcuagaagggaacugcuuuugaaggagacugucuuccaggaagcagggcgaugccgaggagcaaagcaggcccuaugcuuggaggagcuacaauaccaggaaaucaugugggucugggucacaugauggaagcugcugagagaauacaguagaggcuuguguaagggaaauggagugcagggucagagcaauacuauaauuaaguguggcaaugcuaagacuuccuuugaaucuagagagucuggggaaaugccucagccagcauuucucaaccuucauuacacaugagaaucccaugggaguggcuguuuuuaaaaaugcugaaaacccaaaggaauauaaaucauucuguuacaaagauacaugcacacauauguuuauugcagcacuauucccaauagcaaagacuggaaucaacccagaugcccaucagugauagauucaauaaagaaaauaugguacauauacaccauggaauacuaugcagccauaaaaaggaaugagacaauguccuuugcaugaacauggaugaagcuggaagccauuauccucagcagaguaacacaggaaaagaaaaccaaaaaucgcauguucucacucauaaguggaagcugaacaaugagcacauggacacaaguaggggaacaacacacacuggggccuguuggggaguuggcaggggagggagagcaucaguaagaguagcuaauggaugcugggcuuaauagcuaagugauggguugaucugugcagcaaaccacuguggcacauguuuaccauguaacaaaccugcauguccugcacauguaucccggaccguaaaauuaaauuaaaauuuuuuuuuaaaugcugauaacuagacccccaccuccagagaugcuauaugaauucaucuagguugggaccugugcacauucauauuguuuccuaaguuuuuuaauggaagcccagauugaggaccacuggccugagggaccagggaaugaagcagaaacaacaaccgcaaccacaaauuaggcuggacuuguucggaggguguugaauaggagacauuccgguucggugcggaaagagccauuuaucuggagccagugaaccuggguucaagacucucccucugccauuguugcugggaugacauggaacuaguuaaaucaugugccuguuucucuuuuuuuuuuuucauuagucaaauggaaauagugagaauacccacuucaugacagcguugcauaaauuaaaaugagacgaugcagacacagcacccaaggacauguacucagggggaacugaccaaguguuuguugaauuugauggaugaccuugaaguagauagaguuguuuuugugcauuaucagacugcaaacgugguggaaauaggauugaagaauguuauccguggcaccugcgagugagcugacaggaacagggagaaaucagaggcagggggacuagcccaggagacccacacaauguucuaggacaggauccauaaucuauggccaaaaaguaugccugaucuggcccucugcuuguguuuggaaauaaaauuugacuggaacacagccacagccauuuguuauguauuucuauggccgcuuuuaugcuacaauggcagucaagugcuugaagcagagauagcauagccugcgaaguaaagcacauugacucucuggauguuuacagaaaaaguuugaugaccccuguuuuaggauaagauuaagaggcuuggcuucggaugagauguuugaaaucaaaugggaagagcaagugcuucaaacaucaggaagaaagaauuggcaggcuuuagugacagauuguacguagggagauuuugccauauaaagguuagggauguagugucuuuaucacgggcaggaugaugcaaccggacagcuuuccugaaaucuggcacuaagugcaagaguuugcuuuccuagacuagagagaucugggucugucaccccugaaagggucugagcccccuucaugggaggcccauccagacccuggcccugccugcauuaaugagucccaguccuauucauuucaaagugguggaucccacaugcaguaccagaugccagcacucuggagagauccagagauacucagcacauucagauugauugagaucaucacuuaggacauuuuggaugguaagucccuaaucucugucacugcacugcacggagguugauuuucaauuuaccuucuuuguucugaaucuuagauguuuugauucuuaauucagaacauucaucucaaguggauucagagauucagagucgaugauaaauucauguuuguugagaaguuuugcagggaggaggaugauguugucagcuuaguuuuugaauaaugucuuguuugacauuuuaagcugaaagugggcugaaccgcagaucaacacacacacguauugcaugauagaacgauacaucauguucauacauagacuguguauaucuaaagaguagaaaccuggaaggaaagguaauagagaaacaaagguaaaggcacuuacacgcaggggauucuauccacuucugccuuuaugugcccugccugcagcuuuagugggcuugggcugggagaacagcagagaauuugaguauugauacgguuuggcuguguccccacccaaaucucaucuugaauuguagcccccauaauucccauguguugugggagggaugcagugggagauaauugaaucaugggggcgguucccucauacuguucucaugguagugaauaagucucacaagauccaaugguuuuauaagggaaaccccuuucgcuucacucucauucucuuuuugccugccaccauguaagaugugccuuuguucuucccucaccuuucaccauaauugugaggccucccaaaccaugaggaacugugaguccauuaaaccucuuguuuguuauaaauuacccagucucggcuaugucuuuaucagcagcgugaaaauugacuaauacaaguaucuacucuguguaagccugauaugaaguaauauuuguguguguacacacacacacacacacacacacacucaugcuuaugcucccaugucccucauuuuacauaagacacugagucacagaaaaguuaaguauuuugccuaaguuauuuauuaguaaguggaagaaccauaauuuaagcucagcucuuucuuacuccaaaucccaugcucuuacuuaucuacuugauuuguuugcuuuucucaguucucucucccucuuccccagcaucuaauauuauaaugagaugucuuuuuaaauaacuaguaguuuaugaugugcuaggcauuuuaugccuuuuuuuaacaaaaaguuauaguuguuaguucuucucuuucucucuuccucaaaugcuugcuaaguauagggagcaugccaggaccuggggauggagacuggagauugggcggugccacucaaggugugaucugcaggccguuguucguccuucuauuugucagggcucuuuagagaagcagaaccaauagagugugcauauacagcuauguuuauuguaaggaauuggcuugcaugauuauggaagcugacaaguuccaagaucuucagguugagucagcaagcuggagacccaggagagccgauguguaguucuagucugaguccgaaagccugagaaccaggagaucucaugguguaguuccaguccaaauuccaacaggcucgagacccaggaagaucuggugauucaguuugaguuugaaggcaagaaaaagaugaugucccaauucaauggcugucaggcaagaugaguucucuugaauguggaagauggucagcauuuuuguucuacucaugccuucaacuaaugggagguagccaacccacaccaggggaggacaccugcuuuacucugucuaccaauuuaaauguuaaccucauccaaaaacaccuuuaaaaaaaaacacccaaaaugauguuugaucacauauuuggguaccaccuggcccaguugaguugacacauaaaauuaaccauauccucaaauuguugcugcucugcaacaagauacauauggaacuugagacuaagcauuuuagaaacaucuagagcaaauggacuuuguggccagcaucaaguguaugaucaauagucuugauuaacguaguguagaccaguuuguuuaauuccagugaugaguuacacgugggccaagcucuguuuuaccuuugaguguuaggggcaaauuuuuauccaggauggacugggggagggagaaaaacugguucuucacccaagcuccuugugcuuccaugccucucuugcugucuucaccacugguaguuugagaaauaucagugugggcacaguuguuuacauagccauaaaaucguauguaaugggcuguauaacuacgaccuauacacaaagcuugaggagcguuccugggagggaccagugccuguaaaacguaacagagaaacguaaggaggcuggcuguucacuacccugacccucucuccugcuugugcucccagagagucaggagaagccugagcaaagagaucaggagccagaaaaaggaauagucaggaauaaaagcaaaagucaggaugaauaaaacgagaaugagcugugaaucuggcaaggcagcagggcccacuauucacuucugaucaugcgguguugggaucaucuggaccacacagcuacggagaguuagagcugagaggggacucggagcacaucuccagggccccgccuuucagaaggcaaaacuggcuugaggaaaaggaaggggccggcucaagauaauggaccuuuaaaacaaaccaacaaaccggaaaggacaauucugccauuaauugagcacuuccuccaugccagcaguugggcacagcaugaauguugcuuuuuucaacauugauuccucugagaccugacauuaauuauuuaguuguggcuucauuggugacaaaucuauagggcuuuuaaaagugggaaaacccccgcacgucuuugagaguuaaauuugguuaaaaccauuuggggucuaaagcaggggagaaauggacacaggaugucgauagcauuucucuuaagcccacaaucagacaaucauaauuuacguaaauguuuaaaauaugggacuuucaggagaggggcuagagaaugugacccggccucuuuggugaagccugcuugcuugcuccuccauguucuuacggauuaaccaugaccccggcuaaggaugaaggcaggaagcucagcagugccuccucuuggaguauaucucaaaggaagccaaggucuguugacugcuuguucccccauacaacacacagaacaacucuguguucugaaaauacagcgugcuuuacaccuuaaauuacaucaucaacucaucuuacccaugacaucaccuucccucacugagaaagggucacaggaacucacugaugccaagcgccucccaauaagggacaccaugcucuguauuuuguuauuuugcuuaagccucccaucacucuuacuggaacauuuuauguucccauuucacagaagaaaaaaucgaagcucagagcacugauguaacuccuccaaagaggaaacucacaggucccauuuguuaauuuucuagagacccugagacccuguugagcuuccugcauuucugcccaaaugcuccaaaauccuuuccugagaaggaagacccucucagucuccugagcgucuuuaccucuaacuuagcacauauaugcaggagcauagcugagcucaaaguccaggagaccuuguuuacagucaaacugcaacauaauaggaacacaguuuaaacuuuagucuugguuucugcaucaguaauagggauaacuauuacuacuuaauuguacugauagcaaccuaaggcauuaucagcaugaaccaccuagcguggugcagauccaugauagacacuacagaagguguaacucccgaggaagccagagguucaucuuuacccaccccugcucaaagggucgauguugguugagaaaacgcaauuauuaauagcugccuauucuuuuucauucucaguuguaccaaacagggagacagguuucaaaagcuuggguugaagcuuguaauuggccagucggugacaaugcaacccuaaucaaccugugauuucacguccccuaccaauucugcaucggccuuugauuuguggucccaggcagugcaauucauugagucauauuuguugcauugauaggagaagaccaggcacuuaggcguuuaacccugaggugauuaagaggaaaaaaaaugagucauauuuguuaaggcccaaagauacaucaaaaagcccugggcagaggccgacacaagcacaagugagaccugcaggguguaauucaucacauucuuugauccucaaguuugugagucacagagacucucugggacaguuuugaagcucaggggucugggcaggaaggaaaaacuugaaguauggaaaaagaggaauguuuuuuugacaggcagcugagagaggacgauuuucuagagauaugcuuuuuuugcuugguaaccccugagguggcuguaaauguagcuggagcccaggauuucugcagaguggaaacagaaauaagugauagcuuuggguaugccuugugccacuggggcuccugaacaguaagcaugccuugagcgccuacuuuauacaaggugauauaaguauccuugggagaugggguuuuuauacuaauaaguguuuguuuuuuuuuaauguuagcucucugaauagccuauaaugaaaguuuauugaaguggagaguguacaggcccagauaucagagagaccugggugcgaauucugacaucaccauugugguggcaucacauugagagaccugcuuaucgucucugugccucaguuuuuuguguuguuuuuguuuuuguuuuuuguuuugagacagagucuugcucugucgccaggcuggaaugcaguggugcaaucucggcuuacugcaaccccugccuccaggguucaagcaauuccccugccucaaccucacgaguagcugggacuguauacaggugcgugccaccaugccuggcuaacuuuuuguauuuuaguagagacgggguuucacuagcuuggccaggauggucucgaucuccugaccucgugauuugcccgccuuggccucccaaaaugcugggauuacaggcaugagccaccacacgcggccgugccucaguuuuuauugcaggguuguaugauuguuacauggaguguugcuggcacucacuuuaaugguuaacuguuuuucugggaaaaccaugagaugggucaugcuucuacuucuuuuuuccuuguugcuuuuaauauuuuauucuuggcauggagccaugcauccagucuuccagcauuucucagaccuugugacauguuaaccacaaagacagguaagacccgccuuugccuacauugaacucccagucuucauaggcaacauuuaguaaagcuguuuaccaaauacaguauggcagauacauguuuucauagcgcuacauacaaauuauuucggaauauguggaaggauaucuugccugcaaauggaagaagguuuccccugagaggugaugcuuuuaaaacaggauuuugaaagauguauaggaguuugcauaggaagagcucaauaaacuuagucauuauuauuaucuuuuuucuuuuuuuuuuuuuuuuuuuuugagacggagucucacucuggcccaggcuggagugcaguggugcgaucucggcucacugcaagcuccgccucccggguucuugccauuauccugccucagccucccaaguagcugggacuacaggugugugccaccaagcccggcuaauuuuuuuuuuuuuuuuuguauuuuuaguagagaccggguuucaccgguuagccaggauaaucucaaucuccugaccucgugauccgcccgucuuggccucccaaagugcugggaucacaggcgugagccacugcgccuggccuauuauuuuuuccuuauuacucguucucuuccucuugcuccccuccacuuccugguacuccuucuccccucccuugucuuucuccccaauccgcccacuuuguauucauaauucuuuauuguuaagaagccuacuuagaaacaugccaaguagggagaggaagacagugcauuuaauuagaaacaauuuuauuaugauugccuucucuaaaaggcauauuagcuuuuaucaccauaauaaguuguucuguucucaacuuuguucccaguucaaucuggaugcguuuauuuguaacucacuuuccaucuguuuuccuuaaacaugggauugugcaaggagccucgccauguaguaagggaugucuggggaacuuggaggggcuugaggcaugguucauccagauuaaagcuucccugguguuucgcuccccagauggaaagcccgugucucugucaccgcuggagucccaggcacacagccccagguacacggccuccagccagcgggagcgcgagagccuggaggugcgcaugcgcgagguggaggaggagaaccgcgcccuccgcaggcagcucagccuggcccagggccgagccccaucccaucgccgaggcaaccacuccaagaccuacuccauggaggagggcacuggagacagcgagaaccuucgggcuggcaucguggcaggcaacagcuccgagugugggcagcagccggucguggagaaaugcgagguaaagggcaucuggagccuggggaggaaguuguccaaagucccgauugcccucaccccuugcaaaugccuccuggaaacacagccagaugccaagagcuggcauucuugauucuagcccggguguguaagucuggcuugcucgcuaacuuugcucaauggucugacaagucauuuagccucucugagcuucuguuuucccaucugaaaauggggauaagaaggcguaaucuacagauauuaagaggagcucacugauggaaccuaccgcuuguuucuaugugguucauuuugacaugcgcaggguuucuacaccuagcugucauccuguaggccccugcuucuuagacuauagugugaaugguacaccuggaguuguggcccaguugggcaguuuucuuagaccucauuaucacuucacuguauaaacagccucuccaauucagaaccacagacuuguuccuuaucuaaagaaguaauuugaacuuuuauagccuaauaucacuucuccccuuuuaggguaugcuuucuuucuuagcagcucuuuggaaaugugggauauuuauuguccucuauuuccucaaauaccugcauccacgcuucuaugugcagugaacacacauacacucauuccccauuguuuccaguucucaugguggagaugaauuagggcaugccuauucauaggaaggccuuuugagagaugggcgagacugaauucauaucccagcuuuagugauuuaugcagagaguacccuugauccaguugcauaacuucugugaacuccaggugucucaucaguaaacuuuaggaaauaauaccugcuucauggaguauuugugagaauuaaacagaauggccauauaaaggcuugacuagcgccuaguacauaguacauuuucaaaauuaugguuaguuuuuacuauucuuaguuaaacauagauaggaccugcuguuucuuuauuccauuuucuggaauaaagagugguuagacuucaaacucccuaaagagaaugcuuugcaaacuguaguauucuauucuagugaaugggauuauuaguaauauuggugauacuauccaaugagacuauccagugucacuaacaaauggcuuccucagugauguagacuaaguucuuuggaaguucaguggugagggaggaggacaaggagagccccugaggauaggagcauuucucagguuucucaagccugguugaaaaguggauugguggagagguagagagcauccgacagaggauguccaacgaggaaugugucauaugaguaggaacgaugugaaacaaacauccauuauagcaggauucgggaugucacaaguugguccuucagccaagcccagagaaccugggcgaggaggugguucuacuccaucaucaucauucauuuauuuauccauucguucagcaaacauauugcacucguguuuuguaucucauucuguuuuauguguugggaaacagcagugaacaacagcaaaaaagacagaaccccuuucccucugguucuuacaucugucaucagagguagagggagagaugauaaacaaauaaauaaauacaaaugucaggacgugauaaaugcugcacauuuauucagcccugacuguaugccaggcccagugcccuuuagucuuugacaaccacugucaguggcuucuguuacuuaauaucucuauguaugaaaacgggcauucagccacguuaacaaauuccuuuggucuuggcuggucuggggagggcccuaauuuagggaucuucuguucuugccuuggugaaggcauauuugauuucuuucagguucucugcuagcagaucacagccaugguguugguuuagaaaggguuaguuuggaugggaacucugcuacccaggugagauggcccaaaacgagcaaauuuuuucuccaagcguauuuacacuauuaugacauagaaccuaaagaacaaauaagaaucgaggaggggaaaaauaaaaaaggaaaaggggaaaagaaggcauaaaaaagagaaaaagaguuguguuuguggggacauuucucuuccuucuguaaucucucuagccaagaguuucacuccccugcucagucuucugagaaauaacucauuguaauuugggaguccccuguacaauuguguagaccaaagaccauuggcuuuugaagcugggaguugugagucuaaauccuggccccauuucuaguuuaacagcuauguggcuuugagcaaguaagaucacuuuucuguggcuguuuccucauuugcaaacuguggauuaaaaucaaguucugggcccgacacaguggcucaugccuguaaucccagcacuuugggaguccgagguggguggaucacagggucaacagauugagaccaucccggccaacauggugaaaccccgucucuacuaaaaauagcaaaaaucagccggaugugguggcgcgcaucuguagucccagcuacuugggaggcugaggcaggagaaucguuuaaacccaggaaguggagauugcagugagccgagauggugccacugcacuccagccugggugacagugcaaaacuccgucucaaaagaaaaaaaaaaucaaguuccugccuuuuacuauuucaguggugacaauggauauuggaacuugagggaaauucuaauguaguuaguuguaucagucuuagauuucacugcagguuaucaaaaaucccaacuaacacuggcuuaagcaagauuugcaucuuguuucucauuguguuuaagaugucuggaggccaucaguguagggauggcaguauugggauuucuuuaucuuucaccccagccugcuugauugacauucccaaggucaucucaugacccauaaugauugucagagcuuuagcuauguuguccacauuccagcuggcaggaaagaaguguuaaggugggacauaccacuuuccuuaaagaacguaucuuggaaauuucacacuucagauccuuuuagauccuauugacacaacuuaguuacagggauacccuuagcugccaccuagguccaagagagccuggaacagauagauuuuacucaaggaagccauguuuuucuggaacauucuggaguucuguuacuguggucacagugaaccaugucugucacaugggugguucucaaacuugguuguguguuagaauuacauaucaaaaauguguauccaugagaccuaccccagaccuacugacuaagaaucucugggaguagccccugagaauacagauauuuaacaaaagaauauauccagaugauucuaagauaggagagauuguuuggaaaccacugcuuuaggcuggacacaguggcucacgccuauaaucccagcacuuuggcaggccaaggcggguggaucaccugaguucaggaguuucagaccagccuggccaacauggugaaacccuguuucuacuaaaaauacaaaaaaauagcugggcgugguggagggugccugaaaucccagcuacuugggaggcugaggcaggagaaucguuugaaccugggaggcggagguugcagugagcugaggucaugccauugcacuccagccugggcaauagagcgagacuccgucucaaaaaaacaaaacaaaacaaaaaaaggaaaccacugcuuuaaggagcagcacauaggauugaugaauuuucuuuaucccuguguuccuugaaacauaaaacagucauauaggaauucagaucuugaacucguugacuuuuuuuuuuuuaaacuuuaaauucuggaguacaugugcagaaugugcagguuuguuacauagguauacaugugccaugguugguuuacaguaccuaucaaccaucaucuagguuuuaugccccacauauauuagguauuuguccuagugcucucccuccccuugccccgccccucaacaggucccagugugugauguuccccucccuguguccaugcuuucucauuguucaacucccacuuacgagagagaacaugugguguuugguuuucuguuccuguguuaguuugcugagaaugcuguuuuccagcuucauucauguccccacaaaggacaugaacucauucuuuuuuauggccgcauaguauuccaugguguauaugugccacauuuucuuuauccagucuaucauugaugggcauuuggguugguuccuagucuuugcuauugugaauagcacugcaguuaacauacgugugugugucuuuauggcagaaugauuuauaauccuuuggguauauacccaguagauugcugggucaaaugguauuucugguucuagauccuugaggaaucaccacauugucuuccacaaugauugaacuuauuuacauccccaccaacaguguaaaagcguuccuauuucuccacauccuuuccagcaucuguuauuuccugacuuuuuaaugaucgccauuccaacuggcaugagaugguaucucauugugguuuugauuugcauuucuuugaugaccagugaugcugagcuuuucuucauauguuuguuggccguauaagugucuucuuuugagaagugucucuucauaccuucgccacuuuuugauggggucauuuguuuuuucuuguuaauuuguuuaaguuccuuguagauucuggauauuagcccuuugucagauggauagguugcaaaaauuuucucccauucuguagguugccuguuuacucugaugauaguuucuuuugcugugcagaagcucuuuaguuuaauuagaucccauuugucaauuuuggcuuuuguugccacugcuuuugguguuucagucaugaagucuuugcccaugacuauauccugaaugguauugccuagguuuucuucuaggguuuuuaugguuuuaggucuuauguuuaagucuuuaauccaucuugaguuaauuuuuguauaagguguaaggaagggguccaguuucaguuuucugcauauggcuagccaguuuuuccagcaccauuuauuaaauaggaaauccuuucccuauuucuuguuuuugucagguuugucaaagaucagauaguuguaaaugugugguuaauuucugcggccucuguucuguuucauuggucuauauaucuguuuugguaccaguaccaugcuguuuugguuacuguagccuuguaggaguaccaugcugcuuugguuacuguagccuuguaguauaguuugaagucagguagcauaaugccuccagcuuuguucuuuuugcuuaagauugucuuggcuagaugggcucuuuuuugguuccauaugaaauuuaaaguaguuuuuucuaauucuuugaagaaagucaaugguagcuugaugggaauagcauugaauauauaaauuacuucgggcaguauggccacuuucacaauauugauuuuccuauccaugagcauggaauguuuuuccauuuguuuggguccucucuuauuuccuugagcagugguuuguaguucuugaagagguccuucauaacccuuauaaguuguauuccucaguauuuuauguucuuuguagcaauugugaaugggaguucacucaugauuuggcucucuguuugucuguuauugguguauaggagugcuugugauuuuuucaccuugguuuuguauccugagauuuugcugaaguugcuuaucagcuuaaggaguuuugggcugagaagaugggguuuucuaaauauauaaucaugucaucugcaaacagagagaauuucacuuccuuacuuccuguuugaauacccuuuaauucuuucucuugcuugauugcccuggccagaacuuccaacacuauguuaaauaggagugaugagagagggcauccuugucuugugccaguuuucaaagggaaugcuuccagcuuuugcccauucaguaugauauuggcuguggguuugucauaaauagcucuuguuauuuugagauuuguuccaucaaaaccuaguuuauugaguguuuuuagcaugaagagguguugaauuuuaucgaagaccuucucugcaucuauugauauaaucaugugguuuuugucauugguucuguuuauguaauggauuacauuuauugauuugcguguguugaaccagccuugcaucccagggaugaauccaacuugauagugguggauaagcuuuuuaaugugcugcuggauucgguuugccgguauuuuaccgaggauuuucacauugauguucaucagggauauuggccugaaauuuucuuuuuuuguugugucucugccagguuuugguguuagggugaugcuggccucauaaaaugaguuagggaggaaucccucuuuuuuuauuuuuggaauaguuucagaaggaauggcaccagcuccucuuuguaccucugguaagauuuggcugugaauccaucugguccugggcuuuuuuugguugguaggcuauuaauuacugccucaauuucagaacuuguuauuggucuauucagggauucgauuucuuccugguuuagucuugggaggauguauauguccaggaauuuauccauuucuucuagauuuccuaguuuauuuguguagagauguuuacaguauucucugaugguaguuuguauuucuguggaaucaguggugauguccccuuuaucaucuuuuacugugucuauuuguucuucuccuuuuucuucuuuauuagucuagcuaguggccuauauauuuuguuaaucuuuucaaaagaccaacuccuggauucacugauuuuuuugaaggguuuuuugugucucuaucuccuucauccaugagcauggaauguuuuuccauuuguuucugcucugaucuuaguuauuucuugucuucugcuagguuuugaauuuguuugcucuugcuucucuaguuguuagggugucaauuuuagaucuuuccugcuuucuguugugggcauuuagugcuauaaauuucccuauaaacacugcuuuagcugucuuccagagauucugguauguugugucuuuguucucauugguuucagagaacuuauuuauuucugccuuaauuuuguuauuuacccaguagucauucaggagcauguuguucaguuuccauguaguugugcaguuuugagugaguuucuuaauccugagcucuaauuugauugcacuguggucugagagacuguuuguuaugauuucuguucuuugcauuugcugaggaguguuuuauuuccaauuauguggucgauuuuagaauaagugcuuuauggugcugggcagaauguauauucuguugauuugggguggggaguuccguagauauuuauuaaguccacuugguccagagcugaguucaaguccugaauauucuuguuaauuuucugcucauugaucugucuaauacugacaaugggguauuaaagucucccacuauuauugugugggagucuaagucucuuuguagauaucuaagaacuuaaugaaucugggugcuccaguauuggguguguauauauuuaggauaguuagcucuucauguuacauugaucccuuuaccauuauguaaugcacuucuuugucucuuuuggucuuuguugauuuaaaguguguuuuaucagagacuaggauugcaucuccugccuuuuuuuuuuuuuuuuuuuuuuuuugcuuuccauuugcuugguaaauauuccuccauuucuuuauuuugagcuuauguguaucuuugcacaugagaugggucuccugaauacagcacacugaugggucuugacucuauccaauuugccagucugugucuuuuaacugaggcauuuagcccauuuacauuuaagguuaauauuguuaugugugaauuugauccugucaucaugaugcuagcugguuauuuugcacauuaguugaugcaguuucuucauaaugucauugaucuuuauaauuugguauguuuuugcaguggcuggugcuaguuuuuccuuuccauauuuagugcuuccuucagaagcucuuauaaggcaggccuaguggugacaaaauccuucaggaggauuugcuugucuguaaaggauuuuauuucuccuuugcuuaugaaacacaguuuggcuggauaugaaauucugguuugaaaauucuuuucuuuaagaauguugaauauugaucccuauucuauucuggcuuguaggguuucagcauauugaucugcuguuagugugaugggcuucccuccauagguagccugaccuuucuuucuggaugcccuuaacauuauuuccuuuguuucaaaccuggagaaucugacgauuaugugucuugggguugccuuucuggaagacuaucuuugugguguucucuguauuuccugaauuugaauguuagccugucuugcuagguuggggaaguucuccuggauaauauccugaagaguguuuuccaacuugguuccauucucucggucacuuucagguacaccaauaaaauguagguuuguucuuuucacauagucccauauuucuuggaggcuuuguucauuacuuuucauuuuuuuuccuuuaaucuugucuucacacuuuauuucauuaaguugaucuucaaucucugauauccuucuguuugauugauucggcuaucgauacuuguguaugcuucacaaaguucucgugcuguguuuuucagcuccaucaggucauugauguucuucuucucuaaacugguuauuuuaguuagcauuuccuguaaccuuuuuucaagguucuucacuuccuugcauuggguuagaacaugcuccuuuagcucagaggaguuuguuauuacccagcuucugaagccuacuucugucaauuggucaaacucauucuccauccaguuuugugcccuugcuggagaggaguugcgaucauuugggggagaagaggcauucugguuuuuguuauuuucagcauuuuugcagugguuuuucuucaucuucguagauuuaucuaccuuugaucuuggaugcugauggccuuuuuugugggcauccuauuuguugauguugauguuauugcuuuauguuuguuaguuuuccuucuaacaggccccucuucugcaggucugcuggaguuugguggagguccacuccauacccuguuugccuggguaucaccagcggaggcuucagaacaacaaagauugcugccugcuccuuccucuggaagcuuugucccagaggggcacccgcccguugccagccggagcucuccuguuugaggugucucccaaucaggaggcacaggagucagggacccacuugaggaggcggagucuaucccuuagcagagcuugagugcugugcugggagaugggcugcucucuucagagccagcaggcaggaauguuuaaguccgcugaagcugugcccacagccaccuuuugccccaggugcucugucucacggagaugggaguuuuaucuauaagccccugacuggagcugcugccuuucuuucagagguguccugcccagugaggaggaaucuagagagacagucuggccccaggugcuuugccaugccgucaugaguucugcacagucaauuaacacugugaggggaaaaccgcauacucaggccucaguaugguggacgccccuuucuccaccaagcucaaucaucccagcuagacuucagacugcugugcugguggggagaauuucaagccaguguuucuuagcuugcugggcucugugggagugggaccagcugagugagaccacuuggcucccuggcuucagcccccuuuccaggggagugaacgauucugucucacugggauuccagcugcuacugguguaugaaaaaaaaacuccugcagcuagcugggugucugccugaacugccauguugacuuucgguauaacuuauuuucuagucuuuugcacuugagaauuagguuuuguucuucuucucuuucuuuguguuuacugaucauguuaacuucuuagauucuuaaaaaguuauuuuugguagaauucuucuaugaggaaccccugguccuguucagaaccuccaauagaugcacuuaaaagucuuggccugcuacagucauauuucaaagcacacucuccacaaggugcuggccuccuacccaugagcagugcacuuccucucacucccucauuuggugucuuuaaggauuuuaacgaaaaagccauagaggcagacaagaaaugucagucaguagagucaaaauagaaacucccuucaucacagcgcuuuuugguuccaagugcugaagcucaucuugacauccugucacggugcagggccacguaaccagagaugcugccaccaucuguggguguugcggaaacuucucugggcuccgaaaagcauuucugaaaacuccucuaucaauaugccaaggcugucagcugagcuaucuggugauaggaacaacgggcccucaucagucccuuugcccucuuaucauuugguaauuaugugucuuucaaauagcugccugucuuauucuugcauauuucuguugccugugcagugcuguuucagugauggccuggccucugugugccucagaaguuggagcagaacgauccccuuugaucuucacucaugcacauguguguauggauguguguauuuuucuugccuuuccgguucaggucuauucugggacucagcuauuguacggaagaaaaaacagucacuggaacugguaucagaauuccugaacaggagacuuuccuuugcuacucauuagucuugugaccuuagacaauucaguuaccuuuugggagucuauuucaucauuauaaaauggaaauaauaacauguucuucccagugcaauugugaggaugaaaugagguggaggcaggggaagcuaacuaugcaugagugucacauauacucauuaugaauauucaacuucuccacugguaccugaaaaaucaccuaacacuuaaauaaucugaaacagcaccaguuauuuuauuagcugucaugguuucugugggucagagauuugagaaggacuuagcugagugguucugguauggggucccucauacagguggcauuaguguguggcuggagcuggaacaguacaaugcuggaagagugggugcugacccaaccucccuuucuuuuagacucagguccucauguggucucugcaugggcuaguuugagcuuccucacagcauggcagcucuaggcagucagcugcuuacauggcagcuaaaggcuuuaaguacaaguauucccguaagcaaggcagaaaggaagcacuuuucaugaccuggccucagaagccacacagugucacaucugcugauaguggauucuguuaguugaaauggucacaaaagcccacucagcacauacccaucucucaaugagaggaacgucuaggcauuuguggauguacuuaagaacugccacaauggauauuguuauuauggaaagugaaugaauguuauccucugaugccagaccacuccuuaaggaaguacucauuuuuccuucugcuccuugcuuugaacuucauuucucaguaguaauguauuauaguuaauaaccguuaaucaguccuugaaauguaccagacaucaugcuagagcuuuacauaaaauaucucauguaauucacacaacauauuuaccuucauuugacagauaagaaaacugcuaggaaagguuuuauaauuauuucaaggucacacagccagaaagagguagagcuugggauuaaaccuaggcaguuugauucuagaaccuguucuuugaaccauugcacugaagcucugugaauuagagcuugugggacccagacucucaucagcugcugagcccagauccuuauugugugcuucacaggggccucaccucugcagacuuuaggguuaccagucauuauauggggaucaucuuucaccuugggggcuuuagcagccccaugagguaaucguuccucagugaguuuaggcaaagaucugucuguucuucuaaaagaagcugaaauguuuuaaauuauucuccagacuauggauguauuuauuagcuuaguggggcguuugcauuuugcuggaggcaacauguuuauaaaacuugaugcgucucaccuauauucuggguccuaacuaaccuuacaguauuuuaaugcacuuuuucuauuguaucuucauggacuuuacauaauaacccagcagugaaggcguuugccagcuaucuuuccauaucccacauugcuguuggaggauacuaucauagcauuuagacacacauuuuauuagcuucauaggccuucuuuggggcuucuucaaggauguaaauccacaaaaauaaaaauguccucuuuaaauuucaggcccugaaauuaggggauguuauagcuggaaggaaccuggugguauugucacgugcagugauuuucagggcaccuuagguacccucccuguauauguuaguuacuuauugcuacauagccagguacccucaaaacuuaacaacuuaaaaugucaagcauuuauuaucucauacaguuucugaaaauuaggaaucugggagcagcuugguuggggauuaugacucucaaccuuuaaagagauuacaauuaagaugacaucagggguugcagucaucugaagguuugauuggggcugaagacucuguaaccauauaguuuacugacaugauuggaauucucauuuccuuaggacuguucaaguguucucauaacauaucagcuagcuuuucccaggguaagcaguuuaaacagaagaaguaaaaagcuacaacgacuuuuauaaccuagccucggaugucuuauaccauuacuucugcugaauuccauuggucauacagcccggcucugacacaguauaggagaggcuacacggcaugaaaaccagggggaagggaucuuuggagacagucuuggaggcuggcuaccacaccauggccaaggcaagggaccauaucucugccagcccccugucugugcuggccucagaguagccuucucuuguugcauauucugcuuuuuuguaaaacuuauuuuagaaauugugccacugagaaugacaacaacaaauaaagaugcaacucucucauuuuaaaaaugaugaaagggucuugccucagguuacaaaguugcagccacagcccagaugaugagucaagugucucaccuccucauuccugugucuuuuacccuguuaucuggggagaggugacaaggcagugucagcauuugauggaacagagggaauugggcaccuugaagaccuuccuuucaaugaugggaaaaauacuauccuaaccuuacuugaagguagaggaaagagugagagaagaagaaaagaacuugauggcugacauuugaggaaauuuggggcucagaccuuagauauagaacguucagcuuagaauaaacuauaauuguuauuauuauugaugauugcugauacauacccauuacuuacaagguaccaggcucuaaucccuuuacgcgagucaucucaguuaauuugcccaacaguuaguugacauggggcugggcaugguggcucaugccuguaaucccagcaccuuaggaggccgaaguggaaggauuacuugagcacaggaguucaagaccagccugggcaacauagcgagaccccaucucuccaaaaaaaaaauacaaaacuuagcugggcaugguggagaacaccuguaaucccagcuacuuaggaagcugaggugagaggaucgcuugagcccaggaauuugaggcugcagugagccaugauugugccacugcacuccagccugggugacggagcaagacccugaaauaaauaguugacacauuuauuacuccucuuuauagaugaggaaucugaggucccaagagguggaguuacgucuugaaauguggggaagaguuugauaggugaggugaagggucagagcaaucuagaaugaaggcacauucuaaaaacaagaaagcuugaugagucaucuagcaugaccauaacauggcgcuacacugaucauuguugagugauugucuggcuaauguguguggacuuuuuggaccaggccagucuuccagaggcccccaugauggaucaguauugggguguuguuagauaacccaccuaccccagauaugaucucccuguauugauuacaauucucuugacccaccccaaaaucggucucauccuuuaauguuuucuguguaaaauuuggguuucugauuucucagguggcuaugcucuuuauagcacaagaaagucaauccuaaagcagacugggauaugcaggauagaaaauccuggaugcuucauucauucaucauccauuuaugugccuugccguggaggggacaccaagagacuccuuguucucacagcaggcccuggaacccauguggucacaccuguuccucgcugagcccugaaggcuuggcuuacaaagccagguggugcaucuacuucuguuuucugcauaguugaaauaacuuugucuuugcauccaugguucagcauuuagaguggacagauuuagaugagugguuucccaaauccuggagguuuguaacaugauuugagaggguacauuugccauauguuuuaaaaauguuaauagguacauauguguuuuauugaggccauuacugugggcuuaaaagcaggacccugaauucaacccgucacuuugucacagacuagcugagcccucggaccuugggcaaguuacuuaaccacucugugucucaccuucuucagcuugaauuugggaaaaaccuggauguuaggaaaaugcuguauagaaauucuaaaucccuuguuugauagaggcaguggcugaggauccaagagguuagauaauuugccccaaaucacuuagcuggcacaacugugucauacuggaccccuuuugacuccaguaaggacaacaccgugucugagagguugaagaagagacucagagccagugaaugagacaggguuuauggagaacuuacauacagggguggaccagugaccgcaggcugaacagcagaacugcuaccauuuguaaaaagcaugcaguugauaucauguuuucacuuagcagucuccacccugcaaccaucacuuaaccaaaaauaaagggccucgauccccuguacggucugcauuccagggaaugggccagggguucagauuccuucauagauaaggagugaaucuccagauuggccacugugggauucuuuuucuuuuuuuuuuuuuggagauggagucuugcucugucacccaggcuagagugcaguggugcgaucucggcucacugcagcccccaccucccggguucaagugauucuccugccucagcuucccgaguaacugggauuacaggugcccgccacugcgccuggcuaauuuuuguauuuuuuuuaguagaaaugguuucaccauguuggccaggcuggucugaccugugauccacccgccucagccucccaaagugcugggauuacaggcgugagcaccaugcuuggcccgggauucuuagcucagaacuccaaacacacauccuucuuggaccauagggucauucucaggaauugccuagguuauugcugucaggucugucugccauuacaaacuggaaccagcauccagcucucuggauuuccagggguuuuuauuauuauuauuauuauuauuauuauuuugaaauuuuuuuugcaguagaagccuauacccauucucaucucuuuccauuuuuucucacccugaaagaguaacaaauuccaaggccucgggacauguggugguagcugaaagaagaaugcagccuuuccuugucuuguccaagugaagaaaaguggugcucucuacuugagaggaauuggaaauagauuauuugcacgcccucguacucucucaaaauaaucacaguuaacauguguugaguuuuuacuauagagucucuuccaagugcuucugcuagagcagcgguucucaaaguauggucccugggccggcagcagcagugucgccuggaugcagacuauucucaggcuccacuccagagauccuggaucagaaacuggggaggaguccgcacucuguuguaacaagccccuccaggugauucugaugcauacuggaguuggagagccacuuacuccauguccuuaacaagcacuuuaagauuaugucccccauuauacagaggaugaagucaaagaaggaggacucugaacagugucuugugcuguuuauucauucaggaaacauuaauaagcauugauuuauuaggggcacuuucuugcacucauuuguuugauccugacacaacccaaucgguagcuguuuuuaucuccguuuuacggaugaggcgagugaagcucagggacacuaaauaacucuuccaagaucacgcggccacuuagcuucgagcuuguggcuccaaucgaggucucucugcucuuguugugggauuugcacacuacguugccccugccucugacccucgcugcugccugucugaccccggcuguucgcuucuccgcagcugucagagcaucuguccucugggaggucuugccugucccccucaaccccaccaaaagucugcagcuaccauccagaaucugugcugagccugucuuuccauagcacaccugaugcccaaguugaaauggguuucgccucucacucucucagucugucugauaggagaugcuuaacugaaucgugcccccaggcagaaugggcugaagggagcaccaggcccugugggcaagagaagcagggcuggcaggguguugaagaguucugccagggccacagcuugccuggcaucccuuaguuuggugugaauuucuuuugggacaaugauuuuuuuccccauauuuaucugugaaaaacugcucccugaggauucuuuccugcugggaggcagagcauggagaacuuuauguuucagguuuucauggaggcugacaagcaaagagucacaaguccaggcuggcccuaauaucacugguugcucuuguguggucacugaaaugccuucuccuccaagaugcucucccugcaucgucucuuaucugggugaugcuggccacucugggaugcaaagacacccagcuugccaugguaggagccucucauucuccugugggaucucccugguuaacuaucaaauugccuccacaccugauuuuggggaauggggauugucuuaaaauuuaccuuuauuuccuccaagcccagaacaguccuggaacacuggcaacucuaaaaacaucaauguuaugaaucuuuucugcagguuguaagacaaggucaucccuugaccccaguggggucaggaaugaacccaguucacaguucugcacuaccuuaccuguaucaucaaguacagccugcaagauucaaagugugcuggguaccaugucuaggaugacaggaaauuaguggaagccuuagcauugccuuagaaagagcuuuuaugguucauuacucaagagcuuuguaaagcuuuuaaaaaguauaaauaaaauguauaaauucucaaguuuguuacauuggugccguuuccuuuagggaucagcaaguaucuaugaaugccugaaagucuucugugcuuucuuuccagccaacaggacaagugagaugcugaggaaagguccucaguguuggucagguccuggcaaguuacugcuugcaugcuuaggggcugaaaugauuccaggaggggccaagagguaugggcagggcugaggggaggcaacacagaggcaggaagguguuaagaaacccagcaaggacuggaacuugugugauugggccccugacaggagccggggaaaucugaccucugagacccccacuggugccucccaaugaccaaacucaacccaaaaucagaggcaaaaggagcccacuuaacguggucuacaaaggucagacucaaccaggcacgguggcucaugccuguaaucccagcacuuugggaggccgaggugggcggaucacaugaggccaggaguucaagaccagcuugggcaacguggccaaaccccaucucuacuaaaaauacaaauauuagcugggcaugauggccgcaugccuguagucccagcuacuugagaagcugaggcaagagaaucgcuugaaccugggacacggagguuggagagagcugagaucauaccacugcauuccagccugggcgauagaucgagacucggucucaaaacaaacaaacaaacggccagacucuccagacacaggacuguuaggagaaggguagagagugaguuggaggggcaaacgagaacaucauuccauccuccaucuggacuuugugacagagaaacaugaguguuaugucuauacagucauguguuacauaaugacauaucugucaacaguggacugcauuuaccacacugcucccaucagaucauaauggagcuaaaaauuccuauugccuagugacaucauagccauccuaacaucaugugcaacacaucgcucauguguuuggugauguuggugugaacaaaccgacugcgcugccauuuguauaaaacuauagcgcaauuauguacaguacauaauaauacuagagagaaaauggcuguguuaccaguguauguauuuaucauacuaucauuauuuuaguguauuccuucuacuuauuuuuuuuaaaguuaacuguaaaacagccucaggcagguccuucaggagguauuucagaaggccuugcugucgcaggagaugacagcuccauguguguuaaugccccugaggaccuuccagugggacaagguaaggagguggaagacagugauauugaugauucugacuccguguaggccuaggcuaagguguguguuuaugucuuaguuuuuaacaaaaaaguuuuaaaaguuaaaaauaaauaauuuuuaaaacagaaaaaugcguauagaauaagaauauaaaguauuuucauacagcuguacaauguguuuguguuucaagcuauguguuguuauaaaacagucaaaaaguuaagagccaggcacaguggugugcaauuauagucccagcuacucuggaagcugagacgggaagauugcuugagcccaggacuucgaggcugucguguucugugaucaugucugugaauaaccgcuguacucuaaccuggacaauauagcaagaccccaucucuuaaaaaaaaaaauagacaguuggcugggcgcaguggcucaugccuguaaucccagcacuuugggaggcugaggcggguggaucacgaggucaggagauugagagcauccuggcuaacacggugaaaccccgucucuacuaaaaauacaaaaaaauuagccgggcgugguggcaggcgccuguaguccaagcuacucgggagacugaggcaggagaaucgcuugagcccgggaggcagaaguugcaguaagccgagaucacaucacugcacuccauccugggcaacagagugagacuccgucucaaaaaaaaaaaagagauaguuaaaaaaaauuuuaaauuuguaaaguaaaaaaguuccaguaagcuaaguuuaauuuuuuauugaagaaaaauauuuuuuauaaacuuaguauagucuaaguguaccauguuuauaaacuaaguguacacaguaguguacuauaauguccuaggccuucacauucuuugaccacucacugacucacccagagcuacuucgauuucugugaacuguaaucaugaugaguauccuauacagguguaccauuuuuuucucuuauauuauauuuuuacuguacuuuuucuauguuaagagauagaaauacucaccauuguguuacaguugucuacaggauucaguguaguaucauguauacagguuuguagccuaggagcaguagacucuaguauauagccuauguguguuguaggcuauaccaucuaagguuguguaaguggacucuaaaguugcucggaagacaaagucaccuaacgaugauaggcuacucagaagauaucuguguuguuaagcaaagcaugacuguaauuucagguguagacaggaaggccuagugcaaggaccaguggucacugauucugacauucagaucccacccuuugguuuguuuguuuguuuguuuuuugguuuucgguuuuuugggguuuuuuuuugagaccgaguuuuguucuuguugcccaggcuggagugcaauggcgagaucucagcucacugcaaccucugccucccagguucaagcgauucuccugccucagccuccugaguagcugggauuauaggcacacgccaccacaccuggcuaauuuuuuguauuuuuaguagaaaugggguuucaccauguuagccaggcuggucuugaacucuugaccucaggugauccgccgccucggccucccaaagggcugggauugcaagcaugagucaccgcgcacagcaaaauuagccugcagugauggugugugccaccauguuggccaggcgggucucgaacucuugaccuuagaugauccgcccaccuuggccucccaaagugagccacaggcaugagccaagaccccacccuuugauaggaggaauguugaauaguugugaccauuuuuaaucuaccacaccaagaaacuuaaaaacugaacuuaauagcuucaagcccuaaagucacaugacaaaaccauuuuugugaccccauucuuucaaggaucguuuaucuuucucccuacucuccccauucccacuccaaccccugccccacucaugguucacuucuguaaccccagauuuuggaacacccaaaacuccucuaagaacauagucgaugccacugugauuuucugcuuucccagggagcagggcccugcugcuaugccuccagaugaugcauuuauucaugguggcagguguauucgaugaaacuaaagagauuggaaaauuauguaaaauguucaagaaugugcaugcuugugcuuacauuuaaugggcccauuuuaaaaagucucugaacccugaagccaagacaaaguuugauaucucugaggcuguauguuuaaauauuugcgauucugaagagccugauucagcguguuuuuccccauucucauccccuucccaguuaugucuuccaugugcaggcguuuuccuauucauuucccucaugauugaaauggugacaguuacaucugcauuauaaucuuucauccugagucuuuuacagauauuauccagagauaagcaauggugucuuucuuuuacagguggagaaauuaaaauaugcauaaauuagccugaaaaaaagguaccagaaaacccagagggaucugacauugcuucauuuugcuucauuuugcucccucaucccucauacaggguuuucuaacagcacugcucuugaccuuuggggcaggacaggucuuuguuuuggggcugucuugugcauugugggaugcugagcagcaucccuggccucuacucacagaugccaguagcaucccccugccccccaccccagacccaccaaguagugacaaccaagacugucuccaggcauugcagaugucugcggguuggaggauagggaggugaauaugucccugguugagaacuacugccuuccaguagagcauuugaagauccugggcaucagggacugugaauuauuggucugaaggacggagggccuggggcacagaauauaucuuaaaaaucuguuucugauguaccaccaggguuaagaaucuauucuaggccggggugcgauggcuuauaccuguaaucucagcacuuugggaggucaaggugaguggaucacuugaggucaagaguuugagaccagccugaccaacaugguaaaaaccagcucuacuaaaaauacaaaaauuaccuggacguaguagugggugcuuguaauccuagcuacucagaaggcugaggcaggagaaucacuugaaccuggggggcagagguugcagugagcugagauagugccacuucauuccagccuaggugacagagugagauucuggcucaaaaaaaaaaaaaaaagcaaaaacagucuguuucagaauucaaaucccaauucucuaagccuggguuuccugaucugugauacuaaaaugauaauacuguaccugucucauacaacuuugagccugaaaucugguaauaugaagcacagugccuggaaugucaugauuugcucacuacauacuagcuuucaugaugcuucucauuccucucuugcaucuccccuccucuuucuucuugggagcagguauaagagcagagguggagaccguagcacccaucuggguuggggauuugcauuuugaauguggggguagagugcauacgggagcugagagcagaguggggugaugguucagaugagcccuggugggggccagcauggagccuaacagucaacggcaaagggacccuccauagaggaagaggagcgguagagugaugugaggcucugaguccugcucauguggcaagcccauaauuguaggauuucugagaaaauuagauucuauaugaagccaaggucaaguuucucguacugggaauagguguccaaguuggggugaaggucauugggguuaaaugggucauggauguggauuggagggugugggaugguucaucccugauggccgagccucccgugcugauauaagacaguggggugaugaaggaggccugggaaccagaggacauugucacaucacccuguaugggauggacccagauaucagaacugcauuuugacauggcugguugggauaacaagguaucuggaagcccgugucaugggagcaagggcucugaggaguucuggaaaagaaaaggcaucucucagguccccuccuuuaauggaaguauugaaugcuggaggaaacgucauuguucuacaauaugcccaggacagaaugcaacuggaguggguguuaagaggcagguuuccauucaaggaaggcugugcuucaguagaaaggacaaaauccggaaguaugaacucuccauucuucccgaggcuggauaaugaugucccgucggggaugcccuagaguggugcuuuccgaucuuuuucaaguugugccacacauagaaaaugauaacugcuaugaugcaggaggaaaauagaaaaguugccugaggaugccagccccgcccaguagcuuagagggcguaaacagaugaguauauuugucaccuguaauucaaucguggcacacuaaggugccugggcacuccauuugggaagcccagcucuggaggaccuuuuuugguaucauuggaauguaguguggugggcagcauauuccccucuuggcauuguucccucacuccuuagcaccauccugcaagacacaugucaugacgcuuaaauggcagugagucaguggacccugcagcacucccagggucacccugaguucagggauucaugucugaggcccaugcuccuggcuacuuaguugagaugaccccuuggguucccuucaauucugccagucuuccguucuuugaacuguaucccagauggggugcggagguguuccuguguccccuuuggcccuuuuauuagguugacccuaacccaacacaucuugugggaacauuucacuaacucucugagccauaacuucuuagucugagaucccugauuguugguucauacuuucaagauguauuucuuuccucucuguuuaaccaauugucauugucgcucagcuugaggacaggagacucacuguuugccuauuugagccaaucaccaucucucuuguccccaaaauguaauuggaaggagccuuaaugguuuccaaaugauaauagcuccauaagccgauuaaaaaggccuuaauaaaacugucuugaguuauuuuccacagcugcagacaguguccuuuguuuucuaaugaugccaacaagaaaucagggcaauuuuucuuucuagugugaucugaagcaccaggaaggccuccuuccgucugucugacugcucaccccgucuucuuuucuucccagacaauccacguugcuauugucugcgccggauacaaugccagccgggaugucgucacccuggucaaauccguccuguuccauagguaagaacaacuucugugcugugugggcugaggucugucacugccugccuguguauuuccuuggggaaggguuaaauaggagcaaaauuucucaucaaucauucuagcugccauaaaaauguaauuuuugucugaaacccugaggagaugauuguguuaacaauguuuaaugacagcgauuaggugcugucuugccauguuuagaauuguaacucucagaccuaaugcaaucuuaaaggacaccucaaaucugaugcuucagucucucuaucagcuuccccugccuagcauuuaccagaucucaguuguuauacauccuugucgguagguuguguuauggauugaguuauguccaccacaauucuuauggugaggcccucauuccugguaccugagaauaugacuguauuuggagauagggucuuuaauuagauuaaaauggggucauuaguguaggcccuaaucuaauaugacagguguccuuuaaaaaaaagaggagauuaggauacagacaugugccaaacacagaccaugugaacauacauugagaaggaggccauaugcaagucaagagagcggccucaaaagaucuuggacuucuggccucacagacagugggaaaauaaaugucucuuguuuuauccaccuagucggugguguuuucuuauagacagguugcuuccucuauucuggugugggcugucccacuuuugggcauuucugacuguaaaaaaguccugccuuaguuaaacuguuucccaaccugcggaugaucuccauugacucucguggacccccaugggaaccaucauccuaaggauugguucuucuucuaccuggaagugauaaugccucuggaugcucaucucuucuccaugugacacuuccagcauuggcuucugcuuucucauggaacuuuucuucuguuccucacuauuuugauuggcaucuagacauacccaggguccuauccagaaugguguucaugguuccagccaguguccuuggcucugcuuuaacacucuugccaaggguuuggaugaagcuuauccacagcuguagccaacagcauggaaaccuguuggguggaugagucaggauccaggaggcucuccauaguaggaauaguggugaaaaguuugcagaggucagcugaacagagaucaguguaaaaugcugcaccugaaucugucaauggcauaaacaaagaugggaaccauggugggcuucaagaccuaccaacccugcaaggaacugggauucgucauugguucuaccuucucucugucuuccaacaagcccaucugcagucagugcuuugcgauucucccucugagauaguuuucacuuucuccccguucucuccauccccacugcaacugaugucauucagggccaccuauccucucaccuucauguguccuuccugcuuccccaguuucuacucuucagaucaucugcugugauuccagaaugacauuucaaacaggcacaucugauuucucaaaaccuuuuagcggcuucuccuugucaagggguggaaaucaaacccuuuuaccauggcacaaagaccagguugaucuccauagugcuuucugucuccucuuuuugcuuugacuuugcacuccagcagcucugaccugcuuguagcuccccucugcccccauagcguguccggccuguugugucugguuaugcugcucugucuacccauuucucccuccuucuccauuuccucccacccucaccuuggcaaacucccucuuagccuuuaagacuuuacauaagcaucuuuucuaacaggaagccaaccuucugccuguguugggguuucucgucuaccagcccacaauacccccugugcuucuuuccaucauuagauuuauuacauuauauuuuauauaucuauuaaugacaggucugcuguagcagaaggugggcuuucuggaagacagaacccaugccgucauuuucugugucccuaguaucuuagcaaaguagcugacacguauuacaugcucaauaaauguuuacuuauuugacaagucagucugggggaguucauuaauaaagaacgugaagauauauauucaaucaguuaauuaauauauccagcccagacuuaguucaguuccacauucaugacacuauauugcugagugauugucagcaguucguuuugccuuauuuuuauuuuuuauuuuauuuuuuuugagauggaguuuugcucuugucgccaaggcuggagugcaguggcaugaucuuggcucacugaaaccucugccuccuggauuccagcgauucuccugccacagcugcccaaguagcuuggauuacaggcgccugccaccacacccagcuaauuuuuguauuuuuaguagagacuggguuccuccauguuggccagcuggucccaaacuccugaccucaggugauccacccaccuuggccucccaaagugcugggauuacaggugugagccaccgcccccagccauuuuaacucuuuagacuuuagguuuuuuuuuuuuuuuuuuuuaaaucaguuaacuuuugcugugugucaguucacccuaaaacuuaauggucugaaacauuuacuuauuaguucaguuguuucuacugggcugaccuguacgguucuucugcugggccacuuacgugccugcagcaagcuggcaaguuagcaagcgucaaauucacugcccauccugaauggagaaguggauaggagaaguaagcaaucaacaaauagauaacaguucaccguagaggcugucaguucuuccucauagcgcuguccaguuggaauuaugauuucaguuguauauuugaagaggaaauggaaacaccaaagaaagaauggccaaauggggcuugaccuacugucuucugaccugaggugagaugcccuuuccacauuguuauuguuucucugcaguuuugaaggcuccuuucaguacuacggccuucauccuguggcuuaaaaccaggcauuuuguacacuaagcauugaaugagaugaguggucuucagacuuuuauguauuuacuacuuguugccaugacguaucaggucucucccugguuuaaaaaaaaaaaaaaaaagcccacuuucuagaaaagggccuuugcaugauguacagguauucaauuacgcuauuucucaauuauggcaaaguuaaaggucauaaaaaccucugguguuguguauaaauuuuauuccuguugcccuagcugcaaaucagauaaucuaauaguuguugaaauuguaagaauccuguuggguguaaacuuuuacuccuacaguaacugugcagcacaaagauguuaaauuaaaaaauagcgguaguaauauuauuagcugcugauggcaugucguacuuuuaagacggcgugaggacuugagaagaaagcaaauccuuaguaugugcuacgaaaauucugcaucccauuuguuaugcugagccccugucuacuccagugggcauggcacuagguucaggaggccaaagaagaaacccagggccagcaaaugagacguuggguuuaacugggggcuuacauauauggggagagauuccaguggcagcgggcuggacagaucugccuuacguacagcccaguggcaacaggcuggucaggagaaccccaggacccaguggcagcagguugggcaggaaaacugcaacuacuuaugaaaggcaugcaguuuauauaacauuuuggcuuagcaccuguguuaguccauuuucauacuacuauaaagaacugcuugagacugggcaauuuguaaaggaaagggguuuaauugacucacagcuuagcauggcuggggaagccucaggaaacuuauaaucauggcggaaggugaagcgggagcaaggcaucuucuucacaagauggcaggaaggagaagugcugagugaagggggaagaucccccuagaaagccaucagaucuggugagaacucacucgcucacuaucaugagaacagcaugggggaaaccaccuccauaauucaguaaccuccaccuggucucucccuugacacauggggauuauggggauuauaggaauuacaauucgaaaugagauuuggguggggacacaaagccuaaccauaucagcacccuuucccuaacaaccuccaguggggguggcaccaggagguugccaaguagcaccacuucaaucaucccaaaacucagggccucaauucccuguauggcuuguauuccaugggacaguuugggagcucagauguuucuuauagacaaggaaugaaucuccagguuggccuuuccuggauucuccaguucagaacauacauucagguacgucugucaaacagggucauucucaggguaugcuuaaguuauugcugucaggugcguuuaccauacaccauuuuaaugacuacugaccaccuuggaccaaauuaccacagaaguuccugucaucccugaaauuauacaaaugggaaugauucugugaauugauaugcuggugaugaguugagauacaagacaaaaggacuuuugaaagacuuucggcucagaaaguccagcuauaaauagcuucauugcuucccaagcacauuauggggauuaacuaauacaugguuauaaaauacauugacaaaugaaguaccuuacuaauguuaauaauaauauaauaauaguggugcaggaugcuucuuuuggcuuucacuguuaauuauaguaauuagauuuauuuuccagacaagauuuggugcaaauuuucauuuaaggcuugcuucauuacaucaaaucaguuuuacuucugccauaugcuugaugacauauuucaaaagauaguaaaagaguaauauagacacacuugcacacuaaugccaacgcugacaauugcugcgaccuguuggagagaaauuaauacaaugugggaagaccuugacccaguaugaccaccguagggacucucccuuaaaaagagaacccuaacaauagaaaaaccuuuuauaaaauauugcuuuauaauuauaaaauuggauaauacuuaagaacagaauaaauaauggaacauucucuuaugguaaaccauguacucaguuuugaaaaguauggcauaccaugaagcaaugcuuauauaaaauaagugaaaauauaauuuaaaaugggaugcaucguauauauuucaguauacacacacaugccuauaugugacauguacacauauacagggucaaaaugcagacuagcagaaaauacauaagaaauaggacuuuugcgucuuguguuugggugguagaaauaaagguaaucuuguuuuuuuugagacagauucuuguccugucauccaggcuggagugcaguggccugaucuugaugcaaucucagcucacugaaaccuccacuuccuggguucaagcaauucuccugccucagccucuugaguagcugggacuauaggcaugcaccaccacgcccggcuaauuuuuuuuaguggagaugggguuuuaccauguuagccuggcuggucuggaaguccugaccucagaugauccaccugccucggcuucccaaagagcugggguuacaggugugagccaccaugccugggcguaaucuuguuuuuguuuucaguguuacauauauuuuugguugugucagcaugcaaccucuauggugaagaagaaagauggaugagaaaaauauauacaaauuauaaaugacaaagguuuguuuguuacccaguagaaaauagcacaauacacgucuguaucaccuagacggcaggcuauucagaggaaaauuggggggaaugccugugacuccaaucccaguugcagauaaacggggaaauauugcugcucuucaaggaaacuaaacucuuagggagcagagaaaagaaauauuuauuuagcaacuaaguguuuaccuccugggcaggaaaguggaucagcuuguaaaaauuuaauauuuguuugcuagcaugaucugcuuucacacucuacagccuuguuggcaggaugaagcuggguuauuugccuuacuuugcauaucaaguaguuguuuuugguuuuguuuuuuuaaacuucacuugugccccugaaggacguggugaauaaaagagcauauucgugaccaguaucugccuuuaauugucuuaucccuuauucaggcuugaauucauuguagaacugucugaguugugcauaggauuugaauaaaacaaagaagcaggccuggguucugguucugcuccuaccaggccugagcugggugacccuaagcacgugccucuacaucuuggagcuuuggcuuguuucucaaccugccuuagagccccguuuugaauaugggaauauaggcuguauguaauacuugucuguauuuuauuuauuuaacaaauacaaauguagcucuugcucuguaucagggucuguuccaaguguuuuccagaugguaaugcauugauuccucauaugccuucaggaggugagcacuauuaugauguccauuuuacucagaguuaaacuaaagaacaagaugguaagucguggcucaaggucucagugagaagaugggcagagccuaguuggaaaccaggcaaucuagcuucagaaucugagcuucucaacaaaaagaaguucucauuuuuaguaucaugcuucuuuuuucuuuuuuucuuuuuuuuuuuuuuuuugagacagagucucacucugucacccaggcuggagugcaguggcgcagucucggcucacugcaaacucugccucccaaguucaagcaauucuccuuccucaaccucccaacuaucugggauuacaggugccugccaccacaccuggcuaauuuuuguauuuuuaguagagaugggguuuugccacguuggccaggcuggucucgaacuccugacuucaagugaucugccugccuuagccucccagagugcugggaugacaggugugagccacugugcccggucucauuauucuuacuuuuacuuuuaauuuucauucugggugauaguguagacguugugaucuccauaaucauuuugaugcaggauuuuuuguuccuuagcucagcuaggucuggguucuugucucgugaccaggaagaauuaggcacacggacacucaaagaaugagcaagaugggaaguuuuauugagugaugaaacagcuuuuaguggggagaggaugcgggguggucccccuacucaaaggcaggagaguucccaauauagcugagcucaaggcuucuuaugggcucagaauaggaagugcaugcugauuaguuugugacuaugcaaaagagguuaaagcaaagacaccacacaaaggugggcaugauaguguagaaaaccgauuaggaaaggguaguuauguguaaaauaggugaaggauguggauuaauuaggggaaaucacaccaaacaggaaggcggguucucaauccaguuccagaauuuacccaggacuguuucuggcuugaagguuggauuucacuggggaccuguuccuuucugccuaggcauuugucugccuuuugccucuaucaauucucaccccuuccagguauguauuuuugagguguuaaguguagaaucaauacagguuuuaaaggccugggcaucaguauuucuaguuaagucuuaagaaaauagcauaggcacgugauaucuuugaacagguaagagaucaaugguauuuggucauacccauaaauauuaaaaccaaaaggaacugcuuuuuauagugcagauguuaagcuucacaugggcuauuguauuugaauguuaucccgaccuggugccauuauccccauaaacagaugaggaaaccaaggcucagggaaguuaaauaguuuguucaaggucacagaugaaucagucuccaaccuggacucugccagccccuacaauccaugcugcuuuuacugcauuacaaggccuuuugauuuuucuugaaaguugcucuguucuucucuuuuggaaagcuuuucugauauggcacugacuuguccuugaaucuucccauaucaucaaaggcacuuggccacucucaaaugaaggacucacugaaaaacucucauucuggcugcggugauuuucugaaaugaguccuauuaaaucuguaagugcaacagauucacugagaauucagguugcugucacacgcgcuuucuuuuccuaaguuugccauugcauuguaaauuuaauaauuaaagauuauuucagcucaaauguccuuguauauuuuaaugaaaacaggcccuagauugccuuggagggacuguggcacauuccugacaaaauaaggaaggcaggaagaaagcaauggcuuaaucaucuuugccucuuuguaguaccauauuuauugcaucucagccuggaacaagggagcaguuaaggaaaccagagggagcagaagcguugcucauuaagagugaagucugcaggcucugcuggagaggaagcacauacuugcuuccuucuuugguguagaauuguggucuggucugucuguggaccacacuugaugucugcagcaauauguggguugcaguaacccaggcaugcuaugugggaccacucuguauuaagauguguacccaagcuggccuggccaggcagaagcuuuuucuaaggggccucaggcagugcucgcaaguguauuuauaacugguagcuggcauaaaagacuauuuuagauguuauacaaauauaaaacuaaauagccuugaaucauauauugagaaaauuauuccucugaaugaguuuuauuaucugcaguuggcgaaauucucuuugguguaaauauguccuuaacaucugucuaacucuugcuaaucucccuuugaacaaaagagaauaggauguagacucauaggcuuuggcugauuuuggaauuugcagggcucugucauuaaaacuauuucuuaccuuccugaguuaggaaccaaaugugaaauaaggcucagaagucacgcauauaaagaaugaaauaagccuccuuuauggccguuagucuugaguauaggauguucuuucaacuguggccacaaauagagcucucacuuaugucuccaugaauuggacuuaccucccggucagaggccagccuggacaauugcgggguuucccacaugggcacaccauuuacugcuuagcacaucccccuagggaaggaagcccagaaacagaagcagagcaggccuccuucccucucccaaauacacaggucagaccaacauuccaauauuugccuauuccucugagaugaauaaguaaauaugauaaaauuugcucuuuaaaaguguacaauuuagugguuguuuaguaaauucacagaauugugcaacuauccucaguauuuaauaucagagcauuuuuauaaccuuaaaaagaaauccccagccccaauacuacucauuuccuccucuucccaucccauaccaaccacuaaucugcuuucugucuuuuuggauuugccuguucuggacauuucaugaaagugaaaucauacaguauuuagucuuuuggacuggcuuuuuuucauauggcagaauguugucaaaguucaucccugauguagcauguaucaguucuucauuuauuuuaauuacccacaaauauuccauuguaugaauauaccccauuguauuauccauucaucagcugauggccauuucaguuuuuuccacuucuuuuuuuuuuucuuuugagacagagucuugcuccauugcccaggcuggagugcaauggugugaucucggcucacugcaaccuccaccucuuggguucaagcaauccuccugccucagccucccaaguagcuggaauuacaggugccugccaccaugcccagcuaauuuuuuaauuuuuuaaauuuucuuauuuuuuuguuuuugggagagacaggguuucgccauguuggccagcuuggucuugaacuccugaccucaggugguccacccaccucagccucccaaagugcugggauuacaggcaugagccacagugcccggccauccacuucuugacuauuaugaacaauucugcuaagaauguucuguauaagcuuuuguguugacaucuguuuucauauuuuuauagauauuuuuauuuuuaugcuuaauuuuuugagaaauugccaaacuguuucuccuaccagcugcuucauuuuacaguuccaccgguaaccauugaggguuccaauaucugcaaauucuuaaucacuguuuguuauauaucuuuuuuauuuuugccauucuaguggguaaguggcuuauugugguuuugauaugcauuucccuaaugauuaaugauauugaaugucuuuucgugugcuuguuggccauuuguauaucuucuuugagaaaugguuauuuaaauccuuugcucaauuuuuauuggcuuacuuguccuuuuauuguuugagcuguaaaguaucuuuauauauuguggauacagguugcuuaucaaauauaugcuugaaaauauuaucucccacucugguaguuuuucacuuucuugaucauguccugugaagcacaaaguuucuuccuuuuuuuuuuuuuuuuguuuuuccuuaacacuaauuuauuucauaugguucugaaguuggggcagucugagaucagggugcuggucugagaucgggaucugguaggaauggacccuuuuccugguuugcagauggccaccuucuugcugugucuucacauggcagacagcagaaaaagagaaaggguuuuuuaaaaauuauuucagugaaaucuguuuuuucuuucauuguuugugcuucagggaccauaucuaagaaacaauuaccuaacccaauguuaaaagauuugcuccugcauuuuuuucuaagugccucuguaccuaacuuccagguaauuaugucaagcugugggcauuugaaucucuuugguaauugcgucaaacugagggcauuuggaucuuuuugguaauuauucauguguucauuuauucauucuuuccuuaaacaaucacugaguauuucuaccuguaaggggcuguaaaaaaaaaaaucuagguauaagauucuuaacaaaauaaagcauccaugcuaagauuccaucuagcagggaacaaagaagaaguaaauagucgauuauuucaaagaucugaacuaagguuugagcacagacucagcuggagccacuaagaagggcgucugacaccguggaauggccuccucagaacuguggugucuaacuugagaacagaaggccagacgcaguuagcggggugaagcguagaugguccaggaaaaggcgacacaugggcacaagccugccaggagagcaugcucaacccuggaacugcacccgagaccagcuagaugcucucuaagcgcugggguuguagagaguaaacaagagaggagguacuuugugaagcuggagaagcgcuauccuccacagcugacagucucauggaggguaggagguagucuuggagguuaacauggagauuuccagugauaauaaaugcuaggaagaaaucugacaggacagugggauggagagugaugggggagauggggcugcguuggauggggugacuguggaagguuuccccgggaauguggcuguugacuuuauuccugcaggaggagcaggagcuggucacaggcagaacugagggagaaauggcuggagugcaggguuuaaggaaggggugugaagauaugagcuuugagggacagauagggugagaucguugaaggucuuuuuugcuccaugcgagaggcuggggcuuauauauuguacagugagcaaggggcugugugauuacauuagagcaaguguauggcuuaggggcuagaggauauaucagagugaguuagagagucagaaaaacagugaauauauucaugagaaaaaagagugaauauuuucaugagauguccccaagguuggauaggauaaugaggcuaacauuuacuaaguccucacuuccugccaguccuuguuguaagugcugcauauguuuuagcucaaucgaucugacaauaacuguaagguaggagcuauugugaucaagcccauuuugaagauuuggaaacugagacucagaggugaagaagcuuucccaagguucaacauuuguucaugacagaaccacguuaagaaaaaaaaaacaggcaguuuugcuuucaagacccagcuccuaaccauuaagcuaagcugccuuucaggacuugagguugauugaguguguggcauacagcuggguggggggcccagggcauacccccauuucuagcuuaugaggcugggugaaugaggcaccuuuaacgcaggcaggaaauucaaggggaaaccuguguaaggggccaggagagggaaaacugauuucuguuuuggaaauugaggaagccacucauccaugcaguccugcagaauaaacaaaagccccuccuuacugugucagguggugcucugggagcuaggaugcagcagugaaugcaagacccagucucuguccccaaggagcuuaaauucuaaagaagagacaggucccagacaaacacuccacaaaucauuagaaacuugguguguaguagccgggcgugauggcacaugucuguaaucccagcuacucaggaggcugaggcaggagaaucuccugaacccaggaggcggagguuguggugagccaagaucgcgccauugcacuccagccugggcaaaaagagugaaaacucuguuuccaaaaauagaagaaacuuguguguaguagaauuguaauugggugcuucuugauucccagggaccugugggaugugaaaguggggccaucugguugacagucagauuuacagguuaaagcucaggggaacuauuucggcuuacacagaagcuccaagaaagguggucugggcaguauuuucaugugcuugugccaugguuuggugagccuaaaaggaaaaggccacuaucaggaacugcagucugggcccaaauucuuaugaugguacccaaaguggaacauuaauggaaccccucaagcaugcugucugauaggagucagacacaagcugcugauaguuagcccgccuuugauugcugagacaauaucagcaaacugccaaggucuugguugucaccugggcugaggggcucauguguuuucugauuaagcauuuguauauucucaggcaagcuaaugaaacccacuauucccuuugacaaugcagacaccuaguauugccauaaaggugagggugagguuucuuucuggauuuacucugccuucuggacagaagcuuuaaauagaccagaggcagaagaagauugaaggaggaagccccauccuaauguuuguagcaucuuucuuuaagggcuugcuccucuuaccccacacugguccaccuucugcucuguaaccagguuaaaacuucccagaauuauaacuucuauuugcugccugcugagccuccaaaccuugucuggcuguuucucuuagagaaugaaguuugcaguuccuaggaacucacacauucuagcccagucuguccuguagacguggucucucuuuuuuucuuuuuauccucccuauuucuggcauuaaguaggugugcaguaaauguuguuguaugauccacccaaauaugacuauuguucuuucacagaccugcucuguacuuuaccaccuuuguuccuuucuuacucuaucagaguugucccuugguauauagaggggauugguuccaggcaacccacauauccagaaucugcacauauucaaguccuguaguuagcccuaugucaccuaucccuguuagacuguucuuguguugcuauaaagaaacaacugaggcugggugcuguggcucaugccuguaaucccagcacuuugggaggccaaggcaggcagaucuugaggucaagaguucaagaccagccuggccaauguggugaaaccccaucucuacuaaaaauacaaaaauuagccgggcaugguggugggugucuguauucccagcuacaugggaggcugaggcaggagaauagcuugaacccgggagguggagguugcagugagccaagaccaugccacugcacucuagccugggcaauaagagcgaaacucuuucacuggggguggguggggggaaacuuaagacugggcaauuuagaaagaaaagagauuuaauuggcucacaguucugcaggcugcacaagcauggugccagcaucugcucggccucuggggaggccucagggagcauuuacuuaugucagaagggcaaaaaaggagcaggcacaucacauggugaaaguaggagcaagagagagggugggaggugccacaaucuuuaaacagccagcucacaugagaacucacucaguauugugaggacagcaccaagccauuagggauccacccccauaacccagacaucuuccaccaggcuccaccuucaacgcuggggauuaccuuucaacaugagauuugagugggggaaaaauauccaaacuauaucauuccucuccuggcccccgaaaugucauguccuccucacauuucaaacuacaaucauuguuucucacuagccucccaaagucuuaacucauuccauuuuuaacucagaagucccaaguucaaagucccaucugaagaugaguuccuucuaccugugagccuguaaaaucaaaacgcaguauuuacuuccaagaugcaauggugguacaggcaugaggucaacacucuuauucccaaaaggagaaacuggccaaaagaaaggugcuacaggcccccacacaagucugcaacccagcagggcagucauuaagucuuaaagcuccaaaauaauucuugacuccaugucccauaccuagggcacacuggugcaaugggcaggcucccaaagccuugggcaggaacacuccuguggcuuugcaguguacagccccugcagcugcucucauggguuggaguugagugucuguugcuuuuccaagcacaaaggugcacaucgccaguggaucuaccauucuagaauguggacgauaguggcccccuucccacagcucugcuaggcagugucccagaggggacuuuguguggggucuccaaccccacauauaaccuaagcacugcccuaauagaacaucucuggugggcucugccccuguagcaggcuucugcaugggcacccaggcuuucuuauacauucucugaaaucugguagaggcugucaagccuccuucacucuugcacucuccguccugacaggcuuaacaccccauggaaguugccaagguuuauagcuugcacucucugaagcugcagccugagauguaucuugggcccuuugggcugaggcuggaacuggagaggccacaaugcaaagagcagccuuuugggguggugcagggcaaugguguccuggcccuggcccaggaaaccauucuuucuuccuaggccucugggccuguaaugggaggggcagccuggaagacuucugaaaugccuucagggccuuuuucccauugucuuggcugucguaccuggccccuuuuuaguuaugcuaauaucucuagcaaguuguggguucuucucccccaccacccaccaccacccuauaaagccuuuucuuucuuuuccacaugguuaggcuacgaaauuuccaaauuuuuacacccugcuucccucuuuaaguuccaacuuuuagaucauugcuuugcuccuccaucuggacacuuugcugcuuagaaauguccucuggcagauacccuagguugucacucuuaaguuaaaacuuccacagaucucuagggcauggacucaauacagucacauucuuugcuaaggcacaucaagggugaccuuuaaucaaguucccaauaaguuccucauucgcaucugagaacuugucagacuggacuucaguguccuuaucacuaucugcauuuuggucacaaccauuaaaccagucuauaagaaguuccagacuuucccaucuucuucugagcccuccaaacucuuagccccuguauguuacccagcuccaaaguugccuccauauuuucauauauguuuauaguaguaucucacuccugguaccaauuuuucuguguuaggcuguucuugccuugcuauaaacaccuaugacuggauaauuuauaaagaaaaaugguuuaauuggcucaugauucugcaggcuguacaagcauggcaccagcaucugcuuggcuucuagggacaccucaaggaguguuuacuuauggcagaaggugaagcaggaacagguacaucacaugcaagaggagagugggagcaagagaaaguguuuaaaaaaagagaaacucuuuuuuucuuaaacucuuaaaaacucuuaaaaaaaacuucuuaaaaaaagaguuucucuuuuuuuaaacaaccagaucuugagaaaauucacaucaugaggacagcaccaagccaugagggauccgcccccaugacccaaacacuaaccaucaggccucaccuccaaaauuggggauuacguuucaacauaagauuuggauggggaaaaauauccaaacuguaucacagccugugggaaaaaucagcccucaguauagcuggguuucccauuccagauuuuguugaaaaaaauccauaugucaguggacccauacaguucaaccccauguuacucaacggucaacugcacuucccugcugaaugccucccuuucuccuccucugcccauuuagagcucccauuuaauugccacauaguucauggaaaccucccagauucuucacuaccaaaaugucaucucuuucacccucaccaccauguagcuuuugugcuccuccuuguagagucgucauauaugguugugcagguuguuuucaaucuaacucugagaguguccugcauauuaccuguugguuuauguggaaggcucccugggaagugggccauucccaagcucagcuguuguggguggcagcccagcacagcggcgcauccauguucugacguuuguggaguuuuuuguauucugucuuccucugacucuccaagaucguaagcugccuguagagaacacucguagcucauucaucaccuguaucccuguuguaacuuauauguaguuauugcuuaauagcucuuuguuagauauucauucagcccguuuuuugucugugcuuggaagaacuaauugaaaauacuucaucaaaaacgcgaugcaaaaguaguagagaaaaaaagcaguaucauaaguuaauauugguaauagauaaccuguauugaaaucuuaccauauaucagguaguacuuuacuaagcacuuuauguuuauuauguuauuuuauccucacaauuauccaguauaauauuccuugcuucccauuaucucuuuccugcuuuggagaugagaaaauuaggccuugagagaugaagugacuugcuuacagucacucaguagguacugcagccgggaugccaagccaggcauucuggaacauaguccaaacuccgaacucuugauacaaagugugccaucaacuguuucugcccuccuaugcuggugguuacagugauaauacaaggaggggcauuggcuuuuuguuguuguuacaggaauaucuauucaggacccaugauucaccagguucuuugcuggauacuguggauggggaugaaaagaugguuucugucgucuguggucucacaguagggacaaggagccagcaguuuaaauacguaucacaaugccuugcuacagauggcggaugagcuuuucacacaaggugcagaguuagcagaagaaagacacgaggaagugcucaaagaagauuuccaggaggagaugacuuacaaagggaauuuugaagaaugaacaggaauucauggggcuuccaagcagggaagggcauuccauggagagggaacagcacaagcaaagauacagaaauauggaaaguaugaugcauuagagcaaauauaagaagcuugguccauuuauuauugucaccccauggcuaaaauuaagcugccccucuacuguagaugaacaugcaacuugaccaugauauaggcuuaccuuuauccauucuccguuaauaagaauccauuauggcaacuguggccuugggagacagucguggaaacacugagggccaaauggaccgucugucucccuggugacuuuguccugcugccucugacuuggcccucagguaagccacuggccagugggcaaacacagcauugucccuucaugccaccaagcaucaccaaggcccaguggcagcuucuuauagggcauuuagggaagcuguagggaaaauaugccccuuuccccugagcauggugagcauagauaauuuuaugggaaaguugcagucuuuaaaaggcagugggucccauggggaaauucugcagugcugacugcuuuuugauucguuuauucaguuuauuacccuuaggcaccuguuacauguauggcagguuggccuugagaaauuucuuucuucaggucuagacccacccauucagcagcagcacuggcuuugccaccccugacuucagcuugguugcccaaucccagacucacuguccuccuccaaggugccuuucucauuguauucccuguccuggagccauugccgcugacccaggaaccccaguguugccuucugcuccucccucuuuuuuuucucauaucuaauaucuguucuccugaaauccucuagauccagcuuccuuguugcucuuccugggauagacacuuuuuuuuuuuuuuuuuuuuuuugagaugcaguuuugcucuuguugcccaggcuggagugcaauggcacgaucuuggcucacagcaaccucugccucccagguucaagugcugcuccugccucaaccucccaaguagcuggaauuacaggcaucugccaccacgccuggcuaauuuuguauuuuuaguagagacaggguuucgccauguuggucaggcuggacucaaacucgugaccucaggugauccgcccaccucggccucccaaagugcuaggauuacggguaugagccacggcaccuggccaacacugucuuaaucggauucucauuucacauccaccaagucuaaugaucuccuaaaugacaugucuacaucuguuccccucaucucccaucuauccauucaguucauugauucaacuccuacucucuucuaggcacugugcuguagaucaugggccugucuauuugaauguaucugaugugauccuugagcuugcugagcucacaugggggguguagacaaguagacaggcaaccacuacauaaggaugaguaggccgguacguauggcugggauaacaguuaggaaggaccccugaccuagauguggguagucaggaaaggauccuaggagcaaaugauggcgguccuaaggcagacuaagagauaaccaagugcugaauguggaggugcagggugggcaagacugugagcuccaugacagcaggggcaguguggguaugucugacucaccacuguguccccagcauccagcucauccccugacaaauaggguguacucagugaggauuuauugaaugagcaacugcgggacagaugccugcagagcaagcuaaauaugauaaggcccaggguggagagagagcacgggguagggggcgggaaacugagagauggucuguaugucuggaacauaggacagguguggggagugaccaugccgacggccgagagcuaaaaggccagucauccugccccccacaccucccugaagucuagucuguuaauuuuuauuuuauuuuauuuuauuucauuuuauuuuauuuauuuauuuugugauggggucucgcuccaucacccaggcuggagugcagucgugcaaucucggcucacugcaaccuccaccacccagauucaagcaauuuuccugccucagccucccaaguagcugggacuacaggcaugugccaccacaccaggcuaauuuuuuguguuuuuaguagagaugggguuucacuguguuacccaggauggucucgaucuccugaucucauuaucuacccaccuuggccucccaaagugcugggauuacaggcgugagccgccgugcccuguccaaacuguuuuaauuaaacuuucauugcauucucauguccuucucugcuccaacccuggagcccuacuaagccccuccgcccccggcccccacuccuaauacacccugggcccagccuuugucuguugcucuccucagauugcauccccucugccuucuucucuugucaaaguccugcauuucccuuuagggcacagcuucccucuccucuuacacguccuucugacccugucagaauuggcugcugcucuuacucccguggaacuuuguguucuuuuguaguccuuaucacauuccgccccgugcuuauauuuaacugcgcucgucugucucugagcaguaugagcucuuugaggucagcgggccgggucauucucaucuuuguauuucccacagugcuuuauuucuaguagguacucauucauggcauuacgcuuuaugucauuauuuguaguagcacaauaguauuuaugcuaguaguucuugacugacguauugcuuuguaucuagccaguagggcgcaucugcuauugauuauuaucccauguuuauuuuugaugugccguauuuugcacuucuuauuuuauuuaaucaacacagcagccugaugagaaggucuuucuccacauuuuccagaauguagaaauagcagugcagagggguaagugacaugcucaagauucccacucauacauuucagaccuggguuuggaaccuguuuccauuuaacuccggaaguuuugcccuugcguaaugcuccuugguauuucgggugcugccucaguaaaagcaacaucagacaucucagcuccuaacugaaaguguucagggcauaaugaaguuguuugccaccagaaucugauuuuauuaucaaaaguauuaaaguaaccgcuugguuggcacagaauccacuuuggucugaguucuggccaccaaagcuuucaguagaggcuggaggccauuggcuuaguauacaaccuggaaguggucuauuucagaugaacaaaagcuauagaaauauuaaaagugaggacaggcuguuacugggugaugggagcucccgaugacuccaucuuaaagccugguuuucuuuuggagaggaacaagcagaagacagaacuuacacugugcuauuggagaagucucuugccagccgccugcagccagucuaaaaaacuuacacuacauuguuguguuucugcguuaaggcugauaagucagauauaaagguugaccaaauuguuaacacaugcucuacuuacggcuuucagaaaaaaaugaauccuaauaacagguauggcguuuggccugaauugggugucaguagugauuggugguugguugucacuucucugagucacagagguugggugagaugacuucucuccuuuucagcuccugcagccucaccagugagcacuguuuucguaacauuccagauuuacuuucacaauugccguuagaaacgugccccaccguaggaacugugaagaguguguuuuugcagcuguaauucaaagagccguaccucuccaccugacccuuccuucucacacuccccacagacggaacccucugcacuuccaccuuauugcugacuccauugcggagcagauccuggccacgcucuuccagaccuggauggugcccgcugugcguguggacuucuacaaugcagacgagcucaagguaugggcaggaggggaggcacuuccgugaucuccucuagcuggaagcguuauuacuugugguugagcagacuguagcaaugccagaaaucucagcuccuaacugaaaauguguagggcguaaggaaguuguuugccagcagaaucugauuuuauuaucgaaguauuaaaguaaccccuuugagugcacaaaauccacuuuggucugugaguuuugaccaccaaggcuuucuggagacgcuggagagcauuggccugguguauaaucugaaaguggucuaugguagcugucaucuagagaguuccauuacccagugaaguaaaggcugaacucagacccccaugggcugggguuuaaauuugccuguugucacuuacugaucaaaagacacaaaguaaaccacgcaucucugcuggaccuguuuucucaucaguagaaaagguggaugaaauaccaaacucauggggauaauuaagaggcucaaaugagagaauauauuugaaugugcuuuaaaaagacacugcugaauaaauauuaaagguuaugucaggcuggagggguuucaaccaaaugaaaccuuuuuggucaucucuuccccuuacaauuuuuuuguggugccauuuugcuugcaucguguugagacccacagcccgauuaagaaguccuguauauucuggcucuugauucuacuuccagucuugucacuggcauucccguaaaccuucgcuauuccuuuaacucuaaguagcagagcacaccucugguucccuuugcccccucuucuguguuugagucuuugcuuauucuguuccuuccaucugauauuuccuucccaccuaucuugccacaacuccuguucguacuucaggacucagcugcagugccaacuccucuuaagaaacagccugacuuccacaggaaagaggaagacauuuuuuguucacuugucugucuacugaaccuuucuuaaugggguaggaggagaggagccgcaucuuauucuuuucuauauuucuggugcauaguagguacccacuaaugcuuguggauuuaacaaauugcugugauuagaggaacauguaacuuugcagaaaugcacugaugcucugucucugaucaccuugggaaggacucaacaccuaagcaugaggcugacucuggcaaauugcuuguuccaaaccucauaaagccauuaucuuuucauuuuagagccauagcauuuuuaauagaucacugacaugccagccagaguuucugauuuucacauauuucaggcucugagguugauggagauguucagaauuuagcauuuggggauugucuugguaauuugcgugccauucccaaucuauucugagccuaaaauugauuaacacucuuaaaaagggaaaaacaaaauuuagcaaauugcugcgcuaauuaaggugaaagcaagccacucugucucccagggucuuagcgccaacaccaugggggaaaagcaacaugggaggaggagcagcagcugguuccgaaggaugccucugccgcuguguucaccauuuaccuuucuuuggguaggaguccagugccauguccccugugagccugcacccuuuacuuuguaagaagacaccgaagugugcugggcguaguggcucaugccuguaaucccagcacuuuaggaggcugagguggggaggaucacuugagcccaggaguuugagaccagccugggaaacauagugagacccccaccucuacaaaaaaauuuuaaaaauuagccaagugugacggcacacaccuguagucagucuaagcugcucuggaggcugagggcagggggaucacuugaucccaggaguucgagaccagccugggaaacauagugagaugcgugucucuacaaaaaacuagcuggauguggugacugcaccuguagucccagcuacucuggaggcugaaaaaggaagaucacuugagcccaggaguucaagacugcagugagcuaugaucguaccacuguaugccagccugggugauagagcuggcaugugguacaauuguagugguaugcauuaugaugugguacaaucacagugguaagaucauggcuaaaugauuguaucauuuuuuuuccucaaaaaagaaaaaaaaacggaaaaaagaaaaagaaaauacaaagugauugggaaaaaacuaauuucaaauccugguuuaccgccgaagaauucucuaacugguuuugaaccuugguucucucagcucucagauggcuugggacugagucagccacaaaggaaggggugaaauaagaugggucaguguacacgacaugacagcuucuuaaaaaugcuucauuccacuuguagccaaggccagaaugacuuaaaaugcacucgggugguguggccgguugugaaguccaucaacagcuaagaaguugaaggaguaagguaccauggacuggaauucccuccuggaagccccuuccaugaggucucggaugaaaggggagaaggggaggaaacacugaugcucugacucugucaggccuacuuuaauccagggagaccaacugucuauuauuuuacgugcuggcuuuauauauauauacauccgaaauaaauacuucauggcuuaaaaaauaauaauuuagaaaauacaaucugauacguucaaaagaauauugucucuagaguccuguccucuaacccgaugucuacuaucgaagacuucaucaaaguuuccugacaccugcuuuuuauuccccuaccaauuaaccaccugucucucucacauuccugaaucccaugagaguguugucagaauccaguacaacaguaugaaaguauuuauaaaacguaauuuuuucauaauacuaguaacugugguucaugacaaagccaggaugaaaacccaggccugucugacuccaugaucuauuagucugucuauguuuuaguuuauacauaacccggaucaacaaccccaaagccaugaucugccuacuccaccagccugacagccccucuguaguggcaucaccaucugcuuaguugcuguucuggaacugagagcucaucuuugucccuuucucuugcccugggucuaaccacaucacacccuagcguggcuccaccuccccuacaccuaccuaguccaugcuuugugaucuuuccccagcacaauggcaaguguuuuucacacuagucucuuccuuccacugcucaccucuccucccccauaucuuuucucucaguagcaaaagucagcuuuccaaaaacaagcgcagucaugccacucuuuuccucuggguaaaaccuuuucugguuuccuacugcucugagcuagaggccacaguuuuuguuuguuuguuuguuuugcagacagagucuugcucugucgcccaggcuggagugcaguggcgugaucucggcucauugcaaccuccaccuccuggguucaagugauucuucugccucggccuccugaguagaguagcugggaccauaggcgugcacuaccaggcccagcuaauuuuuauauuuuuauuaaagacgggguuucaccaaguuggccagguuggucucgaacgccugaccucaagugauccaucuaccucaggugaucugccuaccucagucucccaaagugcugggauuacgggcaugagccacugcccccggcugaggccacaguucuuaaccgagucacaucucucugcggacgcuggcuccugccuccuuccaaguuguucuugcaccacuugcguccuuccucacucuccaguccugcagauucauuuugcuccuucuuucccaccagagcguucuauuuauuaaacuguugcccaaccuccuuccuuucccccauugcuaaugaauaacaaguucuuuugcuaaaguuacguguacucagggaaacuuucccugucuuuaucauuucauagggguugcuuuguuacauguucuccuagaaucacauacauuucuucaguaaacucaacacagaggguauucuuucaugcuuuugugugaugagcuaauagaugucuaucuccuauaccguaagcucccaaaccaggaucacgucuguuuuucaccaccuuuguaucccaaaggccugacgugaggcuuuuaaagauguuugcuaaacauuuuuaaaagaagcuuuauagaugugugcuaaaacucauaaagaugcuugcuaaaugacuggcuuauaaagauguuuacugaaugacugauacacaaugaauuuagagcugggucccuaagaauaauaaaaccgauggcagaguuucuuuaucacggucaggcccaggaauucacguuucuuuaucacuguagagcccagggucaccacauuccuaaugccuauuugugucccagaggcuuguguggguagccaggaguuugcccaccagccacccugaagucgcauagauaaggcagcaacauuugcaccagcccaccuccuaagagcagcucugggacaggugagugagugucuuuccaugacagguaugcuaggaaggaaacacauuaaaacaccauccaguagacgaccuuagggaaggaggaagaacaggagagaaauggacuugcgccguguuccacaguugcauucaggaagcaugucagaugguacccucagcagacacccgugacggccucccuugauacagcuccaagaaaucacuuuguacagcuguuggaaauggcauuucucagaaauguuccugugggccccuuaugauaucuguuagugcuguagaaugaaguaauaggaaacaggacauuugugagggauuggugcaugauuaaaaacgaacugugggaaauucgcaguggacugguacacuucucucuguaaugaccaauuaguggggauuugcaaauagugauggcucagccugccuaucucuauggccugugaaaugcucauuggucuucccaauguuuacauggcccauuuguuuccggccuccaacuccugguaccaacaggcuaccaggacugaagguaccucugcucugaacuccacucacucaaaacaugcagcuccugucuacaggaggaaaacuuauuuuugcguagagcuuugucaaugaugcgugcugucacucaucucucaugaugacccuggggguuggaaagauaaguaugauuaccuccaccucacuuaaguuaaagugugggguugaagagcauuugcuuaagauuagacugcuaacaagugcugacgcugauauuugacuuuucccuucccaaaagaaaugguaugagauagaggauuguauaauucaguagacauggauguaguggagaucuuaagggaauuugaaagauauggaccacagccccuggggaaugacuguugguuaccacuguugaguugcacuugaauucaaaauuccucuuuuccauggcuuuggaucccacaggcuguggucuaacaucuguuguuuaagaaucacuuacucaaccauuguggaagacaguguggcaauuccucaagaaucuagaaccagaacuaccauuugacucagcaaucccauuacugaguauauacccaaaggauuauaaaucauucuacuauaaagacacaugcacauguauguuuauuguggcucuauucacaauagcaaagacuuggaaccaacccaaaugcccaucaaugauagacuggaucaagaaaauguggcacauagacaccauggaauacuaugcagccuuuaaaaaggauaaguucauguccuuuguaggaacauggaugaagcuggaaaccaucauucucagcaaacuaacacaagaacagaaaaccaagcucuguauguucucacucauaagugggaguugaacaaugagaacacauggacacagggaagggaacaucacacacuggggccugucagggggugggggccugggggagggauagcauuaggaaaaauaccuaauguagaugauggguugaugggugcaguaaaccaccauagcacauguauacccauauaacaaaacuguauggucuacacauguaucccauaacuuaaaguauaauaauaaagaaucauuuacuucauuucucauguuuuacaugguucucucauggucuguuucucaacaacaccucuauggacuagguccuguuauuauucccauuguacauacaaaggaacugaggcauaggggaguuaacuaacuacaaaucauguaaccgguacauggcagagccaggaugaauauccagaacugucugacuccaguaucugugcccuuucuccuauguccuguuucccucucuguggcuuauuucagcuaaguuacugucauugugucuagacaaggacucucugagcuuuugaugggggcagguuccuucucuggguguuccugaagaaccaguauauuaagcauggcuccugcauggaaggccugcugggaaugguacuuccuguaggggaugaaagggagcccuucuaaggaugcugcugaggagggggauggcucugucacuuccauccaaggauccuguucuaaacuaacagucaucacucuagacaguuggcuuuaaaucaggaaaacauuucuugccaguuuucagacaaggcccuacaugucuaccagccuuugaucuugcuccagcuggcccagaaagucacccccaugccaucacuggggugcgcgugaucccgagcucaggaagggaagcggcagggcaguggcuguuucaugauucaccugucuagcugggagcccuaauuuuucuccuuuucucuuagacccaaugcccgcuuguuaccaacaucagaaagaugaugaagugagauucaggacuguggcugcagaaaauauugaugguggacucuaaaaacuggccuccuacucauccuuaauugccuuugugcuggucucuauggaggauggcagagguugucuuuagagaacuguaaucuuccagcccccugccguccuuuaggaggcagacucauuguuccugucauguaggggguggguaaacugcugcuacccuaucuguuuccugggaagcuaugcuuccugaauacuggacauuuucuucugggagagacugaagagagcaugaaaucauaggauucuagggugggaagaaggcuuaauacuuacaaguuuuuuuuuuuuuuuuuuuucaugaauuaggccaagaagugcaacugaauugcccaacaagagaucacauauguuucuuucuaacauauagcuuuucccagaaugggaucuggguuuucuggcugcugggccugguuuauaguucaguggggaccacacuuaacaaugguugaacuucaggugcugugacgaaaugcucucauaaggcuggagcagcuccagugaagcuggaccugcagaagaaagagagaagacauagauaugucucauggaagggcauuaucugcucugggauguccugcagaaacaugagaaaugaaguaagguguguguggccuucugaaucccccaguucacuaauaauguguuaauacccagagcaauggacagaggugaauaaauagccuaucaaaauggguauuucuggcucuccuuuauuggugaagauugauugcaguuaaaugagaacuuguaauggaaagcaaugcuuggcacauaauaggcacucaacaaaucuugcuuucuucuuuuuguuccuaauguggcugccuuucauauauuuaaagaugacuguaauuaacuucuuaaaucuuuucuaagcccaccaugucaacccuuccucuucuccuccaacaaugacugccgaccugucaucagagggucuacauuuuggcuuauuuuucuagaauaguugauggauguaugcucuucuuccuucuuuccuuugugguccuguguuauucggcagggugacagagguuaaauauuaugcgcaggucuggaaaaauuaccacuuucccauuuucuuuauuguuuuauugguucuuggauuaucugugugguuucugaauacgaaggcugguucugcaaggucagcaguguaccucuggccucugucaugggcuuuucugucucacacaaugagggcaagaucacagaauggacauggaaaagcauaaagcacuugaaagcauaccuuuguguauuuauaagacugauguuugacugugaaauguuggacauagaaaauuuuagacaaugaaugcaaacucuaaucugcauuauaaaauaaucuuuuuaugucauuuguucaauucacuuuuuacacaggcagauuuuucuuuauuuaacagucuucuaaugaaugguucuuguccccuuuugagaagcauagaaucuuaauuagaaaggaacuuggcagucaucuagcauaaccuuccacuuucuucuauaauauucuauacaaauggucauuaaucuucugcuuuugaauacuuccagagauaagagaucauuaccucccaaaggacccuguuccauauuuagaaacucuauuagaaauauucgccuuaugccuuacugaaaucuucaucuuuuucauucuccucauugguccaccugagcauuaaugaagaucaggugcaagccuguguaccauuugucuguucccucaucugccuucucuacuagacagagggaaccuagagggcaaggucuguaacauuuauguucaugcccagccuuuggcaugggcauggccagauuuggacaaaaucuggccaauccuggccuccagcaaauaccuggcuucuauguuuugagcuacacagugugcaucaaccaguuguuugaagaccugacacauuuacugaguccucucuucuucucaguaaucacuacuacauuucuucaacuguaccugaaaugacaguguauggagccuaggugacaguugacccuuaaaacaugucuucugaccugcuuguggaauaaaugccuuccagguugcugacuugcuuaaaugugcuccccauugugucuccaucccauagacagagacauucucugugguucugcaaaucacagcacuuggucuagaucugcauaugugacaugccccaccuugagcuacaguuggucugagcucagagucuuaaacucauuuaaaagcagugaagugucccaacucaccuuuuuucucauccugagcauuguuuccuucucauucuuauuuauuguggucuucucauucauacuucauuuaacugauaaggaaaugcuuuaucuguaucaaaacaucucuuguaccccauaaauauauacaccuacuauguacccacaaaaaauaaaaauuaaaaaaaagagagagaagugcuuucauauaccuacuuucauucuguccucccaagaacuccaugccacagagaggacauguguuuuauuauguuuuauuucuaaggaauuugccaaaagaauuaaccaaaugcugcuaaagagagcagcauuuggauggagcggaugccagaaucucguucuugugagccuucccugcagugcuaucucaugcaccacaagucuuaccuaccagaaacuucuguuaagaaacaauuucagcgggguaugguggcucaagccuguaauaccagcacuuugggaggcugaggcagguggaccaccuaaggucaggaguucgagaccagccuggccaacauggugaaacucugucucuacuaaaaaugcaaaaauuagccgggcaugguggugggugccuguaaucccagcuacuugggaggccaaggcaggagaaucgcuugaacccaggaggcggagguugcagugagcugagauugcgccauugcacuccaggcugggcgacaagagcaaaacuccaucuaaaaaacaaaaacaaaaaacuucauugauucaagagugugguuauaaugacggaguugggaucaaaacaagaaagaccagagguguuugacaaauaaugagaaagcaaugggcaggguaaacuggaaauuaugaugagguuaggaaauuugcacugagcacagagucuuuguccaaauguuaugaaaggauaaaaggcuagaguugaggagugagauguuagagauuugguauuuucgaugaggcccuuuuugggguucuuuuuuuggcauguuagccugggauugaguggcugagguguuguuggaaaaaguuaaugaaaacuaugggcucuagauacugcaaggcccaggguguuggcugcuucaucccuaggaugaugaaacucaaggaaaauugucaagcaccaaaaggaauuguauaccugcagaucaaaaggagccucgacaacuaagguaaaaucagugauaaguugcccacauuaguguacacccuagaaaauuauuugaauugcaaggauuaaaacacaauccuucuuuuaggaauaguaauucccauuauuaagaguugauuauuugccaaccuaauaugcuuaacuugcauaaucuucuuuuaucccuaccauuuccuggcgaggaaacugaagcuuaggaaagagacuuguucagauuacucagcgaaugcauuguggaaccaaaacaugaauuuuggguagucugacucuugagcagcgcuacccgauggaaauaaaacagcaacucaucugugugauuuuaaauuuuccaguagucacauucugaaaagcaaaauagaaccagugcaauacauuuuaauaauacaucucauuuaauuuuauuuauccaaaauaguaucguuucaaccugagaucaguauuuugagaauuacugagauauuuuacagauuguaaauauuaagucuuugaaaucugguauauauuuugaacgucucacuuuggacuugcguauuuuaagugcucaguaacacauaugguuguugauggcuguggacaagguauggaacuuggcuuuuaacacuacgugguaauaccagggcagaggguggagacaagcuuauuaucuuggaagaauaaaaaucccgccucagcuucugugcugugagaguagguguccaaauaaaaugucugcagaguuuugagcaaaauagacagagacccaagaauaccaaccaaguucucucauguuaauaaggcaacagaaaaaaaaugauaggcuuugcaggaacucagaaaauauacaccaauaggccaggugcaguggcucacgccuguaaucccagcacuuugggaggcugagguggguggaucacuugagcccaggaguucgagacccaccugggcaacauggcgaaaccccgucucuaccaagaaaauccacaaauuagccagucucauaaccuggucucaaaauaaauaaauagacuuaaaaaaauuuuaaaaacagaaaaaaggcugggcgcuguggcucacgccuguaaucccagcacuuugggaggccgaggugggcggaucacaaggucaagagauugagaccauccuggcuaacacggugaaaccccgucucuacuaaaaauacaaaaaauuagccggaugugguggugggcaccucuagucccagcuacucgggaggcugaggcaggagaauggcgugaaccugggaggcagagcuugcagugagccaaggucacgccacugcacuccagccugggugacagagcaagcuccgucucaaaaaauacacacacacaaacaaacaaacaaaaacagaaaaaaaaagaaaauauacacaaguguauuguucuugaagaaacuauagcuucuuugcaagccacccaaaaaagugaucaaaaugaauauucaggaaugaaaagguauuguuauaaaggggcagacaguguguacagaguuacacauagagugauauguaaauaauuguuuuaagucaguugcaaggcugauugcaaaugccgaaaaguauuugucuucagaacauacgcaaauaauaagcugaucacagccauuuuaaaacacacuggagaguaugaguuggguuuaaaagcuguuaaauauaguggauuuugugggguaacuuaggugguaucuuuuaacucuuuacuuugauuauccuggaaaaaaggguaagguguuucugcaaagcucagacaugaccccaaugaaauaaguagaauuagaucuaauuuauuagugaugauuauuucaaaugaaauaaagccuaaguaagaagcaaagaagaugagacagaaaaaaauaauaauaauaauaaaaugaacuauuagauagccacaugggaaaaaauuaaucuugcuccucacuucauuccacauacaaaaauuaacuugaaaugaaucuuaacaccuaaauaugggagcuaaaucuguagaacuuauagaggaaaacaaagaaaauuauagggacuucaaguugggcaaagauuuccucccucccucccucccucugucccccuucccuccccuccccuccccuccucucuccuccccucccuucuccucuccucuuucuuuuuuuccuuucuuuucuuucuuucucugggucucccuuugucacccaggcugaagugcaguggcagaaucauagcucacugcagccucaaauaccugggcucaagcaauccuccugccucauccucuagaguagcugggacuacaggcacaugcuaucacgccuggcuaauuuaaaaaaaaaaaaaaauuuuuuuuuuuuuuuuggagagacgggucuugcuauauugcccguguugaucuugaacuccuggcccaagcaguccugcuaccucggccucccaaaguguugggauuacaggugugagccaccaugccuggcagagagauuucuuaaauaagacauaaaaagcacacacuaaauaagaaaaaaauugauaaauuggacuucaucgaaguugaggauuuuuguucuugcaaagacauuaauaagaaacuauaaggauaagcuacagacugaaagaaagaauuugccaagcaucuaucugaugaaagauuuguaucugggauauauggagaggucuuacaccaauaauaagaaaacaacccaauuuagaaaugagcaacauauuuuaagagacaugucagccaaggagagauggaguggccaaugaaucccugaaaaaugcaaaucaauaaugacaucauuagucaucagggaaaugcaaauuaaagaccauccugagauaccacuucacacccacuacaauggcuaagauuaaaaggacucacaauacaaagugucagugaggauguggaacagcugcaacucucugacaucacugauggaagugaaaaaugguauaccacuucagaaaacagcuugguagcuuuuuuguuuguuuguuugaggcagagucucacucuuugcccaggcuggagugcaguggccccaucuuggcucacugcaaccuccgccucgcggguucaagcgauucuucugccucagccucccgaauagcuggaauuacaggcacccaccaccacgcccagcuaauuucuguauuuuuaguagagacgggguuuugccauauuggcccggcugaucucaaacuccugaccucgugauccacccgccucagccucccaaagugcugggauuacaggugugagccaccacgcccggccuuggcagcuuuuuaaaauauuaaacauaacucacaauaugaccuagugguuccacuccuagguguucaaccaagagaaauaaaaccuauguccacuggaaaacuuguauguggauauucguggcagcuuuauucauaggacuucacugacugucagcugaagaacugguaaacagcugugguaugucucagcagugggaaggaaugaacugacggcacauacagcaaugccagugagaagguuugauguuaagugaaagaaagccagaccgaaagacugcaugguaaaugguuccauugaugugacauucuugaaagcaagacagaguuaauaggagccagagggugguguggugggacugccuagcaagggacaccagggcauuuucgagggcgaucaaauuguuuuauaaagugacugcugugguuguugcaaacuguauacauuuauuaaauugaacuguacguuuaaaagaggugaauugugaugauguaagauuuuuuucucgaagaaugcauaaacauacuaucacagaaguaaaaucaaacaucaauuacuuuaauaaacguaaaugcuuuaaacucuuccauuacuggauaacaacuuuaauucuugguuaaauagcaauauggugugaguguguuaauuuuagacuaaaucaaauacaauaaaauauauuuaauuagguacaacuaauaauuuuaaauugguaaguuuaauacccauaagaggauagaauagccgaguuauuuuccaaguagaaaacuuccagauauacuaagcacaaaacaaaaauugauagaaauauauguugggagagcuuuggccacagaaaagaaagaugaaucaucuuguuaaugacagaaaugauuuuuaaaacauaauaucaguaguuauugaacugccuaucauauggaauaaaaaugagugaaguguucaucaaaaaaauuacacaaaugauagauaccauaaaaauuacacaggcccuacucuugaccacagugcagcggaacuacauaucagaaacaaacuauuaaaugggaaauucaaacuucuuggaaacuagaggaggguaaagauucuuccuaaaugcuauuuaauccaaaaggauauaaaaacuaaaauuauagucuguuuugguaucaacagaagaggaacauuucauaguaaaguuuauggaauguggccaaagcugucacuggagauauuuuaauagccuccacuucuuucauuauucaaaaacaaagguaaugauaaaugaaucuugcauuucaugcaguaauugaaauaugaacaauggugugucccuaaggaaagcagaagggaaguggaguucacagcagaauucugugaaguaagaaaaauaauaaacagaaaaguaaacaaauauuaauuuucauuaauuuaaauuaaugaaaauauuaauuuuuaauuaauuaauuuccauauauaagaagauggcaaaccucugguaaauuuaauaaaacaauggaggaaauauuaauaaacagaacaaugaguaaagguauacaacaauauaaauuugcaaaaugguaaucaaaaucaauagccaacauuuacuugucacuuaucauguaucagacauaguacuaaacauuuaguguuaucucauugaaaucucaugacagauccuugaaauuagugcugugauaaucuuuuacagaggaggaaccugagaguagaggcagcuagaccaagacuucuuagcuguggagugguggaaacaagaauugagcccugcagccuagccgugggcccuagccuuuccuccucacuuacuacaguugaacucuaugggaaauuccaugcagauuuaugaaagccuggagguguaauguuguguuugccuggaagcagauuugcauuuauugcggcuaguugccugaggcccugucaguccuaaucacuuugaauuaaauucugcauuugaggucugucagacaccagauagcuugaguccagacaacacaccacugugugauccaucuugagggugcuaauucucagggaaggccucccacccccacuuuaguagucauccagauaaaaaucaguguguuuucuguuccucccuucuguguguggggguuuguuucuaaaucaccuuuauacuaagaguguaggauucggguccuaacuucaugcaaagguucucucucugacucccucuuaagccaggccaugggccucaucuucucccuccugcacccucacagcagugaaagcagaaggucaagagccauuccccucaaagcaauacugaguuucagggauuacuuauauucuaauuuuccaacuuggacuugcuuuucauuuuuguauuuuugcugugaugccaacuuaaguuuuauaugcgugcgugcgcacacacacacacacacacacacacgcacacauauauguuccuuguuaacuuuucaaaauguuuucacugugaggguuuugagguugucuaguucacuauguuaccugaaauaggaaucucccuuccucaucuuucuucuagagcucaguuagcaucucaaggaaaguguucugggccuggcauucuguucaaauuuggguuccccuucuauagguuaucuuuccaccuguuacuucauuuuuuaugacauugauccuuguguacuuauuuguuaaauaccuuugaugcauggguauugguggauguaugucucacuugccacugcaguguggagccuacguggauggaccccucggcucuucuuucugcuucccaauucuuagcaugugcuugcucauaguuggcucuaaccagguguuugaaugaagaagucuugguaagaauuuugaggcuguuucauucagcacggaggauucccaguaacguuauuuuaucugccgugaacauaaaaagagaaggccgauaacuuaaguucuggguauccauggucucuugcucaagaaagaauuuccaaccuguagagaaugaauggauuuuccaacaaaaggcauuaaugugauugaggauuugggaagugaucaaauaagauaucaccagauuaaaaaaauaaauuuuguauugauugaaagcuugaauuuaaaaacagaaacauuaaacaaaacuagaagaaaaauaugaaaauguuggucuaagaaugaggaagguuucugugugccuaaggaaaaugaaaaaaaaaaaaucuuaaaggaaaacuccaguagauuugauuaauugcaauggaaaaaaucaaggggaaaauucugaauaaacugaaacaaaauuaaaggacaaguaauaaauuggaaaaauuguacuugaaacagauacagcauguaauacauaaggagcuguugcagauaaauaggaaauacagacucgcagaaaaauggguaaagaauaagaauaagggaacucgcaaaaaaaugcaaaugguaaaaauauacaaauauauucaaagaaagaagaaaauaagauuuuauauaggagucuuuaaaaauuuuuauuacuuauuaaugggaaguaucuaugagggccaacccuucuuaaauugucuauuguaagucaacaucagaauacccuuuuuggauauuuuggcaauaucaagauucuuaaaaauuauauacagguucugugaggcagaaauucuuugcuccaaggaaauaaagguggaaucaaaggauuuucaucaugguauuguuuguuugcaauaguaaaucuuagacacaaccuaaaucccaacauucaugaaagguuagguaaaguaugguacaucguugaaauaagauaguugaagcuuuuccaaaucauuuuuaaauaacauuuuauugauuuaauagcaacguugaauguugcuucaauaaguggaaagggaaaugcucaugauguaauauuaaguuuaaaauaagacacaaaacuaguucucuucaaaguuuaaagaugucuguguaguuauauaauuauuuacaaaggcagaucauaugacaguguuuaauauguuaccucuggguacauguauucuaguuuucucguuuucauugcauuuugcagacuuucuguaguagcacaauuuuuaaaacuauauuuuucucucgacugugaaaggagcagagggagggaaggaaagagaagguaauuaaugacuucacauagauaaugggaauaguaaccuuguuguucucagcugggcgcgguggcucacgccuguaaucccagcacuucgggaggcugaggcggacggaucaugaggucaggagaucgagaccauccuggcuaacauggugaaaccccaucucuacuaaaaauacaaaaaauuagccaggcgugguggugggcgccuguagucccagcuacuugggaggcugaggcaggagaauggcgugaacccaggaggcggagcuugccgugagccgagagaucgugccacugcacuccagccugggcgacagagcaagacuccgucugaaaaaaaaaaaaaaaaagaaaucuuguuguucucccuguuugggggcagcauggcguauucacagguguaagggugcagcauaccaugggguuuggcucaccugcauaugacuugugacuaucaugggugucauugucucuguaagaaggacuugcaagggauaauccagguagaagagcacccacaaacuuauagaggcuuugugugcaugcgagcgccuacccuuuuuacuuaggucauuuuggaggugucuuuugggaacacguaaagaguaacaucagguuuuccaagccagcugguuucccugugcuacggaaaaaaaugaaaacucaacuggcaguccauccaucuuaauccugaaggaacugggaccuuccccacuuacuuaacuaggugacucagaaaauccuaacgugauccaacccaaacuccaaacuggcuaacuuagaaguaacagaugaaaaagagagagugggccgggugcaguggcucacaccuguaaucccagcacuucgggaggccgaggcagguggaucguuugaggucgggaguuugagaccagccuggccaacauggugaaacccugucucuacuaaaaauacaaaaauuagccgggcguggugagcauaaaggaaccuaauggggagaggucacgaaagacucacuuuacaucccuuugugcagcuacagugauuccucccugcauuaccugugugaucaguuuccugaucuuuuauguugugaucuaauauauaaccugaguaaagugccuuaaacaaucuacuaauuuugugucaaauaucaagaagcccuucgauuggcaguuccaagaguggugguuauuaucuugggaauuuucgugggcuccucaugguggaggggugagaauaaauccagaaaucugcugccuacaggacuguagaugggaagagggaaggcaaccuuauucucauaugcacucugucucucauuaccaaacagggaaucuucucccccagauuuccuaggagacuuugcuucauguacauuggccaagauggugucucaggcccaugaccugucuucagggaagacugaaaaagugaugauucuuugugucuuugccugugugugcguuucuaugugugucucagugugugugucuguguguuuucagccuucucaguagggaaucugaaguguagcucucuggauaggcaaccaaaagaaucucccccgucuccuuuguagguuugcugugagaagaaaaugcuuaucucagaagcaggaauaauuaauguauauaagugaguuucucucuccucucacacuccuuuuucugugguguuuguuuguuuguuuuguuuguuuuuuauugagacgaagucuugcugugucacccaggcuggaaugcaguggugcgaucucggcucacugcaaccuccaccucccagauucaagcuauucucaugccucagccucuggagcagcugggauuacaggcgcgcaucaccaugccuggcuaauuuuuguauuuuuaguagagacaggguuucaccauguuggccaggcuggucucaaacucccgaccucaagugaucugccagccucagccucccaaaaugcugggauuacaggcgugagccaaugcgcccagcccacuuucucuuuuucaucugugacuucuaagccaguuuggaguuuggguuggaucauguuaggauuuuccgagacacccaguacguauguggggaaaguccugcuuccuucaagauuaagauggauggacugccagcugaguuuucauuuuuuuuuuuucaguagcacagggaaaccagcuggcuuggaaaaccugauguuaacucuauuuaauagguagcugaauucucaucugauuaggaggaaacaacucaggucuguaccuagauacaaaucagucaguggauaaggauuugcugaaugcacacuguuccagaauacagaugaggaaaagcucaugucuucuccaagaauuuagugaaaacuaaugaaauagggaagaguguaguaccaaucagcuaccagcuggauagucagggaugacuucacagaaaaaggggaacccugagccgagccuugggggccacugugauuuccaggagucggggggaagugugguguucccaugcuagguacaucauugucgagaacacagaagcuuugaggaggaggugaagaggaggcguaagagcauuuuaucuugcucuuugaguuaaugacaggcuuucguugcccaaagaagagaauacuuuuucccaagcaaaacuccuuuaccugcuuuuuaucugcucagcuuagcuauaaaaguuaauacucuuauuaaacuuuuucuauuagaaaggaaagaaaugcacuucuuuucucugccugacacuuccuucucuuuuucacuuaugaagggcauaccuuuuugauaauugaggaaacuaauaaaccagaucucaaacuaacauccaggacuggucaggaugcccacagcggggaaaguugggccaauuuuuauuucugagguuucaguaucaguauagucaguauguccacauuuugauuaaaagaaagcaaauaaauggaaugccuauauaugugucuuggaaagugcuaagggagcuuccaagguaaaaauaguaacuaucuaucacaaaguguguucuuaugggggagauauguguguacugaagugcauuacugaagggauggacaaggcgagggaagcacacuucauacuggaugggggggacccaacuguccuuauauuuggaaaauugaacuuucauuuuauaguguacagauuccauuuuaaaaucaaugucccugaccuauucagugggcucaggggcagaagauggagcugaaugggauaggcguuguuaaauuucuuuccgagguucuaauuuucuuauuuaucggguaacuugcaacagguugccagcuauauaccuugagaggcauugauugcuacuaaguccaaaacccugaccuuaagguuuucaaguccagugaccuagugacaauauggauccugagggcaggaaucuugguagaugaguagaaaaucaagagauaaaauugauuuauuuucuccagacuuaauauuuugcccugugaugguucucaaaaagaagguguuuuggugaaaaacuaccuccaugcacugccuucauccuguggaggugacugcauugagaggcagauucauuuuuacagcugacuugacagggaggguuugacaugguggcugugacagaaagguagaucugggaugugggggagauggaucaugucuagcuccuagaauucuggaacaagcuggugggugcauggugguaggaagauggagaaaacugaggaaggauugagcuuuagcaggaagagcaagaguccuauuugucaucuagacaggguauaauauaugugacuggaacuguccaagguagacaugugcucauacuuaaugugguuuguuuccccugaauaauaacauaguacaguauccgcagggggcacaaaugcccauucuuuaagcauccugcaaagagguguuccugguugaaagcacagccagguacaccuuggagcuacuaucuagcagaaggaauucacucuccucuucuuuuuguacaagacaagcaugaggaugcucuugaccuaaugaaguuaacauuugggcucagaugccaagagucugaacuuugguggaaguauucaggggaaugcugaguaacaucagcuguccagcaccuggagcuuggagcccuugguucagugugaaguuggguuuuggaugaggcguaccugcugggugaccagggugccuagguacaguggaaaggcguaaucccucuuguugagagaauggcagccaauggcuaguucauugccuucagccaagagagaugucccugaaucagucacuggacaaucuugcuuaucuaaacuuuauauucuuucauguauaagucucauucaauucucuuauauguagugguuaaagaguugucacuuuucuuucuuuaaggauucugaggacuucaaacucaucuuuuuuuuuuuccucuuucaaggucuuuccuacuuccagauaaugcaauguuuuccauuaggucaaaacuuagacaaaauguguacucuccuguaccaggacaaagacuuuucauccacauccauuuuuuucugaguuucagcugguacuucugagcaaggugccucaaccuuagcacucaugauguucugggccagauaguuuuuuguugcgggggcuguccugucugaggauguugaguggcauuccuugccucugcccccuggauccaguagcaccccagugcccaagucaugacaaccaaaagugucuccaaguauugccagggguccuuugggggcaaaauugcccuucauauuagaaacugacacaauuggggugaccccacgcucuaggcaggugcugacugugaaggugaugggauagaaaauggaaguacuaaagucagaggccaguccaauggauuugugucauuuuauucccagccaugugaagcuuuaagauguaucuaucacuuggugaccccauggugauguccauucauuacucucuuuccucauuugggacacugaugggucagauucuuuuuuuuuuuuuuuuuuuugagacggaguuucacucugucacccagacuggagugcaauggcacaaucucggcucacugcaaccucugccuccuggguucaagcaauucuccugccucagcuuccugaguagcugggauuacaggcacgugccaccacccccggcuaauuuuuguauuuuuaguagagaugggguuucaccauguuggucaggcuggucuugagcucuugaccucgugaucugcccaccucagccucccaaagugcugggauuacagauuugagccaccgugcccagucagauucucucugucuucuaacugaagcauggaaaacaagccaggucaacaaaauaacuuuauuuauuucuaaacaaaguuacuuuggauaggaaacuuggaaacauuucaaguuuucaucccugguuguaccauuucaccaagcugauuuuaggaaaaggugcacaaagguaucaaaaugugaauuuucuugcugagaacaguacgugaugcuucacagucucuuaauuccaucuguuucccaugauaaaguuccagcauuagguacugguguuagaaggcccuccacauuaugacagugauuuuccugaaggucagaaggggcaaauuuuaacucucccacuuacuagcagugcaauuugagacaaugauguuucuaagucuuaguuuccuauguguaaaauagagguaugaaucccuuacuugcuuaauucacaaacuuauuucaagcauccaaugaaauaauagauggaaaauuucauugaaaaugagaaaaugcugcacaugcauucuuauuacuuuugucaucaucaucaucauuccuauuaucauuuuugaaagauggacgucuuacaaacugaccgguuauguaugcuuuuguauacucaacucccuuggcuaaaaacucaucuaacuagaauauuuucauuggauuuaaccacucagccaggcugaauucaagaaccccaguggguuuuaaaucugcucacuacuggcuaaauaacauguuugaagagaaaauagcaagcaaugaucaacaucuuauucagaggcauaauagcacugcugaaacuccccuuucucauccccuguuauuauuaaugugcugcuauuacuuauuguacauugugucccagaguguguguguugcccuuacauuguauauauacauaagucccacccuccaaaaccagccguuauaaaggagagaaaaucacaacugaugccaugugguaaaggacuagcgucucgagcucacucacugugaucaggccuuuauuccaccugucacauaaugaaauauuucuuccuucuugauucagaaugaaccagcagcucgauucuguaagguccucugcuggguauuuuccuguacaucaucccauuuucaggcugacagagcaauagguggccuugugucugcuuuuuuuuuuuucuuuuuuugugacaguuucauucuuguugccuaggcuggagugcaguggugcgaucucgacucaccgcaaccuccgccaccuggguucaagcgauucuccugccucagccucccaaguaacugggauuacaggcaugcaccaccaugccuggcuaauuuuguauuuguaguagagaugggauuucuccguguuggucaggguggucucaaacucccgagcucaggugaucugccccccuuggccucccaaaguguuggaauuacaggcgugagccacugcgcccggccgccuugugucugcuuuacagaugcaaaaccugaaauucagagaagggaauugccacacuccagcuuguauugaagacagugcucgugccaucauuccauguugcuuccagaucaaggacgcuuaaauauucccaggggauuaaaaaauauguauacuauguaggaacucagcaauucugugcaaacagaaaauaaaguuacagagcugugcuauuaaguugggucuugaucuuccgcaguuagaauuaauugauuggcucacuucccaauuguuguguaccucaggcuugauugcaccuaagaaucacuugguacuguugguaacacaaaacaacaccaccaaaacaaugcuaggggccacucuggaugacacuuuagcauggcuuguguuccaaacccaaacaagcagcaaugccaggcccuaccacuagaugucauaguuuaguuuuucugggguaggcccaguagugcgcccauguaauuccaaaguguggccagcccugggcuggggcugcagcaggucuuuaucaguguccugaaggaggacauccaggcuccacuuggcuccugcucaggacccuccguaauguacaaaugcuaaccguuaguuuuagaaggcugagacuuucccuggcacacuguauuaguccguuuucauggugcugauaaagauauacccaagacuggacaauuuacaaaagaaagagauuuaacuggacuuaaaauuccgcguggcuggggaugccucacaaucaugguggaaggcaaggaggagcaagucccaucuuacauggauggcagcaggcaaagagagagcuugugcaggggaacuccucuuuuuaaaaccaucagaucucaugagacuuacucacugucacaagaacagcacgggaaagacuugcccccaugauucaauuaccucccaccaggucccucccacaacaccugggaauucaagaugagauuuggguggggacacagccaaaccauaucacacacucuaaaguacagaaguuaaaaauccauuguaacaaucuuccugggucuggacauauguuuccaagcuucccuuccugcuuuguauuuugguguuaacagcuuucucaguagagcguuacuggccacuugcaguccuuuagagauuggagaaacauuuguucugagaagguguaugacucuauuauaacugcauuggaauguuuguuucugcuaacaguaugagcucaaucuaguagucaccuuugucuuuccugauuuuacuucccauuucugaguacaauuaauuuugcuauguucuaagaauguugguaagaauuuauauacagauuucacuguguaauaaucaugugaguaucauauuugaauccauuuccaaaaacgauuaagguuuuuggaaagaggcaaaucugauuuuuaaucccagcuccuauaauucauuauaauugggugauuuccuugaugucuacaucacacacaguaauaaagguuauugggugaauuaaaagauacuuguaaauugcuuuaguauacugucuguuacauaguaagcauucaacaaaugcgauuguuauuauaaacauaauaauauuuucucccauuuaauggugaucuucuaagaaagaggaacauuuuucauuuacuccucuuuccuuaguaucuaguacagaauuuggcacacacaaugaguguuuagauaaaugacucacuuucggaauuaggugauuuuuuuaaaggggauuuagagcauuaggaauuccuuugaucaguagccaaauccccaaguggaaguaaaggcacaauggaauuaccuuguaccuuguaccgucuucuauacuacuuuuuaagggugacauuuuucccuucugcauucucauguaugauaaauucuaaaucuagaaagguuagacagccauccucacaaucugguugccuugacaaccaucauauuaaacaguaaaggccuguuguuggcggggggaggugaaugucaauauuaccacggucuaaaucuucugaagcagggcuugaaggucaagguuaaaaguauucaaaauugcaauaagaccuuugguuaauguuuguuagauguauuacaagagcugagugaagccaucaucuuuucagggugaccagugaagagauucauuuuggcugucagccagaagacauuuggacugccauugacaagguuuuccuuuuacuacaccaagagacuuuugccuucuauguguggugaaagaaaacaguuuuuaaaccaaucagaaauuaauaaagggacaacucuggaucauccuccucaacugucuuugccugcuuguaaguugcuguccguguguuuaaacucaccugcaagguguaucuccgcagcuaguaacagagauugucacaggcaagggugucaccuacaaagugcuaaagagcccucugaaaaugaaaagcaaagugccucauuaauguagagcaguguggggcuucuuuaauugcagccuauguggcugcccuuuuuagauggcuccaugggaaggcggagguaagaguggaagaagguaugguugugagagcgagagaaauugcuccccaaauauccagaugaacuugacaacagagaaguguguuuucugauucagcugccuucugauuaaauucagaaaggcaagaaagaacuguuggauucagcagaggcuaagaucggggagcagguuuuugagauguguaugcgugugcuuuugcauacuucucuguuuuguggcuauuuuaguguuguaagauccuggagggugguguuucuuaaccucuuuuuaaauauuaucacuccccucuccuaugugccuuuuuauacuuuuuauuucccugauuaaaccucuaacaugagauuuuaauaccaaaccauuggaauaucuuauuuuuuuuugauccccacaagaaccaacuuuugugucuguuaagaaugcaugcaguagaguaaauuuaugguaacagaaacaaaaucuuuuuuuccacuugcguuuaauagcagagugauuaucucucuucuuagcacuuugaacaggaaugaaauauaacuaaauacaccacgcauacauagucaccuaucuauaucuguggguucuguauucuuggguucaacccaccaagacuugacaguauucaggggaaaagaauagauggguuacaccugaacugaacauuuauggauauuuauuuucuuuucaguaugcucuaaacaauacuguauaacagccauuuacauaguauuuacauugcauuagguauuaauaagcacucuagggaugauuuaaaguauaugggaggauauaccuauguuauaugcaaauacuacacuuauuuacaucaggggacuugugcaccugaggauuuugguauccuugagggugcuggaaccaauccuccacagauagagaggguauguauacacacacauguuuauccaugugcuuucgcggugauaucuguauauaugagcauauucacauacauaggaagacuacagauagacagguuauggcauacccugauaaagcaccgugucaucuaacuuaaaacuagaacaauagcaccaaagccaccuggauaucuucaccaucccaugccccaccucccucacucccaccuccugucaggguaaaccaccacccugacagcugugaccauccuuucugaaauuauuuguuaugucuccccaaacugcacuguuauuuccucaaagcaaucaucuggcacagagcuuuacacuuagaagucgcugaaguguugaaugaaugaaugaacgaagcaggugcaucaguauauccccaucagaagcaaugguucucaauaaguguuuucuguguaaaugcauuguuucacuuuuucaaaacuauucauugagugccuucuaugugucagacacugugcuaagucuacauacauaaauacauacugugcacgguaauaagaauugcagcuucuaaaauuauuaagaucaggcuacgcagcagcuaaugcaauuuucuccucagugcauugaaaaaucuauuagugaagaaggcagcuauauuucaggaaauuaagccacuguaacaguccaguucacaaaucagaauucccagugcuuugaaaugcuccauuucauaacauaaaguacugaaggauguucaggcagucuguaaaugcuccagugaccaauccccucaagcuucgcaaagcuaaauagaggaugcuucuugcugggcgaugagagaggaagggguuuugugccaccgauaggaggagggacgugucuguagauccacgaucacauuccccuugguucacuucuccuuugucaucauucuggaauuauuuauguuugcagaagaugguugcuuaguagacuucugaauaaugagcauuuuuaggugcaagccagcuaaucuuauuuugggcuaggguuguaugucugaauaaauguucauugaugcuuacgggagauugcugucaccugcaaagaccagcuuccaggcucucucaacauuuccuucuaaguugcuaauauaagaaggcaugaaauauguaauucaguucuccuguugaugcugguuacuaagaauuuugcuguagcugaccuagagcugcuuguauuuaaacaggacuucuaaauuuaaaaagaaguacagccaagaagccuuccuggccucacugucauaaacugccuaugagguauagagauagcuaaagaacuccugaucuuacaucaacacuuccuuuuauuaauauuugagaaaggucuucucuccccauaaauccaacaaaguauuaguuucagguggggcacuuaagcuuggggcuaucuuaugacuuguuucugaacaauaaguugguuguugauccaguguaaaugauucagccaagaagaccuugagaaauagcauuuucugucuccuaacuugguguuucuuagaggguaaucuauggagacuugcuuuugaaucacccggggugcugguuuuaaaauacggauuucuaggcccuaccacaaaucuaaugaauuguaaccucucaauaggauccugggaaucuagauuuucaccaggcuuccuccaagguucugaugccucucagcugccuucuguuaaucuuuccuccauaaaucauuagaguauauuccaaaaauauagaugagaucacaucucuuagcucaugaaaccccuuuuguuuuucccacugucucugggauauuauccagugcucuuuuguauggcauaugguccuggucuucuccaacauuugauccuguccuaccuuuccauauccaucucuaucauuuucaacucuaagcuuuuucauuaaguguaucagacuauaguuauuuuacacacacacacacacacacacacacacacacacacacacacacacacacaauuguuuauaucucugugccuucguuguccuaucaugcuuuucucccaauauuugagaaucucaauuuucaacccauuuuucaagaccaaauuuaagguuuauuuccuccagacaucucuaucugauuguugucccuccuuucuuaucacuccccuuuaauuguccuucuacuggaccacugcuauacguaucucaaacaaccaagggcugaaaacacuugaaaaaaaaauagaugguugcaucuauauugaacauguacagaguuuuuucuugucauucccaaaacaauacaguauaacaacuguuuacauaauuuuuacauuuuauuagguguuauaaguaaucuagagaugauuuaaaguauacaggaggaugugcauagguuauaugcaauagggcaccauuuuauaucagagacuugagcaucuuuggauuuugaucuccaaaaggggucauguaacuaauaacccacagacuccaaggauggcuguacuuggaauuuaucacaguccaguucauaacauucuauaauuacagaugugguagccaguuuccaagauggcacccaguaauucccaccuccuagcauucauucacucccaugucuagucccuucccacauugcauaaacuuaccuauauaaccaauaagauguugcaggaaugaugccauguuacuucugaggccaaguuuucaagauaaccuugccuccaccuugcugucuuugggaccacucacuuugggggaagccagcauguuguaaagacucucaagcagacuucuggaguggcaaaaacgugagccuucuuauugauagcuggcaucaacugccgggcauguaugugggagccagcauagaauuagaucuuacaucccagagcaaguauucagaugacugcaaccucaugaggaauccuaagaaccacccagcgaauauacucugagauuccugacacacagaaaccauuugaguuaauaaauaacuggugcuguuuuaagcugcugcauuuugagguaacuugugcagucauggauacugaauauccacuagaccauggacuccuugagaacgucagccauguuuccuucaucauggacccuggucccucgcccuccucaguaccugccccauauuaagguguuccauaaaugucucauuaaaugaucucaacugagcuaaacuggaguuucucugugcugccaagggugaauacucacaaaugcagaugacuuuuuuuguuuuguuuugagcagagucucgcuuuguugcccaggcuggagugcaguggcucgaucucggcucacugcaacccccaccuccuggguucaagugguucuacugccucagccucccgaguagcugggauuacaugcgcacaccaccacgcccggcuaauuuuuguauuuuuaguggagaugguuuuucaccauguuggccaggcuggucuugaacuccugaccucaggugguccauccgccucggccuaccaaagugcugggauuacaggcgugcaacagcaggugccuuuaauagaugugaauauugucuuuugcucuuaguaucaucagucauaauauuaacaguuaacaauauccauugcuuagauauagcaccagaauuuucacaaucccauggaguaugugcuguaaguagccccaauuuacugaugaaaacugagguacauagagguuuaacugcuugcccagaaugacucagauagugaaugauggagccaguauucaaacccagucagucagucuccagacuauguguuguuaaccauuuuauuuuauuuuuauguauuuaauuuuuuuugagacaaagucucacucugucgcccaggcuggaguguaguggcacgaucuuggcucacugcaaccuccaccucccgggcucaagggauucuccugacucagucucccaaguagcugggauuacaggcaugcgccaccaugccuggcuaauuuuugcauuuuuaguagagaugggguuguaccauguuggcuggucuugaacuccugaccucaagugauccgcccaccuuggccucccaaagugcugggauuaauggcaugugucauuuuaaacacucauaucgagcccugauguggcaagcauugugcuaggcacuuugacucuccuaccucauuuaaugcuuuuucaaaccucaugcaauguguauuguuuucucuauuuuauggguggggagcuugagacuuagagaggugacuuugccaggcugguugugguagagucaggauucagaauugggccagccagacuccaaagcucgugcucauuucacgaucuucuuccaaggcaucugccagugucucugucccagcaucucaagccccgccccacuucuguuucuuaacaauuauacucugaacauauagguugguugccaagacaaccacucagaaacaacaugaaaggcaaaugacuuuucaaacauucugcagcugggaugacuucuuuuuuuaauuuuuuaaaauaugucaaggugauuuguaauccacagcaaaauguuaauauggguaagcaaucuauuuugagcaaaaaauauuuccaguauggcagaggagagcuuacagauuacauauauaguaacgccuuaggaaggaagcaggauauacuacuauuacccuuuuuacaggugagaaaauuaaggccuggagagauuuggaagccaggaaugcccagcucuaaagacauuguaccuaauuguuugaaaaacugcuuggagaaugaaaaugugucuggagggaggcagaggcucaguccugacccugcaguaaaucagaagagugaagagcacauugaauaagccagguccagugggaagggagggaaagagagaaacacaucaguucagaguagaguaucuaggacugggggacugaaaguugagguaaggaaaaggaccaccaaacuuuggguacuaaauaauagacaacccuuaaucuugguaggaggaguuucaauaggucagcccauauaaaggucuugccacaaugccugacacccagcacgugcuaggcauauuuucuauuauuaucuuuacugggguaucucaaugacuccuggaaauccacaucuuggagaaggagugagcaucauuuccugacaaaaccagucucuuuuccuguuuuucccuuauuuaucaaaggucagaaaugugucaucaccauugagacauggcuuuccuccauccccuguguuuugggcagucaccuguagaggugagguguguccacuguccagcucucugccuccaugcucauacugcuaaucuggucaacuucucuguggaccaccuggcaucagauauacccuagaaucacuuacaccgccucauagaugcuccccuuugggucugccugguaauuggcagcuucuucaagaaggcagauuucccuuugagagcauccccaaccccccaguuuacauaaaacccuuaaaaccugggguugccugugcucccuuuacauaagugaauuaggugauaaucuugggcaugacugcauuuuugcugauugaaguuuagaccaugcugcuuagaauuauuaacagccauugcaaggauaaugaucugcccauuaaaauaaacuaacucucauuuuuauuaucauuuuaauuacacgaacccuuuggcguguugauagugaugaacaacauggugggauauuacucugccagguguugacuucucuauggggugcucucgggaaaauuugccuggugcccuccagguuuccucagccugccuucgagggugcucuucucuccauugaccccaugauguaagaaguuccugguuggacugaaguguguugcggcauggaaaugagauuaauaccaguguggauugcauggagagacugccccaaaagguugcauggcuaaucacucccacgcacuuuuccuccuccucaaacccaaagugugcuguccaguuuuggagaucuaccagagggagggacuuugcauuuuccagauuucagcuugugauuuuuuuuuuuuuuuuuuuuuuuugaaauggagucucgcuccauugccaggcuggagugcaguggugcuaccuuggcucacugcaaccucucccuccuggguucaagcgauucuccugccucagccucccgaguagcugggacugcaggagcacgucaccaugcccaacuaauuuuuguauuuuuaguagagacaggguuucaccauguuggccaggguggucucgauaucuugaccucaugauccgccugccucauuuuuuacagaaacauaggacaaggugacaagugacuuauuuccccugacaaaaccaucugcauuccugacuuccccuuuacuuucaaagguaccagaauuugcugcuuuuaucaugccccaaauucugagucaucugaacuucgguauugcugacaggcauucacugagaggagaagugggcuuagaggagaccuguugcuugccccgcaugaggcuggaugcugugccuucuccugugaauacuauaacauuguaggcccccauuuuccagaugagaaaacuaagacucaaggagguuaagugaguuaccugaggucacacagcucauuaaaaguagaaccaguucuauagcccaggcuucagggcucaacaaacuaugccucuucuguuguucuguccugacccuggauuuuagcaaucaugaacacuucugcuccuaggugaggaaaauaucagagaaaaaugaacucaggccuggcugacuccguagucaugcacauucaucaaacaguuuuugaauaauuacuguguuguuaccacagucaaaaagacaucgucccugccucaaggaguuucagucaagugcaggagaggggcauggaaaauugaacccagcaggauaacaugcugugcuggaggaagggaaacagcuugcuucuugcuuugggagccccuaauccagccuggggcuguggggguggggguggcuggaaggcagugauuucuaaguugagacuugaaagagggggagaauguggauggaggugggggaagagugcuagauaucaugccgucucuaagagggugagcuauuuguaauaaauguaccugcuucuuaccacuuguucuuuccccaccaccaaauuucuuaauuuuccaccuuuuccuggggcuuucuuucugaauacaaacucaucccauugccuccuuuacaacuaauugaacacuuggacuuaauugauuauguauuaaguuggggacuuggagugacauucaggacugggcucauguugagauuaauuuauuccuguagucuuccuguuuugcaguguaacugagugccucacauguguguuaaaaauaaaacggagagucagggcaaucuaauuagacagcuuaacccaucacucucguguucagucuucacccagcucuccugcuuugaugguaaccaaaauagaugaauaaguuaaucaaaggucugauuaaauagcacagcucugcagcauggacuaaugauugccaagccucaguucaggcagauugcuagaggagagaggaagcugagcugagcuccaaaggccagggcuuucaugaggaagauguuuauaaagcacaugggagggaauuccucacugaguccucggaucuuaacggugauggcucacucuaaaggaaggauaauguaguuuggggaaagaacacaaaccuucuccuggcaaauucugacucuuagagcuuugcaucuugcuggcugugggauuguagacaaaucgcccgccuuccuaugccugccugccauccaucauccauccauccauccauccauccaugcauucauccauccauccauccaucuguuccagauauguguuuuguaccuauuauauacaaggcauugugcuuauuuuuuuuuuuuuuuuuuugagacugaguuucgcuuuuguugcccaggcuggagugcaauggugcgaucucugcucaccgcaacuuccgcuuccuagguucaagugauucuccugccucagccucccgaguagcugggauuacagacaugcaccaccacacccggcuaauuuuguauuuuuaguagagauggcauuucucccuguuguucaggcuggucucgaacucccaaccucaggggauccgcccaccucagccuccuaaaguucugggauuacaggcgugagccacugcgcccagccagggcauugugcuuugauuuuguuguuguucauuuaauuugcccuuguguuaacuguaugacucgguugugugagguuuuuccuucuagguccucucuugccguaacccucacuuuaugcuccaugaggcugaugcauaaagcaucucuagucucgcuuucgcucugguuuccguuaggguugacuggagggcugcccucccgggagacuggugggcaggagggaagugagguugagauguuuuuuccuguucuggcuuaugcguugccacagguaggcugugucccucugcugaaggucacugccucagccagguggccuuacucaaacagcaauucucucuggauuccagcaucugcuggccugggcccuuuuggccuuggggugguaauggccccaaguacucuuccccuccucaaguaacugcacgguucuuguuacugccccuaauucugcauauacuuagauuaaauaguccuuuuauuaaaucuuccuuagauuccccaggagagugugcuguuuccacccacacacugccugauaggaugaaguaaguguagcaacauggauggagcuggaggccauuauccuaagugaacuaacucagaagcagaaaaucaaauaucacauguucucacuuacagauggaagcuaaacaacgggcauaccuggauacaaagcuggaaauaauagacacuggggucuccaaaagaggggagggugagagcugugugaggggugagaaauugccugcuggauacaguguucaacauucaggugacagguauacuggaaguccagucuccaccauuacacaguguacccauguaacaaaaaugcguguguacccccagaaucuaaaauuaaaaauuuuuuaaaaaagaaaucaugaccuuuauaaauagcagaaacucagaaaagcugagcaaaccuguccaaggugacauggcgauuaagugaugauacuagaaucuaaauccaggcaugccugaaucuaccacccaggguguuuugcucuccugcauacaucccacagacccuuaccuucaucuggaagcaccaaaagaggcacugauagcuaaauacauggaauaagauagagggaucaggaagaagggcgggagcuuauuacugaguauauuuuguguaccacgcccuugaguccuuuaauauaauuuaauuuuuauaccacugugugaaguaggcaucgucuccauuuuaccaacuuuuaaaaaugagcaacuacucuuaaaaaaaaacuaaguaaccacauuuuuuucuaacaucauagucuagugaugguggcacacaggaggccaauuuagggcagcuaugagacagguuccccaugcugacucaugagacccauuccaucucugaaacacacuccauuuuacagguaaagaaaccaaggcuuagagagaucaaaugcuuuguguggggcuagagcccagauuugaacuucuguccuuuuuccccaccuccaugaugccuggguguagggugacagggacucauacacagaguuggggaugcuuuuuuugaaauugaugagaggugaagccagcuggacuuccugggucaaauggggacuuggagaacuuuuaugucuagcgaaaggauuguaaaugcaucaguuagcacucuguaaaaauguaccaucagugcucugugucuagcuaaaggauuguaaacacacaccaaucagcacuuuauaaaauggaccaaucagcacucuguaaaaugaccaaucagugcucuguaaaauggaccaaucagcaggaugugggcagggagaaauaagggaauaaaagcuggccaccccagccagcagcggcaucccucucggcuucccuuccaagcuguggaagcuuuguucuuucgcucuucacaguaaaucuugcugcugcucacucuuugggucugcgccaccuuuaagagcugugauacucaccacaaagguccacagcuucacucuugaagucagcgagaccaagaaccccccggaaggagccagcuccgcacacaguuugaugucuugcugcuauuuuuuucuuccuuugcauagauuugggugaauguguuucauuugguuugauuacacguaguuguuuuuaaguaaaagcaguuuuaaagcuugcuuuuuuccccuuuaacaucauaugcagguuuuuagaaauuauaucuugauccacauuguuuuaaacaauuacauaguaugcuaucagaaaaacaagaguaucauguuugaauuaauuguuccauuuuggggcauuuugauggcuguucuuugguaacauggugaugaacaucuuugggaauaaaacuuuggugucuaaaacaaaauuuuuaaauuugaauuuuuuuaagaacaucuccucaacaugguauuuguaaggucaaaggagaucaauauuuuuuggaauccugagaagguggccauguucccuguuuuaaaggguucuauuaaaaguguuacccucuugaaaauaagugugcuuuggcucccauggaaacuccccauggcagcuagguuggggccucugcccacagugaucuucauaaaugacugugcauagaugagagcuuucaucacacuggugcuuuuauuuuuauccuugccuuuggacacaaaauggcacccguguguguaccucgcugaugacucugcccaccugcaagccauugauuguuccauuauguuaugugaggaucauaaugucagugcuccaugggugguucauuucuguccuauguguguguccucuauugcugucaggugaagagugucgcgugaugacuagguccuccuugacuaggaggugaagagugucacgugaugacuagguccuccuucuguccuauguguguguccucuauugcugucaggugaagagugucgcgugaugacuagguccucuuauuuaucugagaauaaagagaaggcagcaguaguaaucuauucaauuacaguuuuaaaagaauaagcauaagcuuuaacaauacuacugcccacuaaucuuuaaugacacguaaauggaauaugauuuaaagaaauauacguacauaggaacaauuugauacugguugcaaaaguauuuguagugggauucaauuuuuggaccuuuauguuuuugcauauccuuuuuuucucuaguggaucuauuuaauuucuauaauaacaaaaguuuuauuuaaaaaucucaacauaggauuugcaguaauaauuauuucauaacuauuacuuuuccucucccuuaauucagauacauuuuccuccagaaaacuucacaugucaaaaugcaaauuauauaaaucuuuaaaagaaaacucauucauuuauucaacaaauuuuuauuggauacuuuuugugugcuaggcacuauuuauaauguuuaagcaaagaauuaauauagcaauuuuuuuucccuuucuccaacucucucucugccuuguucugucuagucugaaguuuccuggauccccaauaaacauuacucugggauuuauggucugaugaagcuuguccugaccaagacucuuccugccaaccuggagagagucaucguccuugacacggauaucaccuuugccacugacauugcagagcugugggcuguguuccacaaguucaaagguaaugguagcccauucguuuuuuccccgauauccuuguagguaucagcaugccaagaauagggguugacuuuuuuaaaaaggugaggucuccucgaaugaggucgugcuaaugcagugggugaggaauuacaaauaugguucaauaucaacucugcuuggauuugaaaaauaauagaguaaaacagaaacuuguuuacaugucuuuaguaaaugaagauguuuuuaacagauaaauaucaaauguguguauuuuguaugcagauagcggaguguucacauacuggucgggacguguguucauugguuuucuuuuuaucgaaggauagucuaauugccaagaaagccugugagguaguagagaugaguauugauucuagaguuuuugaaaauguucauauggcuuuugcuuucauuaacguugugguuuaucauuuuaaggagauguauguauuuggcuuucuuuacaagacguucuuucuagucugguggguuucuuuauagcuauuauuguaacucucgucacggccucaagguauaugagaguaccuagggggaaauugugagcucaguagguguacuaacuguggcauggauaugugagagaaguggcagguuagcacaaaucuuaggcuguuauuuuaauaccccucucccagaugucuuuuuaaaaauuauauuauuuuaaaaauucuucuauacuggaugaguacaaugagaaagaaauucgacagugaaauuuuuaguuuuauauauuuuuuuaauugcacgcuagccccuucuguguuuaaaaucccuucugccauuccucuuagcuccauauccuaugaaagcaaaauacuacuuaaugauuuuaaaucccagcauuuucauaaaucacaggauauuccuguugguuucuguuucuauucaugaacagagaguaaauuuccuugcuugcccuggucacucccugcuuccuucucagggcuucugagcucugggcuaauugaggaaagucuucaccaaaucaugggaaugacauuuugauccccgggacucuuucccuuaucaggaucaaaauuuacuuuucuuauucgugucaauaaugacacuaacaaugacaucauuuaggacagcuguugaaauugaguauggcacagcucucuaaucuucauagaacguguggacguguccuuuuguuucauaaagaaagaaacggaagcuuagagggaugcaggcuuuucccagaguugagaucagagugcccgugucuuggcuuccauccgcugcucuuuucaaguuccccuaucgugucuguuuguuuuucucuuccugaucacagugaacucacgaggggcaguuuuucuauaauuacaugguguuuuauucauuuucuuaugcugauguugaguguucagugaugcauuucuucaacuggcguuuaucgaaucccuacugggugugaagcagugugacgggcucugcaaaugaggagaugaguaaugaggggacagugagaguugucaccucuccuagaggggguuagagaagguagcugggaaggugucacggaggagcuccuaauugugcucugucucaucagaugagaaugguggucguauguacuagacucccacauuuuccuuugggaauaaaggccuuauuacgccagcuggugggagcagucccugcagcgggggcucucagaaaaggcaucagcccuuuuugcaguugccucuguugaagugaguggccaugccuguggccacaccccuucgugggacaccccacaucacggaauggcugaugaacaugagguccugcaggaucaucugccacacucggauacugccucacaggcugauuuuccccucugccuaguccugcuuucuccccuucccuuucauaggugcuguucucaagagcucucucuaauaaaccucuuguaugcugacauccaucucggggucuuuuuccaaagaaacucaacccacagcauauauuuagagcuguaagucuccguuggauaaguauaaccaccauagucaccagaacaggucaucagagauuguagagcuguagcuaggaaaucacguuuauucucuugcagcuugcaauggcuauagugcuaguggcgcucuguagccaauaacaacgugaauugucaugguuauuuuaaauacgcugauaucauccguggaagggaaggcaccagagcucuugcugcucccauagcuggcccaaggacuugauuuggaggacucucagauucaaggcagcuccugggguugaguaggguauaugggccaaggucaggacagggacaagguaaauuugaaugcaaggagcugaguuaaugggcugcauuuuauuuguucauucuuuuguugguuuauuucuagcauuuguuaggcccccacugugaagaggaauagauuagaugcuguuguucccuaaagcuguugagaacacagcaccugccuucaaggaacucagaaacaaggcagagugcauugcguuuuuaucuaucaccagcaaaggaguacaaaacaucagaaguuuucccaugcccacccuaauuuuucuggaaaaauacagaggugaaaagaaaauaaguaaagcucaucucuucuccauaugucccuauuuuguaucacuuuuguaugugugugauuguuuuucuaaaccaaacuauuagaagccaggucauggaauaggaagaaagccuguuaagucaggcgcauaaauguagaauguucugauccaagagagaguguccuucauaaaggcaauugucguugacauccuucacuguaaacgguuggagugauguugauacaauguggccuggcuaauuuuucacuuuuugagaacagcugguugucuggggcugcaguggcucuuggucagauugcgcuugauuccuuuguggcgcugugaaagccccuuguuccuaaauucauuaccgggagaauuacaaagaagccuuuuucaggaguuagacccauccucagccucuaccagaagaagccucuuagagauguccccaucuucccugagcucgacuucagcuaaguagcagauaccucccuccuaugucagcgguuugcaccuuuacccagccugcaccaacagcuggaagauuuucagaaccaccaauucuuagcagaaagaaucagacauaccauuauuggccagggucaggagccacccauucggucaauauuuacugagcuccuucuaggugccaaauagcuuacuguugggacuguugcaagaauaagacuguuuggugagcccguagcuacaccggggugcuaguaccagaguggcuagcagcccuguccuaacagaacauucaggggagcuggacauggguaugguaugcuucucacgagauacuucugguauaccuggcaggggucccucacaugggaaacuuauuuucauaggcagauguccuugcagcucuugucugaccuguguucaguuuacaccugucugacuaccaacuacucugccacugggagccugaccuuguccucucccuggcguaccagagaaaaccagccuggggcagccccugguucuucaauggaaggcgcaaauucaacacaccauuacaaugguggagcuggugaggaggcagguggcuaaaugaguguuuguaaaacagagggaaagcuaacuaccauuucuuaagcacgucuuagguucuaggcacugagcuagaagcuuugcacacuugaaaguuaaauaaacugauggcucacgccuguaaucccagcacuuugggaggccgagcccggcagaucacgaggucaggagaucgaaaccauccuggcuaacacggugaaaccccauuucuacuaaaaauacaaaaaauuagcugggcgugguggcggacgccuguagucccagcuacucgggaggcugaggcaggagaauggcgugaaccugggaggcagagcuugcaguaagccgagauggcgccacugcacuccagccugggugacagagcaagacucugucucaaaaaaaaaaaaaaaguuaaauaaacugggcucaagagagauuaaauuacuuuucaugcucagagagcuauuacauagugaaacugaaccccaauccauacggcuuuggagucugugcucuguccacugacccaggaggcuguacugcacuuagaacgggugugacugcugaguacgugucaccuuggaccccugcaugccuuaguuuuuacugcacaaaacacuggaaauaauaugugauuguugucauuuggggaggcuguugugaaggcauaaauaauaaauacacacccauaaucugaagcuuuuggaagaaggccgugcugaauauucaagauagugauuugauccauaagcacagaugccuccccucuaagaggaucuuagugccacagaguaaaauucucacccuacagcagguauggucaaacuauccagcguacaugggcacugccuuccucacccucacggcaccgcagaugugccaugccacuggguaucauucagggccuaauagacucuguguuguuccuuacaacuaacauguuuaagcacuuagucugugccagccacucuguuaaggacuuuauggauaaacucauuuaauccucacaacccucccaugaagugauuacuguugauguuccuauuuuagagauuugggagcugaugcuuagggaggcauaguuuaccuggagucucacauuucuuaagucaugaaaccgagauuugaacccaaacagucuaacuuugaauccaguccucuuuacucugcacccuccuuucccuugaagaggaguaagagaaaucauugucauguggguggaguuaagagugucuuuggagagaccgaaguuagauucgugaaagaacucaaagugaccauauacaccagguuguagagggcgggcccaaggcgaucuaggcauucagagaacaaaggcagggaagcaaaauuagcauagaaaaguguaguuuucacaggauucgagaaauaaaaucucagucuccagaauucuggcccagcaugugaccuccgagaacaucaucuuuaaguagcuguaguugggguccaagagcucuacccagagacucagcauguccagagaauaaggcaggaucacccugaugacucugucagcgugggcagaugcuguggccugaagguuuguguccucgcaaaguuccuauguugaaaccuaacccccagugcaauggcguuaagaguagagccuuuaggaggugauuaccucaugacagcuguaugaaugggguuaguaccuuuaugaaagaggcuugacagaccuuguucaucccuuauaugugaggacacaguuaaagggauaccaucagcagggugugguggcucacguuuguaaucccagcacuuugggaggccgagggggguggaucaccugaggucaggaguuugagaccagccuggccaacauggcgaaaccccgucucuacuaaaaauacaaaaacuagcugggcgugguggugugugccuguaaucccagcuacucaggaggcugaggcaauagaaucacuugaaaccgggaggcagagguugcaguaugccaagaucacaccauugcacuccagccugggcaacaagagcaagacugcgucucaaaaaaaagguguaccaucaaugaagcagagaguucucaccaugcaucugaucugccggagccuugaucuuggacugcccagccucuagaacugcaagcaauaaauuucuguugcuuauaaauuacccggugucagauauuuuguuauagcagcucaaacugaauaagacagcagguuaucuuaguugauuuaggcucagagaaggaauaaugcuaacggggucuuugugagaauuguacaagauaaugugcauuauuuuuccacauuccauuuucucuaaggacuccugccagagugaaugggaugauggcagacaucguuaaugugugucugcuccauuuccucacaguucuguccacagagccauuggggcuguacaauaauguagaaaagcugaacaugaagaacauugaaguauuacuuuugaaaagacauuuguagaaauuuuaugcuuauaaucaguugccucgaaggaguuuuuaaugcucuuugaaguuucuucaggucuugucuuucuuuguuaccuugccgcccugccugucuccucugauggaauugguggagucagaagagcuuagcaaaaaagagaccaagcuucaagucccugcuggucuacuuuaucagcagggugaucuaagggaggucauugaaccacucuugaccucgcuucugcaccuguagaaagaagauacugauaucugcucacagugguugugugaaauuugaggaggugauucagugauccugguaccugacggacacuuggaccuugcguguuucuuuccccuuuccuuccuccucucuccugugguuaaguuugguguugucccauuggccccuuuuuauuugacuuuaaaucuccuuuccugccuucccuuaucuccaaaugaagcucagugucccccgcccuguuagcccauaggaaaggaaucaaagaagaccuuucaagacaaucccaugaccuuaugccagucagauuuuccugauuaaaggcuucccuucuuggcuggcccagugugcccccuucuagggcucaacauggacagauuuccacgcaucucacauucacuccugacaguuccuaaacuugagagacuguuuugccccggggaagaaaaacauaaauuuuaaaagaugaaauucucaaagugcuuuaaaaugacaccaacagcuggugucuguagaggugaugugcuucuaguacagaaggcgcuggaauucagcugggaaagggcgaggcuuggccuguucuuggucagcaaucauacaguuuuguuaaaaguccugggcauuucuuuuuaaucuguacggggccuuuagaaguucuccugggccgggcuuaguggcucgugcccauaaucccagcacuucaggaggcuaaggcggguggaucaccugaggucaggaguugaagaccagccuggcaaacauggcgaaaccccaucucuacuaaaaauauaaaaaauuagccaggcaugguggcagucaccuguaauuccagcuacuugggaggcugaggcaggagaauugcuugaacccuggaggcagagguugcagugagccaagauugcaccacugcacuccagccugggcgacagagcgagacugucucaaaaaauaaauaaauaaaaaguucuccugcacucccaguauugauaaaguucccuccucacuaccaguuuucaugguuuuguuuaggucuuuaacguccucuagcuccuaguugauuuuccacuuggaaaauuuugaugaccucuuccauuauuuccuccuuguacccuccugcuuucucugccucucuuaaccagccugccuucuacucagaaucagaaacuagcgcuuugauuuucuugauagacacuacugguucuuccauugguccagccaagauguacaccauugaagcaacaccaaggauuuuuuucccuggcagaauugggugaagagguuuuaauuauuuucagauuaacuuugaagcaaaucugccuugucuuauauauuagaaagaucauuuaacuucucagagccucguuuuuguuguuguucuauaaaaaugagagaaugauacauuaauaaccgccccauaggguuuauuuuggugauuaagucagguaauggcucuguauugcacaauaccuaauaagugauaguucccuucuuuucuuuguaugucucaggguuguuuguuuguucgugaaacagucucacucugucgccaggcuggagugcaguggcacaaugucagcucacugcaaccucugccucccggguucaagugauuccccugccucagccucccgaguagcugggacuacaggcgugcaccaccacgccuggcugauuuuuuguauuuuacuagagacaggguuucaccauguuggccacgcuggucuugaucuccugaccucauaaucugcccaccucugccucccaaagugcugggauuacaggcgugagccacugcagccagccucuuuuuuuuuuuucuuguucuucagccugaaauuucagagaguucacagaccagaaaccaacccuaaccucucccuaccuuccugaguuccuuucucccuccuucccuccuucccugccucccuaccugccugccuuccugccugccugccugccugccucccucccucccucccucccucccuccuucccucccucccucccucccuuccuuccuucuuuccuugccuuuugcacccauucagucauucauucuuucauuaauuuacuaccuucugaggcucuuggccugcccuaggcccuggggguaaaauauuaacugagacagaccuagcucuacccuccuguugcuaauaucuauuaaauguguuuuaugugucaugcccugaaccaucucauuuagccuucauaaaacucuuuaagucuguugccugaaaucacuaacuacaaguuaguggcaaaaccugggcugaagccaggcuggucucagagccgacacuuaaccgcuagauucuagauacaucugaacacaugguuacaugcaaguguagaaagucucuugaaagggaaaagucagggugaggucgaaucacauuuuagggaaagcauugcuagugagggaaguuggagggagucaggagggcuucuaaagggagagagguggaugcauuggccucuggucucacuuagagggagcagcauaugugaagcccugagauccagagagagauuagagagagugauacagacagaaacugaaauaaacauuaaaucuacacuuuuuuuuuuuuuuuugagauggagucucucucucuccacccacucuagagugcaguggcgugaucuccacucacugcaaccuccaccucccgggcucaggcaguucuccugucucagccuccagaguagcugggauuacaggaaugugccaccacacccggcuaauuuuuuguaguuuuaguagagaugggguuucaccauguuggccaggcuggucucaaaauccugaccucaguggauccuccugucucggccacccaaagugcuaggauuacaagcaugagccaccacgccuggcccuucaaucuacuuuucaaacagaccagacaggcuccuaccuuuggcccucugcucugauguuccuguaccuggaaugcugcuccuccagaucauucccugucuugcuaccauaaucccagcccuucgagucuuugcccaaaccugagcuucucagcaaggcuuucccugacugucccauugaauccuaaagccugagacaccaucccauuuuucucuacugcucuuucauauuuuuuuuuucaagaggacucaucaccuucuaaugaauaucuaauuacuuaucaagagggcugcucugccucaccccauagggaggacagacccagguaccaggauacagcuggcuccaucugguuauuguguguucuuucuagggaccucccacggauaccaaaaucugcagaugcucaagucccugauauauaaaaaauugcauuugcacaucaucuguggacauccuccuguaugcuuuaaaucaucucucgauuauuuauaauuccuaauacaauguaaaugcuaaguaaauaguuguuagacuguauuguuuagggaauaguaagaagacaaaaaaaaucuguguauauucaguacagaggcaguuuucuuuccaaauauuuucaguccagguugguugaauccacagaugcagaacccauggguguggugggcuaacucaguguaagcaccaggaaggcagggaucuuugucuguuuuaugccugauaugucccagcacagaacagugccugacacauagaaggugcccgauaacuauuugucaaaugaacaaguaaagcggauguuucuuggugaagugagugguggggaauaagguaagagagguauaaagggucuuauuaaguguuagcuuugggucuucuccaaaggucauugaaagacaguuuagaagauuugaaaagaucccuuuggcugaugugugggggugauauaaaaagugcgacaggaaaacaguacuuucaaaaagaguuggcagcagguaggaggcuucagucucagcaaaagaccacuguggcccguagcgggauguuagccuuggagucagagcaagggaugcagauuagagaugaauggggacguagagugaauagcacuggacggcgaguucgguuuuggacaugcagagaugggguaaacaggucuagaucuuacaagaagggucggggccaggggucucuucagguguuuguuguuguuguuguuuuuaauaaacuugaaauagagcuuucuugguguuaaaauagguauucucaccagauuguuacaguuuccuuuucugaauggccaggugagccccaguguagaauccaguugggcagcucuguagugcgugguccugcagggacagcagaggggauuugaugaaucuaacacagggcucauuggaugggggcaggaugaaaucagcaagcacaaagacugggcacggugugauuggcaagcugugauuugcgagggggagcaacggaacggaugcugagcagaacucaugaggagggaucacuggacucacccugauuguguccugagcuccuccuuguacagcccacacccagugaaugauguucacugcugccuccagcugccgcugcguugaaaagucagccaugcccugggucccuagcucugugcugcuuacugggugggagugaggagccucacggauccaucaccaggauuccauggaccucucuaucaguugugggucuuucuuagacacacagggcucagacucucacggaggugagcuggaggacccuuuuaggcuccucaccaagggggaggaaagacaucucuggagguagaugugagauguuucuuuccccacucccuuucccaacucaaguauuuacucucagucaagggcccuuccuugggguugcuuugcauccucuugccaucuuugcaacgucgggguguugcucaacucuaaaccucuguuuccugugggcaagauggggagaaugauacccaugggguauuggcgugaggguaacgugacaugauacauuucaaagucuuagugcuauaccugacacaguaagcucuugacaguguuagcuucugcuguuauuaauauuagagcuauuuuguuuuguuuuguuuuguuuuugugacagggucuuguugugucacccaggcuggagugcagucgugggaucauagcucauugccaccugaaauuccuggacucaagggauucucccaccucaguuuccagaguaguugggacuguaggcaugugcuaccacgucuggcuauuuuuuuuuuuuaauuuuuauuuuugcagacacagggucucacuuuguuccccaggcuggucucaaauuccugggcucaagcgauccucccgccucagcuucccaaagugcugggauuacaggcgugagccacugugccccgcugagucauuuuauuguaaucacaauaagauggcugucuacauaccucuaaacaguucaggaugggagagguucuuaauaucagaggagacaaugcaaggccuuggaguaaacacauuuccaaaaauaaucucugucaagauggggaaagaagccugagaaaugguuauguaaaagcauaggaguuggggguuugcuccuaauuggaaagagcuggccguguaucucaguggggaaaguacaggcuguagagugggaugauuccaagaccuggguuugaggccccacgcuuccaggcacuucgcaauucagcuucucauucucaaugggaauauuauguuaggagcaaaauauguaauucaccuaguauuuugcagguguuuugucauauuaucucaguucuaugauacaggacuuugcacauuuucccauuuccgaaacugagaugugacuuacaaaagcaacuugacagauggucuuuuucuccuggcaaauguuuugauauaucguacaaucagcagccucuuagaauccagaaaauauguugugauuauuuuuauuagcaauaucucucuagcuuuucuuuuuaucuuugaguuguacaggggagaaggagggcgaguaggacuguagacuaaaggagaaagagcugagucagucaaagagaggauuugggggucuuagcagacucuuccuugaucaacuuuuauuguuugaccacaggguccuggagcaucugcaccauugcuauuuuuuuuucuuuuguaaauaaauaucgugcuugugucucccguguugagauaggugccaucucuugguaagcccucccauguggagacugacugucuguuuccuggaagcaaguguuuguauagguugggggcaaggagagaggggaggucaagggacagaguugugguacaaaaacaucugggauuucuuugagaauaucaggaagaaauauugaaaagcagaacagcauuaaauccagaacuccaggaagccugcucugccaugaugucucuucuugcucagacauuuauaaauauuuauugagcaccuacuuguuaccauaugcacaaguuaugcucuuuaaugcucaguccguuagaaauucauaugacugacuuagccuuccuugaaaagaucugauauuucugggaacauuuuaguauuacccgugauuaaugugaauuuuuuagcuagaucacuuuuuuuuuuuuuuuuuuuuuugagacggagccuugcucugucgcccaggcuggagugcaguggcgcgaucucggcucacugcaugcuccgccucccggguucacaccauucuccugccucagccucccaaguagcugggacuacaggcgcccaucaucacgcccggcuaaauuuuuuuguauuuuuaguagagaugggguugcuagauaacuuuuaacaucagcugcuuugaguucaagagauuuugauugcagacacagcuauuguggaugcguagaggggacagggcuuuccaaggacauucuggacaaagagggugagugaguagguuaggaccuaauaaaggcaauaaacaaaucccuugaggcaagaaacaaauggcuuguugaaugaauuuauggagauaaaguccacaccuuuagaaucaugugcuaagaaaagaagccaguuuccuuuuucuuguuuguucuagauguaucuugucugggaaucccacaugaaagucaggguuacuccuacucuccauaagcaacaggccaaauugaacuaauagccaugugaaggcuaagcagcagccucaugaucauugacagcucugccuuuugaacaguaauucugagccauggagaggaggguagcugaaguacuggaauuaccuguagggucuuuucaaauugcacagguucauguccacucuuaucucugcacaguggccugcucaucaccagugacuggagaaucugccuuaguacgggguuucuccauguuggcacuauugauauuuugggcuguauaugucuuuguguguuuuuaacaguuguacaaauguaugggguacauauacaauuuuauugcauguguagauuuuguaguggugaagucagggcuuuuaggguaucuauuauacgaauaaugcacauuauacacauuaauuucucaucauccaccccuuucccaucccuuuacccuucugaguuuccauugucuguuuuuccacucucuacauccauguguacacauuuuuuagcucccauuuauaaaugagagcaugugauauuugacuuucccugucuggcuuguuucacuuagacaguaaccuccaguuccacccauguuguuucagaagacaugauuuuauucuuuuuuguggcuaaauaguauuucguuguacugugauaugcaucuguauaccacauuugcauuauccauugaugggcacgucgguugauuucaugucuuugcuauugugaguaguguugugauaaacaucagugcaggugucuuucuuauauaaugauuucuuuuuccuuugguuagauaucuaguggugggauugcuggauugaaugguaguucuauuguuaguuuuuugagaacucuccauacuguuuucuucuaauuuacauucccaccaacaguguauaagaguuccgucuucuccacauccucacuaaugucuguuauuuuuugucuuuaauaauggccauucugacugaguuuaagaugauaucucauaacuuuuugugguggaagggcugucuuucacacugugggauguucagcaguaucccuagccucuucccucuauccuaugccccuccagcuaugacacgcaaaaauaucucuaggcguugccaaauguccccugaggaaaaugucuuucccuguugagaaccacuuccuuaaugacccacuguuacugauggaaauguguaggguccuuuaggaauauguaguggacuugguaguuuuaagugguuaauagcgacuggcccaagaaaugaaaucuaaaccuuccacaacuucuauauauauauacauacauacauauauauauauguguguguguguguguguguguguguguguguguauacuuuaaguucuaggguacaugugcacaaugugcagguuuguuacauauguauacaugugcuguguugguuugcugcacccauuaacuaaucauuuacauuagguauuucuccuaaugcuaacccucccccauccccugacccuguggacuggauuaagaaaauguggcacauguacaccauggaauacuaugcagccguaaacaaagggugaguucguguccuuuguagcaacauggaugaagcaacagaaugaugggaaaccuucauucugagcaaacuaucgcaaggacagaaaaccaaauacugcauguucucacucauaggugggaacuaaacaaugagaacacuuggacacagggcugggaacaccacaacuucuuuuucaguucauaacucauaguccacgauccaugugcucuuugacuugacuuuucuuaaacuccuauuuuaugugcuucugacuugcuuucccuucuuauuuguaauccacacuagccucaaaagaugcaugaacugugaauuuucacuuccagggccauggauaguugaacaucuaguagugaauuuccucuuucagaagauaaauaaauucauucauuccccuggaucuagaaggauacacaauaccaagagaaagugugaucgaauuaaccagacucaaaagcauucacauccacaaaagggcacagauucaguuaggacccauuagaauuuauggucuucccucgaaauuacaagagggaacaacuugcagcucaucugcauauccgugaagagaggaaccaguguaugccauucuaugacuaucaagaagacacaacuuuuuuuuccuccuaaaugcauauacauagauuauuagaagcaucuaauauaugacaaagacauauguggccugucaaugaagacaaauaugcuggucucuucucugcaccaugcacugggcuugcccauguggaaggaugcagcaggcagagguauguaugcaggguccuuauugagaugaauggaggguccuuauugaaaugaauggaggggccuuuuaaaggaacacugucaaccagaguagguccugguggaaauuaccagcuucccuagaagcaaagggauacuuuuuucauuaauaaccaccuccaucagaaaaggaaggucuggcuuuuauuuucuuauuugccuccugaugaauuuuagggacaaagaaggcauguggauuuuaggcuucucuucguuacugcuuagaugucaaaaaugaccacaggucauaucccaugguagcacaaauucuuaugagauaaaagagaagauuacccaaauccagccaauaauccucuuuuuaaauuuuauuuuugagacauuguauacuacaauauaaauaacaaagggagccuguauuagucuguucucacacugcuguaaagaaauaccugagccggguaugauggcucgugccuauaaucccagcacauugggaggcugagacaggcggaucaccugagguugggaguuugagaccagccugaccaacauggagaaacccuaucucuccuaaaaauacaaaauuagccaggugugguggcacaugccugaaaucccagcuacucgggaggcuaaggcaggggaaucgccuguacccgggagguggagauugcagugagcagagauugagccauugcacuccagccuggacaacaagagugaaaaguccauuucaagaaaaaaaaaacggaaugccugagacuggguaauuuauaugaaaagagauuuaauuggcucacaguucugcaggcuguacaggaaacauggcaguaucuguuucuugggaggccucaaggagcuuacagucauggcagaaggcagagcgggggcaggcaucuuacauggcagaagcaaaagcaaaagagcguaggggaaggugccacacauuuuuuaaaaaaccagaucucaugagaacucuaucaccagaauaccaagggauggugguaagccauuugugaaggauccaccccagugaaccauucacuucccaguaggcccuaccuccaacgcuggggaucacaacugaacaugagauuuggguggggacacagaacccaaaccauguaagaguccuugaaacaucugccuuauauugggaguuggggggugggguaggguuggucggcagugauggacucuuuauuuucuuuauuaaaaauaacuuuuuuauggcaacaguuuuagauuacagaaaaauuaugaagacaauacagagaguucugauauacccuauagccuguuccccuuauuauuaauaugguacauuuuuuuagagaaccugcuuuuuuuuuuuuuuuuuuuuuuuuuuuuuugagauggagucucacucugucguccaggcuggagugcaguggcacaguuucagcugacugcaaccuccaccucccggauucaagcaauucuccugccucagccuccugaguagcuggaauuacagguacaugccaccaugcccagcuaauuuuuuuuuuuaaaguagagaugggguuucaccauguuggucaggcugaucuugaacucuugaccucaugauccaccugccucguccuccuaaagugcugggauuacaggcgugagccaugagaacgugcuuuuaagaagccugguauggucuagaccagggguucccaaacccugggcgccagaccgguguggucuguguccuguuaggaaccaggcgagcaagcauuacagccugaccuucaccuccugucagaucagcgcugggauuagauucccauaguagcgcaaacccuguugugaacugcgcaugcgagggaucuagguugcaugcaccuuaugaaaaucgagcuaaugccugauuaucugauaucuaagguggaacaguuucauccccaaaccauccuacccucccccccaccacccuucauggaaaauugucuuccgugaaacuggucacuagugccaaaaagguuagggacugcuguacauacaguuuagguaucauacauacauacauuagcuucuuucaucuucacaaaagaccuggcauauaacaguucaguccacaucuuagaagagaaaaaaaaaugcuuaaaaagguuaaauaauacuaaauacuaaaaucuucuaacuggcaaguggcagagccaagauuacaaccaucuccacuauuacgaguugauuuauuccacagguuuugaagcacuguuccucaucaaucucuaaaucaguaccgaguuuguaagaauggauaagaugggccaggugcggugguucacgccuguaaucccagcacuuugggaggccaaggugggcggauaaccugaggucaggaguuugagaccagccuggccaccguugugaaaccccaucucuacuaaaaauacaaaaauuagucagauaugguggcaugcaccuguagucccagcuacuugggaggcugaggcugagaauuucuugaacacaggaggcauagguugcagugagcugagauugcaccauugcacucccgccugggugacagagugagacugugucucaaaaaaaauaaaaaauuuaaaaaaagaauggauaagaugguucaccugccuucauggagguccuguucugagaauuccgaagggcagucaaagauaaaggacuauggugagagaaaagggggcaugugccaaacauaaugguguugccauggagacagucauuaauuucggaaccugggaaagacaucccccauaaccuaagagaaaucgguccuuguugauuggcuggagaucuccaccugggaaaaggggaacaaauaggccauuccaaacaaaaggcacagaauggaccaaaggcaggaaggcaugauaaagcgugguguguucccuaugucaguugcauucccuaaggaaucaggugguuggugagaucggaggguuugggaaggugauggcagaucgaaaaguagguaggagcuaggucaugaaggauuuagcgugcugugccaugccaaggaguuuggccuuuucuggaaggcacugaaaauccacugacagucucauaaggagaagacugaccaggucauacuaaucaguccucaguguagaaaggugagugugcgcuugucagagaaaugguuuggaggaaccaaaaccgagcauccaauuaggaagccaugucaauaauucauguaaggaaugaucauggccugaacuaaggcagagguugagcacaacagcagaaucaaaugcuauuaaaggguuaaaauggguguccagggcaccugccauggcucacgccuguaauccaagcacgucgggaggccaaggcugguggaucccuugagcucaggaguucgaaaccagccugggcaacauggcgaaacccuguccauacaaacauauaaaaauuagcuggguguuggcugggcgcaggggcucaugccuguaauccuagcacuuugggaagccgaggcagacagaucacuugagguaagaaguucgagaccagccuggccaacauggcaaaaccccauaucugcaaaaaauacaauuagccaggcauggugguaugugccuguagucccagcuacuuggaaggcugaggcaggagaaucucuugaacccaggagguggagguugcagugagcugagaucgugccacugcacuccagccugggcaacagagcgagacuccaacucagaagaaauuguguguguguguguguguguguguguguguuagcuggguguaguggugcacaccuguagucccagcuacuugggaggcugaguugaacacaggaggcugcggcugcagugagcugagaucauaccacugcccuccagccuaggcaacagaaugagacccugucucuaaaaaaaaaaaaaaaaaaagaaaaggaaagacauagguguucuggucagguguaguacaaaagaaaaaagauuuguacaugaccuacuuucccaguuugcagauuaaguagggaauacaaaaggaagcgcagauuuagagugagagaaugaauucgucucuucuaugucugugauuuuucuuuuuguuguugugguuuugauguuucacuauaacacgugcuuccucaugauauacuguguuuguguucuacugugguaguugugguguucugccugcucagcauacguuucuuccuuccaguaacaucagcagaaugacuguuuuucuguugaacaccauaucucuccuugcuuguuucaguugguuuuuaguguguuugagggguguugaucucaucccuggcugaagggauaaggacaugacucaguccuggccagcugcaagaccacagacaucucccuggcuauagggauugguuuagggcagauuugugacccaagcugaaccaaucagaacuaguaagcauuacgccaaggcuuuuugcuagugcuguugggaaagguacucguuguuguuguuguuguugugguuguuguuuugagacagggucuugcucuguuugcccaggcuggacugcagcggugugaucucagcucacugcaaccuccaccuccaggguucaagugauucuccuucagccucccaaguagcugggauuacaggcguaccacuacacccagcuaauuuuuguaauuuuaguagagauggaguuucaccauguuggccaggcaggucucaaacuccuuaccucaggggaucugcccgccucagccucccaaagugcugggauuacaggcgugagccaccgcaccugguagaaagguacucuuuccacucuauuugcuaaacugugaugaggcaaagcuggaaccaccauuugucauuuugacaccgccaggaguuuccaagaccaccccuaaauucacugguuugcuaggaggacucacaagacucaguguaugucauacucacagauaugauuuauuacagcaaaaagauauaaggcagaauccacaaaggaaaaaggcucauggggugaaguccagaggaaaccaggcucaaacuucaagaguccucccccaguggagucacgcaggacaugccaauucccccaacaauacguugugacaacacacaugaaauguugcccaaaagggaaucucaugagagacucagcacccaggauuuuuauugggggcugguuauguggacauucucuaggacauaccaaaauucuagacucccagaaggaaagcagguguuuaugguaaaccauuuuguuugcacaguuuagacacagugagcucuuagagaauagcaggaagcuucccaaaaccccaguucucagaugccagccaagggccagucuugcaagcaguucaucguucuaaggacagcagugucaagccugccguguuaccucuuuccuagacagucaguuugucugagagggcaaacagaucugagagcuugaaaagagaagacagauuuuagauuacauuguguuggagucucuaguuccagccaugccugaagcaaaauuucucuuuuuaaaaacugcuuaagucucaguaaagucucugucacuugcgaccuuaagaagcaugcuggcugacagaacccaugcuaaguaaauaaaauguuuucuucugacuucuuuuccacuuacuaccaucauuguuucccuucuuaaauugucagagccuccuuauugacagggccuuuacccccauagccuagcauaguacccagcuuaucauaggcauuuguaaacuuuugaugcguggaugaguuuucuguagccguuuagaggauuaaucuguuuagauggaaaaggugguaucugcagccuauuuauccaugaaagugaccuaaauuaaaauucugaccaagcugaauuaucucuuugaucuucccuuuuacaaauuccucuucacugagaaauuggccaccgcucuuauuaaguaguacuacuugggcucaccauccugggccuuuuuuuuuuucuuuuuuucuuuuuuggccuaauuaacugugucaccauucaagccaauuaggugugugccuuacugggagaucaauuaaaaaauaaauuagugucaaaguggaaagggaugugucgaaagauaaauuuucuuuccagucuuguacagaagcagcgggaaacagagcauuuuguagcuuuacuuacaugcacacauguaggaaagaaggacuggaagggaucuuagaggucaugaguuagcucagugccuuuuguugcaaaggucaagaagguucuaaggucuuugacuuggaugaugcaauuucaagagaacuucgcuuggacagaagucuguguuucaucuuuacuagcuguaggcgagucccucuaccuuucugauccuaagcuaucuguucaguaagugcuucacugagugacuauagaaagcaugaaugauuaguaaaauaaauggauuugaguaggugggcccagugucucuuucaggucuauggaucugaugcaaauucacacugucaggggcaaagccagaaccauauaaaagcgggcaucuuugguaccucucuuguccucauacccuacauuuaucuuccaguaaguccugcuggcugugccuucaagguucuauauaccuauccaagccuacuagauacuaaaauauuaguuauugaauaaacaaaauuaggucucuggccucugggcucuuuggauucuacgauauauuuuucucccuucuguuccuuuaaaggagcaaauaagagggacccugaagucaccaaggggacuugagucacugaguuuauauccggcaugaaacacuguccaaggcaggaauggagacacagagugaggaagaaugacgaaaucugccccaaacaggguucccaugagaguucaacuaaugaacagugaccugcuggcucagcccagggagaaucucaaaacauaacauuuggcuuccaaaucaugcuagauuguagucuauaucucuggagacagaucugguagcaguuacaauggaagugggcuuuuauucuuuuuuuuuuuuuuuuuuuuugagacagaguuuugcucuuguugcucaggcuggagugcaguggugcgaucucggcucaaugcaaccucuaccuccuugguucaaggguuucuccugccucagccuccugaguagcugggauuccaggcagccgccaccacacccagcuaauuuuuguauuuuaguagagaugggguuucaccauguuggccaggcuguucuccaacucuugaccucaggugauccacccgccucagccuuccaaagugcugggauuauagacaugagccacugcacccagccuugaauagcucuuaauguuucucauagacacguacaguaggggcucaaccccaaauguuuguuuccuugacuuaagauuuuagagauacccugauaucccaugacaucagcacugccuuuuuuuuuuuuuuuuaauuuuuggaaagaaaauguguuuuccuuguagaacaguaagacgaugacuccagacaggaugagggcagucagcacaaaaagacccucugggccucauuguaauagugaaggaaaaaacaagaauugacuagaccuuuucaagaauggauugcucugcuggaggcaucauuaagguucuccagacugauccacuuuauacaugugugucaugaauaaaacaaugcauguccguaucagcacaaagguaaagaaugaaacucaauuguguauauuucuacuaccuacagucagcuauuguuaauauuucagaugcuuuucugugcauauaggauggauucuuuuauaaaauugggaucauaauauaauccuguuuguauaccagucuuuuucgucuuaacuuugcaucacaaccauuuuucuuuguuaugcuaaaacauaaaagucaaaaagucggcuugcccuguguucaagucccagccccggcuccguaaucuuggugauccaauuaaccucucccugccauauuuucuuuuuuuuuuuuuuucuuuuuuucccccacuuuuuuugagacagggucuugcucuauagcccaggcuggagugcaguggcacaaucacggcucacuacagccucaaucucuugggcuugggugauucucccccugcaacccgccccccgcccccccccccccgcaacccaccaccccagccaccaugaguagcuguaacuacaggugugcaccaccacaccuggcuaauuuuuauauuuuuuuuuaauagagaugggguuuugccacguugcccaagcuggucuugaacuccugugcucaagcaauccgccuaccuccgccucucaaagugcugggauuacuggugugagccgcugugcccgucugccauacuuuauaggaaaacugggcaccuucucuucucugagugcaguuguugucaacacugccuuuaaguuauaaucaucuggggagcacgugaagaauaaugaugcccaggucuaccccauaucagccaagucagaaccucugguaugggcaguggccugccguauuuuugaaagcucccuacauaaugcugaaguguggccaggguugagauucacugcccuaagguugcuaucccaggaucugcuggcuacugcaacaaaagagacacugugucuugguuguuuugccaugggggcaguggggcaggguacuguuugggaggaguguuuggagacgggauuaaaauccuggcacuugucccucccagggaaaagggucauccuguuuauuuugugucaagagcucaaacagugaucaaaauccaauccaacaucauaaauaccagaaaaggucagggcugggcuggucauaggaucaagcacacacagccgagcugagguuggcacuuagucaacuccaaacucuucacuagcaaacagcacagggggggacuuggcaaggcccggccucuuggcgccccagucacagaauggagguucacauggcucuguuguuuuugucgaaggaggagaaaugccauuuucucagcaguccuucuccuugacucauuaguguaguuggcaaugugguuacuuuuuaacuucucugcaaauauucauagaaagagaaggggaguagaaggcaggagcuguuaauguacaccaagcuccuauuuuuugcaggccuccacaggguaaaagggacuggcccccgugcaccaggccacugccaguggugcagaugaaggaccugagcccccacaggcaucugaggucacauggucaguagagcugggaauuuuaucccgggucagaagaacuucaaagcccauauuuugucuuauuacuacacaucuuaagagauuagagggccgggugcaguggcucacaccuguaaucccagcgcuuugggagggcaaggcagguggaucauuugagccuaggaauuugagaccagccugggcaacauagcaagaccucuucucuacaaaaaaauacaaaaauuagccagguggguguggucccagcuacuugguaggcugaggugggaggaucaccugaaccuggaaaauuugaggcugcagugagcugugaucgugucacugcacuccaguauagguaguggagcgagacccugucucaaaaaaaaaaaaaaaaguuuggaggauuuaauuagaucauuucuagauauucugaucuugauugugacaaucuaaaggaaauugcauuguaggcuauuuaaggaacuuuccacauaaguuugucaagccagccuagcuaauagaacaggauauguuugagcaaguuauuuaccccauugggccuauguggaaucccacuggcuccuuuaauaaaagaacauccaguccucaggguuggugauaagaugagugugaagugcggaugcccaugggcauggggaauuuauuuaccaguucuuuuauuaaaagagcuggcaggauucuguuaccaggacuugccuuuuuuuuuuucuuuuaaucagaaaauuuugacaaagaaucuaugaagugcagauguagggccaaccauacuuuucacacuuuuuugauuguauccuacagucagaaauacauuuuucaucacaauccaaaagacauauguguguauguauguuuauacaggcauauauacacacauauaugcagaugagcaauuaaaacaauauuuucguaaaacaauacuugaccuuacuauguucagugaauuuuuauauuucuuuucuaaucuauuuaauguauuuuaauuuuuaaaaugcuugcucagauccacugaauuauuuucacaaccuucaaauguguuacaaacccuaguuucaaaaacacuggacuggaagauauccuaaaaugccuuuuaacucuguauuaagcauucugaaauucagcaaacuugccagcaaucagagaggagaucagaagcucauuuucuagaacccauuugcuggaaggggcagugaguaaucucuuguagacggcuuccuuguccuccaguggccuuccccuucauugaguuacuuuguguggccgugccaagcaugguggcugccacgugguggggggagccuuacaucucauuuuccuuacuucccaggcaggugcccuguuuuauuuaucucuguauuccaagcaucuaguaaggcucaacacugggcucaguaaauugauggggaaacaaaauaaaaaauguggcuccauuuucguuuuucauuaaccuucagggaagauugcacaauguaccuucguaaugcuauucauuuuuuaacuagcuucaauucagcucagaaauauguauggaaauaugccuacuaugugccagguaauguuggacacagaagacacuaaagaaugcgcaagaaagagaagugauucuugcucugaaggaaauccuguguaaauggagaaggggaagaaaaaagcaaaaauaacuacaaaguaauauggccauugcuugugcagagaguuuccaaaagcauggugcaggcauaguugaaggagaguuacuuccacuugggguaggugagguugaggggaagcacuagagcugggcuuugaagacuaggcagcaguuugugaggguccaaauagcagggaauuccaggcaaaaacagcaccuuggaaaaggcauggaggcaugauccugcaggagcuguuugaggcaccaugaccuguggauguggauaaagcugagaguucaccggaagcaggccugcaagggguugggcacucugccucagagacauaggacuuagguuggaaucgcagguccuccucuuucuaccugugauaggcuggauaauggcccccaaagacauccucagccuaauccaugcacuagaaccuguaaaaaaguacccuguauagggccaggcaugguggcucacgcccguaaucccagcacuuugggaggccgaggcggguggaucacgaggucaggaguuugagaccagccuggccaguauagugaaacccugucucuacuaaaaaauccaaaaaaaaauuuugcugggcaugguggcaugugccuguagucccggcuacuugggaggcugagggaggagacuugcuugaacccaggagguggagguuggaaugaaccgagacugcgccauugcacuccagccugggugacagacaagccuccgucuuaaaaaaacaaauaaacaaauaaacccuguauagcaaaagggacuuuacauaagcgauuaaguuaauggucuugagauggagggaguauccuggacuauacaggugacccccaaauagaaugaguguucuuggaagagggagguggaggaagauuuggcugcagagagaagaagcgauauaaugauagaagcagagauuggagugauguacuuggaagauggaguuaagggccacaagccaaggaauacagacagccacuggaagcuggaaacagcagggaaucgaauucuccccagagccuccgcagggaaccagcccugccaacaucuugacuuuaaccugcuaagacugauuucaggcuuucugaccuccagaacugucagagaacaaacgugugauuucaagccacgucauuuguagugaaaugugguacagaaggaauaggaaaacugacacacuucuuuaaauggccuuucacugggcgcgguggcucacgccuguaaucccagcccuuugggaggccgaggcaggcagauaaccugaggucaggagucugagaccagccugaccagcauggugaaaccccaucucuacuaaaaauacaaaauuagccaggcgugguggcgcaugccuguaauccuagcuacucaggaggcugaggcaggaaaaucgcuugaacccgggaggcagagguuguagugagcugagauugcaccaucgcacuccggccugggcaacaagagugaaacucugucucaaaaaauaaguaaauaaauaaauaaaauaaauggccuuucaacuuuauuccaccucuguaagccucaguuuccucaugugugaaaacggggauagaugggagucaucaugccugacguggcagccucaucggguaaaccuccuucugguaaggacgguguacguguccugaaacaugggccuuagcccacucugugacgcaucauaaggccaaauuuauucaugaaaguagauaaagaugaaacaggagagauaauuauguuuuauugaaaaugcuuguugacuugucuuuguuucuggcaaagcuacaaguguggaguggaaagugccuuaucugucugguuuaucacucucuccucagugcauagcagggugcucagcacguuaagccuucuguaauuaauugauaacugauuaaaugcgugcucuguuguauuuggagaucccaaaucaugaaacauacagaaggccauuuguagagagagauuacaggaagggaggccaaugugaccaccacaguaaucuucaugagagaugauuuuucauaucuacuuaaaauccuucauguugcacuuuucugcucaugcccuuucguucuguucucagagcaagagaacagcugcagauuguccucaaauagucucgucucuaccauuaauuuguucuccagccuucucuuuccaaacaaaaugacccaaauuauuuuggcuuucccuuguucagagugccguauuguaaugcccugcagauguugcaagaggauggcccagaggacaaagugggcuugcacauguguuuuaagugaccaugcggacuuuuuuguuucaugcgaauuauaaaacauggcaacuugaacacaugagcucauuuccauggucucucaaaguccaccaagauggcaggaaaggaauaaaagaaggcguaguucacaaggacuaagguacuggaagaggagaauacagacaaggguugccggcaaauuucaggagugaaaauacagaugggacgggggaaccgacaucacagaucagcgaucccaccgggcaacaaggcaaggagugggcugauugacuuugcugaucccagacagggcucagccgugagagguuccagguauucccaaaugccacauggaauggauccccagcccuaugaggggguuggucaauaguuuguauaagaaauaguuagaaccccuaccucuucuccaguuuauacagccagggagauauuccucuuuggucccugcauauugcugcauuuuuuuucuuuuuuuuuuucuuuuguuuuuggaguuuuacucucaucacccagguuggaguacaguagugcgaucucagcucacugcuuccuccaccucccggguucaagcgauucuccugucucagccucccaaguagcugggauuacaggcgccugccaccacauccagcaaauuuucguauuuuuaguagagacagguuuugccauguuggccgggcugaucucaaacuccugaccuccggagauccacccaccucggccucccaaagugcugggauuacaggcaugagccaccgcgccuggccugcuggagguuuucucuuggacccacagcaucagcguggcuccggacacacgcacuucauugugcacagauaggguugcagcagggugcuggagugaaaccaaggagaugaacagaaggcguacgcccugacgggggaggccccucagccccuccucuacucagaagucagaaggcuugaggccaguuuucuguccuccagacaagagauuguaugauuccucuuuggggaaacagcccagcccaagauugugauaaugaugcuugggauaugccaagugcucauguaaagucguauuaaguuauuacucucggcuucaacccacccuacuggacccugcucugagaugguggggaugggacucugcauuucagcacugccaguaucuuuuggggguuuuacagauggagcgccaugggaagacugaguccagaggggaagaagagacuugcuccugccugucugcuuccuguuuuuuguaaaaaucagcccagcauugcaaccucaccugguuguguuguugauucuaguuguaguccauccucuccccaaacccagaaccagcacuggggcagccccgccucggaggccugggucccagcacuguggggcuccaaauucuaauaauccacacucuuucuguguuaccccagcccuaggauugcaguugacacuugcagucgccauuugugugacaggucagcauucccccuuugcucuuacauuucccaugccuggcuagcagcucuuuaugaagguuccgcuagcugggguuucuugacuggacccucacucguggaugcaguagaagucagugagugacuucaucccucuuuuuuuuuuugucuguuuguuuuugagacagagucuugcucugucgcccagguuggagugcaguggcguguucuccgcucacugcaagcuccgccuccuggguucacaccauucuccugccucagccucccgaguagcugggacuacaggugcccaccaccacgcccggcuaauuuuuuguauuuuuaguagagacaggguuucaccgugcuggccaggauggucucgaucuccugaccucgugauccgccugccucggccucccaaagugcugggauuacaggcgugagccaccacgcccggcugacuucaucccucuuuagugaaggccugcagucaagaagcccacccacacacucaaagcugcccaccuacuuuuaaugccucacucauccgcauuaugaagagucaguaaacauuggaggaaaagcucuaauaaaaaagucagguuaguuuugacaaaaugaaaaaaaaaauaaagaaauggauaggaaacagucaaggcagagaagagcggaaaacguccaaaaaaaaaaaaccugaaauuaauguccuaagaaagaugaaacagcuauuucacccaucaaauaugaacaagauccuacauuuuuuuuaaaaaaggcagcuuugaaaaacaaggaagagcuuuaggaaauuaaaagcaugaguguugacauuuuuaaaaaugggucaaaaauuagaagaugaaguggggcaguuuaccaucuagguucuuuuagaugacuuuagacucaugagaaauaaacacaaacauacauuuauugagugcaguugcugggcuaacguuucccgacuugauauuagcccauuuauuacugguaaaaauccacaaagucggggcauuuuacaucuguuggauuaaacaacuaaggcugagggagcccugccugauuuugcagcuucuauuagccucaucgccucgagaaagagaacuguaugccaaucgaggcagccugccgcaaaguuuccaaggggccguauggggagacagcaucuucauugucuagcuaauugaaaaaaggaaggugcucgaauggaacccagcugauaugaauagucucaagugaggacucggucuuucaggcauggacagggccacccagcagcugacgacguuaauaaaauugucaggcagcuauuagaauagcuuaaaauuauucaauuuuuauagguaccuaaaaaagccgaacaacacuugucuuugcucauaaaaugaacaucuguuagcucccggaagacugguacccauuguuaguggcuggcccuuuguaugucacucagcccaggaugcucauaauuuagcuuggguuuuacucccuucuuuaacaugggcccugcaguagacaugcauauacuugauguuucuuuuuucucaauuuuguuuuuacuuuucucauuccuuccacugaaagaccaugaaaucaaacauuuggauucaacacgcaccacuuugagcuguaaccuaccacgugucuugcucuguacuggcccuuuggggcacuagcucaugcucucaguggccauuucaaguaaacgacuaacuggacaucaucgaugagcagguuccagggccguugcgccuaacacuacuuggcacucacaaaggaaugaacacauucuugguguauguauaggggaaauggaucuuagggcugaauucuugcuugcauucugacaaaucagcacagucugaauguuacgucuuagaaaugucaacagaaggacccaagaagccuaaaacuuuaagcauggaugaugaugauaagaauaauuugcaagcaagaacuaugccaccucucacccugaguuggugacagccagccucuguuagccuuaguuuuuauaucuguaaaguggggaugaaaaucucugccuuagaguguuggugucuggaucauuugagauaauguaugugaaauauauggauuagugucuggcacagaguugggguucaggaaauggcuguucuuuagucucccccuugucagggcuugcacaucuagagauuucccugcugcagguacagacccaaccuagauccuguggggacagaaacaaguauaaaacagaacauuuuuccucaagaagcuuucuguaucacacguagccuccaaaaauuucucaaaggugguuagaacagguguuuuagguggggaggaaauaaaacguuaaaagaaauucugaagcccaagauuucuuuguacaaggaaacaaaaguugggagagauuauuagaguuagcaaguggugggaaugaaauaagggauagauuugguccucuucaucccuguucuauucauccauuuauuuagcaaguguuaauuaaaugcucacucugugcuaggcacaucagaguggugcaccacuacggcaucuaaguugauugcaaaaauguacuaaaacagcuuucuagaucaucuaggcacuccugaggcuucaggcgccuccuugcaauccccaccuugcaggcaugcagugucuguugcauggaaccauuggaaggaagcucacccggcaagauaaucuucucuuguuccgggcagccugagcaaaccuugcauccuaaaccauucuuucuaacuuccucucccuucuuugaguuugguccuugagacccuacagcugaggcugauugguuguacugugacaguccuucagguaauugaagucuacuaucagagccuccugggcgguuucccuccuccaugcugcauuucuccaggugaaggauuccaaguucaucaggaucuuugucuuaagacagcagcacacaauuacaaaagcagcaucggugcaacauauucauguuuccuugugccauuuucuagcugugugaucuucagucaguaaauuaaucugcauuaggcuucucaaaaggaaguguggaggucacagugguguccacauccagguaguuggagagauaauugauauaauucaaaagaaugcuggccaggcacgguggcucaugccuguaaucccagcacuuugggaggccgaggcggguggaucaccugagguuaggaguucgagaccagccuggccaacguggugaaacccugucucuacuaaaaauacaaaaauuagcugggcaugguggcgggcaccuguaaucccagcuauucgggaggcugaggcaggagaaucacuugaacccaggaggaggagguugcagugagccgagaucgcgccauugcacuccagccugggcaacaagagcaaaacuccaucucaaaaaaacaaaacaaaacaagaaugcugcacauggaguaggugauccaguuugucuauaaguauaguacuacuggcuugauguugucaggugucagguuauggauggagaggccaaaguacaauuagggcaagucagucaccaagacucucacaucuguuagugugaagaugaggagugagaccagauaucagugcccuguccacauugaaugacuggguagagagucaagcucugcaauuccugagucucugguguguacucuaugguacuuaauggccagucaauaagauacuguucuuuuaguagcaaagaaaaugacuagauaaccaaauaauuacaucggaguccagggugcaucauguaggcugcuauuucucaaauuugaaucugcaugacaguucaucacacagggagcuuuuagauccugguccucaucccuggagacucaggcucugcagggacugugugauaggccuuguacuugugaagcugaugcaugauccucaugggacaugguccucagagcgcaacuaugccuagcuucuaaaugccuaggugagcugaaucuuguaaggccagagaaaacaagagugcuuaaaggagaaggacguuuucugccuaguuguuuuguuuucguuuuaacuuaccaggaaaauauaaaaacaguaucauuaggagacuuaucugauggcuaaaaaaaaaaaaaaaaaagccucagcaagagucuuuccaauaggcaaugguguuugcuagcuuucagugaguuuucuuaacguuuccaaauucugggccagauguuauuuauauaaucucaguuaggagagcuuuuggcugcaaguaacugugcuguaagccauaaggagguagagaguguuuccaaggccccugauucuuuccauccuuuuuccauucuuagcacauuggauuuuuaucuucaugcuuuccacuucauaguugcaagauggcugccauagcuccaggugucuugucuucagagucccaaacaggaagcaagagcaaagcuaaaaucccuucuucccagaagucugccuuuuuauuuaggauaggaaccuccaaagcagacuucucuuuacaucugauaguuuagaaauuaguuauaagcugaacccuagacccuaucgcugcuaguagggaaggggauuaccaugucugguuuauagagauuaugaguuauucccugaggauaggaagaggcccaccuuuccugaaaucagcagucucccgcugcugccaaaacacaaacacaugguucuguuagcuggugagaaggaggaagaugguuggguagauauuaauagcagugagaaucccucaugaagcucagaaaggagaaauaaucuuccgagaacacacagccagcaaagacagagucaguugucaaauuuggguuugccuuugaagcccgugugcuuccuauuuuaccauccugcaucuuagaacaugcagccuucucaucaaccagagaugcuaucuguuccagcaaaccucagaaaaagauccgauccccugccuucguuucacagaugggaaaauaauggccagcaugggggaagugauucaccuaaguucacuggccuauuuggcaggcugugagccucgucaucuuuccuuuuggcauuuaguacuuucugacccgguuaauagcuaggcacguuggggcugcuuuugucuuguguauacuuuauugucugcuaucauuuuuugcuuuagcauccccauugguaagugcucuugcauggauucccaguagguaauggggcaaccacaguaaauuaggaagguaauucgagcuguagcauuugaugcaccccagucacaacuauguugugcugguucaaccugagggacacaugagcaggagggaggauagagagcucagggcuugggcugccaaggcaaggggccaucaugguccucaaaggcgaugagccagggauuagagagggcucaccauuucuacuccugaaaaaaaagcaagauaagcuuuaaagucccuucccaauucuuuauagaguuuccuuuggcuaaggcauaagcugauaggaaagauacugaggaaggacaaaagagagaauaauuagaggaaaaaaagugcuauuccacguguagggagugagauaagggaaguggugaguugaugaguuucucuccuauaaaagaugaggcugaugacaugaacugucuuucaggcuuguucuaagaagagaugacuccauacgugcaaaaugcauagaacaaugccuggcguauaguagacacucaauaaauguuaaguacuaagaaauaaaaauaaaauccuaagcucccuaacaaaucagaccaucucuuggucaaggagaccccagaguaaccuugacaacuaaguugucggccgugauggguugggggugucagugucaaacauaccucguuaugcccccucccucgcuaaccaccguuaggcuuucuucugcaagggauugacaaaaaccagcccucucaagagacugauaucuacuaaccugcugaugcugccccuccuuuuucaccugaucagagaucacccaacacagagugguucuggccagucuauggagaaugugcaauaagaguuuuuguguccuuugcuucaccuuuugacaucagaggaucaaaaccuccacccuuggauaaugcuaacucugccauuuuuuguucaugagacacaugaagggccaugaagcucaguugcucaugggcacgugucuccuuuuauaaauauucaugacuccuccuauagcuuauugaauauguauauuuggucacccugaucagcauaaauuucuguuuccuuuuucccucuggugaagugucuguuucugguuucugacggagucuacaguccccagccuguuagaauagccaccaugcaggcugcgacccuuuaugagaaauaaaucucuccuuuccaaauuuaugaacuucaucauucuuuagcugacacuacuguauuauccuuaauauuggacauuuugugagauuuuaccccgccccgccccccccgaccucugccagaacccacaguuugaagaacaaaguggguaugucuacucuguacaaggaucuguugcuagaauauuuuacucauauggguuuuuuucucguuuaaucuuuccagcagccugagagaucaauauuaauauucugauguuacagagcagaaaaucugggggacccugaaagauuaagaucuguucaaguccaaaaagacauuggcaccaaaguuguucugcuuuuccaugcaggaacuccaccucugccuacagccagcugaguccugcucuaggagcagaugugguuugucauuugggaaccacuguuuacaccuccuccacugucuccugggcccuuucucccccucccuucuuuccuuuuguuauuaugguuuguucuggucaaggggccagucacuuucucuuugugcugucaccuuccuuuaauggguuccacaucugggcagaugauucuaccuucccucuaaagaggguguagaggagccagagaaccucagacucuggguggggugggugucacaccgaugcaggagcaugucaaggagaaagacagcaagagggauuaaaguuggcacucaucuuugagagagccucugaacugauugccauccgagugccacccaccaaugaaaggccguucagaauuucuguccccugggaacauaaauccgaucgccuuggcucugugucuccacugcaucaucucacuggcccuuugagcuccuuccacgugguaaugccguuaucuuuguacgugaaccaccugccucagaaccauuuggaguacgcuugggaaaacagaguuccaaaucuagcucauccgaccuauagggguuuuuauccuuggaauucgcuucuuuuuugagacggaguuuugcucuuguugcccaggccggagugcaauggugcgaucucggcucacugcaaccucugccucccauguugaagugauucuccugccucagccgcccgaguagcugggauuagaggcaugcgccaccaugccuggcuaauuuuguauuuuuaguaaagaugggauuucuccauguaggucaggcuggucucgaacuccugaccucaggugauccacccgccucggccucucaaagugcugcgauuacaggcgugugccacugcacccagccggaauuuccauuuuuaagcaacucccgugguaacgcaggugcugucuucaggccaugcuuugagaaaugcuguagucaacugugagcugcaggggagcaugucugugacucucucuuuguauucacaaccccuugccuuguguauuuuuuuaaucaaaugguggauuaauugaguauuugauuaauuaguguacaaagagaacagaaggaaguccgggaaauggaaaguuuuaguuucucaagaguaaaggaaaacagaauaaaucaaaguuacccuggaagaucagaacagccuuugcaguugauggacuuguguucuguguucucucucugaacucuucccagcgccuguccagcguaggcucucugcugagccaugugagagcacacggauacugcacucucugaaucuuguacacuacagaaguuucauuacaagcaaaacccuuaguccaggcaccuagcugaaaugugaacaggugcccauucuaggauucuucaucugauaaaugccugcaaaggcuccaaguccagcauugaauacugccuuuucucugaagccucuucucuccccucaagccacguaagguccaucucucuuuucuuuaagugucaucuguggcgaaaacaggccucuuuaagucucuggcauuguaccuauuuguucacuuguguguuuccuucauuagacuagaaacucuuaagacaggcucuccacuaauccucuguagaauuuuuuuucauauaaauauaguuuuuuucucuuauaaauacagucguaaaacauugcuaucuuuuguagcuucuuucaaccuaacauaauguuuucaagguuaguccauauuguagcauaugucuguagcacauuuuuuauggccgcauuauacuccgcuuuauggauauauaccacauuuguaaugcuuucaucaguugauagauacuugggcaguuuucacuuuuugacuaccaugaguaauguugcuaugaauauuucuguacauaguuuguguggacauacauuuucaguucucuugaguauauuccuaggaauggggcugccggguaauauguugacuccauguuuaacauuucgaggaauugccaaaccauuuuccaaauggcugcaccauuugcaaggcuguauuuuacaaguagcuguucauaugcuaagaauaccaauccgcugugucuucacugaaugccagcuaaccagacaggugaaacacaggugaugaauuuggagucaagaccugcagaagcuucccguccccguagccucucugagcacucauucagaaauaaugaguggauccaguaugcugggggggaaacauaggggacccaggacuuacgggucaccuaggaacagaugaaguuguuuaaccaugagcuaaaggcaggaugguauuuaauagauacauuuucauaucugggaccugcaucuugauuauagaucaaauaucacuugcauuuguuuuucuuuacucucagugacaugcaacagaagacaggcuuuauuugagaggcuguuucaugcagcuuucagcuuguuucagucucuuugucuaccuugcccaguagucacaaccaagauucugaauaccuccaauuucuucuuggagaucauacuucuuaugcugcaaaucaaggcaguacuaugggccuggggugguaguggaauuugcagcggaagcaguuucauugaagacauauuuucuuugagccucaaucuugaaggauuaagcugagcauauuacugucagaaggucaagggacccucuguucucuguggcagaccugcagaauggagucagguuucauucucuuccuccuuccuccgugcccuaauuaucacuugacuugaguaagccaugaguuccaucuugaugacaucaacacauugccugauggaaagaugcuaaacaaaagauuaaacauuuacaccuuccuaaaccagaagaccugugugcuaaagaaauaguaguaagccaucucaguguuuggcaaccuuauuggauuucagacaauucucuggaaucucucuugccugguuucuuuaccaaaacaaacuacuuuugccaucuggagauuaauucaguagauaaacaugggacagaaaggaccuucuuugcaguacuuuuucccagugggcuguacuuugcuuauagcuucugugggacuuaguuuuuuuuguuugguuugguuuugcuuuuuuuuuuuuuuuagcuuuaccuagaaaguuuuggcagaucagccaaccaggaagagugacgugguuuucucacacccugggggagacuuguuccacuuucucacacucauguuggagugggaaaagagggcuuacuccaaacccuccaggaggaaaaucauugucugguaccagauguaauuucagaaaaggguggguuggagcgaaugggagagcaugggaaagugaugaggggugagacguuauguggccccaggauugaguuggacauuucuuuugcucaaguaaacaaauuaugcaucugauccuguacuaagaaacuuauuagagaagauuuuauaagaugacaagaggguaaauuagaaaauagauuagaaaggugauaauauuggugagugccaggaguuagagauguggggagccuggcaaggaaaugggcuugauuuuauuauuauuauuauuuuuuuuuuuuugaggggagucucacucuguugcccaggcuggagugcaauggcgcaaucucagcucacugcaaccucugccuccuggguucaagcaguucuccugccucagccuccugaguagcugggauuauaggugugugccaccacgcccugcuaauuuuuguauuuuuaguagagacaggguuucaccgugucagucaggcugaucuugaacuccugaccucaugauccgcccgccucagcauucuaaagugcugggauuacagucgugaaccaccacacccggcugggcuugauuuuuauagagguguagauuuaaggagauuuuagugaugauggcacaguucucuguuuugauugccaugaugguuucuugaacacauacgauaaaauggcauagaacuauacacacauauuguacccaugacaguuucuucauuuggauauuguacuaguuaucuaagauaccaacauuggcagaaacugagugauggauacacagaaccucucuguacguuuuuugcaauuucauaugcaucuauuguuauuucaaaauaaaguuauuuuuaaaaccuagaaugaggacaggaaauaguaacacaaauagaaaaaaaaaaaagaaaugauaugauggacaaugcagauaauggcauagcauuaagcagguguaaccucuacugggcuccugacaaauggugacauuuaaaacagggcaaccacacugcaucuaaugugguggccuucauuaagauuuuccaagaggaaaauguuugcgauucaugucacagacaauaggcuaaucucaaaauuagauacaaagaaccccuagaaauuaguauuuuaaaagacaaguaaccauggguacagaguaucaacacacaguucacagaggaggaaaugcagguuguugguuuuuaaccacagaaagagaagcaacuucugccucgcaaaaauaaaaagaaaggaaugcaaauaaaaacaauagugagggcugggcagggugucucacgccuuugggaggucaaggagcacuuugggaggucaaggugggcggaucaccugaagucaggaguucgagaccagccugaccaacauggugaaaccccgucucuacuaaaaauacaaaauuaucugggugugcuggcacacaccuguagucccagcuacucgggaggcugaggcaggagaauugcuugaacccaggaggcagagguugcagugagccgagaucgcgccauugaacuccagucugggcaacaagagugaaacuccauuucaaaaacaaaacaaaacaaaacaaacaaaaacagucacccaagcugaaguacagugaugcagucuuggcucaccgcagccucuaccucccgggcucaagccauccucccaccucagacucccaaguaacugagacuacaggugugugucaccaugccuggcuaauuuuuguuucuuuuuuuuuuuucuuuuuuuuagauagagucuugcuguugaccaggcuggagugaaguggugcaaucucggcccacugcaaccuccaccucuuggguucaagcgauucucuugccucagccucccaaguagcuaggauugcaggugcaugccaccacgcccagcuaauuuuuguauuuuuaguacagaugggguuucaccauguuggccaggcuggucuugagcuccugaccucaugauccacccaccuuggccucccaaagugcugggauuauaggcaucagccaccgcaccuggccuuuuuuguauuuuuuuuagagacaaagucucccuauguugcccaggcugcuuuggaacuccugagcuuaagcaauccacccgccuccaccuccaccucccacagugcugggauuacaggcaugcaccagagauaccauuuauuaacucucagauuacugaaaaucuguaaguuugguaacacauucuguuggugaugcuggugggagugcaaaugagcacauccccugugaacugccuuucagcaacgucuacaaaaugccugugacagagguggcuaacucuucaccaaaaauuugucuugcucuuccucaguaauacaguuacagcuggcaaguagcucagcagcuaagggcuugauauaguuuggauguuuaucaccuccaaaucucauguugaaaugugauccucaguguuucagguagggccugaugggagguguuugggucaagggagcggaucccucaugaauggcuuagugccauccccgugguaaugagugacuucuugcuccgaguucacaugagagcuaguuguuuaaagaagcuggcaccugcccuuucucucucccgcuccuguucuugccaugugacuugccuguucucccuuugccuucugccgugauuggaagcuuccugaggcccucaccagaaauagaugcaggcgcuaugcuuuguauauagucugcaaagcuaugagccaaaauaaaccucuuuucuuuauaaauuacccauucucagguauuccuuuauagcagugugaauggacuaacacagagcuacaccucucagcuucccuugcagacauugcuaguacucugcauuagaaugugaguagaaaaaacgugguguauguauauguguuugcaaaaaauggccacaaguuuuuccccugccuacaucgguuacuuucaccaagacuguguagcuccucccauuaagaggaggcaucuauguccacuuccugaaucugggccggucuugucguuuguuuugaccaauguaaugguaugagcaugacacaagcagagaccugaaaaguacuugagcacuggggcucccccugccacucugggagccugucugcccuguugugaacaaacccgggcuagccuguuggaggaugagagcccauguggagagaggccccaucaucugagcuauccuaugcuagcagguaaggccacccuauaguagccagcccagcugauccaacagcuguacuuauggcugcagaggcaugagcaccguagcccaaaccagaacagcccagcugugucaggccagcuugccuacuugcauuuuaagccacuacaugugaggauuacuuguuacacagcaaugcugacugauacagugugcuacuucuuggagaaacuuuuuaagaaccacguauuucuucacuguguucucuuuuuacuguccuauagucauuccugaaauaacccauaguucccagccagugggacaucucauuuugcaaccaggcaacagugccaaaauacacucauccaggcuccucuuuggcaagcgcuggggacugaaaaucagugcccuggccucaaggagcucaccugccagcaaagacagacacauguaaacaacacaaucaaauuacuacuuauuuuuauuacuaauagauacauugauuucaggugcugaucagugcaaugaaaauacagcuggaagcuuguuaugccuuaaggaagugagcuuuugggaaucaguucacggagccacuccacgcuuucuuuuuacauugaaggaagagaggcccacacagaagucccaaaacagcagcucguguuuugcacggaaucccaugaauuucugucagaucaugucucauagagcauuacuaaaaccaggacagaaagacgcagaacacuuccgggagucaggcagagcagacugggauuaggauucagaugugaacagaaagcagcugcaagcugauguggcucagcucaaugcccaggugggcagugggggcagguguugguggggaagugaguuagagauggcccagcucagcacugcuguguucugcagagaguucagaguccccucccgugcuugucagagagcagaagcuugcugucucccugcgggauugugggauuuggagaacagccacccccaugaaucucagguacaggaugguuuaagaagcacugaggccagacacaguggcucuugccuguaauccuagcgcuuugggaggcugaggugcaaggauugauuuagcccaggguuucaaaaccagccugggcaacauagugagaccccccaucaguacagaaaauaaaaaauuagccaggcaugguggcacacgucuguaguccccauuucaggaggcugagcgauacaaaaaguagaaaauuagccaggcguggcagcacaggccuguagccccagcugcuugggaggcugaagagggaggauugcuugagcucaggagauccaggcugcagugagcucugaucacaccaccgcacuccagccugggugacagagugagacccugacuccaaaaaaaaaaaaaaaaaaaaaaagagaaaaaccacugaaacagauagacgaacagucucuuagccucucagcaagaggaagccagggaguacaaacuucuuaauccuaaggaaaagaaaaugcuacuuaaacuaaauaucaagaagagacaaauuccccugugcuuaagaacacgacuuggaaauguucucuuuuuacccagcgucauaaacagaaugugggcuggugauguggccauguagaucagccucucaaagaaugaauuguuuucuuucucuuuuuuuuccuuguuuuucacuucuaaaauacuauguuuccucuuuugguuaaaugacagacuugcuuuuaagaagagcagucaaggauguaaaaauagugauuucaaagaaagcugggagagaaucaucauuuacguguuuuuguuuuuucaauuugggaauaaacucccaguguggguggggagugucuggagccugagagggaaccugggugucuucgggagccagugcaggggcugguacuuuauuuuauggggaccuguggccugagaugcguuuuagagguaacagugcccccuucuggugcaaaugaauaaagaguugagguuucuguaaguauaauuuagauauccccguggcagaguggagcuuuuaaacucauugucucuggggcagaaauuaugccuuggcuguuccucccuccaaccccagggagccccccugggucuccuuugaggcaugcuccucucugaggcauaugugaccacacacacacacacacacacacgcgcgcgcacgcacgcagcucagggaccugcagaauugccagagaucauugcagugagucaggauuccucugucuugacuuggaucuucauucuucagcuugagcauauccaugagauuuuuuuuuaaucugcagaaagccagagugcucuguggaaucaagcugccugugaaaguguuucuuuucuuuucuuuugccuaaaacaaauuccaacuagcugucuuguuuuagguaaguuccaacuagcugacuuccaucuggucagcuaguuguacagucauauguguacacauccaggggcagaaacaucuaggauguuggucccuggaugugcgggucccuggauauauguacacaugaccgucucuuuugauguaugucaggaugugaucagaauuaacacuuaaacccccacggucaguaccacaccccuuucucugccccacuccaguccccucagggggugcaguuacacuuccacuccuguccuagugaauucuccuuggccuggugaccugggagggccucauuggagaacaagaauauuggacacuaucaugaucaacacuaggggagaagggcccagacuccagagccagucagccuggguucaaauccugugccugaggccgggcgcggugggucgugccugugaucccaaccuuuugggaggccgaggccagcgcaacaccugaggucaggaguucgagaucagccuggccaacauggugaaacuccaucucugcuaaaaauacaaaaauuagccaggcaugguggcaugugccuuuauucaggaggcugaggcaugagaauugccugaaccugggaggcggagguugcagugagcugagauggugucacugcacuccagccuaggcgacagagugagagugucucaaaacaaaaacaaauccugugucugccauuugcuggcgugugaccuugggcuguugauuuaaccuguuugggauucaauuuucucacauagggaugaugaucacaauauguaauuccugggauuugugugacacacagaugaguuccucuaugccacguauuuagagcagcgcucagcauaaaggacuucaugcacauuaaccauuauucuagcuucuuggcuuaagguaugaaguugccagaucuucucagcuguaugauuuccucaagucaaauccugguucccauugccuugagaagagagggugccucagaucccagaaaaaucuguaggaguuggagugaucuaacgacagcaaggagagugaauuuggggcaucacccaguucuccuuauaaucuucaggccaguccugcucacugcugucugacuuuguagccugauuuuuccagaugaagcugcucuuguugacccaggucucccccuucuucuuuaagguauauuguaucugugggauacagacauagugcaggacugaggccaugcauucuccuuccuaagagcuucuuacuccgggucuguggguagauuccagggauucucagacucucucagaaguuguauacaaaauucucugggcggcccggcacaguggcucacgccuguaaucccagcacugugggaggcugaggcaggcggaucacaagucaggaguucgagaccauccuggcccauauggugaaaccccaucucuacuaaaaauacaaaauuagccgggcgggugcuaauauuugcuaauauugguggcaggugccuguauucccagcuauucgggaggcugaggcaggagaaucgcgcuugaacccagugagccaagauugcaccacugcacuccagccugggcaacagagcgagacugucucaaaaaaagaauucuuugugcauuauauguauguuuuuguagcucuacuccaccgaguucagcccuuuuuauuggacaacuuuccuagagguuagagugcgucuuuaguacuuguugggugaugaugggacagagagggguguggagggguugagggauauaaguuuguagccacuuuccaauuuuucauccuaucguagcuucucuuaguaauccagaguuagcuuucuaguggcucagguguauagcucuggaaucaucaguuaauacguauucacaguuaaggggaauuuguagggaaaaaaaugccacaugcugcuucccagagcugaggauuuucaucagcucuucugaauuauucacacuccucgucccuuuuuuaauguagauaacaaagaguugguagcaauauaagagugcguguuugccuuuuaaggcuauagucaacauauaaaaagaaaaugauguguucccuugaguacuuacuacugucuaguaaacaggggacagaggugcuuaaauaggaggaagugggcugggcaugguggcucacgccuguaaucacagcacuuugggaggccgaggugggcgcaucacaaggucaagagaucgagaccauccuggccaacauggugagaccccaucucuacuaaaaauaaauuagccaggcgugguggcgccugcuuguagucccagcuacuugggaggcugaggcaggagaaucgcuugaacccggaaggcggaaguuugcagugagcggagauggcaccacugcacuccagccugauggcagaaggagacugucucaaaaauaauaauaauaauaauaauaggaggaaguuggggaggcuuccaccccaucaucuuggucuguccucaguggucugaugggaugcaggaccagcuguauaauuugugaggccuggugcaaaaugaaagguggggcuuccuuuuuuuaaagaaauguguuaggaguuucaaaauggugauagcaagccauuaaaccaagcacagggucuucgucagcacaaggcccuuuagauccugugucccuaaagcuggcccuggugagacauagggaugugggccucuccccacauccucacacuauuucagcccgcuggaugucuugccugccuucgucacaccaggcacacaucugccuugccugcuuugugcuuacuguuuccccgccuuuaagccucucuccccagauagcccuagcccucgcuccuucauuuccugcagguuucugcccagagcucaccuuagcagaggggccuccgccaucagucuucucucaaacagcaucccucacacccucccugcauccucugcaacaaacucucagcuuucacuauggauuuaucugucuaucauugauugcucuucucacgcuggugaagcgcaggcucuuagagggccuggacacgguggcguugcucacucccggacucugugaagcuggcaaggugccaggcuggugcuguguguguggaauacacaggugggaguguucuuugcuaacuggggaaggcaagccaaagggugagaggccaaggggagggugaggggugacucuggacucgucaccucucauccugaucuugucaggcaggagcaccuucuuccugccaguguucaucauucuggaagccuuuuguaagauccagggcgcugaccagggaacuuuccaugcaccaccuuuugggcagauuaaguccggggacuacugccuccccugccuggguucuucaguguauaaaaugaggggguuucugggguagcuuuucuggcuguuuucucguugaauguguuguugaugaguccagaguucuuguuuagcuccaguguucugggaaagaucguccuggcugucuauuuucugcucccugugaaaaugaguucauucauucaacaaacacauaccaagugccaaucaugugucagguacgcuaacaggcccucagaauacagcagcaacaaacagcaagcagacccuccggaguuuaccuuuucauggaugugaugucugcagggaugaacaguuugucauggauagauuugcugcucucuuucuaggucucugugcaucaauuugcacuggaaaagccacuugcaaugcuguaaaagaaggaguauuuggagcgaaagucuagggaccuucauuaaaaucuagguuucugggccucagcaccaacaaguguggcuuuggggucaagagcuugcggucuggaaucacaucaugcagcauucauucuuuuuuguuguuuuuuauuuuuuauuuuuuuuuuuuuuagcuacaccugcugaaaugggagggguucauucuuggcucuacuguuuucugagaacuugaacaaauaaacugcucgauaucaauuuguuuuuauuuucaauagcaaaauaaagauaggaacauuacgugccugcgaggagauccuuuaccuaaagcgcuuagcacagugccugguucaugcuguucacacagugcuguguguucauguuauugacagccucagugacagccucagugagcuuaggucacuaucuuugggccuuggcuguccccuucuaucaaaugaagugauuguuucaccccuuuauagguccguguuucugacucacuuuaauaggacugaaacucgugauugucucuccuccacguguagacuagccgacuaaaagaaggcuauaugauauauauauacacguaguugucccuucauauccguaggggccugguuccaggaaccccguggauaccaaaauguagcaaugcucaaguuccuuauauuaaaugggguuguauuuacauacaaucuaugcacaucuccugcauacuuuaaaucaucucuaaauuacuuauaauaccuagcaccauguaaauaguuauuauacuguaugaauuuuuaaauuuuguguuacuuucguuuauuuuuauuuucauuguuuuuucuuagaauauuuuugauccacauuuggaugaagucgcaaauguagaaccuggagauacagagggcuggcaguauacaccugugauacauaugugugugcauaugucuaugaauauauauauacacacauaugcaggcauaacugugcaucaucguguguguguguguguguguguggacacacauagacuagccgacugaaagaaagcuaugugagauguauacacacacagucaucccucaguauccacaggggacugguucacauaaacauauaugcagucugugacacuuaaugauggggauauguucugggaaaugcaucauuaggugauugcaucauugugcaaacaucacugaguguacuuauacaaacauagauucuauagcuucccacacaucuaggcuauaugguauagccuguugcuucuaggcuacagccugggcagcaugucacuauacugaauacuguaggcaguuguaacaaaaugguaaguauuuguguaucucaacauagaaaagggacaguaaaaaugcaacgucauaaucuuaugggaccacaacacuauacugucuguuguugaccaaaacaucauuauguggcacaugacucguguguguguguguguguguguguguguguguguacaucagcucuuaagucucuagagcuuucuguaucuggcauugcagucucucagccagcauuccaaucccugagagaugcugcuuuuucacaugugggagcguuccgggauuagaaaaaugaacucuugucucuuccaacucaaggguucuaucaguccuguugcaauccagacagauuuuacuuaauuuccucucuugcauguguuuguuuugcuuguguauugaagagaguugcaucucgcugccuccuggaucugcuuaucagcauuuuuuucaggcagaguguguucuugcuucugcuggucuccaucauucuggauaccauuuguaagauucaggacccuggccauauaacagucuggaacaggaaccaaaaaguguuugaguugcuguaugcucaauaaugcacugauuucacaagguuuagcccauuuagcucacagaggaaucucagccaaaguuuagacuugggcagcuuuucuuauuaccuugaaauuagucucgauuacccuuaaauuacugaagauugaccaccaugcaaagugguuucuccuuucauuaaucuuacuaacuggcugcauuguuacaaaucuuuuuuccuagccagcacaagauuccuuuucugcaaaagggcuucucccgcggugccuuucuuuuacauuccucacuucuagugguuugauuaauggucacaccaguacacauccugacagccgugcuuccacuugugucucaccagcaaaaccaucuggguggaagguuugcaucucugggauccucaggcauuaggcaccuccuuuugcauaaaccuggguuggagugaugucacacaucuggcucaggcauuuaaaaaacaauuuaaaaaaaacagugaauguguuugcuuauuauagaguacauugugagcaucacaggguauguugaagacaagagaaaauuaggggaaaagagaagaaucauacaucuccuacuaccugaagaucaccauuauuuuaauuauuuauuuuugagauggaguuucacuguugucaccuaggcuggaguguagugguguaaucucugcucacugcaacuuccgccuuccagguuuaagugauuauccugccucagccucccgaguagcugggauuacaggcgccugccaccacucccggcuaaauuuuuguauuuuaguagagaugggguuuugccauguuggccaggcuggucucgaacuccugaccucaggugaucuuccugccucggccucccaaagugcugggauuacaggcgugagccacugcgccuggcccaccauuauuugauuaguuacuugcaaucuacuuuucuguauauuuuuaaagacuguuguuuuccuccuauauguaauucugacuucugccuuuuauuuucacuuaauauuaucgaucuuuguaacugucacuuucauugacuggguaauguuccaucuagugauaaaucauaauuuuuuaaaagacauucuccuauuuugggccaguuaggauguuucugguauuuugaagauuuaauuaaagacuguugaauuucuuuggcauacaacauucccuauuucagauucauuuuuaauauaaauuagcauaguaugauuccugggucaaaggauuugaauucucuuaaucuacaauaucaguuuccuuccuaagaggcaagugucucuuuauacugcaaccagaaugucagagagagcccugucagagguaaauuuaauauuuuagcucauaaugaaguucuaugacauuaauuuuuuacaggacuuuuuuaagaacaaggaaaaaaaucauggcuuuacaaaaaacaacuguauggucaaccuacaaguaaacaguucccuuuccugggccucagguacaauaaagagaugagacaagaagauaugcuacagucccauccacuuguaggggaguuagccauugcaguuagacaguuugacaaaagccaucucuggcuguggaaucaaaggaggaaaggcuggguacuaaguagaaaaaugacauuucguuucguggaaaacaagcaaccuugacauaacucagauuugucuuacaaggauggaaugagcagaacuugccuugccagagacgcaguucacaauggagguagucagagauaagaagacagacuagggccaugcagagcugaaugcauuccuucuaccaaguccuuuuccaggguaaagcucuccaucccugucauagggucugcaaacaucacagcugcugggguagaggaaggguccauucucuagacuggaucaugagaucagucccacugguuguacuucuuaggucaccuaaaauccauggaauauuugggaacuaugauuacagagcuagacgugcccuggaauuuaucaugcaaagcugaauccccccucacucugaguaacaacacagaaaaccucuuuaaaugccagggaaauaucacccuuguugucuguaucagagacuaaaaguauucuuaauaguuuaaaggguacucaauaaauauuaccacaugggguauuaagcuuccagauuaccccaccucaaggcauacagcaguacacacacagguacaacucauguggcuggcaucagcaacauaaagaaauagcagcaguaaaagcugcgugugaagauaccugaguacagcugccacauguggaaacaucuguccaaaugggaggaaagucuggcugcccccguuuggucucaucagucauuuaauggcccaucaguaaaacaggaagaaaaucacuaugugugugauggauugcccgacaauacagaacuguaucggcacccgccaccuugaauuggguucauuuguauauaugcuugccuucucucaagaacagggaccauuugccagucauuggagagccuggggcauguagcacggacuucagaaccaaaagcuaagccaggcugggugugguagcucacgccuguaaucccagcacuuugggcggccaaggugggcggauugcuugaguucaggaguucaagaccagccugggcaacauagugaaacucugucucaacaacaacaacaaagaaauacaaaaaauuagccaggcacgguggcaugcaccuguagucacagcuacucaggaggcugaggugagaggaucauuugagccugcgaggccaagguugcagugagccaagauugcaucauugcaccccagccuacccuccuggaguuagauccugucucaaaaacaaaacagaaaacaccaaaccaguuuuuagccucuguggacuuugguauuuucuuaucagugaaaugugggcuauacacacuuaccagcggaggugauagaguauagcagucauuagcacauccucuggagacaggcagccuggguuccaauuuuaccuccacuuuuuacuagcacggagacacaagccaauuguuagaggucuccucucuauggcugaauuuccucaucuguaaaguuccuaacucauauaguuauugauuaaaucaguaaauauguauaaaaugcuuagaggagacuugggaccuaguaggcauguuauucgaauuugcugucaucaccacuacccccuuacaagguggcugcagggauuaagacuugcauguuuagacugcuucgugcauggucggugccuaauaaauguaguuacuauuauuguguuuacaucccuaacucccaguacauugcuugcuuaugguaguuuauuaaguagaauaaugagcucauuucucagguuuauucucuaaucuguuagguaggugcuggaauauugauuugguuuuauuauuguacucacacauucuuguucuuuagguuucaaauguagaucaaagcaaggucagagaugagggcucacaggggagcggcgagacuuuuucccaaaugcaaaauugucauagguuggugaagcccagguaaacaugcaccgcucacuuuuccuucacucucugcgauucauuucugucuaaaugaaagcagacgagagagauuuuaaauugcccaguuagguuugggcaaaacacagaucauuuauaaaaacacagaacauuuauaaaaucuuggacgcaauggcacacacuuguaaucccagcacuuucagaggccaaggugggaggaucacuugaggccaggaguuugagaccagauugggcaguauagcaagacccuaucuguaccaaaaaauuuaaaaauuagcuggguaugguggcaugcaccuguagucugggcuacuugggaggcuggggugggaggaucacuugagcccagggcuuuaagauuacagugagguaugauugugcuuugcucuccaggcugggugacagagcaagacccugucucuuaaaaaaaaaauaaaaaucccucuuuccauagaggacucuauuaaacaugacaccauuucauccuugcaauggaaugugugcuugggaccuccaagacaauuguuuuuguugcacugccuccauuuugcagaugagacagaugagauggggagagggucuuggaucagguugaaggagaguauugaugaggccagugguucucaacagguggcccugggaccagcagcaucagccucacuugggaacuugcugguauucaaagucuuggggugcaccccaggcauacuaaaucaguaacccuagggguggggcccucagugauuauaaugcgugggaaaguuugaaacccacuggguuaggcggaucauuuuaggcaggugaugucuuuuggaaggacagccuaaggccugauauaccuguucuuuuccucacuccccaagcaaauauauaccugugaccacacaaucagagcgguaaauugaagccaauuagcagcuaaguaacugccagcacuugucaccaggguaguuguuaguaauuagcacuaaugacucuagagaggaaaacaguugugguucaaagacauccccaccauuugaauucacucuggguuuuuucccacacuucccugccauauuuuccuuuugcaugcaaacaccaucgcaguuggauggaugcuucucgggagacaaaugucacgugaaguaauaauaugcgaugaguuuuuaaugcuugccaggaugagauuguucuguugggguauauauuaaaguugccaaucaaccuuuuggauacaccugcauaauucugauaggaugucauggauguacguuguaacuuucuccaggaagcaaaaagugauuuauaagcaugacaaauuguugaaugagaucaccacaugacaguucucugcauuuggugagagugucgcgagaaagaagagaaaccaaggaaagagaauuuucacauagagagucaaauauguacacuuuaguguugaguuaccaaauguagguuuuagaaaacccuuuuaagaaaaugguaaggguguaauuaacaugacccucuuaccugguuacccaugaguauagugugcauuggaagaggagaaaggcugccuuugauccaugugcuccuugaaguuggcagugauuguguuuuacucguucccagugcccugcaguggccccugugccuugcccagggugacacccaccaguagagucuucagaaugucagauuaaauugagcagggugggaucuagcaccaccugguuuuggcuaugugaaauucuguuguucgguguagauucugugugcuccacugugaucaaagcucaucucugugaaaguuuuugaggcuggcagauguuuaguugugcaaggucuuguuaauuaggagagggagcacauuaucaaagggaaguguggcuguuucuguucugucucuuuucuuccuucaacccaaagguauaaaauuagggaaguuagucagaaacgcaaggaggagguaggaauugugggauuuaaaggucccccucuuccagaaggugauugcuguuaaaagaugcuagauuguuuguaaagugugaauccucaacagucccccuagguauguaauucugguaccacaccaguguagagcaagcuggaguuccuaaacuuccauagaugagaagaggguggucaugaaugugugucuuccaccagaacaccgugcuucagaaacauuauuauggugaaauauaccuaacaaaauuuuaccauuguaaccauuuuaaaguacauaguucaguggcauuaagugcauucacguugugguacaaccaucgccaccauccaucuccagaacuuuuucaucauccugaacugaagcuuuauaccuauuaauauauauaauaacuguacauucuccccucccccagcuucugguagccaccagucuccuuucugucucaaugaauuugaauauucuagguaucccauauaaguggagucauaugauguuugcggguuuuuuuuuaguguaugucugguuuauuucacuuagcaugauaucuucaaguuugauccauuuuguagcauguaugagaauuuccuucuccugggcauacacuucaggacugucagcauccuuagcucugcacucagagccccucucuaggauuaacucccagcaccagaugcccauucagacaaccuuguuucauuugcaccuuucugaagcaaacagcauaccugcucucgggucucuaugccauugcaaaagcuggucccuaugccugggauguucaugucaucagccugcugaauuccaucucauucuuaaggcuucccuugacuaucacugugacagggguugggggguguuuacuuggaucacagcaugugacaccaucaugaccaucaauucccuuaccucuucuucccacucccucuucagccugugaguaccuuaaaagcaaacucucccuugcucuugugucucccaaauagcugacaugaagucuggggguacagucugcuuuguugucucuaauacuucuccugaguuuuuuuguuuguuugagacagagucuaacucugucgcccaggcuggaguacaauggcgugaucucggcucacugcaaccuccgccuccuggguucaagcgauucucuugccucaguuucccaaguagcugaaacuacagacaugggccaccacaccugucuaauuuuuauguuuuuacuagagacgggguuucaccauauuggccaggcuggucucgaacuccugaccucaggugaucuacccgccucagccucccaaagugcugggauuauaggcgugagccacugccccaggccaguucuccugaguuuuaagaagaggugggcagccugcuagacaaaggccagacaagacagaauccuccuccacuuuugacguaagaaagagaacaucugugaccaugcagagucaucaucuggcuccaugccccuuucucagcuccuccccggguggaauuguacaugcuggguucagccuaugggaggaggaaggguuuccucgaggacacaggaacagcaugucucugaugccagaucccugcucugggggcgcucaucuguggccucaagagauguauggcuucugugccuagugcagaguugggauugauugcucaguuuaaauggaaaauuguuccaaaagcagcagcugccucuccagcccugaaugagaagaauguaucuuucucugaguccaaaaauauauauauauauauauuauguagcacauacuauguucagggcauccuuugaggggaagguuugaaaugaggcccuugaaaugaggccccauucuucccuucagggaagaucuaaucucaaagggaagcuggguaaaugcacagaauucauggcugugaguccccuaauugaguggcaguuguaaagccuggggaaugcugccacuuugauuugcacauuggcaccuacuaugcuucaggacucuggggugucagggauuggcaugauaauuuguccaauacaaacuauguggugcuuugucuaauagaacagaacauagaacauucugagagcaaaguugucagauccaucauuuauuaagcauuaguaagugagagaaaagaagggaaacugauugcaagugacaggaaucaagagaugauuccugaaaugacacagucgcagcacgacaaggaauccugaaagccugggauggccacucaccuaacccaagucaucagguagccugugcacagacuccccagugacggggaacucgcuaccucucaugacagcuuguugugucuacaaagaguucuggcuuuugaaaguucuucauauucagcccaaaaucuccucuuguaacuucucccuuuguucuggguuuuaccccucaccaugcagaauaaaucucucuucccagcaucacccuucagaugugugaggcaucuauaaugggcccugugagccuuuucuucuuccagggaaacgagcccagucucugccucccuucuagggguagggaugacacaugagcugggcagaggauuaguaaagcccauuuggauccucucaucucuacuacgauaaugguauuagcaguagcuccagacagaaaccuggcauuccccugcaaaccugacaguucaaagccucagcuucacccagccucugcagaggcuacaggauggaugucugcucuagcaggccgcucuauuccacuaaucgugguccuguccugagcacaggucuccucugcucacugugggacacagggagaggacaggacaguagauagacaagcuguugaagcugcaugccuguucagugcucacgagacuguguaauacgagcucuuuaggaauccucuguguguugagcggcuuuaacuuucaguacugaggaguuagagauguaguugccuccucauaccugaugccccuggccauggcuugagguuaccaccuuugccaccuggagguugucaccuuugcccuguugcuguauccaaaugaggauagaugcuauacacuuuagcaauacagugcuugccugcgaauaugauuaguugugcuuucaaaugccacuugugguuuucaaaaucauugucuauuuaagguauuauguuuuguuaacuacuauguuauuuuuuuuaaaugugaguaucuuauagcaacugugagacuaaugcuuccuaugaaauauuucauuuuauagucacagcaaccccgugaguugguguuacgcaucuugaaccaaugcgggaacuaaagcuuagagagagaaauucaucugaucuauuucacacggcuuaguaaugaguagaacugggauuugaaaccagccugccagucucuaaugucugaacuuuuagucaauauccuuuuuaaaaaagauauauuuccaauggcucacgccuguaaucccaguaccuugggaggccgaggcggguggaucaccugaggucaggaguuugagaccagccuggccgacguggugaaacccugucucuacuaaaaauacaaaaauuagccggggauggcggugggcaccuguaaccccagcuacucggaaggcugaggcaggagaauugcuugaacccgggaggcggagguugcagugagcugagauugcgccacugcacugcagccugggcaacagagcaagacucugucuaaaaauaaauaaauaaaaauucacccauuuguaguguauaguucaugggauuuuaguauauucagagaugugaaccucaccacaauccaacuuuaaaguuuucaacucucccuaaagaaauccugcauccauuagcagccaguccucauuuucccauuaccgcugcccuaggcagcuacuaaucuacucucugucucugcagaacugcccauuguaagcacuuccuguaaaaguaauaauauacaacauguggccuuuuucuguuuggugucuuugacuuagcaugacauuuucaagguuuguccacaucauaccauguauggaauuccuuuuuaugccacaauaauauuccaugguauggcuaaaccacauuuuguuuauccauucaucgguucgacugacauuuagguagguuguucucaugguuuuuguuuuguuuuguuuuguuuuuugguguuuuuguuuuuguuuuuguuuuuugagacagagucuugcucugucgcccaggcuagagugcagugaugcgaucuuggcucacugcaaccuccaccucccggguucaagcaauuuuccugccucagccuccugaguagcugggauuacaggcacccacgaccgcacccagcuaauuuuuguauuuuuaguagagacgugguuucaccauauuggccaggcuggucucaaacuccugaccucgugauccacccgccucggccucccaaagugcuuaauuauugugaauaaugcugcuauaaacacucacauaaaaguuuuugcauggauguguguuuucauucuccugguacauauguaccuagaacggaauugcuggucauaugguaacucuguguuuaguauuuuaaggaacuccucgggugccuguaaucccagcuacucgggaggcugaggcaggaaaauugcuugaacccggaaggcggagguugcagugagccgagaucgcaccacugcacuccaaccugggcaacagagcaagacuccaucucaaacaaaaaaaaaaacaaaaaaaaaaaaaaaaggggaacuccuaaaccauuuuccaaggcaacuggaccauuucuuggccacuguucuucacugcauuuuugaguaaagaaaucacgucuuugguguugcggauaaccuuucccacaucccuuuuauucuaguucagcaacucaucuggugguuuuggaccuccuugcacaaaacagccaugcuguagaguuucugaagcauaccugauucgaaccucaaccugaacucaccaccucagugaccuuggguuuuucagcuauucuuucuuucuguaucagacaaaugaauggaugugaggauucaaugagauaugauguguaaaagccugguacgaggccuagagcauagcagggacucuuucauucacccagcacuugugcuucaauuucugcugugcaccguaaaagcauguggcuugggaggcugaggugggcagaucacgaggucaagagaucgagaccauccuggccaacguggugaaaccuugucucuacuaaaaacacaaaaauuagccaggcgugguggcaggcgccuguagucccagcuacuugggaggcugagguaggaggauggcguggacccuggaggcggagcuugcagugagccgagaucacgccacugcacuccagccuggguggcagagccagacucugucucaaaaaaaaagcacguggcaggauaugcaggauacgcagagguggguggcaccuauacaacauuauauuuggaggcuggagaaaggcaggccuccacuccuucuugccuguugaacuucaccgcucccugcaugccugcuccgugguucacuuucugcagacacccucaugucccuucuuuucagagcaaauaauucucccuccgucucuggcccuuuacaccugcucuuccuucguacuggaacuuucuuuccucuguuuccuaggcgaccaucccacccuugcuugacugaucucugcauguuuuuccaaccucagcucaccgccgcugucacugccuggggagugugucaccuguccagauagguuccuacaguuuuuuuuuuuuuuuuaagauggggucucacucugccauccaggcuggagugcaguggugcaaucucggcucacugcagccuccgccuccuggguucaagggauucuccugccucagccuccugaguagcuggaacuacaggcgccugccagcaugcccggcuaauuuuuuguguuuuuaauagagagaugggguuucaccacguugaccaggcuagucucaaacuccugaccucaggugaucugcccgccucagccucccaaagugcugggauuacaagcgugagccaucaugcccacccaguuccuccuacuuuguaccuccacaagcaccuguguuuccccuucauagcacaugguugucauuuuacacugaagugcauuugcaugacuguguagcuaacguccaugucacccacuagacuauaagccguugaaaaucacuugcuuugggcucgaaggacggcaucacccacaucaugccugggugaguggagagucauaguccaggccgccugccgccccaucuggaugccaggccuggcguucaauucaaauaaguguugauggacagccaggugguaagcagguugagauuaagaacgacuuggaucauuuccuaacaauuccaagaaagaaacccagagcacauugagaucagaaucgagggcugccagugggcaguuucagggaaaccagcccaucucccacucuauauucaaguuaauuaauccucccucaucuccauccuccucuccccuguggccaccgccagcuacugaucaucgcagguguaaguguccagauucaugcccccuagggccuggcuccuuuugcagcaaacacagaggcgaucucccauccucuccccaagucagcgucuucuguuuccugcuccuguuuuugugaggagcagccccuuuccccagccccucugccgcucacugccuuugaaguauacauaauaaacuuuuacagauggugacaagaaaagcuacauuagcuucgucccuuacuuggagaguggcucuaauccacucuccuucugaguaugacucuuuaauguaccauuucaauucuuucccucucaaauacagcccuggagcuucuuugaagugucacccuccacccuccgucuuugauuccuccuuaggguguucuaaucauggaggguccuaggcuguccaggaagccuuccaugggcgcccgcaccuccacccagucucuaaacccuuuucacuggucucauaaugauaguugucccucuccccugagcuagcaccuaugcugggagugaaugaucuucuauuucuucuggggcuagcaauccuuccuguaguuuagcugugaauuuccauuaagccacuuguuuggaugggcuucugugaaagccacuguugaaguaaugaugauaaugauccauuccauuuauugauaaugccacucauuagauuaauggcuuccuguguacugccuuauuuaaucucccaacaaucauguaagcaaaggugcuuucaucauccccauuuuauggaugaggacacaaagacuuagagugguuaaguaguuugccugaagucaaagagucaccaaagagugauucugcaguuagagucaggcagagggaugcuccacugugcccuuacccacguuguaaaccaggaagcuaugagaccaauuuuucuuuaacaaauucacuagaauuuuuauauccaaauagucuccugcgggagauuccacacuuuaaugauguuuuucuuuugcuuuaauugucaacaucaugguccucaaagaguguuuguaccuauaauugaacagguaagauuaggaguuuucgaagauugagauaaaguaagugccuugcuaauuccuuugcugccugaagauguuccaaagcuuaaauugaauggucuuuugagaaaaucaucucccacuuagcaccuaacuguuggcaaagcagcgugcuaaucaugggggauucaaaggugaauuagacccacuuccuacuuugagaggcuuuuauguguaaaagaaaaaagaaacauagaagcagacuuacauauuaucuuauagauguacaugauacauauauuucaauguauacaugguaucuuuaugauauaaaauuacauauuuuaguccagucguggugacucacgccuuguaaucccagcacuuugggaggccgaggcaggcagaucaccugaggucaggaguucgagaccagccugaccaauguggugaaaccccgucucuacuaaaaauacaaaauguagccaaacauggugucccgcgccuguaaucccagcuacucaggagauugaggcaggagagucgcuugaaccugggaggcggagguugcagugagccgagauugcaccauugcacucuagccuggguggacagagcgagacuucaucucaaaaaagaaaaaauuuacauguuuuaucuuuacauaucuaauaccuauuacaacacauaauugcguaagaugcuguaggaacugacagaggagcuuaggacuccucaugccuauaagucaauaaaaucucuaccauauugaguuaaauaaugaaggaauggauugcuucauuuaacugaaaaaacagagauaggacaggugucacgggacccuggcucacuucuccaagguucucucauccguguccucgggcuggcuccccuuuugguaguggaugauuuccaucugccccuggggcugcaggcuuccacuuuucauuucucagagaggaagaguccugugcugcaccaugaucgugccaucucaggucacaugcccauuccuuaaccaaucguuauaacuaaauaaguggauaauugccaucugccuuaguuagacagggcccauacuuugaacagggaugaggucagucccaucuaaaccgaacggcugccacaaaaugagagaagagaguaggaaauaggaggaagcuguaagcacuagccgacuauaggcaccuuccuuuggcgaauccuguucagggcagaaagcccugggcuuggguuccacucugacccuagaguccacccugcuacuaagcacagccucaagguguggaagguaguggguaaacugcagugucaaagaggcugcuccagaugucugucaucccaaaaguuauauacacaauugccuuuaaagccacaagagucucuguuuuauacuguuuuauuucaauuuuuuuuuaaauuuuuuguuuauuuauguauuuauuuuuuugagacggaaucucccucuguuccccaggcuggagugcaguggcgcgaucucggcucacugcaaccuccgccuccuggauucauaccauucuccugccucagcuucccaaguagcugggacuacaggucccccgccaccacucccggcuaauuuuuuguauuuuuaguagagaugggguuucacccuguuagccaggguggucucgaucuccugaccucgugauccgcccaccucggccucccaaagugcugggauuacaggugugagcccccgcgccuggccuguuuuauuuuuuauaaagaacacgcccugcuauccucuguuaguacuuaucuuauuuacaugauuuggaagugcaugggaauguuggcuuguucugaaaauuaaaucagcucugaaagggaaagauaugccaacccuuagguguuuagaagaguauguuguaggaucugagugcaguuccaagacauucggcugccgcaguggugauuuuaacaauagcagcaucguuaauauauguauccagccuccuugaugacuguucuggagaagaagauguucuaaucacagcuugcuuuuuccuaccaagucauucuaaaaaguuguagagauuauuuuaagagaacagcccugccugaaggacuguuacuguuauuugaggcuaaaggaaaucuugcaauuugcaaaaaaaguuaaaucugaacccuccccuccaccgugggggccagggacaaggcacaauuccauuuccaccccccagcuuucuuauuggaaaaauaaacaccccugccagacacaguggcucacaccuguaaucccagcauuuugggaggccgagguggauggaucacuugaggccaggaacucgagaccagccuaaccaacaugccgaaaccccgucucuacuaaaaauacaaaaaaauuagcugagcaugguguuacacgucuguaaucacagcuacucgggaggcugaggcacgagaaucgcuugaacguaggaggcggagguugcagugagccgagaugauaccacugcauuccagccuaagcgacagagcaagacugucucaaaaauaaacaaacaaacaaauaaauaaaugaaaaguaagcacucuguaacucuugcuuuguacaguguagaugaacugagaugaaguacgcaaaggcucuucuaaaccacuaagaugccaguaauauaugauuguuaucguuagcaucaguuacuuauaugaacuacagauauuuagcaguguuaggaaaaaguuagaaguaauuaauaauauauugaugccuucuucuagaagaagaguuacuguccuuuauugaacauauacuggacacuuuguauguuuugucacaucgaaaaauugacaagaaugcagcccuaagcuucuggcagugaucuuaugugaaugaucucuacugaagcacaagacucuuuuuagacacugugcagaauaauuaugauagcugauauuuacauagcccuuacucugggccagucaccagaaggcaggcauuguuauuuuugucccuaguuuauagugaugaaacugagacauggaguggucauuucauuugccuaagaaaauagcaggcuggguuuguuggcucacaccuguaaucccagcacuuugggaggccaagguggguggaucacuugaggugaggaguuugagaccagccuugccaacuuagugaaacccuaucuguacuaaaaauacaaaaaugagccaggcauaguggcaugcacuuguagucccagcuguuugggagacugaggcaggagguucgcuugaaccagggagucagagguugcagugagccaagauugcaccacuguacuccacauccugggugacagagugagacuccgucuccaagaaaaaaaaaaaaaaaagaaaagaaaagaaaauagcagaacuaguuuccaacuucccugagucuggaauuugugucccuacauauacugccuuuccaaguaucagauuucuucagaaagagccuauuuuuaugaacaagaucccaaacaaaaauaaacagaaagcaaaaauaaaaugaaaaagauaaaccaaacaauguugaauuuauuauuuacuuccugauaggcaagagaacagaugcccauguaaaaauuuacugagugcaucacaaagagaaaaauuaggaguuuuuaagugcagaagugggauaaaagagguggaaugagagauagagucugaaaacuguuuucugggcaggaccuaaugaguucauagauuuguacaaaguuguugaaaacgauagcguaguucauuggccggaaaagaagaguguuucuuuaguccugucgugguccauucaggcugcuaacaacauagcguaaacagaacgggucauaaacagaaauuuauuucucacaguucuggaggcugggaaguucaaguugcuggcagacucagcuuggugucuuggugauugcccuuuuccugguucuuggauuacccuucuugcuguguccuuacuugguagaagaggcaggguagcucucugugccucuuuuauaagggcauuaaucucacuaaugaggacuucgcccucaugauauuaucacucaccgugaugguuaagauugagugucaacuugauuggauugaagaauggaaaguguuguuccugggugugucuaugaggguguugccaaaggagauuaacauuugagucaguggacuaggaaagacagacccacccucaaucuggguggggacaaucuaaucagcugccagcacggccggaauaaaagcaggcagaagaacguggaaagacuagacuaguuuagucuucuggccuccaucuuucuccuaugcuggaugcuuccugcccuccaacauuggacuccaaguucuucagcuuugggacucggacuggcuuccuugcaccucagcuuauagauggccuauugugggaccucaacuugugauugugugagucaguacuccuuaauaacuucccuuuauagaagcaucuauccuauuaguucugucccucuagagaauccugacuaauacacucacagagguaccacuuccuaauaccaccacacugaggacuagauuucaacauaggaguuuggaggaacacagacccucagaccacagcagauccaguuagagucuaccgugaucaugaccccuuuauggcuucagcuguuucaaagcaguagcauugaaauacaaacuuuaguuuuuuuguuuuguucuguuuuguuucguuuuugagacagagucucacucugacucaggcuggagugcaguggugugaucucggcucacugcaaccuccgccucccagguucaagcaauucuccugccucagccucccgaguagcugggauuacaggcacaugccaccacgcccagcuaauuuuuguauuuuuaguagagacaggauuucaccaugucugucaggcuggucucgaacuccugaccuugugaucagcccgccugggccucccaaagugcugggauuacaggugugagccaccacgcccagccaaacuuuaguuuugcucuguccugggcaagugcuacaggggauggaaaacuuguuuuuacacuauauagcaugcacugcauaaggcgaccaaggcagucaagggcuugggagagcguaaauaagcaagacaauucagauagcggucagugcuaugaaagauguaagacugcaacacgauggagacucaaaggaaaguucaaaggaugagaagcuuccgccaagagaagaugcuguggaaguguucuaagcagagggaaggcagaugcaaaggagagagccugugauguuugauggagagaaaggaggccucuguguguccgggggguggggguguggguggggaagagaguguuaggcaguggaaucauguucacgugggccuugcugaugaauugcagggagagaauagagggaacgaggaaaucagccacaguuccagacugggauagcauuacugaguggaguguggcucuccccuugagcccuagggugcaguuaucugcauagaggcagcgccaagagaggacagagacuugaggagaguugccugcccucucccagauuugcccugugaucccagagagccgauuaucuuucuucacugugauuuugcagaaccugcaggcaguuuggaaacagcacuggcaaaggagaaaacgagacucagauuucucauccuagcugugacagagaugccaaguaaccuaguggcuuugugcaaguccuuuaaucucacagaaccucauguuucucaucugcaaaaugaguguaagauuaguuaagcugccuaccuguuaggguaguugugaauaucaguugggaaaauuggugggaaaagagcuuggaaccauuuaaaauauacagauuugugaggaaucaaugcuauggaucuaaccaauuaaaauagaauaugguggcaugauagcuaaucuuuuaauggaaucauugucauuuucuucuaccauuuugagcacuaacuguguuaaacaccguacugagcacuuccacauacauuaaucuuuguuauauuuuagaagcagcucagucacuuuauucauuuacguaagcugucaaguagcauuuaaccaagggaaacguccucaguuaaucuucacaacagcacacacaagccaucuccauuuuauggguagggaaacugaggcacaucaguucaauucauugcccaggacccaauaaccuauaaguggaaaaauuccagauccacagccagggcuuuuuggcuucagagcucaucaaagaccauaugcaaagcuuucucucagcacagcuuuauacagcuguugagcaucaaugcugucuauaaauuaguguucaaacuuggcaucugugcugaagagcuuaaaaguuaauuucucguauuuguccuuggaccuguguuagccacggagugggcaucgccuugcacaaaguagcaccuuuuaaaugagagccuucacuagagauugagcaacugcugcguacuuugcaaauagaaagugucuugugacugccacccaguuggaagauguagagcccuugucagcaccuggguuuggagggucucuuaauuaugucaggagucugggcacacugauauuuauuagcucuauacuaugcagauguggaccacagaggcuggguaccuggagucauuguuuaaaauaaaggaucuugagugcagcuguguggcugugaaucccagccccaagacaucccaacuaggucaccuuggaaaagugguucaaucccucugucugcaguuuccucaucugcaaaauggguaugaucauacugccuacuucauaggguugcugcuguuguggggguggguguugauuuggaacuauccacauaaauaaagcauauugcccaguacuuggaccagcacucagacuuggcugucaucaccauuagguugaaccauuuuaucaccuccacaaaugucagauguagacacauuaaaaaauuccaugcucaggccgggcacgguggcucacaccuguaaucccagcacuuugggaggccgaggugggaggaucaccugaggucaggaguucaagaccagccuggccaacauggugaaaccccgucucuacuaaaaauacaaaaauuagcuggacauaguggcgcgcgccuguaaucccagcugcuagggaggcugaggcaggagaaucacuugaacccgggaggugaagguugcagcgagccgagaucgcaccacugcacuccagccugggcgacagagcaagacuaugucucaaaaaaaaaaaaaaaaaaaaaaaaggccaccaugcuuguagagcuauccauuuggauagagaugguuuuagcaggaaggaauuugaaagaggacccucgaguuaugugccagagcacugcuacucuucucacuuacacaggcauuaaacacaauuuugaauuuaaugggauacucugauaauuucucuuuuguccugaaaauggauuguuagagaggaagcaucacagcagaguauguugccuuucaaaacagggugcgcauugcccacccgccgcccgcauuucccuccucccucccuguggagauucagcuuuuaucagauacuguucaaagcccccaggacaaggacaggacguccuuucauaugaaaguaauuuaaaacauguuuuguuuuguuuuguuuucaguuagcacacaaccauauuaugagguaaaauuuaaaaugugcacaauugauuaaaaauugagacuucaaagaaaucacucgcucauuggcaggcuaauuugggcuguauauucguucucaagggcucuuaggaauuguguaagugaaagaauuugcaaagcucccggagcuugcagccugugccuucagacacagcagcacggaguccccacucugcuuccuguuuacugugcaacuggaguuuguuacuuagaggcuuaguuuccucugcugaaaaucaagauagcacuuuccauuucaaaggguuugaggggacaaaggagauucacagauguaaagggaaaguguggugcccaggaggugguuugcacccaguguaguccccccacuccuuugccuucacuugaaagacgcaaaagugucacuggcaauguugugcacagagcagacgucagagaaucaagaugggccugcuuccugccauggacuuuggacccugcagccccagcuucuugcucuuugugccucucagcuauaggggcuuaaucugggagcuuggagugucaccaugccucccuugcaucucccucagugaugcauuggcucaucugucaccugccaguggccgacaaggccccaucagucuugcuguuaccuauuuaucuaccugcuuuuucuucuuucugucaucacucauuuaguaauucaacacuauucuggcacccacucuguucagaacacugccacugauacuuuuguaucuuucuauuuugaaauauuccaugaaacucuucuuaccauuuguggagccauaaggccacaucaaggggucggccuuucaucucagcaaaaauuuugcauuucagcugccucgggaaugguuuucuuuccccucgaccuugucuuuauuucauaguaauuuagccacaucuugaauuccucgucuuuucuguuugaguuugacaguuuuauuuuguuucaacuaugcaauacuagccuucaagacugauaaauucauauuauuccaaagcuuuuaguaccuacccaauggugggcacaaaaauggggcuguaagaucgacuuaugauuaaguuccaauuucagauuaagugguuuauugucuaggcagagcuccuugugauuucuccuuuauaggcaaagagcugaggcucaggagaaauccaggcaaccaacauuuuaauuaaaaggaaguuuugagaagauucuuucaucuucagaauuuucucucaccuugaagugagcgucgagcauugucuuuuaaauuauugaaucugggcuggaugggauagcucaguugggaaaaugcguucaucuuuuuuaacuacuuuuaucagagguucugucugacccuccaugcauguggguauaaugaccccaaccucuuucuagcuguaugcaguuauauguaaaaccgcuuccugcucuuuccuacauaaaaauucuugcauuguauuuuuacauuauuacauguaguggguggccagcuaucaggaaacagcauuuuagugcccucgagcuuuuaaaaugucccuaaauuuggagguagacauagaacaacaauacuauuaacaauuccauauacuguguaccaacacugucauauuaagagauguauauccucucaacugcccugaaagcagcuuuguguuguccuaauuuuacaagagaagauccuuguaaacaaagaugugucuggcugagguggucucacagcaauugaaggggauguuugggucucaggcucagguuugucuggcugggcugcugaaauucuugccacuuucucucagagaacauguaggcaacaauaaagagaaaaacaggaguaagagagaagaguacccaggaaacuggcgacaaugguaggaagaggugaacaacagagaaaacucaagaaguggagcagcucugcagcucauggucaccggcgaagagcuacuaaagugucaguccuguggguuuugcagacaaagcaucuccaccauauuugaauguggagagugucagagaugauguaaagagucaguaacuaccucuaacuuggggcaaugccuucaaaugugaaccuucucuuuagugagccgggaagcuguaugggauucccagguacuauggcauccacuaucagauugaucugacucuaguuggagacuaaaaucagaagcguugcagcaguguacuggauaaugaauggagugauguaguuagaaaacaguuggccuacaaauaauucuauuuagaguaguaauaguaguuauagaaacaacacauguuuacugagccguuuucauguucuuggcacugggcuaaacacuuuacaugcacuauuucauuuaaauugcacuauuucauuaaaauaacaucucaguccuuugugagagacgaaugagguggaaagaaaauaaggacaaaaugacagggauuccucuuuauucucugguagggaagcggggcaagguucaugguugauguuccauggagcuucuggcgugaauaaaugaagauggauaagacgcagucccagcccuuuaguaaugugaacuugguaggaauaacuuacccgaauauauaaauaugauguaauauugcaugaugcagauuaaucaaguuauuuauaauuuacaaugauccaguugagggagcaaguaauuaugccuaagcagagccccccuagcuccagagggaaagugcuucuggagucaggaguuggaaaaggaggagaaaguggccagggauacaaggcggggaaaccguguucuagcaaaacaguaagaugugcaugugaagucacugccuucccugggacaggcacccucuuuagagacagcaacaccacccagcccagccccaucuacgcuuguucauguccacuuagcacuuccauucaucugagcgccugcagugugguguuugcuucuuguuucucucugccacuaggaugucagcucccucaagccagggcuuuguuuuguucauuguuucuauuaguucgcuuucaugcugcugauaacgacacacccgagacuggguaguuuauaaagaaaaagaggguuuaauggacucacaguuccacauggcuggggaggccucacaaucauggcagaaggggaaaggcacaucuuacaugguggcaaacaagacagaaugagagccaagugaaaggggaaaccuguuauaaaaccaucagaucuggugagauuuauucacuaccacaggaacaguaugggggaaaccaccuccaugauucaguuaucuccuacugggucccuccuacaacacauaaaaauuaugggagcuacaauucaagaugagauuuggauggggacacagccagaccauaucauuguccucaccccagugcucagaacacugcccugcgcauagugaaguguucaauaaaaauuucuugaaugaaugauugacaguuugaaaagaccugggaagguaacaucuaaauauaaagaaaguugcccucuucccucucccuccacgaccacacauuuugugaucuucguagcaccuaucaccauuugucauuauguaucuuaaauauuuacuuuucugcugccuguuuucuccugcuacaguauaagcuccacgaggauaggcaucugacuuugcauucucuugucuucaccucuguagccucagcaccuagcaucauauguagacauggaagcacuuaauaaacauuuguugaaugaaugaaugaccaaaugagacuacugcugguggacugagcagagaggaggaggugguaaacuacaguuagguugugaaggggaucauaugucaugacaaagacuuugauagguacuccagggaaaggagugcuuugugaaguuuuucaaguuggguguugugauuacauuugcacuucgcaaggagcauuugguguggccccagggagauuuagagagguagguuaugucuagaaugaugacugcuugcaucuuggaauauuacaaagcguuuccccagauuaugaugauuagcgcaugauuuauuuuugggaaacucuuccuuaagugcuagguuaucagaauuaguauugucagggcaaaugauaguaggugagccauuuggcuuaagggaauggauucuguaugacuuuuuaaugucuuuauuuuuaucuuuacuuauuaguaaaauauaauacuucugaauggugcugaacuguuaguaaccauagcuacuaaagcuguccuguaaaaccauccaaauaccccagaaaguacuuguuaagacagccccaaaaugagaacagccucacucuguuaaccaugaaaaauuauugaaaacaugccaacauuuuauuuuacaaaccuccauggaauugacucucuugcccuguuguucacuuuucucuuauuucuccucccaugucuuauuuuccaucccuaagcucuguccaacauaacuuucuggacugauggaaauguuuuacaucugcacucuuugguaugguaaccacuaccauguggucacugagcacaggagaugugccuggcaugaauaaagaacugaguuuuaauuuaauccgaguuugauuaauuauuuaaauuuaaauugccacauguggcuaguggcuacuguguucaacaagcacaauucuagacauuuggaagucaacgguguuugaaauuucaccaaguccuuugggcaccagcaaaguguuugaccccagaacuauagaaaaccucuuuucugggaaacaaauggcaaaauuccuccccaguacuuuuacucugaggcuaacaugaguagcacaauugaauuaaauaagauugugguugauaagcugcuucacacacugccuggcuucuaguuaaugcuuaauaaaugauaacaauuauuuaauauucauggcaggcuuaaagggagauaacaugaucuccacuuugcagauagggaaacagaagcucagaguuucaacaucaagugcccaagaggucuugccgucagugagcagcagaacagagcuuccuugcccaugucggugugugcuuuccaguacaccaggccaagaagcagucuuauuuucuagauuucagugaguuuuauccucuuacucagcuaaaggaggccaucucaacaacagcacaggcucugcauccuuuguggcagguucuucgucuuucuugaucaguaagucuacugacccugcgagauggauaggcacuuucucugauuacccagcuuggcagcuggaggaaaugccuuuacaacugaagggcucuccaaagguccugccuugagaaacucaugagccagaaaagcaagcagaggaguagauacuggggagaaggaccuuaggcugcugucaagaaacccguuagacugaugccaaucagaacaagaggaauuggugauuuucaucaccaacauggaguggagaucagggaauucagcagaccugugaugaggacaggaagcagcuuuccaacuccugaugcuagugaauugcaucugucucaccaguuugaauagacucuuuaucccgauugccugaaucagugucuuguugaugguacaggcucaguaauuauccgucagauggaugaacaggugaaugaaugaauaauuugauaagcauaaguuuacuguugcccugaagcacauuccuucuuaagggguuuguuggggcgggaagcuugcuccugcaagcuugcagcaauccaaaagggcuagagaauagacuuaggcugcagucacucauccagagcgaauguaaaaaggaauauuuguguccgcaauuuggaucuagccuuuugauaaaagucacagaauuacaauaagagcacaguuauauaacccaguaaacagauuugauagagaccuagauauauucuucuaaauguguugcagaaguuucagccucagauuucugaggauucugcaaucuucaagccaaguuugggggaugagagccggagacacucaugcagguccccucucuccaucagagggacauggagaaagcaccaggagucaaugaagaugacuagaucaacaguggauuguguaauucccauuggauucaugaagugugacaguugccaaagcgguauuuaaauaagauuuagaugaauucugugaaaauuaacuccccugccuuuuggugcucuuuuuuucucuuucucucugaaguugcaguuaauuuccccaauggauuuccucagucuuucccuggugugcgcucuccucucucucucucucugucucucucucugucucuucuguuuaguccugcugacucugccaugccauuuuaggugcuuuccaugcuugauguugaugcucuguuugagauuccugugcugauuagccaauugauaaacuuaaugagaaagcaaaagcacuuuguaaacugucaaguccugcaccaguggaaggagggauaggugaucagauucugcuuuccguggcuuuggucuagagccccaggaacuucaugcugucuucucuguagaggcuguaugaucucuucgaacaaagagauggaagcgccuucaggcaccacccacacccagcccucucauuucuaucagugugaaacugaggcucagagugggcaagccacaugcccuggaucacccagagaguuagcagcagagcugacacgagagccaagucucagaauaucuuuccucuucuuccccuuugcuggcagaagugccagggagcacaucugcaaggccauuguccugagcgaugguccuugucucuaagaguuauuuacuguugugaaagagaagcaccugcucuucuugagauaaucagggcguauguaucccugggccucagagguguagcagcaaacaaaacagacaaaaauuucugcccaccuggagcuuauauucuccccuggggaaauacauaaauguauauauaguaugucagauggugauaagagccaugguggaaaauaaagcugaguaagugcgguugagagugugaggggagaggugauacuguguuaaauaggggguguggaucagaguagccucacggauaauguggcauuggaacugaugguugaauuugggggaugaucuaacuuggaaccuaauuugguagaaaucaggacaagaguuuaaaaaacaacgucuaagugacagaaagucauggaauauucacuaaaauguuaaccaucccaaucucuaguuaaugggauuacaguuauuucuaguuugcauauuuuuauuuccuaaauuuccugcaaggaauauguauuccuuuuuuuauuuaaaaaaaugaacuccccagcacuuugggaggccgaggggguggcagaucaccugaggucgguaguucaagaccagccugaccaacauggugaaacccggucucuacuaaaaauacaaaaauuagcugggugugguggcccgugccuguaaucccagcuacucgggaggcuggggcaggagaauuauuugaaccugggaggcagagguugcagugagcccagaucgugccacugcacuccagccugggcgacagagcaagacucugucucaaaaaaaaaaaaagacucagaccggacgcgguggcucaugccuguaguccuagcacuuugggaggccaaggcaggcacauugccugagcuaaggaguucgagacuagccuggcuaacauagcaaaacccagucucuacuaaaaauacaaaaaauuagccgggcgugguggugggaaccuguaaucccagcuacucaggaggcugaggcaggagaaucucuugaacccugaaguuggagguugcagugagccaagaucgugccacugcauuccagccugggcaacagagcgagacucugucucaaaaaaaaaaaaaaaaaaccaccucauuauuuacuuugggugaguggauaucacucuaggacaauaagugacaauagugacaauuguggcaauagugucacaaaaaugacaauaaggaagaauggguaagagaggucagaggaugugaagaggaagagaagcugaacaggaauaaccagaccgggggcauggcuuuaguccugaugcugcaccuguuggcggaugggcgcaaaacaguuuggaggagacaaaguaaaagcaaccauuaauugacucuuaacuuaaagucagcaaggcaguagaacccagcgcucuccugucguggaagcaccucugucauggaggccagaauucuaguuuugaagcucugaucuccagaaagagucacagcccuucaaagccuucuugcaaacuguucuguaacauagcucucacuuuaagaugcagaaacucuaagaagaugggaaaagaggaaauugaucauccuuuaacauuuguuuuccagaaacauuauucucuuuccaaguaugauucacaguaagauuuauuggauaaguccuguugcugcauuuaaaucaugaugacauugguuuuagaauaagaaagauucuuauauaaucauuacauugaaacuccucaagguuagagaucuggcucauuuuucuuugaaucacccauagcaccuagccccauaaauauugauuuuaucaagaaagauugugugaugaagugagaggaacauuagaacuguagcugacgaauuuuuuaaacccaggaacaucaaacucuuccccaaggugucuguugucccaggcucuuuguguauuuggugaggugcagcuuuagaaggugucacguguacagcccggguagauaaauguauuuguagcaaugaggcccgugucgcggcuuuucacuguccgcaccccguaugcucaaggauucccagaaagucuaaacuuccggccgucaaggucacgcaucucaccuuccaaaggaugguguugaccgccucugcugccaggccaugcccagcagcaggcugaugagaugcauggggaacaggggccuuggggaacaggauucuccacccuagcaugccacuccuuccagaucuccaauucuuucaucccuguuucuguagaaaauucuacaagccaguggcccacuuuccugccuccaucaguuuaacagagugaagauaauuuaaucguccuuuaacgaggcaggaucuucagugcccugugguuauaauuaagagcaucagcgaucauuacuagcauucauuaaugcagcccgaccccuccuauuucguuccccuuggcuacuuccuugcccacacucaccuguuucuuuccuuaaaugccuagagcugcuguuugaccaucuuuaaccugccucuucacugcccuugcucuuuuaccucuguccuuucugucccuaucuguucaccaucacccucucaguccucuggacaugggaacucaauagcuaauuuugcaugacacuaccucugcccccaauaucaguguguuuccaagcuuugguggacugaugguugcaaggggaagcauuuccauuaauaaaaugaaaucuuggaucuccagaguggcucuggaaguaaaaauaccuuccucucuaagagagagagcuggaugaaagcccguauugggguccucugaauaugaccuucucuggugaggccugucugccgagccuccggaugaugcuauguaacccuuagugcugucacucaagugugaaccaaauggaaggcgggccagccaagacuuuugaaaagauugaaauuuuacaaguagaaaggagguggaagaaaacgauaauaguaaacagaacacaagacacauaacuacaaccuaaugaagauacacggcagagguuuccggagcuacauugguugguuugcuuccaggccacguaaguccuguccaucccgcaugcaaucucugcuuuccugauuucccagcaucagguagagaaggugccauuuguacccccaccuuccuggagcugccucaagugcucaaacucuugacauuuccaggaacuauggagccagcuuuccauuuugcuucccaacaccucaauagggacaagagucuuuucuuuaaauagggugccuacagucaauaauaauuucauuguacauuuuuaaauaacugaaagaguauuauuggauuguuugguguuuuuuuuuauuauuauacuuuaaguucugggguacaugugcagaacgugcagguuuguuacauagguggccaaaccauggccagaacgugccaugaugguuugcugcacccaucaacccgucaucuacauuuggcauuucuuguaaugcucucucuccccuagcccccaaccucccgacaggccccagugugugaugcucuuuuaacuugcagugagaccugccuuuaacaugcaggaaguaguuuuccaaauccagaaacugugagucccuugaggaucccuauuauguuuuguucaacccugagcccccaguuacuggaacaaggcucagcauagaacaccauggcuuaaugcccgauaaaugugugagaaauacaaaaacagaagaaaggaaaaaggaaagaggagaaaagcaugaauaacaacaccuugucuuugcuaauauuauagccaucaccgacccauugcaagagggauagagucuccgagagguuuuucuagguuaugaccuuucuugcaagucaacuuccaagacuccugcuuuugaccucaaaccaaauaauucuaccuaauuccugauucaaauuggucauaaaauguagcaaucauuuugauaacacuuaacaguucaagaagugcuuucaguuagauuuaagagcuaguuuguggaguacaguagauaugaugaugaugguaauaauaucugguagguagugagaaagcugaaaaucaaagaaguugaccuaacugucugguagguaggaaagaaggaaacucuaaugcagguuuccucacuacagauucuugacucugucugugaccuguaugucacucaaaauuuuauuguccuaaaugagguggccacugccugacuuuugcuaagagaacuggugccggucucuuuaugaccaauuuuuacaucaucugucaaccucuguuucaguuggcaguugcucuaacgggcaagguuuacccagggaauauccaccuugaauguuggcaguuguucuaacgggcaagguuuacccggggaauauccaccuugaaugaaaucucugcucauccaacagaaaaauuagugauauaccugccgugaauggugguguuucucuuaucugcuuuaguauggcuuuacugguacuguuugacaagaagacaaaugaaaaauucauagggugcaugagaagagguaacaaaacaccauuaaauuuuuguuugaaacaaacuauucuagaaaaaaugugcaccauagauuaaaaaucauggaucaguauuucgauauguaaaauguuccuacaaagcauuuaaaaaaauaauggcccacagacaugaauguucuccacugaagaaguaaacccaaauaagucauuuaacacauaaaaaaaacucuacuucacaaaguaaacaaaaaauugaaaaccaaagcaguaauuaaacacuggcagugcuuaaaaaaaaaaaaauguguguguacguguguguguguguguguguguguaucuauagugccaaugauaauaaagguaugaaaaauguaaauacuucuccuugcuggaagaaguauaaaucacuaaagcguuuuuuuuuugcagggcaauuuuaaaguauguaucuaaguuuuaaaauauguauauauuugacacagccauuucauuuccaggaaauuauaagagaugagaauagggagcuuuuaguauuauuuaugaugaggaaauuuugaaaacauaggcaacuuccaaaaacagauaaauuuaaauuuaaguuguuaaauuuugguauauccauacaauugaauaacauggaaaucauacauaaaauguggagugucgacaugaggaaauguuaauaacguauuuauagaacagcugcuaagaguaaguagguuauauaguaauucuaccguuauccuguuuuugucaaaauauaucuguauaucuaaacacauaauaaaagucuaagacugcauuauaaaauuaucucuaagugauaagauugcaaguaacuuacucuuuuuguguuuuuucaagugugcacauuuuaugaaaggaauuuuuuuuguuuuaucaucagaaauaaagauaaaaugcauccaaaguuauuggaaacaugaaauuugauuuacugagauuucauuuacaugcagcccuuggagaauauauacauuacuuaaagcagggccugguucuccucuacuggaagaaggcugcuuucuggaaaauacucccugggagcacaggaaccucuacggggcucaccuccccucccugggcagagaaccagagaaaugagcaggagauuauacccgcuugacuucuuguucuuauccuuuuugauuaaaaaauacaucaagacaugagauggauggaaaaacccauaaaaauuguuuuacugcaucauaaaaggcuuacauuucugacauuaggaucaugaagggauuaauugauacugucacucucuguauuucuagcagaacacacucuagcugggauggcgcagcccugcuccgaggucugcgugaagccguccagggugccuguuccuugcgccucgguugucauucacucucuguguucaguuuaggcaccguugcuuugaguagcuccuggggggcagggucagcgucuugauguagucacugaacuuuguacauugcuugaccgauaagaggcauucuugccgggcacagugguucacgccuguaaucccagcacuuugggagguggagacagucagaucaccugaggucaggaguucgagaccagccuggccaacauggugaaaccccaucucuaccaaaaauacaaaaauuagcugggugugguagugcacaccuguaaucccagauacucgagagacugaggcacgagaauugcuuaaaccugggacacagagguugcagugagcugagacugcaccacuguacuccagccugggcgacaaagugagacucugucucaaaaaaaaaaaaaaaaagucauuacuuuuguuaguaucccuugccccucauuuugauuuacauaaauauuaaaauauucuaguaauuguggggaacaaacagaucaggaaguaaucucagagcaauuugauuuguuggugaguaggaauuauuuacugcuaauuuuccaaauaguagcuuggcuuauucagucauucauccuuucauuuaagaaacauugauuuaguuucuguuauaugccaggcacuguucuaguccuguugacuguagaaauaacugacaaagucccuguuucuauggaguuuaucuucccauggaauugagaccagaucuuuccuuccuuucucccuucccuuucccucuuccuucuguuuguucauccaauaguccauccagucauccauucauuuuauccacccaucauuugcugaaugcucaucaggugccagaugcugugcuagguguuggaggauaccaauaaacaagaccauguuccuguucugaaagagcagagggucuaauaggggaaugggacaaugucagggcugucuaguaaaugcaacaucaggcauaaccccagggcagcaucaaggggugcaugggagaccucgccccccaguuggagagcaccuuucucuuggccacagaggaaguuggcaccugcuugcaggaggaaaguuggccucaggaauucaggcuuaaacaaaaaaggaugccacuugcuaccaggaacacucauaugaauggugagguuccuugggggaaaagcuguuguacaguaaaaauccuuggugucaacuacauguugagccaccugcuccauccugggggcuaaauggaaggucuaagucccccgguacccaacauccauguucuaggaaaucuguccacuggagaagauaguuagcgaugcccucucacaucuuuaagugccacaucagggacuuggacuaucccugcuacgggaacacaguggaacuaagagaagaaagaaagaaaugcuuauugagcaccuacuagauuccuccuaggcauugugccagaugcuuucaugugcuaucucauuuaauucacacagaaauccugugacaguucauuauguuuuuacagaugaagaaauugugguucagaggggcuaauugacuuggccaaggucacagguagcaaauagcaaaaggcaaaacugaguucccaaacaaaucuguuugaccucuucaucuuucugcaguuaggaaagcagcauggaggaaguuucgcccuuuggcucuuuauuugaaguucucucauggccauuauuucauccuacuuugcaaugcgguguuguuucccagacuauuuugcagaacacaagauguuaauagguguucuaggcaaaagagccuccauggcuaaauacauuggggagauugugggugaaacugguuuaagccuggagcuccuuuagccuucaguguacuuccauguguuuugaagcucaaagaagagacuauggcaggcacacaguggcucagggcacugguguccaguggaagcccguuuggaaaguauugcuuauuucccaagcauuugaugagcuucuucucugagaauggccccugugguccauguuauugcucccucuggacuggacugugagcagagauggggcccuauccuccucucucccagugcccauugaacuugacauaauuagagcuuaaucaaccuaugcgugggugagugaaauagggcucaccuuuaacccugaagagguagaggaaagagccauugaguuagaggagggcuuccaggaaaaggaaggaguuagaccugugacucagaugcaaauagagaugcugcccauuugagaaacguagaaagagguuugguuucagcagagggugaguauuuuagaucagcgacagucagggauccuuuauccaagcacuugggcuauuuuuacugcaaugaaauggaauuugcaggacaucgaaagacugauggugaccaaaggccuuaauucuccaucuguuaccgaugaauugcaaugcuuaguacuuuccugggucauagccauacugguucuaacccauugcuugaagguggaauuacucagcugagcucuaagaccuggcggagcucacuggcauuuuguggcgaacgugggggugcgugugugcauggcuggggggaguugugucuaaccacaggcaagcuuuggggguauucugaacgcuuuuacuacuuuucuuggacaugaaauuaaggucccaugaggacaggcaguuuucauuuaccuuauuuggaauacagauugacacauuuuucccugaucuuuuguugaacccaaaagaacaagcaagcauaguuucuaaacaaagagggacuuugacaaagcaucuuuagacggcauaauuaucaaguagaaacuuuuaacaaagaguucuuuagagauugaaaaauuccccauuccuuauaacugacagcaaacccuuucuuggaagggacccguuggccuggccuugcuuuugcugcagccuguaauuauagucacuugaucuccugauucaacuaagaaggaagaaaucuguacauaugaagugucagggucucucacgccccagguggggcuuuuucugagaacauuccucccagaauuucuugucaccaguggcacuuugaaaacuuagcggugagccgccacgcagcucugagcuguuucuuuuucaucucuuuggaaacuuuucccaggaaaguuauuucugugaccugagaaaagagcacugugacaggcucagaaggcuccccacuguccuucgauuccagcaauugucaccgagccgaagaaucgcagggcagcaccucaugacucacauccgagucaugucaccgaagcugcauguugcgugcaugaaaagguccugugugcacguucugcuaauguuaguuauccacacucugacaucgccguuugaguuucucugcuucugcccuccuugcuuaugaucuggucaugaauguauaccuuuggagagcaccuuuuggguguaguuaauaccuaguauucuuugggcuggggggcggggugcagugggauagggaagagaaccaaaaaggaaauguuacuucauuuaaaggacauaugaacccaaaguaucugagagcagucucaaucaauuuagaaaguuuauuuugccaagguuaaggacaugccuaugacacagccucaggaaguccugaagacaugugccccaggguggucaggagacagcuugcuuguauacauuuuacagagacgugaugcaucagucaauauguauaagaugugcauugguuugguccagaaaggagggacaagucgaaguaguaggcggagcuuccaggucauagguagauaagagacaaaggguugcauucuuuugagucuuugaucauccauucacugaacacacaauuuacagugagaagagugguggagaaauagucacuuuugccuuagucuggcucaaugaaucugcauuuuuacauaaauagggcagaggaagcaauccagguaugcguuugucucaggugagcagagggaggacugucugucccacaccugugaagaucagcuaaucagcuaucaauuuacauugccaggugaaguucagcagaauuguuuuagaauaaagauauugaguuucacagggaauuuccuuguggccaaauugugaggaagauacguagcuuuuguuuuuucuuuuuaaaaucuuuguagcuaucuuauuuaggaauauaaugggaagcagguuugccugaggcaguugccagcaguucccagcuugacuuuuaucuuuggcuuagugauuuuggggucccaagauuuauuuuccuuucacagacaauauucucuaauaacaccuauccaaauuaggggcucuggaugguguuugggcagcagacaugguuaaaaagaauggcugauuguacaguaugcuaauuauaucucaauaaagcugugaaaaaaauaaugaguuaggccaggugcgguggcucacgccuguaaucccaacacuuugggaggcugaggcggggcagaucaacugaggucgggaguucgagaccacucugaccgacuuggagaaaccccgucucuacuaaaaauacaaaaaauuagccaggugucguggugcaugccuguaaucccagcuacuugggaggcugaggcaggagaauccccugaaccugggaggcggagguugcagugagccuaagucaugccauugcacuccagccugggcaacaagagcgaaaccccaucucaaaauaaauaaauaaauaaauaaauaaauaaauaaauaaauaaauaaauaaauaugacucacugaugcugauuaucaaguagguacuaggaacuggucuaaacauuuucucuaccuugaucuccuucaguuugucuucauaaccaucucuaucacauaaauccuauuauuaucauccuuauuuaacaaauaaggagaccaauuaagagauaugcaacuugccuuugacugguaaagugaugcaaauaggaagagaugaaacagagauucaaacccugguagucccaccccaguauucaucuucuauaugggauuaggcaagauuccugaaaaagcuucuaaaccccucauauuaaacacaaagacucuguuccagugaguagacuaugccauucccuguccccaaauucagccuggcucccccucccuggugcauguccuguagaugguggagugaaaagaggugcaguuugacaaaagagggcauuccaucuccuuaucuucugauauuacugucagaaacaaguuccuggccucucacuucagcucucuucuuuucagccaguuauccccugaacaaaauugccucaagauuacagaugagcagcuguguuuuggaugcaggagcauugccaucuugcugacagcugaguuuucucuggggacaucagcuagcccacagcaccccacucuuuuuccacacuccuuauuuuccuguaagcugugguugguuuccucuugugaccacaaaugaaucaaaaagagaacuguuucccaguuauuccuuauuaugucaaagcagauguucaaggugaggcuccggaugacuuaucaaaacuccagaggugauuuguguccugauaacagugaggucucagacucacauguaugcagguggaaggcaggcagugucaauaugcaaagcgugccaggcauaaggggguaagcgccaugucucuaccauugucaccaagcacagcaccugucuaguuguauugccuuuuaaaagacagacuaggccgggcacaguggcucaugccuguaaucccaguacuuugggaggccgaggcagguggaucaccugaggucaggaguucgagaccagccugaccaaaauggugaaaccccauuucuacuaagaacagaaaauuagccaggcaugguggugcaugccuauaaucccagcuacuugggaggcugaggcaggagaaucacuugaaccugggaggcggagguugcagugagccgagauugcaccauugcacuucagccuaggcaacgagagugaaacuccaucucaaaaaauaaauaaauaaauaaauaaaaauaaaagacuagauacauuggccaacaauauauguuugaggcccuuugagugaaaaagauuauccagauuuaguaaccuugaaguuccugugaaauaugugauccugugauaucaugauuccuuuucagaaggcagaccaaccuccuuuccccuccaaagauguuuuggagaauacuuugcagaaaauauaagaauaugaaaugucuucaaacugugggauggugagaaggugugccuugguaucagcugcacauuucuggaaagucgcauacucauagaacagaauuaauuuuagcaacucugagaaaauggccuguuuuuucucucccucuucucccauucauuuaauauuuuuuuccaucacuuuucauaugcccagcaccuuguguauguagaagguaugaaaaagugcugggcucgguggcugacgccuguaaucccagcacuuuggaaggccaaggugguggaucaccugaggucaggaguucgagaccagccuagccaacguggugaaaccccaccucuacuaaaaauacaaaaaauugguugggcaugguggaucacgaggucaggaguucaagaccagccugaccaacagggugaaaccucgucucuacuaaaaaaauacaaaaauuagcugggcauggugguggcaugugccccuagucccagcugcucaggaggcugaggcgggagaaucacuugaacccgggaggcagaaguugcagugagccgagauagugccacugcacuucagucugagcaacagagugagacuucgucucaaaaaaauaaaaaaaauaaaaaauaaaaagaacuacccgggcaugguggugggugccuuuaaucccagcuacuugggaggcugaggcaggagaguggcuugaaccugggagccggagguugcagugagccaagaucacgccauugcacuccagccugggcaauaagagugaaacuccaucucaaagaaaaaaaaaaaaagagagauaugaaaaaguguagguuguaucauuuugaaaguaucaugcaucucaauauguuaauacucaguagaguggcucgcucauccucauuugccuggaacuuucccaauuuuagcauuaaaaguucuacauucaggaaaccccucagucccaggcaagccaagauauuugaccaccccagugcucuagaagacaggacgaaaugaucuugugcaggcaucaacagaauuccuuuacacaugacagcuacaaaugcagaaagauacaggugcaucguuugaugacucagaugcugccagcagcacugcuacugguaucauuacuuuacaaaaugacgagcagcucuugguaaaauuccaaacaaaguggaguacgaucuucccucaauuuacaugguagaugcuuugcuagaaaacucagcacauauuaaaaugugcagaaacacucagaguuuaaauguaaaaugugguuuagauuuuauacauagcugcuuauugacgucuuuuucacuaaaaugacuaucugcugagacauuugaaagucaugagaggcaagggacuauugugugugguguggaauuucccuguagagugcagaauguugaucaucccuugaccucaccucuaaauuuagccaauggcauccucuaauuauagcaacaacaaaaaacaccugcagagguuuccaaaauaccccacuaggaaucaguccugcucucauuggaaaccacuauacuagauauuugaaaagaaagaaauacucaaaaagagguaagcaacaguaagauccuuucucuggcaucccuuuuucuuuaucuccucucccucugcaugccugucucucucuuugucuccuucaucaguacaaacuguugacauuuucucuguguauaacauccugcaaagugcuugggaaggucugcagguaacugccaucuuugccuccaaagaccuuaaaguaugcuugaaaauaugaaaccaaccaggagaaucagcucaaaguuaacccauggcacuaaaucaggauugccugcucagcuccagcuguaacugaauugauuggauggucuucccauugucuccccuggcucuccacugaggcucuacucuuuuuuuuugagucagagucucacugugucacccaggcuggagugcaguggugugaucucagcucacugcaaccuccaccucccggguucaaacaauucuccugccucagccucccgaguagcuaggauuacaggcacccgccaccacgcccagcuaauuuuuguauuuuuaguagagacgggguuucaccauauuggccaggcuggucucuuggccaggcuggucuagaacuccugaccucaugaugcgcccgccucggccucccaaagugcugggauuacaggggugagccaccgcgccuggccucucccacuuaucuuuuauugaucauaagaucagcccagugcuuucagccucuuuuuguacuuuggcaccuggggaggagcuaaggccuacaccucucugaguggaagaguuuccugggcagcccuguguuuggucccaaccaguuauucagcaugguccauauuggcauuauuuuggguggggcacaagaguuggaaauaagcaauaaauaaaauacaaaaaaauucaugaugagagagaagagaccauaagaaauuagugaagagccacaucggaaaauugagcagaugcuuugcacauaaaagcaacaguuauaauaagagguauuauuauuauaguuguuuuuguacuuugugggguuguucggggcuuuccagaaucaauaucuuguuguuagaagaaagacugggcugagugugguggcucaugccuguaauccuggcauuuugggaggccaagguggguagaucacuugaggucagggguucgagaccagcuuggccaccguggugcuaaaaaucucugcuaaaaauauaucucaacuaaaaauacaaguaugagcugggcaugguagugugugcccuuaaccccagcuacuuggaaggcugaggcaugagaauugcuugaacccagguggcagagguugccgugagcagagaucacgccaccuuacuccagccuaggagucaaagcgagacucucucaaaaaaaaaaaaaaaaaagaagaagaagaaagacuauuaaguuucaucaguccuacaacguuuauaagucauuuuacaaacauuaucauauaugguccucacaacaaccaacuuaauaucccuauuugacagaagucuaaccugaggcucagggagacuuagauuugguuaaggucccacgcuguaaaauagcucucucagauucaugcaugguguuucuaugagacuacacugccuuuuacucagaggaggcauuugaacugaaucuaaaugaaaccuuagauggugugggccagaccagaauggggaccugcauucagagaagcaagugcuccccacgaagaggucaagguccguguagaggaaguggaacucacaaggugagggcagcuuauggacgagaggaaugaggggcccuuccggggaggugagggagagcaugugcccacacggggcugagaggcuucaguuaagagaccaggcuugucaggacagcaugcacugguguguuuugacagagaggagaacguggagcaaaaggaauagauucuaagaucuuugagggcaaagacugcucauuccuguuuauuauucccaauaccugaaauagaguaaauacaucauaaauguucacuugaaaguuguguggcagguugaagccaagccaaggaguuuaggguugaagccacagcaagagagggcuugucugccuuuuuagaguucaauaauaaugccaugauguauuuaacuuuuauuuugguuucagggguacauguguagguuugugauauaaguaaauuacaugucaugaggguuugguguacagauuauuuugucacccaaagaguaaacauaguaggccaggcccaguggcucaugccuguaaucccagcacuuugugaggcugaggcggguggaucacaaggucaggagaucaagaccauccuggcuaacguggugaaaccccaucucuacuaaaaaauacaaaaaauuagccgggcgugguggcaggagccuguagucccagcuacucgggaggcugaggcaggagaauggcgugaacccgggagguggagcuugcagugagccaagaucgcaccacugcacuccagccugggugacagagcgagacuccgugucagaaaaaaaaaaaaaaaaaaagaguaaacauagcacccaauagaugguuuuuuguuuuuuguuuuuuguuuuuuguuuuuaagauggagucucacucugucgcccaggcuggagugcaguggugcgaucuuggcugacugcaaccuccaccucccaggcucaagcaauuccccugccuuagccucucgaguagcuggaauuacaggugcaugcccccaugccuagcuaauuucuuuuguauuuuuaguagagaggggguuucaccauguuggccagacuggucucgaacuccugaccucaagugauccacccaccucggccuccugaagugcugggauuacaggcaauagauaguuuuucuauccuuauucucuucccacccuccacacccaagugggccuaguuuucuguucucuucuuuguguucauguaaacucaguguuugguuuucacuuauuggagguaaacauuuuguguuccugcguuaguguguuuacgauaauggcauccagcuccauccguauugcugcaaaggacaugaccuuguucuuuuuuaugacugcauaguauucuaugguguguauguacaauauuuucuuuuuucagucuacuguugaugggcaucuagguugauuccaugccuuugcuauugugaauagugcugcagugaaccuaugugugcaugugucuuuaugauagaacuguuucuacuccuuuggguauauacccaauaaugagauugcuggguugaaugguaguucuaauuucuuugagaaauugcccagcugcuuuccacaguggcugaacuaauuuacauuccuaccagcaguguauaagcauucccuuuucuccagaaccucaccagcaucuguuauuuuuuuacuuuuuaauaauagcccuuuugacuaauucugugauuuuuaauuaaugaaacuugcagcucccgagguauggugagugugguguuacaggaagauugaccuggcaaugguauaaguuggugaaaagguguaagucggaggcaaauacugauggagauuugggagucugcuguggaauauaggggggagauuccaugagacuuuuggggaggcagcuuugugugaugaaaauaacaggacuuugaagucagacaaaccuggauuugaaucguggcucuaccguauucuagcugugugcccuaggacaaguagcuuaaacugucaacuucaguuuccuaauccauacaaacggggauuaauauauguaucucagagagccgcugggaaaaauaaaauagauguaugcagaucuuguguuccuaggaaauauucaauaaauguuuugauuuuguguccuccuuuuugccaaaggaauuauugaucagaaguugauaaguaaugggauuugagacuccagaaugugcugccuaaagauggugacuauaauagaaaaauuagauguugggguuuguuuauuuguguuuuuaaaaggagaugggagcuugcuguguugcccaggcugaccuugaauuccugaacucaagugauccuccugccucagucuuccaagggacugggacuagaggcaucacugcacccagaucaauggguuuuuuucauguuaacuuugagugacagccuaguugagaugccugggguagaauuggugauauggggccaaaacucagcugaggcuugagaggggugaauugugcagagacauugauuuggagaguccucaacaaaggaaugaaugcucugaucaaagagucacaagaucaaaacagagaccaggcuguugguguuccaugcgcucaucaacgcuguugauuagcauuaccccauccuaggaaacaugacagguugcuuccagauguuaccuucaagaucugcauuccuuucagauugcucgucuucugccacagcuagcaagauuugcccgaacauugaggucacagccucaaaugagccccucaaagccucagaaugacaggagagaagcuuggucaggcacuccacuggcaucuaagguagacugagcucugccaauuuccaaagacagauggggcugaagagccaaguuuugguaacauggacaaaaaccaaagcaauuccagauguuagagccggagcagccagcgccucuguugcuuuccaccccuguagcauuaaaauuagagagcaacagccaaguaaugaagccugggucacuccccaucugucucacuaaaugccauuuggaaccagugccuuuucauuugacaguaaaaucaaugaaugaaauaucgcaggguugaaagugaugcuguucagaauucauuaugggcgaugcucuauuccaaaggauggaagacucagcccucugcacuuuacuuuccgguaacaucaacacaucuacuuaaugaaacuugaaccuucuguuaauccuucaccuauuugcuuuuaaacugagucguuuugaggaaagucuaaaggccuucucucuggauucugccucuuaaugaauuagcuaucacaaaaaguuggaagaugcagcaguuuaaggaaagagggacuaguuaauuaggaaaacagcuugagauuggaggacuuuugccaauaaucacugggucccuuaucagccaacaccauuuccuuugaauuguucuuuccuguugagaaaugucucagcacugagcacaccgagcugagggucacaauuuguacaaauucagauacagcuaugaggugggagagcaaagaaggguggcaaagagaagagggaaugcccucacucuuggaauuaacaccugccucuggaaaaauggaagacacaguugaaacaauaucauuccuuuauaaguaaugaaaacuaggaucaacaugagagaacagacucuuuuuuuucagagaguuuugcucuuguuacccaggcuggaguacaauggcacgaucuuggcucacugcaaccuccaccucccagauucaagugauucucuccugccucagcuucccaaguaggugggauuacaggcgugcuccaccacgcucagcuaauuuuuuuuguuuuuaguagagacugcauuucaacauguuugucaggcuggucuugaacuccugaccuugggggauccauccuccucagccucccaaagugcugggguuacaggcgugagccaccaugccuggugauaacaaacucuuaagguguguguguguaguguguguguguauguguguguguguguguguguagagagagagagggggugaaugaggccagggcucauuaucugcugcccuuucuacaacagaaguguucuuuccuugggauaguggguguuugauuuauguagggguauuagacaaaaaaagaaauaccugggaugacaaguaacauucacagcucaucuaagaaauaucuucaaauuuaaugcagccuuccuuuuuuuuuuccuucaacaaauauuuauugagcacuuacuauauucccaccagguccuagaaauaauaagucauagacuucccacaagagccuggguguucaaguaugacagagagagagagagagagagaggcaagagaaaaagcaagaaaaaaaaacagugaugggcauuagaaggcaacaaagaaagagagaacaagaguaaggcagggcagggaaagcuacuucggagagagggacaugaaguaaggcuucuccaaggaggagaaauucaagcuggaaacacagaaaggcgcugaccaugacaagaguuggggugagcauuucagcaugugcgugggcaugagacagggcagagcugguggucuuggaaggguggaaaguccaacauggccgggguauagggagugacaggugguguuaugaaauuaggauggaaaugagcggggacauauuggguagggacguauaggcuaccacaguaaguuuggguuuuuaugucuagacuuuucgaguagggaacuggaugggagaagacgucauggaagaaaggugaccacuuagcaccagguaagaaaguugguacagcaguauuugcagauggagguggcuagauccaagauauauuuuggaguuagcaugauagggaugccauuggugagagagaggaggaauuugggcagacgcagauuccuguugugagccacacuaggaggauggagucacugucacucagccuuuuaaggaauguucuuggcacaucagcagugcacuuugucugugccagggcuggagaagcaaacaaguguagaaugcaguuccuucccucgcuggcuucacagucaaaacaggaagauggacgugugaauagacacuuaaagaacgccuuaugguacuggcacccaccuggagguuuucugcagaacgcccugcaaagccuauuguuuccucauccacaacccccauguuuguuuuguugcaaucauuauuguuuuguuuuuguugguauaugugaaaucuauggcauauguucuacuugggaaggagcauauauaauguuuacauucuguuuaaagaguaauaaaccuaacauccaugcacccaccauccagcuuaagacaaauccucacccaaagacuuggagcuccauguggucuuugccccagagcuaacuauugcaccaaauuuuggauuuaucacuuccauguacuuugugguuauaacagucacgaucacaagcaauauguauuucuuuugccucuuuuagcuuuauacaguggaagcauucuauauuaauacuucugugacuugcuucuuuugcucaaauuacguuagugagaugcaucaaugucgcgccauguaaacugaguucauucauuucacugaugcaugugaauaagucacauuagauugaucuauucuuuugucauaggacauuuggauguuugccauuuuuggcuauuccuaauacuucugugaguacuauuuauguaucuccuaggguuuuccugagagguuacauguaggaguggguuagagaauguguguguguauguguguguguauguguacgugcauguaugugugcauguguauguguguguguguguaugugugugcaugugugugcaguguguguguaguguguguguaugugugcgugggugugugcauguguguguauacacagucaacuuuauuagugacugccagugauuuuccaaaaugguuauuccaguuuacaccccuacuagugaugaagaguucuuauugccacccaucuuaaccaguucuuauucauuauuguuucacauuuuacgaucuuuuccaaucuagaagaaugauaccugagauauuaauuugcauuuuuucaucauuaaugagguuauacauuagguaugugcauuggcugguugaauuucugagaaauauuuguuuauaucuuuugcccauuuuuuuuguugcucaucuuuuccguauugacuuguagccguucuuuaucuguucugcaaacuaagccuuugccaauuuuauaugcugcaaauaucagccuucaguuuauugcaugucuaauuuuuaugaugucuuaugaugugcugaaguucugcacugaaguugaauuuaucagucauuuuuuuuacggucuuacauguuuuuggauucgacuuaugaaaauaaaccaaaaccuggggucauaaaaauacucuucuuauuguauucuaaguuuuugaaagguuugccuuucacauuuaacuccuucauucauaugggauugaauacuuuuuguaugguagugauuuguuccaagauuuuuuucauuaccuuuuccaugcuuauuugucacagaucaaguuccuauauaugaaugaauaaguuccauugguuguuuauguauuccuaagucaauacuacauuguguuuagauuauuaugccuuuauaauaauccugauagcuaguagugcuaguuuucuuaccugcucuccucccuuuuuuauaacuuaaaaauugaacuauuaaaaacguaaauaaaacgggugcagugucccacaccuguaaucccagcacuuuggggggccaaggcgggcagaucaccugaggucaggaguucgagaccagccuggccaacauggugaaaccccaucucuacuaaaaaauacaaaaauuagcugagcgugguagcaggcaccuguaauccuagcuacuagggaggcugaggcaggagaaucacuugaaccugggaggcggagguuauggugagccgagguugcgccacggcacuccagccugggugacagaguaagacucugucucaaaaaaauauaguaccagcucaaugaauugucacaaucuuggcuguucuuaaccauauauauuuugggauaaguuugucaaguucuuuaccuauguacaaauacacauacacacacauugggauuuugauugcaauuuuauuucuaucuauaaauuaauuugaugagaauuguuguaugugugauaaugaaucuuccuaucuauaaaccugauuuguuauuauuuuauuuguucuuuaauaucauccaauaacauuuugcaauauuccccuuaaagucuuguacaucuuguauaauuuaucaguagacuucaauuuuuuuaugauguaaagaguacuucuaguaauguguuuuuugucuauuuugaauacaaauucaucagcuuuuuuuguauuuguauuuucuuuuaugucuucuucccucuuuuuauuuucagaguuuuucuuuuaaaugauauauaguuggauuuauuuaaauucccaaaugaaaaucuuucaccuaaaaaguaagggucuauuuacuagauugcggccaccaagauggcagguguuauuucugccacuugauauugugcuuucuaguugucauacuuuuuagauuucuucauuucuccuuucuaaccuucuuuagaaugacuguagauuuuuauuucucauucuaauuuuaacccccacuagauugaaaguuauauaccaagaaucuuaacaugaauauuuaacuucaagucugaaauuaauaucuucacucuucuccaacacagugugagacguuagaaaguuuaaucgccuccuucugaguuacaugcuuguuauuuuaaaaguuugcuuguucuauuuuauucuuguucaaauuucauuaauuagauagccuuguugauuuuucaguugguauauauauuauuuuuauuuuuugagacagagucuugcucugucacacaggcuggaguacaguggcaugaucuuggcucacugaagccucugccuccugggcucaagcaauuauccugccucagccuccugaguagcugggauuaugggcacaugccaccacacccggcuaauuuuuguauuuuuaauagagauaggguuucagcauguuugccaggcuagucucaaacuccugaccucgugauccacccaccucggccucccuaagugcugggauuacaggccugagccaccacgcccagccucaguggguauauuuuuaaauguuuaucuauaaaguugcuguuuuuuuuucucacuauucuucacauuucagaccuuccuucugggauuauuuuccuuccuccugaaguauaucuuuuaaaauuucccuucauguaagugccuaguacuaguagcaucuguuuuuuauuaucugaaaaaugucuuuauuuugccaucccgaaggguguuuuuccuggaucuacaauucuugguugacacuuauuuucucucagcacacugaagguauuccacucccuuaaggcuuacauugucucuguugguaagucagcugccagucauuuuuuacuucugcaacauuuauuugguuccuuuucaaauacaccuggucauuuuuaacaguuuucuuguucuuuuaucauaaaauuguauaaucuguaugguuaucuauucaugaauaauaaauuaccauaaaacuuaguggcuuaaaauaauuggauuuguuaugucucauaguuucuguuagaaacccaggaggagcucagcuaggcaaaugucuucugggaucucucaugcagcuguagucacacaucaacauggagggauaauugacuucuaaggugacucauucaaguagcugucaaguugguuccugcuauaggccaugggcaucauuuuuccucuaugugggccucuccauagggcauccugagugucccuacaacauggagauuggcuucucccaaagagaguaaacaauaagagacagagagagugugugugccugugugugugcgugccaggcauaggucauaacauuuuuuuuuuuuguaauuucucuuuuuuuuucuuuuuucuuuuuuuuuuuaaauuauacuuuaaguucuaggguacaugugcacaacaugcagguuuguuacauguguauacauguaccauguuggugugcugcacccauuaacucgucauuuacauuagguauaucuccuaaugcuauccuucccccaccccaugacaggccccagugugugauguucccugcccuguguccaaaggucauaacauuuuuauuaccuagauucacaugucccacaauaucacuucugucccauucuauuuauuagaaaugagucacugaaacaauucaaugggagggaaucucugccuuuuaaagggaagaaagggaaagaauuuagggacauauuuuauuuguuuguuuguuugucuguuuuuuagagacagggucucacucuguggcccaggcuggagcauggugacacaaucauagcucacuguaaccuccaacuccugggcuguagcaauccuuggagacauauuuuaaaaccaccaccuacuuccuauuauuucuugaaauauauuaaacagauuuuccuuauguucuguacaugaugauuuuaucagucuucugggguugaauucauuguuacuucugcaguuuuuguuugauguugugguaaguucguguucuuggaaauuuaucuuugaggccagguuuuaaaauacaguccucuagauaggauuuguauuugcuucugccaggcuacaagaugguuggcuuucagaccaacaagauagguaugauucuggcccccaaacucccugagaaugggccuagaauuaagaauucucaguggagaucacugucuuuuacccagacccaaggcuaagacaggcaaauuuccuauagaacuggcuccuuacuucuuuacccaucaaaggugugacuucugggggauccugucuuuacgcuuuguucucuaggguguuuuuauguaauccugcucuucaucucauuuuccuguguuugccccauuaaaaccaaugcuuaauuccaguagggauaggcaggcuccccaguucagguacugccuucagcuugcuuagcucucagggucugugcuaucuuaucaguuuccauuauugacucaagaucugccuuauguucuugccuacucaucuauuucuguuacacacagauaaaugcauguaugugcauauauacaugcauuauuuuuacauagcauuuuuauguguuuuuaugccagaguuuuguuuuccaugauuuauuuuucucuaugguaucagacaccaaacuacccaggaagcucuuuagaaauacgaauuugcuggcccaacccagaguuaggaaauuagcaaauuagaaucuucugagauggguaccagguaccuauaugauuuuuuaaaaccuccccagaggaugcugaugccugucacuguuaaagauaauuauuauaaugaagacaugguccagaagcaguggaagcucagcaagagagcuaaauuuggccgacacaaccgaggaaggcuuuauagaggaggaaauugcauuucgccuuuuuaaaacauuuccucucauccuuugacugcuacaguuagcuggacaguauguaagccccuuagcgccaugccaugcguuugaagaccccagggggauguccagaggcagccauugucucacuguguguguagcaaggucgugggacuuagccacuuugcaggauaagauucuguagcacuuaucagugcccauccacuuaucugcccauugccuaggcucagagccacuauggaccagcuuacagagcaggaacuugccagcauuguucuugggugcuauuggggguaugaauugggcugucugggcuggcgguguaauguaaauaucagauaaauugccuaggcucagagccacuauggaccagcuuacagagcaagaacuuaccuacauuguuuuugggugcuauugggggugugaauugggcugucugggcuggcgguguaauguaaauaucagauaaauugccuaggcccagagccacuauggaccagcuuacagagcaggaacuuaccugcauuguucuugggugcuauuggggguaugaauugggcugucugggcuggcagugcaauguaaauaucagauaaauguagcagggaggauucuauagaggcgauaacucucagaagguuggauaccauuauuucacaacccagagcugugccaaacccugcaaugucaaaaaaaaaaaaaaaaaaaaagagagagagcgagcgagcuuuguuugacuuuacuguucacugcccuguaaaagacuuucacgguggaucaugcuccucgauccacauugagagcagaugcuaaacagugccugaggccugugcauuuggagggaagaaaacccaguuugaaucucagcucuacaacuuauuagcagcaugacaaggauuucacugccucugagcuucaguuuucguucuguuaaauggaagguaaaaauaccuaucuugacauugagaacacauagacacagagaggggaauaacacacaccagggucuguugggggccgaggggugaugggagggaacuuagaggacagagcaauaggugcagcaaaccaccauggcacauauauacaaaccugcauguucugcacacuuuuuuuuauuuuagaagaaauuaaaaaaaaaauacuugucuucuaagguuauuggaagacuuacgugaagcaauguauuuuaaaugcccuauacuauaccugguaucuaguggacauuucuguuuauuauuuuugcuguugugauucugaaagacccuaauggauaaguagggcaaggauuauuuucauguucucguguuuagcauauguaaugccugcucaccucugcauucaagucaagaccagacuuauguauccauagcuugagccaacucuucccucuagauuuaguuccuaauaaaaaaguaaaaaugggcuggacacaguggcucacgcauguaaucccagcacuuugggaggccuaggugggcggaucacccgagaucaggaguucgagaccagccugaccaacauggagaaaccccaucucuacuaaaaauacgaaaacauuagccgggcaugguggcacaugccuguaaucccagcuacucaggaggcuggagaauagcuugaacccgggaagcggagguuguggugagccgagaucacgccauugcacuccagccugagcaacaagagcaaaacucugucuuaaaaaaauaaaaaaauaaaaaauaacaguaaaaauagacauuuuuggccgggcacgguggcucacgccuguaaucccagcacuuugggaggccaaggcgggcggaucaugaggucaggagaucgagaccauccuggcugacacagugaaaccccgucuccacuaaaaauacaaaaaauuagccgagcgugguggcagcaccuguagucccagcuacugggaggcugaggcaggagaauggcaugaacccgggagauggagcuugcagugagccgagaucaugccacugcacuccagccugaacgacagagugagacuccaucucaaaaaaaaaaaaaagaaaaaaauuagacauuuuuaaaauuuauuaaacaaauaugaaguaucuggcaccaaguuagaugguuuacagauauggucucuagucuuuauaauaaacuucagguagguuuuauuagccucauuugacaagagcaaaccaaagcucagagaguaaaagaugcugaaagauuauacacuuggccaguggguaagcugggauuugaaacuaagguugugucguuuuccauauacacacacagccucuccuucaccuuauacuucucuaccacaauugcugugcucagggucuuuccucagccuggaaggccuucuaccucccacucugcccaauaaacucuuacuuauucuuuaagacccaacacaaaugcugccucccuuguaaggcuuuggcucccucaggugcaaaaaaaauuacucuuuugcaauauuuucaugggauuuuacuuacauuccuuuuuuguacacuuuuuuguacacuuuuacuuacauuccauuuuuugucuuaugucucuuaggcauauacaugucuuuuguacuuauuuguaguguguuugaggucagcaauuauaucuuuuuuuaauuuaauaaggacuauccuuuauacuucauaaauguugauuaaauguuuauugaauuaagaaauacaaauuaggccgggcuugguggcuuacaccuauaaucccagcacuuugggagcccugaggcgggcagaugaaucacuugaggucaggaguucgagaccagccuggccaacaugguguaaccccgucucuaauaaaaauacaaaaaaaaaaaaaaaaaaaaaaaaaaaaaagagccaggcgugguggcaggcaccuguaagcccagcuacuugggaggcugaggcacaagaaucgcuugaacuugggaggcagagguuucagugagccaagaucacgccacugcacuccauccacccugggugacagaguaagaugccgucucaauaaauaaauaaauaaaaauuauguucagaaaaguuguuagacagauacauucuuaaguauguuuguccuuacaucuucagugaugcuauacaagugacuaccaucucuuagcaggggaaaaaguugacacacauuugccuuagugccuggcuuugcccuucucugcgaaguuuccacauugcaagugcacaaguaaaggaccuucugucuacccaaguuuuauaaguugcagaagcuuauuugacuugaucauaucuccuguucccaguccaggucuuuaucuguggccccuccagcuucuucauuaccuggcacauaauucuacauuuacagaagggcacuggaccgcauguugaguucuauuagcucagaguugcagcugcuuccaugaacaaguucuuaaaaugauucaucaugaggagacuuacaccuaaguuacugggucacugucacugaaaaauugcauaaguggaauggaauuagaaucucucaggagcuaaaagguugcauuuacaacagguucugccauuucuaugaugucuuucauucaaugacacuucaauagaaaguuaauugaaauggaaaagaucaagcacaaagacaaaaagcaaaaaggacuuuacaagauguuuagccuuauuccaugcuuugaugaggcauagauguagaagccacaggcaagccaaaaacuuuguuucgaaaacuguuaaaacaauaauauguccaaaauuggccugucuccaagaaagauucacaguacccaaaauuggggaguauugauacagcaaauacgguaggucagagucauuagauccuguggaagauucucgguauagaugggguuggugauugugucuaagucuucaguggcucaacagcuaugcaauaauuggcagccacagaauccuggaccaucagaaccaagaaccuuuguggguuguucuguggaaauauuaaugaucuuauuuugcaagaguggagguccaggucuaagaacaagugggccuagccuggaacucagaucucuuguugcuuguuuccaacguuuaccuguaguaauugcucagccagcuacaaagcuggccuuagcauacggagaaaauguacagacaaaucauugcugugugaugggagaauagcuguggauagggauacuuugcagucacaauauugucucugagugaggguccaccaauuagaguuagaugucguguuucuugcagccccgauacccacaaugcaguuucaaauaccaguuacuuaaagcaaaguuaguauucaaacucacucuucacgcacaagaaugcagacuccgaggagacuucuacuauccuucccaguuguuuaaaccaauagcaauuuuuuuuuuuuuuuuuuuuuuuggcugagacagaguuucacucagucgccuaggcuggagugcaguggcaugaucucagcucacugcaaccuccgccuccuggguucaagcgauucuccugccucagccucccgaguagcuggaauuacgggcacacaccaccaugcccggcuaauuuuuuguauuuuuaguaaauacaggguuucacuauguuggccaugcuggucuugaacuucugaccucaggugauccuccugccucggccucccaaagugcugggauuacaggcacaauagcaauuuuuuuagcagcucaccauggucuaaucuuucuaaaguagucuauuuuguuuucagaaaaacaacucucuucccacacugcuaauuaauagauguacauaauauuagaguucucaaugguaagaacaagaaaugacauaaaagguuugggaacaaccacaagucacucuugguaagcacccagcccaggugguggaaacagcaguguguggacauaccagagugcugcuucgagugagccaucugugugcccugcacaucaguuacuauaaaaacauuccuggcaaaaaggaagcauuggcaacaaggccucaaucuauugccauccauucccucccuuauggacccaggaaagaaagaaagguguccugggucaagucuuaaacacacugacagaccuucugucaaacacacauauuaauacauuaauagcauuugcuaggagagaguccuuaucuguggauugcuuuuagcaguacguaccuugcuaugguuuggaucuguguccccacccaagucucauauccacuuguaauccccaguguuggagguagggccugguaggaggugauuaggucacagggguggauucuucauaaaugguuuagcaccauccguuucaugcuguucucaugauagaguucucucgagaucuggucauuuaaaaguggguggcaccuccccccauucuuucugcugcucccaccaugugagacgugucuguuucuguuuugccuuccgccaugacugugcauucccugaggccuccccagaagcggaggcugccaugcuuccuguacagccugcagaaccaugagccaauuaaaccucuuuucuucuucuucuuuuuuuuuuuuuuuuuuuagacagagucuugcucugucaccaggcugaagugcaguggcucaaucucggcucacugcaaccuccgccucccggauucaagcaauuccccugccuuagcuucccaaguagcugggaguacaggcacguaccaccacacccgacuaauuuuuuguuuuuucaguagagacgggauuucaccauguuggccaggcuagucucaaucuccugaccucgugauccacccgccucagccucccaaagugcugagauuacaggugugagccacugugcccggccuaacucaacuacuuuucuuauaauuuaccuagucucaggcauuuuuuuuauagcaaugugagaauggacuaauacauaccugaacuaggauuacuaugggaaacaaaucuguaauuauuggguuuaugguacgugcacccccuggaaaacagcacagaaacucuguaauuguuggaauauaaaauugagauguuucaugaccgacauagcucuguucagugcaagcaaugaugcauacacaacucagagaccucauauguuaaaucagggccagaacacuuuuccauguggcaaggaauuggaaagugguauuggugguccugggcuucucucugccuugccuaauaauuacuugacacuaaggcaaugagcucugauauuugugauucugauccuuuguguuaucucaauugcuuaauucaguguauugauuagacauucaaauaaaacagccucugguagauguucaaaaugcaguaggaaaaagacaaauaacugguuuuuccauuuuucaaagagauuuuguuagaaaucucuuaugagagaacccagaucucuaguggaagcaaaaccaucauagaaacuggagguuggaacaaaguccguuccuaggugaguuuagcgagaaccaaguaaaaaaaccaggagccaggaaagacagauggacacagacagaaugaagaugggcugccucagacugccagucagauguacuccaaaucacggugcacgcagaggaccuggcuuuucagugauaagagugaaccauuaucucacugacuguagcugacucucuacaauucuugguagcuuuauaaacucucaccaccaguggugguaguuuuggucacucccugggagaucagacugaaguauguagcuguccaaguuaagagugaagcaacaacuuuuuuuuuuuuuuugagauggagucucgcucugucacccaggcuggagugcaguggcacgaucuuggcucacugcaaccugugccucccagguucaagcgauucuccugccucagccuccugaguagcugggauuacaggcgugcaccaccaugcccagcuaauuuuuguauuuuuaguagagaugggguuucaccauauuggccaggcuggucucgaacucgugacuucauaauccacccgccucggccucccaaagugcugggauuacaggcgugagccaccacgcccggccugaaacaacaaccuuucaaugucuuagcuuuagcacuacaaaccugucuguagagaugaugaaguuggcuugucucugucuauucaguuuccuucugggaaagcuggagggcaggccagggugguauggcuuaagcacacagcauucucugguuccuugcugccuuucaaacaauccuccgucacgguaauuccucucuaccaggccuuuggcaagccauagauaguagauugugcaggguucauuucuugaaguaaaggaaaugagcauguuguaagcuauaguauccauuaauuagaauuguaauaauuuugaguaaggaaaaggauggaaaugccucagcuguuuucaaggggucguauuuaaacaucuagaccucugagcuaagggagcguguuguuucuaugcagucuccuuuauguaccccagaugggcgcuccugccagcaccuuugauggcgcugaaaugcuguucugacaaauccaccguguggccuuccucaccgauucauucucaaguggccuugagcccuaaauaaggaacagauguccccccaggcagaguugcccugccacucgcuacuaaacuagugacguuuuccagauugagcuugugacaacagccucuuuauguggcccgcucaccugagacagguguaccaggccugccaugggccccuuccuggaggagaagccaccaccucuaccuucucugccacucuuucuucuuuugcuggcauugcucugagcaggggaaauggccuuucuccucaaaugucaccucagcugugcuuccccaagccccucccccuuucugcugcauaggccacccguccuucacccugcacccuugcuguguccccuuaucuccuuuccuuuuuguagcaucucuugucaccacuuagcauuucauuacauauuuauuugugguccagcucccgcauuggaaugaaagugccaacaaggcaggaauuuguuuuguuuuguuuuuuuaaacacucaagaguccagaauagugccugacguauagucaccucucaauaaauaacuguuggaugaauaaauguguagaugaauaaacaaacagcugaaugaacagaugagcagauucggguuggaaugcgaucucugacuccuugugaagaggaaccuggguguaauuggagaccauuagucucagugaaguaacucaagaguggaaaaccaaacguuguauguugucacugauaagugggagcuaagcuaugaggaugcaaaggcauaagaaugagagacucccggccgggggcgguggcucacgccuguaaucccaacacuuugggaggccgaggcggguggaucacaaggucaggagaucaagaccauccugcccaacauggugaaaccccgucucuacuaaaaauucaaaaauuagcugggugugguggugcgugccuguaaucccagcuacucgggaggcugaggcaggaaaaucgcuugaaccugggaggcagagguugcagugagccgagaucaugccacugcacuccagccuggcgacauagcgagacuuggucucaaaaaaaaaaaaaagaaugagauacucccauagaguggauuuuggggacucgguggggaaaggguuugagggggugagggauaaaagacuguacauuggguacagugucuacugcucgggugaugggugcaccaaaaucucggaagucaccgcuaaagaacuuauucauguaaccaagcaucaccuguuccccaaaaagcuauugaaauaaaauaaaauaaaauaagaauuuuuuuggcagcugagcguucuuuucuugguggucaccuacgcgcauauagacaaauguguucccucucuuguucucucccaccgcugcccacccccaucucugaaacuuugccagaugaaguuuuuucuacccugaacuuggaugccuccaucggaaaggauaucaaaacuauucaaaggcagugucuuacauguugggauuguuggugauuuaacgccaugccaggagaagaccacuagcuggccauuguagcuguguuguccuuggcuugcuaagggagaauucucuccgaagagggcaguggcaagagggagaucagugggcugcgucugcacuggcuuugcugacagagccauacucugcuuuaccccguguuuauguggagugugugcuguucagcauuuggagguguuggaugagaaggcucuugugugugugauggccuaaacaaagccaggauccguccagacaccccauucuagcuauuaauuucagcaaccuucauuuccaggcugauacugcguggcucauaaggacaguuuuguuaggaaacaaggguucuggccuuuacucaucugugugaucuugggaauaucauuuacccucacagcaagucaguuucaucaguuauacgaugaaaagauuggacuaaaugaguauuaagguuuuuuuccagguguaauauuuuuaaccauauugagauccauuuauuuauuuauuuauuuauuuauuuauuuauuuaacagaaucuugcuuuguugcccaggcaggagugcaguaucuuggcucacugcagccucugccugcuggguuccagcgauucuccugccucagccuccuggguagcugggacuacgggcacccgccaccacaccuggcuaauuuuuuuuuuuuuuuuguauuuuuaguagagaugggguuucaccauguuggccaggcuggucucaaacuccugaccucacgugaucugccugccucggccucccaagggaucuccucuuuauauuggaguucucauguucuuuuucucaucauucaaaugagaaguuugguccaaaauauccuacaggcccuugcaacucugauuccugugaugugaugcugcaucaaauuuuuuaaaaguacaaaagccucggccaggugcaguggcucacaccuguaaucccagcacuuugggagguggagguggauggaucacuugagaucaggaguucgagaccagccuggccaacauggcaaaacuccgucucuacuaaaaauacaaaaauuagccgggcgugguggcgggugccuguaguuccagcuacuugggaggcugaggcaguagaaucacuugaacccaagaggcggagguugcagugagccaagaucacacugcugcacuccagcuugggcaacagagcaagacuucucaaaaaaaaaaaaguacaaaagccucauccucgaugcaagaguccccuuagacauagcagacuguuuauaaacaugagggacgcagucuucuugaugggcaucuucagggcacuggcagccaggaauguggguuggggcucaacuuucuuuugaaagugggcuggcuuggccagcauauuguuuccuuggcaaaagacuggcaauugauugcucuccucgaagcaugugcuuugagacgcauauauaccaggcagccuaacccaaaguugaugagaaugauucagaaaccuugguuuuucacugaggauguuaaggaagccaauugugaaucucaccauagacggagcaucuugucuugugagugaaaugcgguuguagcuguaaugaacuggcaguacauaccaucuuuggagucagagugcuugauugcaaauuuuagaucuagaaaauucugcuacauugauaaucuaaaacccacaccuguggauucuccauugccuccccuuuauauuaauacaauaccacaaaguugacuucugcucuuacccugggggagcucugcacagcccugccuagggauacuccuuuucugcguucccuuccucuuugcucaacagcuaaacaguggagagccccaacacucugccuuggucuucucuauaagcaucuccuuuaaaugagcucacauuuuaaaauacuauucauguuccaaugauaugcaaaucuauagcuuggaucucgggcagcuuggaucucaggcuuaacuuacggaaaacagaagucuugauuccacucaaauuaugguauauccauacuuggaaauaccacucagcaguaaaaaggaaggcaguauuaauacacauaacacuuggauggauuucaaaagcaucaugccaaguacaagaagucaaacaggaaaaacuacgugcuauaagauuauaauucuauuuuuaugaaauucuagaauaagcucaacugcagugacagaacgaaaaucagugguugccuggagcggguguguggggaaguggauggacccaaaaagagcacaagaagacuucagguccuuggaacaguucuguaucuugauggucguggugcacuacccaugacugcacccaguuacuaacauuugcugaacugcacuuaaaaugggugaauucauugaguuguacgguacuucaauaaaguuggggaggcagggaggcugacuccacaguuuucuggcuuaagggagagaauggauugccauugacugacauggggaaggcugagggaagagcaggugugaggggaaaaaacaagaguuugaucugggacaccuuaaagucugagaugcugagcugaucauuggcccagaggggacaagcaagaccacagggcuggacagagagcagcagagcucugaagacuguguccuggagccccagcauuuguggugaagauuaaauaggauaaacuaugugagaauauuaccgacauauaccaaguaauacuuucuuuucuuaauuuauuguuuaauuaacaaauaaaauuguauauacuaagguauauaagccgauguuuugauauuuguguacauuguggaaugaccaaaucaagcuacuugacauacacauucccuccaaguauuacuuucacguuacccucaucauaauuuucuauggaggugaaauucacauacuuccauguaguuaacaguuuuaaagggugcaauccaguggcauuuaguguuuucacaacguugugcaaccacuugaugucucuaguuucaagaugucuuuaucaccccaggaaaacaccgcgaacccaccaaauaaucauuccacaccccccucucccugucccccauugaccacuaaucugcucucugucuccgugaauuuggcuauuccgaauauaucacgugaaaugugauauauacugacuuagucaugcaauaugugacauuuugugucuggcaucuuucccuugacauaagguuuccaagguucauccagguggcagcaucuguuaguacugugcuccuuuuuauggcugaauguguuguuauuacuccauuccuuuccacacaccagcuccagagugugcaugaguauacuuagcugagcccuuccuccuuccacccacucuccccagccuguccuuccuccuccucccugugcugcaccugccuuugugucaguggugcagcccaccugcucccgagggacuuaccccacgcccagaagcacuucuucuucauccccaagacauacaccauaguaauuucuugaauucaccuucaccgccucuuuggcagagccagauuggcuccuaacacaagccaaaguguugccuuuguaacaauucuauucagcaagcaggaagagagugcuaggaggcugugcauugggacgugcugggguuaccagagcugcagagcccacugugccccuuccuuccgggcucaagcccuuauguggaucacaggggagacaagcacucucaccucccggcuccugguuuggcccucggccccugcaugucaccuguacacaggccccucagaagauguugcugaccaugauuugugucuccagcccuuaccucuccccucaucuccaugcuuguguauccaucauggaauaucucuaaaagaaagaaugaaaaguaaaugcuugauuuccaccugcucaaaucauuccugauccuacuccacauaguggcaaggauguucucuucaaaacacaauucugggccaggugcaguggcucaugccuuauaaucccagcacuuugggaggccaagacggguggaucaccugaggucaggaguucaagaccagccuggccaccauggugaaacccugucucuacuaaaaauacaaaaauuagcugauugcaguguggcgugccuguaguuccaacuacaugggaggcugaggcaggagaaucacuugaauccgggaggcagagauugcagugaaccgagauggugccacugaauuccagccugggugacagagcaagacucugucucaaaaacacaaacaaacaaaacccacaauucugaccacaucagcaccuagucucaacacugccgugucacucaacuccaagggacacuguucacguugccucugugcagauggugcccuggugucauacagcaggaugguccugcccgccuguucccuucagugguucccccugcuuguccuucguggagaaauccccuuacucuggccuugaccacaaggcccccagaccagcccuccuggcuucagccucgucucccucgccaucugcuccuccaucuauuugucucagccacauugaccuugagucccugcagagguguuuuuucccuccugauacaaagcaaugaucagauucugugcagauacccacuaaguguccugcaauucaauucaauucacuucugacccuaacuacccagaauuagugucaggcugcacgggcuuaagagcuccaucccacaaaaccaccaucacuucagacgccagccacacauaguggggccccaggcugcaaagucagagguuuccauagcacucaccucagguuccauaauuucuuagaaggauacagagcuuaggaaaguguuuuacuuucuguugcagguuuguuauaaaggauacagcccaggaacagccauauggaagagaugugagcuaugggggcagggcguggagcccccauaccuuuuccagacauaccauccucccagaccuggauguguuucuacccaguagcucucugagcccuaucauuuagggauuuuaauguugguuucauuacauaggcauguugacuaagucaguaaugauuggugaucaauucagucuccagccacugccgccucccugcagguugagggugaaguucaaagauccaacccucuaauucugccuuguuacuucugucagccagccccuauucugaagcucucuaggggccuaguaagaguggcccccuuagggccgggugcaguggcucacgccuguaaucccagcacuuuaggaggcugaggcacaugaaucaccugaggccaggaguucgagaccagccuggccaauauggugaaaguccaucucuauuaaaaauacaaaaaguagccgagcaugguggcaggcgccuauaaucccagcuacucaggaggcugagacaggagaauugcuugaauccgggagguggagguugcagugagccgagaucccgccauugugcuccagccugggugacaaaagugaaacucuugucucaaaaaaaaaaaaaaaaaaguggcccccuuagaacaaaagguguugccccugucacccaggaaauuccaaggggcuuaagagcucugucucagugaucaaggagggacaaagaccaaguauuuuucugagauaccacuuuacucauccuugucaagcuuccugcucugaggucuuaacgcucuuccuccugccuucuuccucccuucccgauuuccuucagaugucuauuaaauccuuauuucaucagcaaccuuuuuggcuaacuucccaccuuucagcauucuggaccucucuaucucagccauuucugagucacaguuccacaauuguuggugugacuguuuaguggaccucguccuguuuuaucagcugaauucagucccccaaaauucauaugugggagcccugaccccuugucaccucacaaugugaccauauuuugagaugggaccuugaaggaggugauuaagguaaagcuaagacaugaagauaggcccuaaucccagaagacuggugcccuuguaagaagaggagguggcggggcacagcggcucacaccuguaaucccagcacuuugggaggccguggcgggcggaucaccugaggucaggaguucaagaccagccugacugacauggcgaaaccgcgucucuaccaaaaauacaaaaaugagccgugcauggugguacgcgccuguaaucccagcuacuugggagguugaggcaggagaaucgcuugaaccugggaggcggagguugcagugagucgagaucgcgccacugcacuccagccuaggugacagaacaagacaacgucucaccgucucaaaaaauaaaacuguaagcuccacugagggaagggaccgccucagcccugcuuguugcuagacucugauucugauauagaugcaaugaauauuuguugaauagaugaauaacuuaucucaugauguugacagagaccuuugaaauacgccuuucauuaaccuuauaccaaaugaugccaagccagcauaccuuuauccuuuuaguaaguccuggcuugaauuucauccacauucuuccucauucaacaagaauuacuacaucuuuauaaucugcccaaggaucaggcuuaagaauagaaagagauuuugugcuuaaguuuccugaccacuucgccaugcaaggagggccucucucaucaguagcuguucugagugagccgagaucaugccacugcacuccagccuggaugacagagcaagacuccaucucaaaaaagaagaaaggaauacuauaaggggaaaaaaauuaagcaguaacuacuuaaaacccagaaauuuuugguaauagugauaauacuuaaucaaaauuggacaguuauuuuacaauuuaacaauucauuuuacagucaaaacaguguuaugauagaaguaggaugaguuuuacuguuauccacuguuaaaaaaauaaaaauuaaaguuuggaaauugagucauuugacccagguggcacaguuaauaauugaaaaagccagaacuuaaauguuggccuuauccuacacagaagugcuuauucuacaaccccgcuuugcagcauucuggagaaauuaacaaauuaaacaauuucuccuagacacuaauaauaguaagucaaaggaauaucugugagugaaguaucuaaaagaugccaacaaauucuguuuuuuaaaaaagacaaauccaaaauuuccauggauggagguuguagcugggcugaggccagcucugccgccucguggaggccucgucugagagguggcggcagccaugcguccugggagucaguguuauaaaagcagccuuggaagagagccuagcagcucuguguuccuuuuuuaguuuuucccauuuccaaagaccaaagaucacggaaggaagaagagaaaaaucauuauuucagauugaacugaagucuuaaacuguaaauuaaguuaaugugggccugcuggggauaucuuggggguuggggaggguggacuuguucuuggaucuuggcagaagaaaucauuaucuggaccuuuauuggacuggauacccuuuucugcaucuugggccuuccuucucuaugcucccgaggugcccuggguaggauguccucucagcucaauguacuaggauuaacacugaaagaaauuaaacucagagcaucccagugggcaccagaggguucugcagaggggccugggcuccugccugcaaccccagguggcagugcagacaggagcaggugggcugggcaugcacuucgaccacccuuucuccccuuccucucugugcccuuuagagucuaccccauggugaugcccgcuguagccauucccuuggggagagaaaugcuuugcagauguuucuaaccauaaguguaggugugaaaacaugggcuuuuguaacugagaggugggaaugcaauccccuacucugagauuucuugaccuugacaugugacuuuaucucucuaaaccucaauuucccuucugaaagguagaaauaaguacacugcccaccucguggugucauuguaucucuuugaugaugcauagaaagcaaucaauggcugggugcaguggcucacgucuguaaucccaacacuuugggaggccgaggagggcggaucaugaggucaagagaucgagaccauccuggcuaacacggugaaaaccugucucuacuaaaaaauacaaaaaauuagccggauguggugcgggcgccuguagucccagcuacucgggaggcugaggcaggagaauggcgugaacccgggaggcggagcuugcagugagcggagauagugccacugcacuccagccugggcggcagagcgagacuccaucucaaaaaaaaaaaaaaaagcuaucaguaucccagugccuggaccaaguacuaacuagagggagcagcacugagaaaaacugacucugcucauagggcagcuguccauacacauauggacagcacaaguaaaagaagaacaaguauggggauguucuugaugagaauguugagaaaacucaucacugacauagcauaaagagagcucccaaucagguuggaaggcagcuuugaggucuucaaaccuagucuucugcgcaguacagaaaucccccuucccacagcaugccugguaggugaccacccccuuucagagguccccaaaccuacccuguaucagaauuaaugggggccacuguugaaaaagaaauucccagggcucagccugcgaguagcugcauccgugagauuugaggcagagccuggcaaaugguagcuggaccguuugagaagcucuuuguaaagauaaaauucagaagggccaagagcgugccuguuuucuucccugcugugucuguagcaguuagcacagauccuggugcagaguuggggcuccauaaauaccugcuggaugagggcugaaucaugcagccucuuccagaaccauuccggugaucggaagcuucucccuagaaagggagcucauuucuguuuugauuaacugauggcuaguuauggucuugcuuauaauaagcaacgucuuucuuccucucaucuucacuuauucagccuaacucuucuuucaagagugacacagauucuguuugcucucagaagggauuaucccugagccauaguucaguaaggguggaguauuuuuuccaagugaaaggagggcugagugaugaauaaacuggguuagaggugcuucaucaagaaacugaaacccaagcaaucaaaaugaguggcaaugaauuggaguacauagaucgcaucugaaggacaugcaauauaaaccugggcuccccaaaccugauuaagagucccagugaagcccuaugaaauagauaccauuuuacacaugagaaaaaugaagaacugagaguuuacucgauauuaccuaugagcugggugugguggugcaugccagcacuaugggaagcugaggugggaggaucaucugaggccaagaguucaagaccagccugggcgacauagcgagacccccaugucuacaaaaaaaaauuuaaaguuagcuggaugugguggcauacaccuguagucccguagcugcucaggaggcuggggcaggaggauagcuugagcccaggaguucaaggcugcgcugagccaugauugugccacugcauuccagucugggugacauagugagacccugucucuuuauuaaacagagagagagagaaagagagagauuaccuauuaaauauagaagagcuagaacuuaaaccagguggagaauuauauuaaaguucaaagaggcuggcugugguggcucaugucuguaaucccagcacuuugggaggccgaggugggcggaucaccugaggucaggaguucgagacuagccuggccaacaugaugaaaucucgucucuacuaaaaauacaaaaauuagcugggcauggcggcaagcaccuguaaucccagcuacucgggaggcugagacaggagaaucgcuugaacugggaaguggagguugcagugagccaagauuguaccauugcacuccagccucagagacaagagcaaaacucccucucaaaaaaaaaaaaaaaaaaaaguucaaacaaaauagcagcagcugaguuugagacacauaggaaaaaaaaacaaaaaaaggaacuucaagccagaguuuugguuuuggcuccuggcucuuccauugacugcguguuucuauaaacaccgcucgcccuuggcagucuucaugugcaguaguagaugguuccagagaagucauuaagaccaucacaguucaucugacugucugugauccuagggugcuuugagcuggagcugaacugcaaaguaggagcugugaaacacacagguucagaaauucuccuuuucagucuauucgggguuguuuaaauaucguucugugugcaucuucucaggaaauguuuucuuauucuacauugacuagccaggaacaccuggggcuguguagcagcucuuucaggagguuuaguaaacgguaauaugauauuauauguuuuccuacuuacagacauccugcacucagacacacauugaauggugcuauuaaaugcuuuucuauuuuaaaauagcuuauuagaauaaauaugagguugggagagcacuauuagguucucugcugacagucagggcagccucugguuuuaacauuuuaauauucaccuagugguauaagcacagccgguuugaucagcagcagugauuggcagacuuccucugugugcccaggagcuuuucuggggguggaaaaaaggagauagcacugaaagcauccugcagaucacagcuagagccaccuguuccugguguuuaccuggagaaguuaacuaguacgcaucuacuuccacuccauucagauagaauuuaccaauuccagaugggcuaagaugguggguuguggauaauguauauuuuuuauuuauucacccauucauucauccauucauccacacaccugcaguauaaugggccccuagagcacuuaagcuuuuuaaucaaggaagcagaaucaucaaauuugugcuuucaaaacauuucuguggcuagguaggcagaauggaauggcacagggcuacccugaggaaaaagugaucagguacaaaucugcuaauccaggagagagagagaggaggagagcaugguagagcaagggaagggaugaauuugagaaacacuccauagauaaaaucugugggauuugggcauggcaaggaugugaggaaugaggagcaggaggguucaagauugaguaaaaggcuucuagcuguggugacaaguuugaucuucaugcuaccaaccaagaaaacagguaggggucacaccuauuuuguaggaggagaagauuguggaguuaguuuuggucagcuugcguugaaagucauuguggaacagccaaaucaccuaagaagauggugggcugauacauagauugaagaguagggcacuuuggaaagaagucugaguuaacauggagauuggugaucaucuuccagucaauagugucugaagccaccggaguagaucccaucaucuguggauaaaauagagaguaacaaaagggggccaagaaggggaguuggggagcaccagcauguuaaggguggcagagagagggaagcuccauggaggagguaggggaaggauguucagagggaguacaucagcgaagggacagaugucgccgacgcuaaaggcuucagaaagguggaguggggugagagacagcagggauggggugagggguaauguagccaaauuuugcagaguccagucuaugcaccuaaaugucagcacuuggguaggaaaaccuagacauuaugaacacuggucaucccaaaagggaggaagagaagugccuuuaguugagcaucucccaugagccagcacuuuacaucugucauccuuuuuuuuuuuuuuuugagauggagucucacucugucaccuagacuggagugcaguggcgcagucucgguucacugcagccuccgccucccaaguucaagcgauucucaugccuuagccucccaaguagcugggauuacaggugcaugccaccacacccagcuaauuuuuuuguauuuuuaguagaggcggggguuucacuauguuggccaggcuggucuugaacuccugacuucaagugauccacccaccuuggccucccaaagugcugggauuacaggugugagccaccgcgcccggccuuguaucaucuuaaucugaucucaauauccauucuuagaggucagagauagauuuuauacuuaaccuuuuaugauaaggaaacucaaggcucagagaagcuauaccuuggucaaaucauacacagguggggcuagaauccuguuuugccaaguuuuaaaauccuuugucuuccugauuuaucaugcugccuucuuuauacccaauggacgaaugcucagcucagccuuuucaugccagaugcacuguguggaagaauuguaguucucugcuccuugguucucaccucccgagcagcaggagccgggccuugagccaaaaccugcagaaggaagaagagaggagaguucccugcguagagccauccaucugcuggcuggugacaccaacaccagggccccagcagaaaagcaagcuuguucgcucuugucugacuguuaguagugauguaugaauaagcaaagaagacagcuucauuuucauaaguuaacuugugccuagacuaaggaagauggagaacagcgcacuuaaucauaaccacaggcccagcuuggaaaacaaugacaaagcguuuucugugagucacaguguuuuauuacaauaacucccaagaagacgagacaggcagugcagaaugcugagcaagccagcacccuguagccaccugugucaucucccccaaggaauccccugggauuuuaccucuucacacgauggcaagcugaagauguguuugcaccaucaagguuacagcuguagacuugggccucuggagaccaggauuuagaugccaccuggaugaugggcugggauugcuggaacugucacagaucaccuguaucauccaugcugucaccugguagcagaggggacuucucuccuagaaggguguuacccgacagaacccuuauuggaaaagcuuuuggggaggccuggcugcagugcuggaagggaugugguaggugacucggugggaagggagacauccaacuugucuagcagguaucacccacuuacccccacagaaucaauuacucccuacuuauuauucccccaucuugcuaauaucgcccugucacugcuaauaucaugcugcuucaaaauuguuuaucugucuccucuucuagcugcccccagggcaagaacuauguuuuuuuugucuuucauuccuuaguauuuuguguggugucugacacaacucaaacccucaaucgauacuaagcugaaccaacgucucagcaaacuaagggccaugucagcuaaggacaggaggagauggcugagcuggagguccaggcagauggagcagaguguaggaccagggaguucugggugcuuccauaagagcaaaugcuuacugaacgcuuuacuauuucaucgacgcuuuuagugguaauguuugaauaagcacaaaacacagcaucauuuucacaaauuaacuugugcuuagaggaaaaaaaaaauuagguauguuacuuacuaucucuauuuuacaagugaaugaagaagcaagcacagagaggcuaaguaccuuguccagggucacauagcuaguaaguggaagagccaggauuugagcccaggcgucuggcucugguguucauuuucuucaccacuuuacuguacucaggaaguauggcauuggagacuaccaaugaauucuacugguuuaugaggugaauguagacaccaugugaguuuauuaugugccagucacccugcaggugaaauuuacccuugacuaaagcaguaacggagcuuccaaacuccaaucaguaauucucaaacuuuaaugugcaucugaauuaccuggggaguugguuuauuucaaugcaaauuacuagaccccguggccagaauucuuaugcagaaauauuguggagugagggaauuaauauauuauuuccccauaugcaccacccccgccccugccaauauugaaccaacuuagagauaaaggagggagagccagaugucaccuuauuuuacugauaaaggugaaauuggaggacucaacuuuagaguccuucaguaucuacaauggcucuuccuagcaccaaaacccagaguuggaauugcucagcuaucccaagaaguacuagacaaccacagccucacagaggaggucugcucuauaaaauuuaacagcgugaaagaacagauucgaugcaggcuaucuguuggcaugcuggcuccuggaagaagggacagaggaagaggcuaggccacaucaacuugguugccucugaaacucaccuuucucuuccccauggauguggaaggaguuaucugucaccagucagauaacugucaccagucaguuaacuccuuucacacccauggggaagagaaaagaucggcucaaggugucaagaaaucccuccuucuagaaaccggagaaguaggggaaagcauccucccacuaauaacuaacuucuagguugaaugaagcccaggagccugugcuuuuagcaagaaucucagggguuucugaaacagauaguccucagaccacacuuagagaggcagaguucgagaauggccuaaugguugugcuggaugaccuccaaagaaaaccucauggauaagcuugcugucuaucaggggcuuucggguuaggauaggcagugacuaucauauguacagugcuuagaguuccagcuucuguucuaagaacuuaacauguaugaagucauuccagcaugugaagucacagcagcuguaagaguuagauaccaaggcagagauagguuaagcaauuuuuuucacggcuacgcagcuagaagguggcagggcuaggaaccggaaccaggcagccugaguucaguccacacucuuuaucuccaacuauauugauguucaugguucccucuucacacagaagcugggaaggcacagccugaaagcaaaacucaacaccguugagaggcuaagcaacaucgcuuacccuuacuacuguuuugaucauugauauggcagcuaaugaauuucuuuuaaaaagcaaaaugaagucucaguagcugcugauuauucuguuuuuuucucaccaauggauauuaaaguucuaacuaucauguugcuaauuaaggaauuuuuuaagaggauuggcgugccugagaggguuaagugguacuaucaaaagcaaugcagcccagguacaaacugaaugaagagcaauuuggauauuauucuuugggauaacgugacuuuagguuaaccaugaaaaucauuccuucucuggagaugaagaccuugaguuuaagccuuauguagagcaccccaagugggugcugccuccccaucuuugcaguuuuccauacaggggagcgggugccugaguucccagagcuggguggaaggucuguuaauauuggugacuacagagagggugaaaugauuuaugaggacacuaacacacacccgaucaggaagguuaacccacuagaugucauuuauuuagcagacauuuauuaagcaccuacuguguguucaguacuacaccuuguaguaucuugcccuuggaauaaugcaggaagugguuauuuauaaaugaggucugugggugccugaauauugccaacuucaucuuuuauggaguguaagucagcugcuggcaaaauacccguaggagccaggcaugguggcucacgccuguaauccuagcacuuugggaggcugcggugggaggaucgccugagguuaggaguucgagaucagccuggucaacauggcgaaacccugucucugcuaaaaauacaaaaauuagccagacaugguggcaggugucuguaaucccagcuacucaggaggcugaggcaggagaaucgcuuuaacucgggaggcgaagguugcagugagccgagauggcgccauuugcacuccagccugggcgacagagcaagacuccaucucaaaaaacaaaacaaagcaaacaaacaaacaaaaaacaguaggaaguacuaaauagugaugucuuccaucuaauaugggaaugaagauaaaguaauaguucagacuugggcuuauucauaaaaggcuucaugcuggagauggaccuugaaaggauuguggguggggauuggcagggggggcaagggcaaugccugccaagggagagcuauaugagcaagguagaaauuagaccacaggcaacaaaauauuuuuguuuggcaggaauaaaguguagcucguagaguauuugucugaagaaguaaacaggcaaaauaaaauguaugggaugccaccauauaaaauuuggccuuucagauaucugaagaugaccuuaccugaaauuuagauggacccccuaaauucaauaaaagauccuucccaggcugggcgcaguggcucacgcuuguaaucccagcacuuugggaggccgaggcaggcggaucacaaggucaggagaucgagaccauccuggccaacacggugaaaccccgucucuacuaaaauacacaaaauuaacugggugugguggugugugccuguagucccagcuacucgggaggcugaggcaggggaguuacuugaacccgggaggcggagguugcagugagcccagauugcgccacugcacuccagccuggcaacagagcgagacuacgucucaaaaacaaaacaaaagacccuugggauacccaccuggggccuuaguaauuaucuuaauaauuagguaucaccccucucccccaacaaugacacuucccauccucauugugagguuauuaaaugaggucucuagcugggucauagcaucaggacaggacacacagcuuucccaacuaagggcacccugccuuucagaucuaauuguucugcacaaauguccuaagcuuguugcacaugggauugauugacucuuauacucccugaauugguguuauguuuuucugaggaauucuacaaguuuuagaugucaucauauacaaugacaaagugggugguaguguuuuucccaugccucugauuuauguauuugugcccggggugaugauuuagauaggagcuuaauaaaauugaucgaauauauuaccccaaacccacacaccaucauuucagggagcugucaucauaccaaggagaugcuauaucacccagcauaguguuccaaaagaaccacuguguuuucuuaagugcggaugggcuuccauuuggucagaaaggucuuuauuucucaaauuggccaacaguacaagaguguaaauucaaaagguauugguuagcuguagaagagagucauuguuaggugugugacuuuuccaaguuauuuaaacucucuaaaccucaauuucccuuucuuuuuuuuuuuuuuuuuuuuuuuguuuuguuuuuugagacggagucuugcucucucacccagacuggagugcaguggugcgaucucggcucacugcaagcuccgccuuccggauucaugccauucuccugccucagccucccaaguagcugggacuacaggugcccgccaccacgccuggcuaauuuuuuguauuuuuaguagagaugggguuucacuguguuagccaggauggucuccaucuccugaccucaugauccgcccaucccggccucccaaagugcugggauuacaggugugagccaccgcacccagcccucaauuucccuuucuacaaaacguggauugauaauuccugccuaaaauauuuguuuuuguaaggauaagcaauagugcaucaagacagugggaggaaucuuuguuucaaacaaauguagaugucuauccuagcuccaucuuuagcuguccaagucacugguccuuugugagccuguuuccuaggcugugaaaugguauugguaauaauugcaagagaaggccuucugcaugauggaguugucuaaaggagccagguggaucagaugugaaggcccagagacauguacgcccuaagagauugaccacaaggcuaacuugccuaaguugcuaagaugcagcagagacugaggccaacaucaacgccagcucuggggacagaggagcaguuguuaucuagacaacacucuuguauugauaugauauugacaugaugcuuguugacacaagauaaauauauuugaaaggaagcagugagggugagaacaaaaacccuguaagaagguggacaaagaguggcucuucucuuugggcucucgucucagcaaacaaggguaaucccuccucccugucgugagaaaccaaucccaguccauucccagaaaacgaguaaauuaauguacagugggaaauaccagaaugggaaugcuugagaaauaguaugccugucaauaaauaugugcuccaugaguuaggaaagaaaugcaugcaugcaugcaugaaugaaugaaugaaugaaugaaugaaugaaugauuugggauucuagcuuuaucagauucacuaggugaccugcagcaaaucaguuaacuguucugggccucuauuucuucucuauaaaauggaaauaauaaaaaugacugccuaauggugagaauuaaauauguuaaugcaaguuaagcuguuaggucagaggcuggcacuucauaaaaccucucaguaagugaauacuguuguugugaugauuugccauuacccugugucuucaauagucacugauccagauggcuuggcuucuccuuuuaagauguuuguauucucuguaccucacaggucagcaaguccugggcuugguggagaaccagagugacugguaccuuggaaaccuguggaaaaaucaccgcccauggccagcccuuggaagaggcuacaacacagguaaauccucagggugguaugggaagaguugcagaaggugauaugaggacccagugcuccuuccgcaggagaggagauugcaaaagcucaggaggaggccaccugauugcuugaauucagugguggaugguuugugggcaguuugcauuccaguuccuucuuggugcuauacccacagguagaguaaccguugggcuguggcagucuguggcaucucaccagaaagccccucuccugaccucuaauccagauccuauuggauaucuuuaucaguaugacccauagguucccuggcucuguuaauacagaccagauaucauucuucaguaacaaccccauuucaguuucuuaacacaacggauauguacuuuugccaaucacauuccacguccacuugaggucuucagggaucuguguucacuguggguacucaggauucaucuccaugcauacuuccauguauguggugggaaaguagcagaaguuguauuaucucuuaaaguuuuuguuuagaagugacguaauuucauauuucauugacuaagcauguuguguggccaugccucccuuuaaagcgugugggcaagugcagucuaccaugugccuggcaggagaaaaagcagauauauuugcuaaucagcacuuuugaggaccacaugugccuggcaggagaaaaugcagaaauauuugguaaucagcacuuuugaggaccacagaccuauaaccaugugucuaaaauaaaauccauuauucuaccucguuacuagccccaaacuugcaucuccucuucaguuucuuucucuguuauugguguccuucauucauccaucaacccuucuuguucaccagcugucccuugaaugcuuacuguguacgaggcccuaugcuagcugcagcagacacaguccaugaccucaugggguguauaagcaaugaaacuagggcagccucuuccuccugaggcucaauucccaucagugucuaucuuugacaugcuucuggauccuucugccucccuccuccauccucauugccacugcugugguaucccauucucaaaggaugcagacuccugaucuuugucagacuagaauguggaacucagggaacaguaggaugggugagaccaagaagggcuggaacuuggcaucugagaccagcaaaugaaguggguugggacaggugucuggcucuggggacaguaccaccuaaaagugauaagugaagccugcccuggaggcugaggccagucuguagugggaucagccaaaaagagucccaaauucugagagcugauggucagacuccagaaaagucaaaugcaaacacagggucccagagaacaaaggagaagggacaugagucaagcuuccagagguaagaguucacagauggggucagagugggggucaaagcuagaggaggacaaggaaagaaaguccagcaucaauguccagagguggcaggcagccagggagcccuguauugacggccauccuaagagacggggacauuccuuagcuaacauuugccugaguauuagauaugccuugcucuauguaauuuuuuuuuuccuguaaugccuaccaggcaaacagagguugugauugaagaaugucaaccaccagcccuucacagacuccagauucccacccuggagucucccaugcuguguugggcauuaauacuuuaguugcuggaugauggggaagucugaggaguuccugagaggggccagguuggggaaaggcagcugagggcaucagagcagugguucucuuagcaggucaggagguauuucacucuuuucaauaauggguaaggcagggccucuacguaucagcugaguauuagccaggcaccauguuaggugcuuuaugguugucagucuccuuugauccucacacucauccuaugaggcaggugccaugccuauaccagaagaaacuagucuauaccagaggaaacugaagauuggagcaucgaaggcugcaacccugaaaagucaaggagccugugguguuaacuaccaaccugccuugcuugaacuuuaauggcuucaggauuaaacacuuuucaacaauggagaauucugggcucugcccuucaagagucugauugacuaggucugugcaggagacugggauucuguccuauaggaagccucuaggauguuucuggggcagaauguccaagggccugcucugauuaaacauggcacucuguuuccugucccagcaagcucucccagacgcuguuuucucagugcauuggagacuggacccuccaugaacccacagcgggccagggacggggguuccacgugcuuuccucuggcaaacgacuagucaccccguguugaucuuuugugccuggauuuucagacacguucccuccaagcuuucauggagguggagacaccuauguuucuggguggagaaaggaagucucaggaaaacccugguguauacauuucguuucugucuuccaaaauauauaauagaaaaugucacauagaaauauacugcagugccucagggaugcugcaucaagaucacgguuuccugcguaaaacaaaagccgcuggucaucaauccggguuugcagagagaagaagaauguagcacacuagggaauuuauuacaaccaaaauggcaugucucuuccugcccuucccuauuugcuauagaauguagcaucaggagacacaggagcacguaaaccaccuccaguucccgcuugauuugucaaagcagugaguuacuucccuccucgcugguacugaaagggcagagcagaagagggaaagcccuguugaagugauguguccauuuaaauaagccagugacacugagugauuauuaugaaaggacuuaggcaacaucaaaaugcaaaaaaauggcuuucacgaaggggaugugucgcuuuaaaaccaaggauugugccacccagugaaugagucauccagacauguagauucucauggaaacugaggacgacccuggagagaaccugccacccuaaaucccagcacaucugaagccuccaaaaagaauaucuccagcagaaccuccugucuuaugccuucagcuugauguuaggaacucaggcagaucuggguuagagcugcaguacagucauuuagucuucuuaugcaacuuggccaagucacuucacuccuugaaccucaguucucuccuuuuuuuuuuuuuuuuuuguuucuuuuuuuuugagacagagucucgcucuuucgcccaggcuggagugcaguggcgcaaucucggcucacugcaagcucugccucccggguucacgccauucuccugccucagccucccgaauagcugggacuacaggcgcccaccaccacgcccggcuaauuuuuuuuuuuuuuuuuuuuuuaguagugacgggguuucaccacguuagccagaauggucucgaucuccugaccucaugauccacccgccucagccucccaaagugcugggauuacaggcaugagccaccgugcccagcaguucucucucuuuuuuaagauaggacaaggccaggcacgguggcucacgccuguaaucucagcacuuugggaggccgagguggguggaucacgaggucaggaguugaagaccagccuggccaagauggugaaaccccaucucuacuaaaaauacaaaaaauuagcugggcaugguggugugugccuguaaucccagcuacucgggaggcugaggcagagaauugcuuaacccaggagguggagguugcagugagccgagaucaugccacugcacuccagcugggcgacagacugagacucugucucaaaaaaaaaaaaaaaagacauaacaaaccuaguaugugaggauuagcaauuaauguuguaacuuguuuaaugagccuagccugauccagggcacaaaguaaguacuuaguaaaucuuggucuuucuccucuugcauuuuucugccacuugcucuaucagggaaugagauuuaccgacuggaaaaaggagguuaugugauugacugggguuugcuaaggucucccaagcccuuuggucagaaagaacgaguaaguauuuuacuuuccccagguguaauccagcuaccuagcaguuuuuccuguaucucuuuacuaucugaaaagguuagcuuuuuauaucacauuaggaaaaaaaaugacuauuuaguucgcauaucagcuuccucgcuguguuuuacuuugaaaauccccagaaaagcauaugagauguuuguguuggaagcucugccuucaagaccuggcguuguugcuuuugaguucugugccuuuuggaaagcuuacccaagcucagggagccuugggcuucucauuuaugaacuggggaccucagaacccacucggaggcucuguugugguggcgcagccacgugugccugggguaaaccaaaguacuuuagcaaguugguugugauuuuuauuuaucccccuaaccauagcccaacugaauaacucuuuucagcuaauucagauucaaccgcagacaucaaacacagccucuucacuacacauucauucauugacucaucccaccaggcaucauaccaggcaccauagcgugcaugggcuuuguuaauuccuugaauuaucuuauaaacuagacuuuucccccuacaagagucagucaguuucccccguucucuuuguuugcuuuucuuucccagucugcuuuuccaaagccuacauggccacaaaacauuagagaagaucuuuccaccaucucccauucaucuccuucccuuuuuacuagagcuguucccaacuuaauuccagaagcuacugagccaccgcagcuucggauggauaaccaggcagauccuagcaugaagcucuugcccauaacuguucgggugaaauuacaggcgucuuucacagucuugcacagaaacgggucaguuuccaaccgcucugcccaggcaucaucuccuagaugcaagaagcugucauucacccagcauucagcugugagcaggacuuagaaaacaacaacaaaaauacaccuaggauuuugacaggcucauuaagauucagcucucuucaguuccuaagcugacggaugaauaucuuaaaaacaaacaacagcaaagaaaaggggaaggagggcuaaacauagcaggggauuggagaaugaggugagggaaggcaggucgguagaaagaagauggcauguuugcagauagguuuauuugcaugggaccccaaaggcgacucaagcacaaggugcguccuccccaaguugaaggguguaacacuagccagagaaugugcuuuuuaaaacaauuuaaaaauaaaauguaucguguuucauucagcccccaaauuagggcagagacaggcagauggagaccuggcuguuuagggagggaggaagaauuucucucggaauccuucucugcaggacaacaaaauuggaaugcucaaggacuggcucaccucugagguuagagcaaaccguggaaggcaaugggcaguacagucagauaccauggaaaauucuguggcagagauucaaaaggagaaaacauuugauaguuugccaaagaacuguuaaauagcuuuagugggauaaauagaaauaugcaaucuaggcucaacuuaccucugccucugacauccagcauucugggacccuggcuaagucccuucauuucucugcaucuuaauugucucugaugucaggaacuaagaucucuucguguucugaaagaauacugugauugggugauuucugucuguaauaauugcauccagagaagcuauauuuaaauacaauuuauucauucauuacaugcuacugaauaccuauaauacuggcaaggguaggguagaaaacuguuuuguuuuguuuuuuaaaugggugauaccaagaaccuuccuucaaaaaguuuaucgucuaauagagaagcguuugcauaucugcaaauaaaguuaauaugacuugagccucuuccaugauugagauccagaauugaucaucagcccugcaguaauaaccccuagacuagcguuuucuagacuaauuccagaggucacugcaagggaugugaauauguguuuagaaauugugaacagaggccaggugcgguggcucacaccuguaaucccagcacuuuaggaggccgaagcggguggaucacaaggucaggaaaucgagaccauccuggcuaacauggugaaacccugucucuacuaaaaauacaaaauaaauaaauaaauuagccggucaugguggcacgugccuguagucccagcuacucaggaggcugaggcaagagaaucgcuugaaccuagaaggcggagguugcagugagccgagaucgugccugcauacugugucugcccuuuggagauucauaugugcauguuagagaucuuauaaagucuggaaguaaagaaagcuauuacacccagaagcauuucccaguuuuacuugauccuagagcuacggaaauaaauuagggacaaacugccuguagauggagucuguagaauaaucccacugaaagaugugugcuauucuaagaacaguucuucugacaucgugcucaauagaaaugucuacucccuacuuucuuuuguacuguagguucucauucaucuuucugcugcaaggauguagacacugucuuaggugcuauaacagaugucccauagacuggguggcuuaacuacaaacauuucucacaguucuggagccugggaagucuaagaucaagguacccagccauucuaguguguggugaggacuuacuuucuuguuugcacauggacaccuucucauuguauccugacauggcagagagcagggaaagaaaauauucugucuguauauccucuuuuuuuguuuuuguuuuuuugagacagagucuugcucugucacccaggcugaagugcaauggcaauaucucggcucacugcaaccuccaccucccggguucaagcgauucuccugccucagccuccugaguagcugggauuacaggcacacgccaccacaccuggcuaauuuuuguauuuuuaguggaggugagguuucaccacguugaucaggcuggucuugaacuccuaaccucaugauccacccguuuccaccucccaaagugcugggauuacaggcgugagcugccgcgcccagccuugugucucuucuuacaaggucauuaaucacauuaaugaagucccuaccuucaugacccuaauuacuucccaaaggccccaccuucuaauacugucucauuaggaauuaggauuuuaaaguauuuuauuuuauuuuuugagauagggucuugcucugucagucaggcuggaguacaguggcgcagacacagcucgcugcagccucgaccuccuaggcucaagcagaccuugcaggcucaagcgauccucucaccucagccuccagaguagcuuggacuacagcugugcacccccacccuaggcucauuuucuuauuuuuuauauagacagggucucacuuuguugcucaggcuggucucgaauccugagcucaagcaauccucccaccucugcuucccaaagugcuaggauuacaggugugagccacuaugccuggacggguuuaggacuuuaaugugugaauuugggggagauaugacauucaguccauugcagguaccauaucauugcaccugcuuaaucacucugcugugugucauugcauaacugaagcgagcauccuuccaaaaccuucuguccauagguaggaauucugugagagauggcuucuacaccuuuuccaauccugauugguugaccaccuuuagauagcuccacuuuuucucuuuggaagugacacucugaccugaaugauaugcaguggccauuauccaacaauugaagguucacaccuccaccuguaaacuuccgcucacuguucugaaucacuuaaaauuccuguuuaaaaugucaaccucagggcccugcccccagagaaagugaaucucaaugucuagagaugaggcugggugacuguucuuuuaaacaugcucccuacuugauuccgaugguuacuuaaguuugagaaccaguaccuaggccucugaugauguacuuuuacugccacauugcacuucuagcucaaauugaacuugaguucaacugagaagcuccaugaaugacuuuucagccaaaugcuccccuuucuguacuucuguaguagccuuauugagucuaaaguacagauuuuauauuggucuagugaguuuuaucuucuuuggaccauucuuuucaucauuuuauuagauuucauauuaggguauccacaaaaauacuaaaaaugccuucuguuccuucacccaguguccuugccccauauuuguaacaaauguuuugaaugccucuuuuauaauccuggaaugaaauucaaggauuacaucuauauuauauugccuacaaguguaauuuuuuuuuuuuuuuuuugagacagaaucucacagcagagcccaggcuggagggcaguggugcaaucucugcucacugcaaccuucgucuccgggguucaagccauucccgcgccucagccuccugaguagcugggauuacaggcgcacaccaccaugcccagcuaauuuauguauuuuuuuuaauagagacgggguuucacuguguuggccaggcuggucucauacuccugaccucaagugauccgcccaccucagccucccaaagugcugggauuacaggcgugagccaccgugcccagccauaauuauaauuuuuuuaaagaaaauuaauauagugcccuggcuuuaauauaaagaguaaauaaaauaaaauuauuauaaaauaauauuuacuucaacguguaauggucagguuuggcuauaguaaaugaccuaauaaaguggucagaugcuucugugccuguauuugggauagaacugucuucacugugacgccuacgagugcugaaugguacugauacauuaccagcacucggcauuucaugagugggguuugccaaauuugugguacauuuuuccaaaguagugaacaacucuugguaaaguaucagauaacaggaaguaccaucuucgcuugacuuguucuccaaguucagugacuauucaaaccaugcaaaaaaaaaaaaaugguuuuaaaaaauaucccguaaguaguguuaguuccaggcucaaauauugauaggguuuggaucuguuucccugcccaaaucucauguugaauuguaauccccaguguuuagguggggccuggugggaagugauuggaucauggggguggauuucucaugaaugguuuagcaccaucaccuuggugccguucucaugauagugagugaguucucaugagaucugguuguuuaaaaguguguauggccgggcgcagaggaucaugaggucaggaguucgagaccagccuggccaacauggugaaaccccaucucuacuaaagauacaaaaaauuagccaggcgugguggcaugcaccugugaucccaaccacucggaagguggaggcaguacaaucucuuaaaccaaggaguuggagguugcagugagcggagaucaugccauuguacuccagccuggguaacagagcaagauuccaucucaaaaaaaaaaaaaaaaaguguguagcacuuccaagcucguucucugucuccugcuccugcucuggccaugugagguaccugcucccccuuugccuucugccaugauuggaagcuuccugaggccuccccagaagcugagcagaugccagcaccauacuucuuguaaagccugcagaaccgugagccaaugaaaugacuuuucuuuauaaauuacccagucuuggguauuucccuguagcaacacgagaacagacuaacacagauacuuaacaauuauguguaauuauaaacaugaacggccugugguacccacauguuaugugggugcauuuuucauugugcuggacacuccugggaaggagcacugccugcuuugaaagucgaagguuggagguguugccaguguucaacaggcuggcuggaugcaaagcugugcuguguuuaaaauccuuccugggguuggcagcaaugaguaagauaaugcuccuugcucacagagaguagucggccagcugaaagccugcuuggcaguacugccaugggcuacuucucuccacuuaaccuuuauccaaauucagugacccaaccaaagcuuauucacuuuguauccugauccagaaucuucuuuggccucaggucugccuccuggauucacagagaauaaaccuacucccucuuccaccugcuuacccccagaaaucuaacugaaagaaagcagacaaugccuucucaucuugccuucuguaguccuggcacccugguuuccucaggaauuccuauaugucacuuagucucugagcaccaguucacucauaugugaguugaggaugguuauaguaaguaccauagaaaggauuguucugaaaaguaaaugagauaauagaguacauuuaaugugaugagacaagguuuagcacauaguaaaugcucaguaaauguaggcauaguuaccuuguuuuuuaagaggcagacggagggccugcaguaugucuggccucuugccuuauuggucaaccugggauccuauagcucauauuuuauuuuugcuauuaagagacuguauugcuuguauucuggaguugaacagucuuugguccaagucccaccuccaccuguuacuagcucccuuauucuggggaaugaacaacuuuuucauuucaggauaaaaagaauucauauuucacacagaugccuucaggagaaaaggaguuaauguuuucaaagugcaugggacagugucugggucaauaaauguuagauauuaguauuuucccacuccuuuauugauugauugauugauugauugauugauugauuuuauuuuauuuuuuauuuuuugaaacagaggcucacucugucgcccaaggcuggagugcaguggcgugaucucugcucacugcaaccuccaccuccuggguucaagcaacuuuccuaccucagccucccaaguaccugggacuacaggcaugcaucaccacaccuggcuaauuuuuuguauuuuugguagagaugggguuucaccauguuggccgggcuggucucgaacuccugaccucaggugauucaccccccucggccucccaaacugcugagauuacaggcaugagccaccgcgcccagccuuccuuuuccuuuaauacucgaaguacguaaauggggaaagaggauuacgucugugucuuuugacaguaacuccgucuuuugcccagguaagguauuuggagcugagcauucucccagggcugaccauccacguguucauucauuuguuggacagaaauuaaacaugcaucuagcacaugcaaugugccaagcuucucuguaggcccuggggugccacagugaacaagacaaaugggaacccuguuuacagggagguuacugguuauugugggggagaaacugucuuccuucuugugcuuuuuugaugucguuuccuggaaguguuccccacacucgcuccacuccagccacucuggcuuccuugcugcucuuugaacacaccuauuuaaaugugagccucucugccuccaaacuacagccuccaugcuauuccguuuuccaccuuauucuccuccagcacuuuuaaguaccaucugaccaacuacaguuugguucauuuucuuuuaauuucccugugucuuuccaugaggauauaaguuccucaaagguaguaauuuuuuucugucaauuucacugcugucuauggccauaccacccugaaugcacccaaucucaucugaauuucacugcuuuaucccccauaccuggaaucaugccuggccuguauuaggcacuaaguauuuguuguugaauaaaauaaauaauuuuggaagauaaguguuucgaagacagugauauagagcagcauuucucaugguugcucgugggaaauuuuacaacccaugggacaccggcaaugucuggagacauuuuucuugucacagccaggagguucuacgggcacuuaguggguagaggccagggaugccacuaguacaccagacaguccccccauaacaaagauucaucugggucaggugcaguggcucaugccuauaaucucagcacuuugggaggccaaagugaguggaucacuugaggucaggaguucgagaccagccuggccaacauggugaaaccccaccucuacuauaaacacaaaaauuagcugggugugauggugguaggcgccuguaaucccagcuauuugggaggcugaggcacgagaaucgcucggacccaggaggcagaggcugcagugagcugagaucgugccacuacacuucagccugggcaauagagcgagacuccaucucaaaacaaacaaacaaaaaacaacaacaacaacaacaaaaacaaagauucaucuggccacaaauaccacuaguggaacccuaacagaaaagcaaguuuugagggaauuggauucuucuagaaaggaccguuucuuuggguagagucucugagaagacgacauuugagcuaagaccugaaggauggaaaggcggcagccaugcugagagcuggaaugagcaucccagauagagaggacggcacgugcaaaggccaccaagcaggcguguacuugggugaucguguuucccucucaugaucauggcccucaucauuccuggcacugcacccucugcucuugucaccuuuaucuaguaaugcaugagugguugauauggucaggcccugugucuccacccagaucucaucuugaauuguaauccccaugugucaaaggaggaaccugaugggaggcaauugcauuaugggggugguuccccuaugcuguacuugugauagugaguucuccugagaucugagguuuuuuaagguggcgauuuuuccugugcuugcaacuggacuucucucuugccugccaccauguaagacgugccugcuucccuuuccaccaugauuguaaguuuccugaggccuccccagccaugcggaacugcgagucaauuaaaccucuuuucuucauaaauuacccagucucgggaaugucuuuauagcagggugaggauggacuaauacaaugggauucuucagguguucagaccccaagugcccucgcuuucuucccuccaugcccucuggacucucugacucguacuaacacacuuuggaaccaugaugugguccuguugaccugccugugccccaagguuccugaagaucaccacuagcacagagugaauaauggcaaaauucagccucauaggaugggagccggccugggcuggcuuuguccaguuguccguauccacagccccuccucuucccugcucacuccagccgccucccuccagccacucuggcccccuggcuguugcccaggcacauucucaccccugcaaucugagcucuuugccuggaccgcucuucugcuagcagcucucuggcuuaucccauuacuuccucaguccuuggaucaggugucaucuccucagagugggcuucccuagccauccuauucaaagcggcagucuccaucccuuuacucugauuuauauuucuucuuugcacuuuccauccauguuauaaaauauguuuuugauuauuugacugcuguccaucacaguaggcagaaucccccacccccauccuaguauccaggcucuaagcccuggaaccuguggauauguuaugucccauggcaaaagagacuuugcagcuauaauuaugggcuucaacauagggaguuuaucuuggauuaucuggugggcccauucuaaucacaugagccuguaaaagcagagaauuucuggccggcugcaguggcucacgacuguaaucccagcacuuugggaggccgaggcggguggaucacaaggucaggagauugagaccauccuggcuaacacggugaaaccucgucucuacuaaaaauacaaacaauuagccaggcaugguggcacaugccuguagucccagcuacuugagaggcugaggcaggagaauugcuugaacccgggagguggagguugcagugagcugagauugugccagugcacuccagccugggcgacagagcgagacucugucucaaaaaaaagagcagagaauuuccuccaccuagauguagaagagauagagucaaaggggaagucacagaaacuugaaguaggagaaggacucaaccugccauugcugguuugaaauggaggaaacaauaggacaaggaguugcagauggucguuagaugcugagaguggcucccauuugauugagaaagggcguggggaccuccguccuacauagaacugaauucugccaacaaccuggaugagcuuagaagugguuucuccccgagagccccgggcaagagcccuggauggcugcaccuugacuuuggucuugcaagacucuaaucagaagacccaccugagcccccaagauuucucaccuacuuaacugugaaauaauaaggguguggauuuuaaguggccaaaguauuuuguuauggcugcaauagaaagcuaauaucccuguccuucccacaagaaugaaaguuccaugagaguaagaucuuguuuucuuuguuccuaugucccuaucuggugugugaaaagcucucaauaaauauuuguugacugaguaaaugaauucuacacucccaccugcauuucuccccagagggcagggaacacacuggugauuagaaauggagaaggggcuugaaaagccacuggugggaaacauuccauauuccuagguccugccggcugcccauuuaguaggcaguuguccagcagauacuaggugccuggaaucaugauuggcauuaggaguagaaauuaaaaagaaaggcugggcacgguggcucacgccuguaaucccagcauuuugggaggccgaggcaggcggaucacgaggucaagagauagagagcauccuggccaacauggugaaaccccaucucuaguaaaaauacaaaaauuagcugggcguggugacacacgccuguagucccagcuacucgggaggcugaagcaggagaaucgcuugaacccgggaggcggagguugcagugagcugagaucacaccacugcacuccagccuggugacacagcgagacucugucucaaaaaaaaaaaaaaaaaaaguccgggcguggugccucacaccuguaaucccagcacuuugggaggccaaggccuugguagcagaucacaaggucaggaguucaagaccagccugaccaacauagugaaaccccaucucuacuaaaaauacaaaaaauuagccgggcugguggcgggugccuguaaucccagcuacucuagaagcugagguaagaaaaucgccugaacccaggaguuggagguugcagugagccgagaucgcaccuuuguacuccaggcugggcgacaaugcgagacuccgucucaaaaaaaaagaaaguaaaaaagaaaaugggugucuacuugcaccaccauugccucccccgccccccaaaaaaaacacacaaaacacuagaugacccacauagagccaaaaaucagaagauuaaggacagugaaaugcaauguggccugcacuaugauggaggagucuguacacaauuccgagagcuagaguggaggccugcacggguggguggagaaaagcuucaaaguggguagaacuggaagugggggaugguggcauggacuuugcagagcuugcuguucaacagagcagcaagcccccagcccagguuggaaggugugaaaauacuugggauggccagagcagcacacacggugguuuuuaguuucacugaaggugcagcuuguaggguaugugcccaauguaggaggagcagggaggagcucaagcucugucucacccuugacuagcugaauggucuugggcaaaucccuuugucacauuuuggguuuuuauggucugacuuuccucaccuagaagaugggagcaucaguguagacucacgagauuggcagaaaaaauggcaugaaugggaaauagcuggcacaaaguaaaugcucagcaagugauagcuaagauucguggugcagccacagggaguaugggacaagaggcuccugucaugucgaggcugggaaucagggaggucuaaggucugaacgguaaccaggcaguucagccuuauccagcaagcuggaagguucuuaaacaauacaguuucccgccuggcccucaggagaaaccgcccucacccaccauccucuucccucuugauugucuccauuuaugucuugacccugagccaaguguucaucucucagggcuguggcugcagccuguugaaacauaugcagaagcucccauccacaggcccagggcacuaaagucaucgcagugccuucagccuugcuacauucucugcaguacccuagcaaggcagccaagcgagagcccccuccuaugagacuuggugggggcucuaauuaaacugagcagcuagagaguuuucccagcugcauccugaaaagauggcaagauuucccaucgcuugccuuccugagcaaaagccacuguucuagaagaguugcucuaccauugcuuccucccuuccuggagcaccagcccucacaggagagaauauguaugcaauguaaggcuuccaggaucuggccugaagugcaagaaaucuguuuccccagcuucucucacucugagacuuuuucuccugagcuauuuuucuuauaaaugauucuauuuccagguuagcucuggcaacaccacuccaugguuuuccucucucuuugcuaauuacaucacagagcuacugcaugcugauuagaaggaaaauaaagcaaaaacaaaacaacgccuccaccugagcugggccuccccugcaguugucugugaacuggagcaucugccuuugugcagcugggcugcagggugcugggugcuccuccugacuugcccuuuauugcucaugcauccugaccugaagauacucaagccaccucuccacaccccaggauccucuuguuugaaucgaaaaaaauaacacugucuuaguccauucuggcugcuauaacaaaauaacauuaaccagguggcuuauaaacaacauaaauguauuucucacaguucuggaggcugggaaguccaagaucaagguagauuuggugucugcugaggagucacuuucugauucauagaugacaccuucuaacugugccuucacauggugaaagggaugagcuagcucucuggggucucuuuuauaagggcacaaaucccauucuugaggacugcacacucaugaccuagucaccucacaaagacuccaacuccccaauaccauccucuuggagauuaggauuucaacauauggauuuugaggggacacagacacuuagaccagagcacaugccuggaaacggaagcaauaucccucaugaucuuguugauaagauaaaaggcuacagaugccauagagcuaugacauuaucagcagcugcauuuucuuagcaucugaacaugaguugccaauccuagucaaccccuuuguuagcuacguccuacccacuugcucucagcuuaucuuuagccauuucucauuguaucugcagcccucaaccuuuucuccccaaggccuauggcacacacccuuuuauuguuguuguuauuguuaacuauagcagauuuccaguuauauuuucuguuauauuucauauaacagaaacuuuuaccuauuaagaaauaauucauuucucccuuccccuagucccuggcaaucaugauucuauucuuugccucuauuaguuugaccauuuuaaauaucucauaugagcagaaucaugcaguauuauguacuucugugaauggcuuauuucacuuggcguaauggaacccuuuaaacacuguuuuugggaauguauuauagaaugaugcggccacuauggaaaacaguauggcgguuccuccaaaaauuaaaaauagaauuaccauaugauccagcaaucccacuccuggguauauauccaaaagaauugagaucagagucucaaagcaguaucuguacccccauguuuauuccaacauuauucacaauaggcaagauauuguaacaccccacauguccauuaauagaagaauggguaaagaaaaugugguguauucaugcaauggaauauuauucagccuuaaaaagaaggaaaucuugcccucugugacaacauggauggcaugcacccuucaugaaugggggcucacuaugccuuguguucaagagggcagugggcaguuuuaaaaagcccccaguaggccgggugcggugggucacaccuguaaucccagcacuuugggaggccgaggcgggcagaucacaaggucaggaguucaagaccagccuggccagcauggugaaaccccaucucuacuaaaaauacaaaaaaauuagccgggcaugguggcacacaccuguagucccggguacucaggaggcugaggcaggagaauugcuugaauugggcaggcagagguugcagugagccaagaucucgccacugcacuccagucugggcgacagagcaagacuccuucuaaaaauaauaauaauaauaaaauaaaauaaaaagcccccaguaaugaugccuaugucagaguguuucgggggagagguagggauaucauauggcauauauauaaaauauauguaggaaaaauuuguauucuggcauauagcaggcauuuaauaaacuguggcucuuuuugcagaaugugccacacaauagguaggaguagaaguuaaaaauuauuauaccacucuuucagaaagagugguucaguugcuuuaaaacuccacuauagacauugccaguuacuagugaaucugugagauucugguucuagauuacugccaaaggauaggauuuuuuuuuuauuuuagacuauuuuuuaaaagaauuuugacaacucauauucacauuuguuauaaaggacaaaaauagucuagaaaugcagugaugugcuaggguccuagcucacaucugcuagugaaagccuauuguuaaauuuuuaggaaauaugggauccaguuguuaaacauagccacuauuaaaaaucaaggccgggcacgguggcucacgccuguaaucccagcacuuugggaggccaaggcggguagaucaccugaggccaagauaucgagaccagccuggccaacauggugaaacgcugucucuacuaaaaaugcaaaaauuaccccagcauggggucacaugccuguagucgcagcuacucgggaggcugaggcaggagaauugcuugaaccagcaagguagagguugcagugagcugagauugcaucacugcacuccagccugggcgacacagcaagacuccaucucaaaaauaaauaaauacauaaaauaaaauaaaaaucagauuauguaaacuuacaaugaaauaugucauuugaaaaacaaagguaacaaauacucaaaacucuuaaaacuuguuaauuccuaaucacuuuacucucugugcuucuaagguuguuugcgucugccaugucuguauggcgggaaugccaugcaguggggucgugcugcacaucccuucauaaccguucaguagcauugcauugguagcuugaaaucugccauggugggacuauugcaaccuggaaaugggaaaacacuaccaucaggggauuucuuucuuucugaagagucaguuguugaacauuuaccagcauugcugaaauauaauaauaauaaauauauauauauauaugacuuugagauggagucucacucuugucacccaggauagagugcaauggugcgaucuuggcucacugcaaccuccgccucccggguucaagcaauucucuugccucagccucucgaguagcugggacuacaagcgcgugccaccacgccuggcuaauuuuuguacuuuuaguagagacgggauuuugccauguuggccaggcuggucucgaacuccugaccucaagugaucugcccgccucagccucccaaagugcugggauuacaggcgugagccaccgugcccggccaauaauauauauuuuucacauucccugaaaguaaguacuguugacaguuugcagucuugacuucugcuuuccacauauguaauuaucuauuucucuguauauaugcauauucuuuuugaauagacuuguuuacuuaaaaauaaaauauugggcgucuucuacauuaauacaaugguguauuuucuuucuuguuaagaacugcauaguuuugccauuugauggaggugcuauaauucguuuauuccauuuuuuaugaguugguauuuuagcuguaccuagguuuuccccucaauuauaaacaauaccauacauagauauucucauuacccauguuuguuuguuuguuugcuuaugcaaguauugguacacaauagcuccuaagcuauucugguacugcuauauuaaauguuauggauauuuuaaauucugauagaucaaaauuuaaauuugccaaaugugucaguuuacaaucgagauaaaauuuuaaauuaaacagaugugugcauguuuauguaugcaugugauuugcuuguuuguuuucuguguuaggcacacagucuguguauuugcaaagaaucaguauuuugccaaggagcuacuucauaggaacccaacuugagcuuuuucaauuuaggcagaugaucucugacuaaaagguccagguguuugaagccauggaucguugaccaguggccaagugaaacagagacauuuccuugcuguggcuaacucugccuggcugcagcauuccaacaccuggauaagugaguugaccuggcuuaguauuuacacggggguggccguuccugaaaaugugucugcccuacucugcugacccauacaaggucagggguuuucucugucacucacucaggucuuuagcauugcaagagcuaacaggaguuacgacccaagcauccagacaccuguaugguucagugugcaguagaagggaaagaaggaaggauaugauccuaaaucuuccugacuuaaggaaaauaaucuggccaucauucagaacgugguuuccuugaagacacauuugugaugggaagaggcacuugauuucucuggggccucucagguucacaguacuaauugcuuagauuugauucaugcuuucacgugcaccagcucauauaauucccauucuacagaggaagcugauggaggcucagcaagguucguugauuuugcaaguuagcagagccaguaaaugucagagcccagugcuuaagccuaccuugcaaucucuuucugggccuucagugcuugagagugguugguagagcaguauaugaguccauucucacacugcuauaaaaaaaaaauaccugagacuggguaauuuauaaaggaaagaggauuaacugacucacaguuccacauggcuggggaggcgucaggaaacuuauaaucauggugggagaugaaggggaagcaaggaucuucuucacauggcagcaggagagagaagacugagcaucaaagggggaagagccccuuauaaaaccaucagaucucgugagaacucacucacugucacgagaacagcauggaggaaaccgccccccgcccccaugauucagucaccucccaucauaucucucccuaggcauguggggauuauggggauuacaauucaagaugcgauuuggcuggggacacagccaaaccauaucaagcaguuacuuagcucuggggauuuuucuagcucccuccccagucuauagguuagagagcuauggaccgucauaacaacgucgugcugucuacuaaauuuacaguaguacuugccaucauggcugcauguuggaaucaccugggagauuugaaauaauccuggcaucccagggcuuaucucagaccacuuaaauuagaaccucuagggugagacucuuccuucaguaguucguaaaaccaagcaggugaucccuauauacuggacaggcauguccuccuuuccuuccaaagccugcauuauaaagacaccauuuguaauguagccacucuguaccugcuuucccucuucauuaccuauacccuauuuuucuagccaucacugaacuccuagacuccauagcugcuugaauuuguggacauucaaccaagauuucuuaucuuuuuuuuuuuuuuuuuuugagauggagucucacucugucgcccaggcuggagugcaguggcaugaucuuggcucacugcaaccucugccucccagguucaagugauucuccugccucagccucccaaguagcugggacuaaaggcgugugccaccacaccuagcuaauuuuuuguauuuuuaguagagaugggguuucauuguguuagccaggauagucucaaucuccugaccuugugauccacccaccucagccuccccaaguggauuucguuuuauuauuauuauuaacugugcauaaugucacaccccaugcuggacucuggggaugcuucaguggguaaaagaauccuagccucagacugcugacugucaaguaacagcuacagacacaagccauuuggaugcagaagugcccugauggagaaagcccuuagacaacugggaaaaggggacaggcagugauguaccaucaguggcuuauuuacaucccuauuguugccuggauccugaccugcuauacuaugcuuuccccuggggcugccagugacaucacauagagaaagagaccagccuccuccuccuccuuccgucucaggguaagcuguucccugucauccaccauuaugcuucaauagccccuccuugucccccugagcccuugccugccgcaucuccuuuauugcauauuugacauuucaccacagcagaucagauguauuugaaucagaauggcacacagggccccugaauugguuggcagagcccuaugggacugcuccaagugaagggaaucuccaugaagacaauuauccaagagaaauagccuaucucagcaggcaucguucugcuuugcuuauugagccaacauuuaugaagcauagacuucauaccgagcucaaugcaaacagacucaccucuagcaaggcucaagggaggcaacaaaagaaauagaaaacacggcccuugucaacaaaccuaggauuaaguuggaguggccgggcgaauauacugaggaaacauugguuuucuuuuuuaacccuuuucgaagucuauuuaaugucugccuacugaauauuuaauuauuaacaacaggaguugacccccccuggccauuuuuguaugucccacgcuggguuuuuccauuuucagauaguuaaggcaaaaagaaaaaaaaaaaaaaagacaagucuauuuuguggcacaugaaaaucauaugaaauucuaauugcaguguccauuaauaaaaguuuugugggcucacagccacagcauucauuuuuauuuugucuauggcuguaugaaaguugucaggaucaagauggaaucacuaauauuagaaaacccugauaaauaggggaaggccacgaagacaugauucucacacuuauaugccugauaaugaaacagacucuacaaaaaacacagccuugcacaaacaccucacgaccuuacacaaaaacaugugugcaaggacaucugccucuccaaccucggaccagugucauccuuaucauugaucuuuguagccaaagauaauuacucaaaacaauuauguacuccuccuuauuuuuuccuuuaaaaauguuuaucuuuggcugggcuuuguggcucaagccuguaaucccagcacuuugggggccgaggcggguagaucaccugaggucaggagaucgagaccauccuggccaacauggcaaaaccccgucuuuguuaaaaauacaaaaaaaaauuagcugggcgugguguugcacgccuguaaucccagcuacuuaggaggcugaggcaggagaaccucuugaacccaggaggcagagguugcagugagccgagaucgugccacugcacuccagccugggcgacagaaaaagacuccgucucaaaaaaaaaaaaaaaaaguuuaucuuccuuaccacccugaaugcaugcagacuuuacuaugacauguguauucccauuacaauauuuaauucccaaauaaacguauuuucuuuuacagagugucucucugcuuauuauuuagauugacagcugcuuugaggcugcaaagacagaaauuaaguaguugcaacagaguccuuuucgcuuccaaagccaaagauacauacuuauuggcccuuucagaaaaaauuugcugaccgagguccacagcauagcagaaagcauggucucgggagcagacuugguuaggaucuugccugcaccaguuagcuuuccacaucuagugaauaggaauaauaacauguucuuaauaggcugagauugaauaaagccacuguaaaggaaacauaaaccccaguuauuuagaacuaguauugaugccuaguaaauauugguuaccuucacccaccuuaauuauauacaaauauaauuuccuauauaggcacaaaaagaaagauagaauuaccugaggcuaauccuacucucaacuggaaagauaugcacaagaaauagagggaaagggaaugagacuaauacauucauuggauacuuuauaauagcagagucuucuuacucuuguucaauccuuuauuccccagcaguuagagcuguccugcugggcacaguggugcacaccuauaguucccgcuacuugggaggcugagucaagagaaucucuggagcccaagaguucaaaacuguagugugcgaugaucgugcuugugaauagccacugcacuccagccugcucaacauaguaagacccagucucuaaaaaaguaauaauagaguggucccuggcauaugguauaggcauagaguucaguauauauuauaugcauuuucagccaggcgugguggcucaugccuguaaucccaguacuuugggaggcugaggugaguggaucaccugaggucaagaguucaaaaccagccuggccaacauggugaaaccccgucucugcuaaaaauauaaaaauuugcugggcgugguggcgggugccuguaaucccagcuccuugggaggcugaagcaggagaaucgccugaaccugggagguggagguugcagugagccaagaucgugccauugcacuccagccugggugacaaaggcgaaacuccuucucaaaaaauaaauaaauaaaugcauuuucacauucagcccucuuaauaauugauauaguugucaaacauuuuacuuauggagucaucaucaggaugaggccccaaauuccacuccuccacacaccaccacacagcccugggcaugccaacuucucugugccaguguucacaccugaaaaugcggauaaugggaaaacguguggcagagggucgucucgaagacugaaugagaucuaaagugugcuagauaccucugcaacccaaaagagggaagggcagacaaacagugagggugugugcguucaagucaaaacauggauguuucaucacacaggcuucuuugaacucugucucggugugguaguaagcaggaaauccugcaagcucucaagacggagaggauaggagaaaaaucccaagaugcaaaucgggcagaggucauuguuuaaggagcagcuuugugggucggaucucaagggaugggacugcgcagaauguuggacagaauggggaagggaagaccugcagguggagggggcacgccaggcuguggaauggguguggccaggcaagucuggguauacacggcgggaagagccguggucauagaggaagccuuacuacuggacuucagagaagaauggagucaccacucacuugcuuuaggucuggagaccuaaugagaauguaucaucagauucccauaccuguuucuaccaaccacauauucagccugguuucaaaguuuauuucugguuuccaaguucuuuggauugaaucuauacuacugauuggauaagacugaggaaauguauguguuaauggaaauggcaaugcauuccuauugcaguuguuaaucuuuccgaagauuccagacucugauuuuuaauggucuucauuuauucuaaugaguuaacguaaccacagauuaguaaacagggacuaucgaucuucacagagcguaaggaaggaauuuacacguaguaagggcccauuguuguacuaaaaucaccacugacuuuucguucagcauugacucugcaccaggcccugugcuaagugcuuccugugcuuucucucauuuaaugcccacuacaucguuuguaaggaucguuacaccauuuauucaaaaucucacuauuugucggcagcaaagucaagacuggaacauggagcauuccguauugaaagcagaaggcuccugccccuguagugccuuaaguauguggucuguugaaaucuucacuccccaccuagaaaaaaaggaaaagaaggaagaaagaaauuacacauaguaauguugauuacucccuaaaguaauuaaccaggauuguguaaugaaugacaacagagacagaccucucugaugaggugacaguuuagccgagaucugaagcguguccugaagccagccacacacuuggccagagaacaagaauguagcagcccugaugugggcuccagcuuggccuguucuggaacugacaggugggaggcuggaaggaggaacuugaguugagacuggggagcuaggcuagagcuuccugggccaugauacaaugacacagaauuugcauuuuguucuguaacacacuggcaaagacggcacuuggcugagaauauccaugagcuuuugaacaguagcaaucaugcaauguccuuguagggaucuacugaaugcaggacgaucuuucucccuagaaagaaagaaagaaacaaagacaaaaauaaaggacacagagcuuaggacggucccaugaccuuaaaagccaacaagaggacagcaaacuccuuuaugcuccucuuccccacuacccaaugcagaagugcagaguccuucgaacugggagccucuuuuguggccgugaugacuaagaaucacccuggauaauugcucagguauagcuuucaccacacuuuccuucccccccacugaacagaagcaaaauuccuugcuagggagaaaguucacccuguacucaguagauacugcaaaguuuggcuccaacccccuucccccuuacuuggggguuauugaauacugcaaaagugaucaaggaaaguacauuuaucacucuugccucaaagcuugagccaggauaauuuugcacauucuguuuaaacgauugacacgagaaagcuggauuuaguucucccuucuuacuucccagcacuaaaugcacaccucgcuaauccaauuucuaggaaauccucccuugugagcaggacagccuguggguuugcccagaucaggcuggcagaggguagauaggcucguuugugggagcacguucagaccccaaggauuacuguggccuuauggcugccagagccacuuucuauuagguagggggccuuuaugugcccccagaaauaauguuaauaguccuagcuaacauuuauugagcacugguuauaaauguggcauugcaaauggauuaugaucuuauuuaauuuucaaaacagccuaggaggcaggcacuccuugcuguuuuuccaauuuaucagcuggcuuaagggccuuugcacuuguggcuaauucugccuaaguuccuccuccuuaucagcauggcaugcuaccucgccuccugcagauccugucuuaaauaucaucuucuuggaaaagucuucgcugaccacugguugaaaauuucaccacaucucccagcugagcuuucuuuaucuccccucccugcuuuguucuuaucauacaauagacuauauguuuaaccuacuuacuuguuuaucccucuucuguuagcacauaggcuucccgaggacuaugauuucuauuuucagauggguucugguacauaggagacuugcagaagauacuggucuaaggaaaaacauaauaucaucauaacuauuuugcaaacuaggaaagagaaguuuauagaaaugagcuaguaugggccgggcgcgguggcucacgccuguaaucccaacgcuuugggagguggguggaucgccugagaucaggaguucgagacaagccuggccaacaugacaaaaccccgucucuacuaaaaauacaaaaauuagccaggcgugguggcaggcacuuguaaucccagcuacucgggaggcugaggcaggagaaucgcuugaacccaagaggcagagguugcagugagccgagaucgcgccacuacacuccagccugggugacaaggacgaaacuccgucucaaaaaaaaaagaaaagaaaugagccgguaugguccagguaagaccgaaaacaaguagcagacuagaauuaaccuaggccucagaccuucuaaguguuuacaacacugcagaaccagcacguggccaaauacaaagccauccguggaacugugguugugcugggaaauaaggagacacuacucccuauuacucccauuaaaauguucuuuugaaaucaacuuaguccuucaggaugacaguuauugauguuaacacaaguggaauuuuuuagccccucuucugcacuaggacucugcuuguugagauccagaggaaauaaguuauggucucaucucucugcaagcucacuccaguucauugccaaugcaggagcuuauacuuguauugaguagaccuacuguauggcacauaccgugcaggaagcuguggguauggagucaguaacacacaccacugcccucugggagcucagaguuuggugccacaaagcaccuacaauaacugcagcucugaaaggcacagauguagauuguacuauguaguauuuuguuguuguuguuguuuguuuuguuuuuuacagccauagcccuguaagucauauuccacaucaccccauaggcaucaguauuagaaaacgcauggauuuuggaacaagugaaacuggauuugaaucuggguugucacuugcuaauugcuuacucgaucuuucugugauguuauaaggaauagaguuaauaggcaugccuagugccuggguccuaguaagcugcugccaucaccguuagcucucaguaucaucauuauuauuguucugccucugggucacagugaguggugaauucagugccuacaggucaauaggaagaaacuaguuugguuaaaaauauaccccagguaauaacaauagucccuuauuuaauuaagacuaacguguauuagucacugugcuaugcugaguauuucguuaucuuauuugauucucccaacaguccuauaaguuaugaugaauauccauuuugcagaagaguaccauaaagcacagagcaguuauuaaguaaccugcccaaggucaugcgugcuguguggguagaugcuaggacccugacccuugauuuuuuugcucagcugccccaggucaucaaagugugcacuggggaggugacuguauucuugcugucauucccaaauuagucagagaagcagcaaaaaguaccaaaucuagcaucaagaggcuuuuauucaagccuguauucugccacugcauaagcuuccugaccucaggcugcugaccucacuccgaagucuugguuuccucaucuauaaaaugaagacguugacuuagugaugcccagccccugggccucugguucugggauauggcucuuucauucaucacacagcagaccuaccaaagccaaugucaucagaguuagaaagaccucagcugaaaccccagcucugccacucaccagcuguaugaccucuccgagccucaguuuccuuguuuguaaaaacaagcauaaacauaccaauuucauggggcuguuacaaggacucacugaaauaacauaacaaucaggaucccaucaagaagacaucugcccuuggaagucagcauauuugaaugaagggacugcauaugggggugaaugggcaggauugaaggcaucagcaagggaugcuggggcacccagggacuagccaaagcugagagcugguaccaguucugggcugagagauguguguuaguuugcuagggcugccguaacaaaauaccacagacuggguggcuuaaacaacauagauuuauuuuuuucucacaguucuagaagcuagaagucugggaccaagguauugacaagguugguuuuaucgcacccuucucuccuuggcuucuauauagaugcuuccucucccuacgucuauaaucucacuucugcgcaugucugccuccuaauugcuucuucacaugagggcaccaguccuauuggauuagccugagacagcacugcagagccucuucauggagggugaagccccacaggcuauauaccagcuacuaaaaaaauggcuaccacucucuaaacagaaaucugaucugcugacuggcugguuggcauggagauuuucuuuuucuuuuuauuuuuuuuaugacuaaugggcuggccucuccucaucaaucuggcuagaugcuucacagcacacgaggaugucucauuugccucccaagaaggacgagacagcguggauggccaagcauuucugaccaguugauuggacauuggucacccgucugaccucauuuuaacuuaacuaccuuuuuaaagacccuguuuccaaauucagucccauucugagguugcuggggauuagagcuucaacagaugaauuuggaggaggacacaaucaacucauaacaagauacaaagggaagcaauaauggugccagaagccacugaaggcuugaaccauggagauggcugccaagcagagacugaaguggaggacacagccauugcugggaacguugcccacccacaugcgagagugugcgagggagaaacacacucucuuuccucccacccuccaagcuguugccaaagcuuccgaucaggaaccagccaccaggggaugccaggugaucccagggcacagagaagggcagaguauggaccugggaguggaaaaacugagaauaugugucuggcacagaaggggcacucacgaaguguucauccuucucaccucauaaaugaggaauuaaaguagagaagacaccugugaccucugcacaccucccugaauguguuuucagcgucugcuuuuuuucugagcaugcgaaugagugaauaaugaaggcauacucaguugugcccuuccaugcagacucacuuuguuuaagcuggaaguugcagaaagcuuccugcccuuucggcuguuuaggagcuccacauuccagcaggugccagcacauguucaacuggucagagcugcucggccauccacgccaucucucccuucuggggagggaaaugagacaucaucgugugccgugaagcaucuagccagacugauagagagaggcagauucauuauuuguuaaaaauuuaaaauauccauaccauccaacaaacuggccagcagaucugacuucuguucagaguugcagccauuuuucgguagcugguauauagcccauggggugucagacccucccaucccucccccagauggcucugcagugcuguucuaugcuacugcaucuaccccagcucuucaauuauugcauugugcuccauuuuauucaguggcaauuuuaagaccaauauccugguacuacucaguauauuguuccugcuauacagcugcagaaaauacuuccuccuuccugaaauaggcuggagaguuuuuaauaacuacuguaacugcaguggccuggacacagccagaauaucuucauucaguaaauguuaucuccugcguucugauggacugccugugaaagccugucuugucucagagcaggaccucuaagggacuugacaucuucauggauuucugagcgagagaagagacaacuacagacaagugagcgugauuucugccuuggguuuuucuuaucauuuacugucuaaaaugugcaaaauuacuugccuucugugauuuagugauuagcugaaaaucuguccaaaucuggaaaaugacagugauauuacuuuacuggaacugcuguaacaaagcaccacaaacaguggcuuaaaaaagcagaaguuggccgggcgugguggcucacgccucuaaucccagcacuuugggaggccgaggcgggcagaucacgaggucaggagaucgagaccauccuggcuaacaugaugaaaccccaucucuacuaaaaauacaaaaaauuagccgggcaugguggcaggcgccuguagucccagcuacucaggaggcugaggcaggagaauggugugaacccgggagguggagcuugcagugagccgagaucgcaccauugcacuccagccugggcaaaaaaaaagcagaaguuucugguucuagauccuugaagaaucgccacgcugucuuccacagugguugacccagcaaucccauuacuggguauauacccaaaggauuacaaaucauucuacuauaaagacacaugcacacguauguuuauugcagcacuauuuacaauagcaaagacuuggaaucaacccaaaugcccaucaaugacagacuggauaaagaaaauguggcacauauauaccauggaauacuaugcagccauaaaaaagaaugaguucauguccuuugcagggacauggaugaagcuggaagccaauauuaucagcaacuaacacaggaagagaaaaccaaguaccaccuguucucacucguaagugagaguugaacaaugagaacacauggacacagggagcagaacaucacacaugggggccucuuggucggggcggggggaagcggagggagagaauuaggacaaauaccuaaugcuugaagggcuuaaaaccuagaugauggguugauaggugcagcaaaccaccaugccacguguauaucuauguaacaaaccugcauguuguaucccagaacuuaaaauaaauuuuuuuuaaaaaagcagaaguuuacucuuccacaguccuggaggcuagaaguccaugugaagguguuagccaaaccacgcucuuuccgaagccucuaggggaaaauucuucugauucuuccuugccucuuccagcucugguagcaccaggcauuccuuaggguauaucuucaaccccugccucugucggcccucuucccuuugugucugucucuaucucuucuucuuauaaggacacuagccauuggauuggagucuacucuaauccacuaugaccucauguugacuugauuacaacugcaaagacauuuuccaaaaaaugggucacaugcauagguauugggggucaggacuuggacauaccuuuuggaaaggacauaauucaacccauaagaacacuuuuccucaacuuuuuauuugcaaagcacucugugguuaaaaggaacuaucuguggaaucuccucagaucugcaggguugaccaggaauuaucacucuaguucggcaagugagucuaaacagacuaaggaaagcugagaugagcuuaaacagauugacuauagagaagcagagaguuggaggagucagaaauagcucaggaggaaagguugggggagugucagggacuuagauccuugaccuuuuuuuuuaacuucguauuaguuguuuugcuuugaccagccacauagccuuucugagccucaguuuccugaagccauuggggauagagauggggcauggauuugauaaccuucuuugagguuuuuuuuuuucuagcuuaauauagauuccagaaaagacuagcaaaguaggcagcaggcaucacccacccaugaaugcccauccagcuuugagaagggggucucuguuggugcauagcuggacacacaaagccagaaauucgcucauuuccagucagcuucaggacccacauuccuuuacuuuaaaagugggaagaaaaauauaugaagaacucguccaaaccaguaagaaaaagggcagacaacccaauagaaaaaugagcaaaagaacaggcaguucccaaaagaggacaaaaugggcaauuaacauauaaaaagacuaugacccucauuagucauuaaaaaaugcaaauuaaaauccauauuguuauaccacuauacaaaguguagaccuaaccgaaugccuaaaaugcaaaaauugagacaaugccaguuuuuagugggacugcggagcaauuggaauacuucagaaccacuuugcaauaucuacuuaaccugagcacaugcacacucaaugaccuggaaauuccacuuggagguauguacucaacagaaaugcauacacaugccgucaaaagacauguucaagaauguuuauuacagcccaaauguccaucagugacauaauggguagaguaagauauucaugucauagauuauuacacagcauuaagaugaacaaaugacaauggcaugcaugggauggauggauuucacaaauguaauauucauacaaagggcacauacuguaugauucaaagcauauaaagcucagaaauggauaaaacuaugcuauuguguaagaaggcgagaugagggcaggcaccauggcucaugccuguaaucccagcacuuugggaggccaaggcgguaggaucagcugaggucgggaguucgagaccagccugaccaacauggagaaaccccgucucuacuaaaaauacaaaauuagccgggcauaguggcacaugccuguuaucccagcuacucgggaggcugagguaggagaauugcuuggacccaggaggcagagguugcggugaaaagagaucgagccauuguacuccagccugggcaacaagagcgaaacuccaucucaaaaaaaaagaaagaaaaaaggcaagaugauggcaagauauuggguagguuuuugacuguaagggggauucugguuuagugauauucuguuucuuggucuggguucuaguuauucaauucaugaaaauucaucaagcuguacaguuaugaucuaugcacuuuucugaauguacauuccacucuaauaaaaaguuugcuuauaaaagcaaaaaacaaaaguacucugcaaguuuuuguugaaaguauuugccagccaccaaaccguuuguguccuuaguucuaucacaaccuuggccaaaugauuucuguccagugagauaaagaggaagagugaaguguuguugucuaaaagaaccacuucccacaacaugaaauccaaccacacccaccuuugggagcccacccugucugccuagaacauaccucuauuugcccauaacaccuccaagcucucucgggcagggacgacuguguucuuugucucuguguugcuaaaauauauauuuauugaaugaaugagugagugaaugaccacaccccauuccauucacacuugagaaaaacccagccaaguuagggaagguuugagauggaaggauuuccacuuucucucccaccccucccuccuucccuaucucucucucucucucucucucucucucucucucugucacucucucugucucucacucugucuuucucucucaaaaagcuuucaggaagaaauaauuuaaaaagcaaaagcuggauuacagaaccuuuucauuuauaugaucaaaagugagucccagguaaaaucagcaggggauuuuaaauuaagugguuuuuaauaaacuuacuuucuguuggauuaugaauaagaagagaacucuagugcuucaaagcagaagggaggaagguugcgauucugagggugauuuuuaucagcauuucugagaugagagucugcacgcuccccagagccuccugcugagcagcugcgcuguguccauaggauuucacugguucaaaccagcaaagccucaaaaaccacugaaggacuaaggagcaaaucuucauuuucacguaguggauccugcauuagagguggagagcugaggaagugcagaccaaagccagugaggacucaaacugaagggacaagcaauauccuauuagaguccugggggaaaaggggcaaaucguucugacaguguuggaagccguaaccaccuuugagauucacugugcacacugauauaucaaaaccuauuuaacuuuauuuaacccuaaucaaucaucuccuacacuuauuuaacuuauuuagcccugcuuccacaacauuuacuagcauccuacagaaugcuacaucauacacugugagaaguacugaguuuaggaauaaaagguuucaucugaaacuuccucugaaccucauucaaaggagucauccaggcacuuuggucccuacuuucuccuccugagccaaggagguauguggucugaauugaccaacccaauucuagcuacauucuuguagcuagccuaaagaaugaaaauagggcagggagggaauaguggcagaaccuucucuuaaacaguuuucauaaugcaagcuuaaggcauuccccuuugcuaaaaaaguuuuaaagaguucuugccugcaaguaguccucuacaugcuaugaaguuacuuggaugguuucagaugcagaaagaagggaauguuccuaccaugcaggagggaaaguugacauaaguuagcgcugacacaguguccugaguugaauauuuauuggcuccauccgguuacccacuaucacuaaucuuggaucaggcccuacccuaggccuacagcuuccuuuucauacaggacuguccucagggaagcccuaguuuuccuggcuuuuuuuuuuuuuuuuuuuuugaggcagagucgcugcgucacccaggcuggagugcagcggcgcgaucucggcucacugcaagcuccgccuccgggguucacaccauucuccugccucagccucccaaauagcugggacuacaggggcccgccaccacgcccggcuaauuuuuuuguauuuuuaguagagacgggguuucaccguguguuagccaggauggucucaaucuccugaccucgugaucugccagccuuggccucccaaagugcugggauuacaggugugagccaccaugcccagcccuuucccggccuuuuauaaugauugggaucuucccagguuuucacagaggcagucugcuuauggccuguggucuucucaaaguccuucaaacauuuacuuacugcuccuccaggagcuacucuuuuguuuuggcuuuagaccccugauucagcaaagccucaccguauuuaguuaugagcauguagauacacacacacauacacacacacacacacacacacacacacacacacacacacacgcucccaggagguugagaccacaugguaugguugagaccacaaaucaaagagugaaauuaauuuuaccacacguuaguuauauggaagcuuuaguuucuucaucuguaaaauggagguaauucugucuaccuuaguuucuucaucuguaaaauagagauaauuccaucuacuuugcaaguuugucauaagaaucagaggucaucuggcugggugcagugggucacaccuguaaucccaggacuucgggaggccgaggcaugcggauuacgaggucaggaguucgagaccagccuggccaacauggugaaaccccgucucuacuaaaaauacaaaaaauuagcugggugugguggcacacgccuguagugccagcuacucaggaggcugaggcagaagaaucacuugaaccugggaggcagagguugcagugagccgagauugugccacugcacuacagccugggugacagagcgagacucugucucaaaaaaaaaaaaaaaaaagaaucagaggucaucuaaguuaaguuccuucucucuaguauacugcaguugcuugauaaauaguagguauuaucaucauugucacccuguuuagcuucucuuuuuuuuuuuuuuuuuggcaguugcacuggcaaaaaauaaugucuagcucauaaaauagcauuauucucacuuuccucucugcacagauaccuacuuuucuuucccugccaucuugauuacugagcuguugcuaaaaagaaaacauggcccucugauccacagaugaaaagcccugcuacuugaccagauguucaugagagaauccuuugauuuuuaauuuauuuauucauuuauuuauuuagcguuggucucugugcucccagcacaacagcuguagguaaagugcugcgggucacaugcaucccagccagcucccuugacaguccuugucaaauuuaaggcauguugccucugugcagagcacucaggggcaaggggcuugcuccaagcucccagaccccgacgacaaggaugggaauggguggaucaggcagcagcgaaugccaggcaaaggccaaagucaagcuuuuuggcaccaccuuccaccugacagcagaaaagcagggucaaaagucugauuuggggcacgcauuccaaagccaaauccguguuguuucagcuuaaaaggcuccaguuucaaauggaaccauuuucauaacuugaagcaguagucacuuaaaaauccucuuucuacuuugcacacaugcacauaauuuauauuaaauccagugggaauuaggcaaguucagugagggauaauuagacaccuuaaugaggaaauguauaguuucuguaacugucauuuauuaagcuuuuauguacuacuucauauuuugaaagcacugcacagccauuaauuaggauauuuccgcagccccauaggagcaaggucaauaaacagaguucuguuucucuuggaaauguuguuucucaagucuuuuaugaccugagugcaaacuccuaaccuuugaagaaacuggcagauugucuuauaagcucauaucaauaugaugauuauauuuaacauccuaaacagacucauuagcugcuuaagaauauaauuuaagcucauaauuuuccauacaguggauuuucuuuccuuuauuauuauuuguuuucuuccuguggauguaucucuuagcugccacuuggaauaaccucaagagaucuccuaagcaugcaggcugugacacuauaagccaccuauuuucagaacacugagaaggcuaugggccuggaaauguuugcaaauauugcaaauauuucaaguuguccaguacauuucacacucacgggaauuuugaagauuauuugaauaaucaguggauuacaaagaaaaaugauuuacuagguuuggacauuaauuauccauuaauaauucccacuacagcacugguggauacucuuccacuguaccagaugccauuuaaaucuuuaaaguggcauccacuuuaaagaugccauuuuucuugcuuuuguuguuguuguuguuguuuuuaagacagagucucgcuguguugcccaggcgggaguacaguggggccaucuuggcucaccacaacauccgccucccagguucaagcaauucuucugccucagccuccuaaguaacugugauuacaggcacccaccaccacaucuggcuaauuuuuguauuuuuaguagagacaggguuuugccguauugaccaggcuggucucgaacuccugaccucaggugauccacccuccucugccucucaaagugcugggaucacaggcgugagccaccgcaccuggcccccauuuucuuuuuuguuccucacaaucaccuuggaguuaaugugggauugucacuauauuacaaauaaggaucugaggcuuagaaacacagugacuuuuuucaagaaucauauugauauuaagcagugauaucaggacucagagccaagaguguguuuuccaaguccacugcaguuuuuucuuuuuccuuccccuucugggauagcuacaaaaaaaaaaaaaaagaagaagcguguguucccagaauucauucugcugugucacucugaggaugugaggauauugguuauaggaauaaccugugguaggcugggcacgguggcucacaccuguaauugcaacacuuggggaggccgaggcagguggaucaugaggucaggaguucgagagcagccuggccaacauaguguaacccugucucuacuaaaaauacaaaaaauuagcugggugugguggugggcaccuauaaucccagcuacucgggaggcugaggcaggagaaucgcuagaacccgggaggcagagguugcagugagccgagaucacgccauugcacuccugccugagcgacagugcaagacuccgucucaaaaaaaaaaaaaaaaaaaaaaggaaaaaggaaauaaccuguggauaauuauagauuuaugagcaaagacaaauguuuucacccaugcuagacaacuuuaugcagccuuucuaaaauuuucuuuuuugggagaagagggggacaugggucauuaccuuuugaggucugcaguucagaugugguggacaguauuugcuaccugcuagauauucagcaacccauuccuuugaaaucacuguccuagagagagaagccugucugguuugaccuuuguucuuccugucucucacuuauauaaccuuuuuuauccuuaaguuucaguguagacaucauucauuucaagaugcccuuccccuaaugcuuccccugagacacagucaguuuaccuguaccccagcucccauaguucuuccccaccucccauuuaucacagugcuuugcauuuuugugauuaccuguuucccuucccuaucaggccuugcucccugagaacaaggacuguguuuuaaaaacuuccaaguccccaguuaacuaaugaauagaaccaaagcaggugcucaaauaaaaaaauuuugaaaugaaucauagacgaaaugacuucugaaugcaggaccuaugaggaugugaggauauugguuauaggaauaaccugugguaggcugggcacgguggcucacaccuguaauugcaacacuuggggaggccgaggcggguggaucaugaggucaggaguucgagagcagccuggccaacauaguguaacccugucucuacuaaaaauacaaaaaauuagcuggguguggugguuuacaccuguguucccagcacuuugggaggccaaggugggcggaucacuugaguucaggaauucgagaccagccuggcuaacauggugaaaccccuucucucuuaaaaauacaaaaaacauuagccaggccugguggcgcacaccugugguccuacuuacucaggaggcugaggcacaagaauggcuuaaaccugggaggcggagggugcagugagcugagaucgugccacucacugcacuccagccugggcagcagaguaagacucugucucaaaaaaaaaaaaaaaaaacacacaacaaaagcagacagaguccccucugguuuggcaugccaagagcagcuugccuauggcccagcuguggugucugggagcccugauucccagaagcccacaugagccugugucagccgagcacacgugugacauucauguuuaagaggaagcauggucuuuaaaaaugucuagguacaaagaagagccacccauggguucugcuggcacaggaagcacagggucuuuauuaguucuaauguucuaagauaaacagggcaguaagaagcaguugccagcacugugacaucggaaacaucaccuccauccucagcaccucgguucccacaucgaugcaaacuuagcaguaaggucuaaccagccccccuuucuaagaauguugugagauuagaggaggcucaggaagcugagagugaaauucauaagcuuugugacauguuugcucaugaauguuuuugucugcuuuggauucugauucuugguugaaucgggguacagagagugguauauuuaguaaacguucuggaauuccaaagagaaaagcagccugagaaucagcucaucaaauucacagaggcagagguugcgguuguuuuauggcagagugccaguuuuccuggaugaaguggucugaugaaagaaaagaaaauuaaauuauggcgagaaccagauggucuggccacaaccaagggguuauagcuuguucugaagaccacccugaaauacuggaggccuuugaucuugugaaauggcaggauaaaugacagcaacauuuuagcuugguuuuuuuuguuugguugguugguugguugguugguugguugguugguugguugguuuuugagacugagucucauucugucacccuggcuggaguacagugaugcagucgcggcucacugcaaccugugcuucccagguucaagugauucuccugccucagccucccaaguaacugggacuauaggcacacaccaccaugcccggcucauuuugguauuuuuaguagagacaggguuucuccauguuggccaggcuggucucaaacuccugaccucaggugauccgccagccucagccucccaaagugcugggauuacaggcaugagccaccgcacccagcuaguuuggcuuuucuaaaacagauucuguuguagucacucucuugcucuacauccuugucuggcuuucaguuguccucaguaggacuucccaaccacugugucacacaugggugacaagugccaacaaaaucaucuccugggccuuggggauacuuugguagggccuggggccucugaaacccuuggaucagccuuuccagccauaagcagcuuaacucccaguggguuuuaagaauagcauuuucucuguaggaaacggcauaaacaugguuggaacgcaccuguguugcauagauacgaggcucuuccugauuuauugccugugcguguguucaggcgucuguccuggcauuugccuaagccugcuauugaaacugucuggccaugauacacucuaguucuugcguagcccagucuugucaugcaucuccugccucugugccuuuguccaugguguuuccucagacagcuuccccaacugccugaccaaguccuagcccaggccacccaggccucccuccugugagcucucuucauaagcacugcaugaucucaguguuugcagucaucacauugaauccuaaugauguacgugucuuauguguguuuccacaaaagggccuggcaaagaaugaauguuacaccuccaguaaauauaugcugaguuaauauguugaauaaagcccaugagauuggccaggcgugguggcucacaccuguaaaaucccagcauuuugggaggcugagguggguggaucaccugaggucaggaguuugagaccagccuggccaacauggcgaaaccccaucucuauuaaaaauacaaaaaaucagccaggcgugguggugugugccuguaguuccaguuacuugggaugcugaggcaggagaauugcuugaaccugggaggcagagguuacagugagccgagaucgugccauugcacuccagccugggcagcagagcaagacucugucuaaaaaaauaaaaaaauuuaaaaagcccaugagauuggugaaaguagugaagcaaaauaaguacaagucuauuucugugaauucacacauaguagcuacucaguaaauaacuguugaaugaaugaauaaaagaaauguaaaagguguuuuaaauuuagaaucuguggacucaguaauggcugacuguaagagaaauggaagauggaguaguugaagauguuucaagacaaggagcgccuucaacacggcaaucccgguccaacuuuggaagcugcacccuagcuaagcucucgagacaugaaucaagauuaggauauuuauugcagcauuguucauaauggcaaaaacauaguaaacaaccaaaauguccuucaggagaggaauggauaaauaaauuaugguauagguauaaaauggaugaugugauuacagugacuaaacuagauaggaaauacuaacauaguuaaaucuuaaagacauaacagugggugaaaaggcaaguuagaauaggaaauacgcaauccaaaacacacuaaaaauaccauguguuauuaugugcauagaggauaaaaauauaaaaacaagccuaggaauaaaacacagaccccugggaauacuggcugccuuugaggaagagaggagguagaaugagaugaacuuuagauuuaucuguaaugcuuuaauuuuuuaacaguaaauguggcaagguauuauaacaaccauuauaucuaggugguggguauucauuauauuaguuugugugcuuuucuauuguuuugaaauaguucauaauuuuaaaaauuaaagucacgcaaaagaaaagacuggcuaacagggaggaugauccugcaucucugcauuuagucaucuguuuuagacauuccgacuuuucaggcaaccuggcaaaucacaucugccaagucucacaccauuuaaaagcaucaguucucagcuuggucaccagagacucauagguuuauccuggaccucucuagaggcuucaaaaaugugcauuaauauauuucaucauuguuucuaguuucccaccauccccccccccauuuuuuaauacauuggagcaucuauccaaccuaauuauaauucauuuuuguaauaagauuaaugaaauucuuucuuucuuuuuuuuuuuuuuuuuuuugagacagagucucacucuguuacccccacuggaggacaguggugcaaucucagcucaccgcauccuccgucuccuggguucaagcuauucuugugccucagccucaggaguagcugggacuacaggcgugcaccaccacacccggcuaguuuuuuuguauuuuuaguagaggugggguuucgccauguuggcggggcuggucuuggacuccugacuucagaugaucugugcaccuuggccucccaaagugcugagauuacaggcaugagccaccacaccugcccgcccuuuuuuuguuuuuuguuuuuuguuuuuuguuuuuugagauggagucuugcucaguuaccuaggcuggaguacaguggcacaaucucggcucacugcaaccuccgccuccuggauucaagcacuucuccugccucagccuccugaguagcugggauuacaagcacacaccacaaugccuagcuaauuuuuuuguauuuuuaguagagacgggguuucaccauguuggccaggcuggucuugaacuccugaccucaagugauccacccaccuuggccucccaaagugcuggggucacaggugugagccaccaugcccggcuucauucauauuuuugacuggaauauauuuucuuaaaucagucaccagugacuuacaucacuauauucucuugguuuguaacuuuguaaauguuucuuuucuuucuaccccccccaacauuguuuaucugaguaaaacaaucagauaauacauuuauggcgaacaauuuccacuguguaccuuccuccccaacuccauauucagugauaugauauugcuagcuugaaauuagccaugaugggaguguuuacaccuuggcaauuggcaaaugcuacaaauccggccguuuuuuucccccagagagcugaugguuaaacauuaccagccuaccacaagagugcgcaacaguuuucugagcugugcagggcaaguagcauuuuucucauuuaacacucauagaaacugagagucaacaaaagacagaucuugaccugagucccauggcuccaaagugacauugcuggggcucuagucuaugugguugaguggaagaagcacuggccuuggaaucacgcagaucugaguuugaaucugacauagcuacuuuugaacagugaauugacaaguguccgauuuagccccucaguuuccucaccuauaaaauaaggauaacaaaaucuaucuuguagagaucucagggagcauuaggggaaaugauacgugaugugcaaaaacccuaacaaagcacaaaggaccuaugcagcagaucuaauuuguccuucagacuuacaaguucagaucucuguguauuaacccaaucuucccauagccauauagauacuauuuuuuuuccaacuccaccuggccaaacaccuuucacuaaauggugaauauaucuuuucuccaaauaugugccacuggaauaaguaaagaggcuuagaguugacauuuguaugugauuuggggaaaucaguuucuuuccuagagucuuggaaaugcaggugcuagguuucaacuaagaucauuuuucaacugccuugagucuuccccacugaccauucugcugagcuaagcauccugaagaggauugauuugggggccucugggugcuacaguuccacccaccaaauugacugcaguggccugcagggaaauucucucggcuuuuuguguuccgugcucagggcuuuuucugcuugcucuaacugaccugaugguagauaguugcuucucagccauucagcuaagccuaaguguauuuuucuuuuuuagauuuuaacugauguauuuauuuuuugccugaauaauauguuuaguuguuuuagcuuuuuuuuuuuuuuuuuuuuuuuuuuugagacgguguccugcgcugucguccaggcuggagugccguggcacgaucucagcucacugcaaccuccaccucccagguucgagugauucuccugccucagccucccaaguaacugggaucacaggcaugcaccaccacacccagcuaauuuugcauuuuuaguagagaugggguuucaccauguuggccaggcuaaucugaccucaggugauccacccaccuccccucccaaagugcuggguuuacaggcaugaaccaccaccacacccggcuguuguuuuagcguuuuaaaaaacacaaaaggauauagacaaggggaguuucccucccuaaacaacccuccauucacccaggucccuuccgcagaaaguaaccaagaaaagauaccaaggaagaggaaccaccucuuauuauuaguuucuuaugagcucacaggcuucuggagcucaccuuaaagacccagcguggaugggccaaaaagacccucuugaaaucaggaagacugagacaggcccauauggcuugucaguaaucaucaagcaaauuggcaaagccauacccagaauaaagucacagaggagcugcuuuuguguguacggauaaaugguauacaucguacaaauuccaccuaucagcucaaccuagguagguggucauaucucuggggaaaaacacaggagagaaccuaaugucuauaaggaaugugcucuguauccagugcagagcuagaaucuuuuuuuucauuauuguggugagauauacauaacauaaauuuaccguguuaaccauguuuaaacguacaguugagcggcaugaaguccauucacauuguugugcggccaccaccacuguccaucuccauacaaugcuaggcucucccugcccucaucacuuacuccuuccaacaguccuuugaggccuguaugaccagucuccauacaacaaggaggucucagagagaugguuucaugucuccuaucgaguaacuggcagguccuaggcuugaacccagguguauucgucuccaaaacaggugccccauacuguggagccucauuggaagaauuuuuagagggaagacucaucugcagcagugcauaggccucuugucugcauaagacaaucauccccgagagacuguggcugugaugugaguaggugugccuagcucuccaucuuuuuuauuuuuuaauuuucucuuuuauccugugcuguugcccaggggugauccuguuacuucuggauaagcugcggaagaugaaaugggagcagauguggaggcugaccgcagagagggagcucaugggcaugcucucuacauccuuagcugaccaggugaguggccagguucgaaggugcagcuauuccugagugugcuuggugcuguuucucaaagaaacuuaaaauuaaaucgaucugaaugguuuucuacguauugugugacucugugugcucugauacagcugccuuauucuugccagucuaagacaacagcucaacuccuuagugccuucccuuuguucauucauuuguucauucggcagacuuucacugaguacuguguauaccaggagccaaguucagaaaaaggaugacagagauagacgaaggaugcagcacuugcccucauagagcuuagcgucuacugacgcagacucauaaguagaugucggugcccucuucaucaccagguggagugcacagggccugcucucugggaccccagaaugccacagcauauuucccaggcaagguuucacuggccucccuggcaaauagagucuaaccuuuaaucugagccuuuugcuuagaugcuguccuagugucccuuuacucaagggaaaugcacuuaaauagaaagaauaaacugcaagaaaaccaccuugcuaugcaggcagccucagaaacuccuugaacucuaccaaacuguuagcaaauauucauuuuuauuauuuuauuuuauuuuugagguggagucucgcucugucacccaggcuggaaugcagugguacagucucggcucacggcaaccuccgccuccuggguucaagcaauucuccugccucagccucccaagucgcuaggauuacaggcgugcagcaccacaccaggcuaauuuuuguauuuuuaguagagaugggguuucuccacguuggccaggcugguuuugaacuccugaccucagaugauccgccugccucagccucccaaagugcugggauuacaggcaugagucucugcacccagccaacaaauagucauuuuuuaaaaaccuauuccucauuuugacguccuaggaaaggcagagggcuccagucugacuuugagucuaccaggaucacucauuuaaauuuucaucuuccuguggcacugguagcugucuucaggcacgaagaugauuucucugaguuuucugcauuucacccuuuccuuuucauccaaagagccagcucacucugcauguuuuuguucaaagugcaauuuccugguucgucgaaugccugcaaaguuucauaauacggaggaaacaagaaacccugcaugauuacuuuacuauuuuuuaaaguauuauuauucaguauuucccaagcagccagaaacugauuuccuuuuucaaacaugagauagaguauaaugaaugaguuuaagaaaaaaaauaauacccagguagcuguuuuaaaccugaggggaaaaucguccaccagccucauauuucaagucgggucacagugacuugagcaugucccccaaagcuagcaauuguaugcccauguccaguaaggauaguuuauucagccaucuucugccacgaaggcccauaauucaccucccggcgccaccugucagcagcuaguuaauaaguauggccuggugcaacagcuuggagaagagcccaaaaaagguaaaaccucccuagacaagucaggguuggauuuugaaacggggagugcguauccugggcaccaugggcugcagaaauccaaggagcauccaucacugaguccaccgcaggccccaggaagcacugcugaaagggaggaucuguaauuugucucagucccugaaugaguggggcuacuugucaucaugcaguuuccucuccaggaggcucaggauggguaacacagggcuccugccuaggaggccagaggggaaggagacuucguuuuucauaugccagugaggguagggaagacaccccaugucugcacaugugagcucacuggauagggccuuaugagaccagcaggacucuggagcuuccagucagccugggacauucccccgucucuauccaaacauuauugcuugguuccuagagauaacaggcaagagagaugccucacagugcgagccagccuguguucagagcaggagguucaagagaagcccuaucacaggggaugcagugccuugagagccaaaaugggcagcuggaccauccgacugucuugacugugucuuuggcuuucaucccccaggauauuuucaaugccgucaucaaacaaaaccccuuccuuguguaccagcuccccugcuucuggaaugugcagcugucagaccacacccgcuccgagcagugcuacagagacgugucugaucuaaagguagggucaacacagggacaucccuggagguagggugaggugggccgagaggaccucccaggggcauggauggcugggagauuuaugugcaauguggugagagagauaagggcacaggagagcagaaugaguaugcuuuucaucuuugugggguguugguuuuuuuccacccuuauuugggcuuucuggaaagccuaaagccuccuggcguaagaaccagcuugugugguuauuauucuugccaucugcugcuggcucuuuugguucaugccagcuccccaaaucuauucauucaacucaagcaaaaacauuuauugagggccuacucugugccaggugcuauagauguggaugugaauaauuaaccugcuuccaagucauguaugacuuggaggaggagagaaaugugcaaagaaguaaguauuuaaaaaaggacaaagugcuaugacaggugugggugggucagucggggagaugcaagcauaaaugucucauucuuccucacagagggcggacaaugacagaaaaagcuuucaucaccacucuguagguaccaaacacugugaaugaaccuggcuauagaaagaggaagaagacaggguauauuagucaucuacugcuauagauaaugcugcauaacaagcuauucugauaguggccuaaaucagcaaccauuuauauaguugaugaguuuguaggcugguuggaugguucauuuuuuuacugguuuaacagaguauuuguggucagcuucagaugggacagcuggugacuggggcaacuuagauguccucuguccccucagcaagccaguaugguguuuucucauggugaggcagagguggcagaggaagcccuaauacacaagaggaaaccuugagucauuguugcuaauaucccucauuggccaaaguaacuguaugacuaagcccguaugauuacuuugaguaaggagugugaguuaaggaguguguuagaauucccucccuacaguggaaggaguaaagaauugaccacaacuauucaacagaacgaagauuucaacacaggccugucugacagcaagggcuuuugccucucagguuguaucacagaggauuagauacaugcauccuuaaagaauuuguuccauauaaaguuuauauccauugcaaguuuuaaaaaggaaaaaggauugcaaagcuagcuuuucuaauaaauuagucuuuuguacuuggcuucugauccauguccccauguggguauuaugucuuauuuguagucauaacgcauguuaaaugugguuuucugcuuuucauuuguugcauaucauaagcauuuucugggugagccacaugguguuaaugaacaucauauccaauaguuagucuguuaccuagccacucccuugaccuuaguuguuuucaaauuuucauaaauauaaauuauaucuuaauuaacagcuuuguccaugaagcccuuccauccaauauuguuguagcuugccuuuccaggaaugaaauuauagcauuagaaagaaagaacuuuuuuuuaacugcacuugaaauuuauuucaaaauauuagaaaggauuuaaaacagaggugccugcaacauucauuccuuccaucggcauuuauucaguuccuucuguauaucaugugcuuguuagaaauaaggaaaagagaagaaacagacaggaauauugucaagaauaucauggauuaaaaaguuuggagagggggcgaaauaaaaccaacuguguaaagaauauguaaaaaugcuggauuaaaaaauauuuuacaugcuuugaaagcauaauugaucgguucauaaagcaaguaaagaaagcaaaggccagaaacaaugacagagugaauccaaaaagauaagcaaagagcaacuggaugucaccuuugcccuuggaagggaugaucccuaguggcagggagccugguuuaaaggugagccugguauuauaagaaaucuauuuagucuuugucccugguuccuggaacagagcuccuaaaacccuugaaauuuccugagugauaagaacagcuuuuauuguguauaugagccccuuuggguuauaccugaguuuaugcuaaugaggugucuuagaguagggccccuagagagccucaggauggaaagaccaagugaucagaggguuagaacuuccccacugaucaauucccaccuacgagugagaacaugcgguguuugguuuucuauccuugcaauuguuugcucagaaugaugguuuccagcuucauccaugucccuacaaaggacaugaacuuauccuuuuuuauggcugcauaguguuccaugguguauaugugccacauuuucuuaauccagucugucacugauggacauuuggguugguuccaagucuuugcuauugugaauagugccgcaguaaacauaggugugcaugugucuuuauagcagaacaaugagaacacuuggacacaggguggggaacaucacacaccggggccugucauggggugggggagagaggaggaauagcauuaggagauauaccuaauguaaaggacaaguuagugggugcagcacaccaacauggcacauguacacauauguaacaaaccugcacguugugcacauguacccuagaacuuaaaguauaauaaaaaaaaaaaaaagaaagaaaucacucagcaaauauaaagcuuugccugugugacuucuuucauaaaauaaagacuuuacgacacucaaaaaaaaaaaaaagaacuuccccacugaaaguuccauggaccucugggaaggcaggagggugugcuagaaaucaagcucuuuaaaugcucuugaauaacaagauuugaugaacuucuggguuggugaacacuauuguugcugcaggguggugugcccagagaaggcauggaagcuccauacccccucaccccacacccccauauuuugccuuauguaccucuucucucuggcuguucccaaguugcauccuugauaauaagcuaguaaauguguuucccagaguuucaggagccauucuaguaaauuauggaacccaaggaggggaucauaggaauccuugauuuacagcaaaucugucagaggacaggagacugggauuugcaacuggcaucugaagugggcagccucgugggacuaagccacuaacccauagagucugaugcuuuugucaaggagguagugucacuguuguauuaaauuauagggacccagcuaguguugaagaacuggucauuguaggaaaauaaccccacaauaucuggcaucagaagucuucugugugagaguauagaaaaacagugguuuuucucaauagguaacuguauaauuuauuguucaaacaagcgaaugcuaucaugggauacagagggacaauaggccaacaggcaaaacauauaauuauucuguugaaauacuauacacaggaccuuaggcccacaagaagaaagaccucacauaaaggccucacauaaagucaggauccacaaagaguauuauccucagcggauaaacaguuaauaaaacucagaguguagaagaagacaguagagguuguugucuguuucauccuugguuuuagguagaaugagggagaaauguuuccucugagauuuuauuuuaagccuaugcccauauuauuuugggggcugaaauuacaugugugggagcaaaaauggaaagaaaaaaaauuaaaaauuugccaggcacuuggcagaaacuaacauaaaucugaucuagaagaauauucuuaaaaacaagucuucagaauuuuuuaggggaaguuacaaggaaagcaagguucucaggaaucacaaaacacacaaggaaguaagcuacccugagaaagugcaaaaacugaagacuggaguuaaaucugaaagacugcaaauauuggacuuaccagauauaaaacauaaguauuuuuauuacauguagaaauaaaaaaugaauauugaaaguaggaugaaggaauaguagauucucaaaaaaugaauagccguauuuggauuaaauaguauuuuuagaagugaaagauaugauuauugaaauuaaauggauauguuaaacagcagcuuaaacacagcugaagagagaauuagugaacuggaagagguauaagaaauuacccaagaugcaacacagaaugaaaagagauagaaaaacugagaaagaagcaaagaaauugggauaugucucauuggacuaucagaaggagauaauagagaaaauuggaagugaggcauaucuuaaguaugccaagaaacaauaacagguuguauaccuagaagaauaaucuuucaaguauaagauaacaaagagaauuuucugcaaacaugcaaagaaacugcuaaaguauugucagccuuaauaaugaagagauccucucuaaaagaaaauuauauuuauucuggaauagugcauugcaaugggaauauacaugccauagcaaacuaugugcauacccagggagguaaaggaagauaaagguuuuuaaaggaaaaaugaagaggauuuuauaauuguuuggagauaauuaucuuuggccaaaggaucaguaacaaaguugacaccaguccaagacuggacaggcaguugcugggcagacgugccugcagaaguuuuuauuuuguguguguaaaguuacgauggcauuugugcaagauugugguuuucacggagucuuuuguaaucauucuuguuaucagacacuuguggaagaaaagccucuuuccauggcauuccugguucuauuugucaggguuuuguuaacacaaaugacuccauuuuuauuuuggcaacauucauauuucacccuuuugaucaagauguuuccccaaaagugucacuguucagucauccuuuaguuagguuuucaugucucucagugccaggauggaccucucccagguuucuggucuuguuucacguuggagagaaugaauggcagcuaggagucagugucaaaaccuuuuuaaccacauuugagcaauaaggaaguuuaaguggggugcuccucgucugucuacuuggagucuguaauuaaguucaauuuugucuguuccauaggcauguguuaccaucucaaagugcuggguuagcauuauacuguuaggauucguacaucuguaaaaaauuugaacaaguaacagauacaaaauuaaagagaaaaaugcaaaguaaaauuaauagugaugugacaagaacaguuugcauaaggacuuugagcaauaaaccuaggcuuuaaagacagccaauugaauaaacaaaaugaccauuauccuaccaagugaaaaagguaggcuuuguuauaucauuaugauauagagccuuguucugacaucuugaaaaaaagcugucuacagcaugaaaacaaucaacucucguccugguuugcaguuugaaugucucuggugauggcaugggacaguuuggugaaccuuguguggcccagacaucaggcacgagacuuauuucuuaaaauucaucuaguuucaucuuauagggcuuccaaaacagagaaauucccauuugugguaacugcauagaagaaaguaggauuguagaaaucuagaagaguucuauaggcaaauaacaaauagcaauuugcucuauaggcaaauaacaagaacuugaaaacagugcacacagcuaucaucuaauaacagguguauucuagcuuucuuuagaaauauaacucguguccgcauuuuuuucuuuaaaucauagccauaugggaaauuuucuauuuuguuaugguucucuuuuauugaugggcaugcagugaguguuucuuggaaauggccaauuuuuauuaaaauauuucuggaagaaaaaaaagaacagaaacauaacuuuuucuuccuacggugauauuggcuuuuccaaaaauagaguaagacaaauuuguuucuaaaauaaauuuaguuuuuaucaaauauugccugcaagaauagugauuugaccacauaguaaucucagauuuaaaaaccuuucaaagcuaagcugguggcaagugccuguaguucuagcuacuggggagguugaggugggagaacugcuucaccccaggagccugagguuacagugagcugugauugugccacugcacuccagccugagugacagagagaaaccaugucucaaaaaaauaaauaaaaaauaaacauaaauaaaaauaaaaauuucuugagguuaauaagauaacccaagacagacuuuagguuauacuuacaguccuaauguuccugcaccugccaggaauugauaauuuuuauucaucuacucuaaggcugagaacccuagaagucaggcaguuuauacauauucucagauaugacauuucagucaaagccuugaugauauaaccaauuguugccauuguauccugcuauagagagagaguuaauuuuuuuuuuauuuuuaggagagacagaguuucaccauguaugccaggcuggucucaaacuccuggccucaaggggucugcccaccuggcuuacagacaugagccacuguggcaggcagagagagcaaauguuauugaacuuguauaaauaaccauauuaccguaaaaaauaagaauacucacaaaaucucuccaaacuuuggagagagaaaauuggaagaaggaaaugcuucuaccuuguucacaaauauauaguuuaccaaaucauugugcacuauagacagcuuagggaagaaaauuuccuuaaaucuggaaaacaaaacauuuaagugaagaacuaacaguguuuuaaauaaaagucaaaaacauuaucaguuacuuaaucucaugcaauuuauuuuuguucugcuugagcuugauuaguaguuucaugaauucauguuucuucauuggaguucucaaacauuugcauuuaguccauugaucuuaaaguuuuuauuaaccuauaucuaagaguacuuguuagagucgcuuccauaaauuugcuugcaaaugccuuuaaagaagaauucaaaacaauagcuguggauaaaaacuuagaauagccauggcuaaaaaucugaugggaguucauuauaauaagcaauuaacauggaaauuuaguuauuuuugugccacacaacauaaugucuagaauuuuaacuaaugucauauuagauuuuuaagaauuuuauauaauuuggguagauacccauaaauguaaugcaaagaagaucuaguaucacuuauuauuugacagcauuuagcaugcaguucacaaaauaagacuaaucauuuaauauuucuacaagaugagagauacauucuuugagacucuccagagucucuggaaaauccaaaaguuaauuucaggucaauaaaacuuaaguuagaauuuugauucauggaaaccugccaaagauuuuaaaagguugaaagcacuugauaagaaguuacugugaaguaauagucauucauguaaccagagugauuaucaaaagacgauagagaaacuuacguggaaucuuagugcuuucaaaacuccauuuuccuaaguaaucaaauacugaauaaagauaacacaggaaauuauauugauaacauauaaaauguuuguuucuuaggccaguuauuaaaaagguaagaaacaacuucagcagguugauugcuucuccuugugagaagccaauguauaauagauaaccagguagucgaccugaugaaaaggguacuugaauuuaaucugacauagaaagaaugaguccaagguuaggaauguauaccauauuauacaggaauguaaacaagaaaacuagcaccuugagcaggggaauacaugguccuuaguaauagcacgggaaguuucuugguuacaugggauaauuccgacaugucaagaaaagccaagaguacaaaaucaagguauacugguggaagacauugccuuuguaggccuucaagauaaacuuuuuuuuuuuuuuuuuuuuuuugagacggagucucacucuauccccaggcuggagugcaauggcgcgauaucggcugacugcaaccuccaccucccggguucaagugauucuccugccucagccucccgaguagcuggaacuacaagcgcgugccaccacacguggcuaauuuguuguauuuuuaguagagacaggguuucaccauguuauccaggauggucucgaucuccugacuucaugaucugccugccucagccucccaaaguguugggauuacaggcauaagccaccguacccaagauaaacauuuaauggacaagccauaauagcagaguuagaacugggggaaaaaaaacaguuacaggaaggaauggaaaacuuaaaggagagaguuaucccaggccuucucaaggguagaaagacgaagagcagaaggcaaugauguaugaccugaaaaucacaugcagcaagauauagcaaaaguugaacuucugagacaugaaucugaaaagcuuccagaggaaaccucugccucaagaagugaaauuaccauucuaaaugaagaagacagcauuucuaacccaaaacuagggaaauuaaauggaucucaggaagaaauuuugcagaaauagaaacugcaguucagaagauggcaguuaaacagauuucagaauuaaaaauuaugaucucuuaugguuuuacuaagagcagaucaguacuucaagaaaaccuuguuguucuaacauaggggaugaaaauuuuaguuuuguuuuaguguauuuuuaauagcaaagcucaaucuuuaggaaggcuuauaaauaauugccuucuaauuacaggcaacuugaucacacccacaauuucuuuuauaaauuuauccuucauaaacuuuaucgugacuuacucagaccuuuuacaacaugcuuaaacuuucugcuuuguccuuuacuuucucuuuauuaaauaaccagucauuuuacuuuaagacaaaaauuuaccacauaagauuguuucucauaggaaaugcucuuuucuuuuuaacuauccuuaccaaaaauacauccuuauauccauaacuuucuucauauuacucuccuacuuauggauuccugucugucuuguuucuauuuccauucuaaauauacuuuucgaggcaaccuuuaaguaaccucugaacuggacaaaauuauucuauuuucucaguaagaaacauauuuuuaugccuuguaauuucauucaucaaaacacaucuuauuuugguauacuuugugauaugauuuggcuguguccccacccaaaucucaucuugaauuguagcucccacaauuaacacauguugugggagggaccugguggaaauaauugaaucaugggagcaguuucccccacaaauuucucaugguaguaaauaggucuuacgagaucugaugguuuuauaagaaguuuccccuauugcuuggcucucacucugucuugccugcugccauguaagacuugccuuuugccuuccaccuugauugugaggccuccucaaccacguggaacugugagucccuuaaaccucuuuuucuuuauaaauuacccagucuuggauaugucuuuaucagcaacaugaaaauggauuaauacacuuuguauacagaauuauauauaaauuaauuaggauuuuauucuuaguaaccuuaauuucuagugaaaaccuaggaagccaaaaauuuugaauucucugucacauaucagcauuuuguaauaagaacuauuuuauaauuuuuagaagcauguuuuaauagacucaaauauauuuaagaagcugaaaacaacuuauauuuauguucagcaauuuguucuuauuuuuauggaaaugacccagacauuugaugaguguuuuuuauuuaauguaacauagcauaaccuuaugauuuuaaaguacaugaaaaguuauuuuauaaacauuuauuccacauuccauuuauuccaaauguuuauuuuauaaacuuuuuuuuuuuuuuugagauggagucucgcucugucgcccaggcuggagugcaguggugcaaucucagcucacugcaagcucugccucccacauucacaacauucuccugccccagccucccgaguagcugggacuacaggcgcccgccaccaugcccggcuaauuuuuuguauuuuuaguggagacgagguuucaccguguuagccaggauggucucgaucuccugaccucaugauccacccaccucggccucccaaagugcugggauuauaggcgugagccaccgcgcccggcaaacauuuacuccauuuacauuuaccuaauuuacugauuuuuaacaauucaccuagauuacuuaugaaaacugaaauauuacacaaagcgaaucaucauuucaaguuauuguccuguuaaccauuuuuguauuuugugaauaucagguguuuguuuaaguaagagccugaaaguaaaauacacaaguauuuugccuguaacucagaagcuacaacuguuuuuauuaaaccaauauuaaauuaguccuacuuaucaaggaguuacacaaagauuauucuguuuucaaguugacuucauagcuucaugacuuuaaaacauguagcagaaacaaauacaaaacccagccaaaaauguaugcugccaguuucgaagauauuuccauuuuuauuuuaccaaugauuuaaaaaccaucuuauuuaucaaaguuuuauuuaagucacaggaacuaaaaggcauuuggguuaauuacuauauauuuuauaugugugauaauucaucuaagccaaucaaaauaaaauuucuuaggaguuuuuuuuuuggccaacuauuccacauuuuacuauguagauacagcauaacauauauuaucuaacauaaugcauguuauauaauauguauuauucauauaacauguuauucuauaacauguauuauucguguucuaugaauauacuaugaauauuauauuucauuauacauuuuauuuuacauuucuuagauuuuacuauguagacauaacauauauaaaaugauaaauguuauauguauuauucauguuauguuauaugaauacuauucauuguuauauccauuaauauucaauaauuauugaauauuauuaauuuauuaauauuaauaucaauuauuuaauuuaacaguguuaaauuauugaugguauuuaaugauuugauaauauuaauauuuauaaugcaauaauaauguucuauaauauaauauguauuauuauaacaccuauuccagauuuuacuuuguaaauacaacauaacauauuauauaacauaauacauguacauguugguaaccacaccuaaacacauagacauacauacacaaagaucuuacugcuuuuauuuuagaauuuuagccaugagauaguaauacaaacucacccauuuauaaacaacgauugcauucaaauuauauuucucucaaaauugggaccuuuuuacauagcuaaacuuaaaugcuaaucuagugaaggcuauggaucaaaguuuuggauaaagcaguuugauuuuuuaaaaaaccucuuuuaccuuuuuuuguuuccuuucuucagcuucaaaugaguuuacauuuuagcugggagugacgaauuguauaagaaaaacaaaaucuccaguggccuugaauuaguaacacauuuaucuuuguucacugauccccuuugcuagucaaugguuauggggaagcaucuuaacaagaguuuuguuuuccagcuauuuuuuuuuaacggccccuguguggcagacacaacaguuuuuaugcuggaaagagauaccuuauauuacuguucugaccucaagauuuugaccugagagccuaaccuucauaaugauuuaucuaauuuuuauuauuuuaggcuaucaguccccuuaguuaacugcucuagcauccuaagcaauugguagccaggcaaacccaaauuuacauuugcaaaagaugucuagguuguugguuacuuuggagcuguuguaauauguaaagccauuuauuuaaaagcccuuuaagacuuuuuuuuuuuuuuaaucuuggcuagaaugccauaagcacugaauuuuaucucaacaccagcagaaaagucaacugauuuaggccaggcacaguggcucacgccuguaauccuagcacuuugggaggccaaggcagguggaucacuugaguucaggaauucgagaccagcuuggccaacauggugaaaccccgucucuacuaaaaauauaaaaauuagccggguguggugaugugcaccuguaaucccagcuacucaggaggcugaggcaggcgaauugcuugaacccugccuggaggcagagguugcagugagccuagaucgugccaccgcacuccagucugggcuauagagcaagacucugucucaaaaauaaaaaagaaaaagaaaagucaccagauuuaaaguaggcaguaaaaaaaguagagauagagaacuaagaaggcucuguuaucuauauaaucacaaacucuuaauuuggggaaaaaaaaaccaagaaaauagaaaaaagaagcuuggggaguucaaauaaucuguguuguggcuguugauccaaaaacaugcaugaggaaagccuuguaauuagcuggagucucugaaaaccuggcacaccuucaugugggagaaucccauucuauuucuuaucaaucucuugagagcaaagaaaauuccauaaauccuaucugagaaugucaggauuuuggacuugugucucuuccugugacauuuugguaauguucauuguuauuauaucugauuuaaaauacuacauaaacuuaguugauaaagcaggggcaggauuugagaagauuggcuccaauuuugaaagaaguucuauuguagguaagaauuaucaaacugcaucaauugcuacagagaaacuuuucaugaaaggaagagucgauccaugugggaaacuucauuguuaccuuauuuuaagaaauuggccacaaccaccccaaccuuccaacaaccaccacccugaucagucagcagccaucaacaccaagacaggacccuccaccagcaaaaggauugugacucacugaaggccaggugaucauuaacauuuuuuagaaauaaaguauuucuuaauuaaaguacguauuuuuuuagacauaaugcuguuguacacuuaacagaguacaguguaguuuaaacauaauuuuuauauguaucggaaaaccaaaaaaugugauucacuucaugugguauucacuuuauuacaguagucugaaaccaaacccacaauaucuccaaguuaugccuguauauauaucuguccaaauacauauacacaaacaggcacacacacacacagagcucauuagaacuccagggagaaauugauaaguccauuuucaucuuggaauauuuaacauauuuuuucuuuuuuccuuuuuuuuuuuuuuuuuuugagaaagagucuugcucuguugcccaggcuguggugcaguggcaugaucucagcucacugcaaccuucacuucccauguucaaacgauucuccugccucagccucgcaaguagcuaggacuacaggugcccgccaccacgccuggcuaauuuuugcauuuuugguagagaugggguuucgccauguuggccaggcuggucucaaacucuugaccucaggugaucggccucccaccucggccucccaaagugcugggauuacaggcaugagccaccgcacccagcccauauuuuuuuucaaauguugaaauaucaaaagacaaaaauuacuaagacuauagaagauuuaaacuacacaguuaacauguugacuuauugggcaaauaaggaaccuuguaccuaaugaucugagaguauacauccuucuuaggcucauauggaacauuuauuaaaaagaaaccaaguacuagacaucaauacauuucaaagaaugauauuauacuauaguucucugaagaaagcaaaauuaaauaagaaggcaguaacaauaagguuuuuaaaaaucuauuugauuacaauugaaaacauacuuuuacauuacucaugguucuaaacauaaauaauuuaaauugaaaacuacuuagagccuaaaugaaaauaaaaauaauaugucaaaauuagugggauaaaauaacauguaaggaaauguauauccuuaaauguuuauauuaaaaagaagaaaaguugaaaauuaauaagccaaguuugcaacucaagaugauauauuaauauaaacaacguuagaguuggccgggccuggugacucaugccuguaaucccagcaacuugggaggcugagaugggaggaucccuugaguucaggaguuuaagaccagccucagcaacaaagcaagaccuccaucucuaccaaaaaauaaauaaauggggggaugggaguggggcaguggugguagcuacucaagucccaguuccuagagaggcugaggcaggauuacuugagcccaggagcuccagacugcaguaaacugugauugcaccaccguacuacagccuggguaacagaaugagacccugucucuaaaaacaaaacacaacagaacagaacauuaaauucaaaugcaaucaaauugaaguuggucagcaaauugaucaauaaagucaaaaguuugaaagggaccaauaaaauagacaaaccuauggcgagacucaucaagaaaaaagaaagugaacucaccaagaaaugaauaggggcaccuaauuccagauccacuuacucauucucucauuguuuuugagcaagugacuucugaguucuagauauacagcaaagauaaagcaaacagucucaguugguggagcuuucaaucaauuagcagaauugaaaaaaaaaauagaauacugugaacaacauuaugugaacaaauuugagaauuuuuguuaaauggacaaauuccuagaaauguguuacuuaccaaaaccgauuuaagaaaaaaguauaaaguuuagauuaucuucuagccauuaaaccuuuuuaaaacaguaccccuagacggcaaguagaaauaaguucuaccaauuuuuuuuaauccaaggacauuuccaauuuuaaauaaacuuuucuagagaauaugaaaagaggaacacuuuuuaacccauucagcaaagccaggauauuaucaacaccaaaaucagacaaaaaaaaagugcauuagucuguucucaugcuguuaauaaagacauacucgagacugaaacuagguaauuuauaaaggaaagagguguaauugacucacaguuccacagggcuggggaggccucacaaucauggcggaagacgaaagagaagcaaagucacgucacaaagacaggaagauugcaagccagucucacucaugaauauagaugcaaaaaucuuaagcaaaauauuuagcaaaccaaaucuagccauguauaaaauagauaauauaucauugccaaguuggguuuguuccaggaaagacaagagugauuuagcauugaaaaauccacgugucauucagcauguuaauagauuaaaggagaaauaccaaauaaucauauaaacagaugaaggaaaguuauuugacaaaauuacgugcucauucaugauaaaaacucucauaaauaguaacuagugaaaaccuacaguaaacuauugcugagcauuugcucagggccgugcaauuaguuggaaagaggagagcgugcaagagcacacacacauuuaugaaagcauuuugguauaugaagaggcaacauaccugaucauugaagaaaugauuaaguuuuccauaaacugugcugagacaccugauuauccacauggaaaaaauuuaaguggaucccugucucauaccaugcauaaaauuaauuccagacggauuagaaacuuagaaagugaagggccaaauuaaacuuuuauuuuuuaaaugaaaagggaaacuggccuuaagacuucagaauggagaaguauguauucaacaagacaucaaaaacgcauaccauaaaugaaugaauccguaaauuuaaucacauugauaucaauaacucaaucaaacaggcauuaaaaagagaaaagcaggccaggugcaguggcucacgccuguaaucccagcacauugggaggccaaggcaggugccucacuugagcucaggaguucgauaccagccuggccaacaugugaaaccccaucucuacuaaaaauacaaaaauuagccagacgugguggcgcaugccuguagucccagcuacucaggaggcuaaggcaggagaauuucuugagcccgggagguggagagguugcagugagccgagauugugccacugcacuccagccuaggcaacagagcaagacuccaucucaaaaaaaaaaaaaaaagagagaaaagcaaaagauacuucaacacauguaacugacaagagagcacuaaacaaaauauauaagcaacucuuaauauugaaugauaaaucuguaaaacauguaaacaguccuuucacuugguugccaggcaaauggccaauaaacacaugaaaagauauauagccucgcuguucaucagggaagugaaaauuaagaccacaaauaauuuuauagccaccaaauuggaagagugauacuaucaagucucaguugaccaguggucuguuaugucacccauaggaguguguauggauacaccaaauuggaaaacacuuuggcacuauauugaaaaauugaaguggaauauaccuuacaaucugggucuuggauguaauaggucacaaauggagaaguggaugacuuucuaaagaaagucagguucagccaucagugagcgaauuacaacagauagaaguagugcuuuggaaggccuguguccuccugaugaaugacauuucuugaccaggcagggcacaggagacuucuaaacucucaagucuuuuuauaucaaaaauaaaaacauaaaaauaaguacaacuaaaaacuuuggcaggccuugaaaagggauaaaauucugaaggucaggcauggugguucaugccaguaaucucagcacuuugggaggcugaggcagguggauugcuugagcccaggaguuugagaccagccuaggcaacauaguaagacccccgucucuacaaaaaauaaaaaauuagccggcaugguggcaugugccuguagucucagcuacuuggguggcugcggugggacguuugcaugaacccaggaggcagaggaugcagugaccugugauugugccacugcacuccaaccugggcaacaaaacaaaaaacugacauaugcuauaacuuggaugaacuuugaggacauuaugcuuagugaccuaagccaaacacaaaaggacaaauacuguauuauuuaacuuaaaugacuuauguaaaguggcaugaaacaugcuacuuaaaauggcaugcaauuuaaaauaugaauuauuucuggaaucuuccauuuaauauuuucagacagugguugaccucugguaacugaaguggagaaaagcaaaaccccgaguaaggagaggcuguuguacucccaagggaagaacauaaaaaacagcaauuaggagguccuucguaaacgcggaacgggauugaaaaaacaaaagaugggaggaagcggagaaaaagaaugaaaauaggccggacacaguggcucacgccuguaaucccagcacuuugggaggccgaggcgggcggaucacgaggucaggagauggagaccauccuggcuaacacggugaaaccccgucucuacuaaaaauacaaagaaaaauuagccgggcgugguggcgggcgccuguagucccagcuacucgggaggcugaggcaggagaauggcgugaacccggggggcggaguuugcagugagccgagauugcgccacugcacuccagccugggcgacagagcgagacuccgucucaaaaaaaaaaaaauauauagcaaagaugcacuuugaccaggacucugagacccagauuggccuggugggacagacgguguucuugggucaucccugagggcuccacagaaauguccaggcaccaagaggacccagagggucucaccaucccgcucagucccacccgggaggugaaucaucccuucauccagcaucuccaugcugucugcacuacuggccugugaaucacuuaguagccaucucaguuaucagauugacucucugggaucgcaaugcuuguguucaagucgcccuaauuuuacuucgucauggcuccaaagugcaaaagcaguggugcugacguauuauaauuauucaguuuuauuauaauuuauuguuauuaaucuuucacugugccuaauuaugaguuaaacuaaucauaaguauguauguauaggaaaaaacaugguauggaguuagguacgugauacgguuuggcuguaucaccacccaaaccucaucuugaauuguagcccccauaauccccauguguugugggaggaacccagugggaguuacguaauugaaucacgggggugauuuuccccauacuguucuuguggcagugaauaagucucaugagaucugaugguuuuauaagggguuucccuuuucccuugggucucauucuuucucuugccuguugccaauguaagccaugccuuucaccuuccaccaugauugugaggccuccccagccacacggaacugugaguucuccauuaaaccucuuuuucuuuauaaauuacccagucuuggguaugucuuuaucagcagcgugaaaacggacuuauacagcacuauugcaugguuucaggcaaccauucuggguuuuggaaugugugcagauacuacuguagacagggggacccugccucuccuggucucccucagcucacacucugcuacuccaaaggagagucaaccugagcagcccccugugggaaaagcgggagccccaugcugggucagaugauugaaaaugucauuuaaagcgagaaucauaaaaauauuuuaaccuugauuugcuuucuuuucauccacaggccagguuuuuugaucugcuaauugagugcuguauuaucuugcauaaaccacccucaugcaucuucugugguuaucgguguccuuucauucaaagugaaacaagaacuuaaggacucuuccaaaacaauuggaggacgguccuggguuaguucuauuuuccccccuuuagucucacccacaccuaacacaaaagcaaauuuguuuagggacuucuuuucauugagcuguugcaaagcguuuaguuugccuuucagggaaacagcaauucuuuguaguuacauaccauaaacucaaauaauauuuaauuagauuuccaauugcauuagaaacacaagauagaaaaacaccuucgguaauaaucacagcucacucuugcugagcacagagcccauuuguaggaacagacauccucugacauccuacuagcgagaggcuuaccagccuugggcaucuacuuugcccuagguguccauggagaacuuugugcuaaguagagguugguuaagagaacuucuaaggggagagguguuuucacugaagaggcaaaaguguauauccuuugggagccaagcaaucuuguaaauucugaugacaguuuugcuucuuaccaacugaaggacuugaguaaaucacuuaaccucucccagguucaguuacauuauugagaaaauugaggccauuauucuuugccccauucucagccaugccccuugagugcuccauagaaauacacuugacuuuaccucagucuuuguguuucaggaccuucauuguuaucucuuuaguccuuacgcuugauaacucagccuucccuggcugagucuuaaauuaaaaagagaagggaagggcccaagggagcaucuuuuuaucacuuuaccaguggcacaaacucuuaggagaccagaguguguagugugcugguuuacagaaaggagcaugagagaauucugugaaacuuugcucuaguucuugagccuuugauggaccauuagagaaugaagcucuggccagaaucaguugguaaugaccaggaaagggaaagcagagggucuaccaaugggucucucuagggguuucuagagucccagagcugagugagccaugguuccugcucucagaaaagucucuagugagaccuaauuggugaguaauggaaaauuccaauagagucugcuaggugcugugauguaaggaagugagggagccuaacagagcaagaggagggacucuaaagaggagggacucuaaagaggagggacucugagccaguuggggagugugaugcagaaucugaaucucaaggaauucagauucagauaggaaaccugagcugaaucuugauauccaaacucccagacaccugaacucucuuccuuccccaucugcugcccucacacuaccccucagccccaaaacauccuugcugccccucuccacaguccugugaaaacugcugcuccuccccugcucauaucuccagagcagggaguaagugcaaggacuacacgagaaagaguggaaacccaaaugcaaguuaagaagaaauagaugcacacagcugggccauugcuucaaaaauguuuauguagaaugcauugagcucuuucuggaaucaacaggaaguacauuucagaggaaguuguugugucaaaccccugugaaccucauuaggaaagucaucagcuccaagaggcugaagaagagacccagagacagcaaaccagaaccagacaugguuuauuuuuauuuuuauuuauuuauuuauuauuauuauuuuuuuaaacagucuugcucugucacccaggcuggagugcaauggcgcauucucggcucacuguaacccccaccucucagguucaagcaauucugccucagccucccgaguagcugggauuacaggcaugguggugcacgccuguaauuuuuguauuuuuaguagagacuggguuucaccauguugggcaggcuugucuugaacucccgaccucgugauccacccgccucggccucccaaagugcugagauuauaggcgugagccacugugcccggccgacaugggguuuuaucgggauuacauacaggggagagaguccagcggcagcaggcuggacaggagagcugccuuauguacagaaagaguccaguggcagugggcuggacaagauaccugccuucguacagcccaguggcggugggcugggcaggaaaacugcaauuaucugcaaacaucacgcaguuuauauagcauuuucacuuaacacucucccacuaaugaccuugauacgguuuaaaucugugucccccuccaaaucucauguugaaguguaauccccagugcuggaaguggggccugcugggaggugcuuggaucaugggggugguuucucaugaaugguuuagcaccauccgcaucguguuguucuuaugauaguguucucacaagauccgauuguuuaaaaguguauagcaucuccucccucuuucucuugcugcucuggcccacauaagacauguguaaguuucugccaugccccuucugccaugauuguaaguuuccugaggccucucuagaagcagaugccacuaugcuuccuguacagccugcagaaccaugagccaauuagaccucuuuauaaauuaccagcccucaggguuuuuuuguuuuuguuuuuggagacacagccuugcucuguugcccaggcuggagcacaguggcguggucuuggcucacugcaaccuccaccucccagguucaagcaguucuccugccugaaccucccaaguagcugggacuacaggcacacgucacuacgccuggcuaauuuuuguauuuuuaauagagacgagguuucaccauguuggccagacuggucucaaacucgaaccucaagugaucugcccaccucagucucccaaagugcagggauuacagaugugauuucuuuauagcaauguaagaauggacuaauacagaacucuaacuggcaaccuucauuuaacccaaaacucaggacuuuggucccauauaugggcucagauguuccuuauagacaaggaaggaaucucuggguuggccacuccuagauugucuagcucagaacacacguuaagaugagucugcuggcugggugcgguggcucacgccugugaucccagcacuuugggaggccgaggcgggcagaucacaaggucaggagaucgagaccauccuggcuaacacagugaaaccccaucucuacuaaaaauacaaaaaaauuagccgggcgugguggugggcgccuguagucccagcuacucgagaagcugaggcaggagaauggugugaacccgggaggcggagcuugcagugagccaagaucgcgccacugagcuccagccuuggcaacagagcgagacuccaucucaaaaaaaaaaaaaaaaaaaaagaugagucugccauacagggucguucuaaggguugcuuaaguugcugcucucagguguguuuauccuacagaagugagcugucacagcuucauugugggccucaaaagaugaaaaggaguuuuccaggaugauuggcugggaaugguguuccaggcaugaccucacuuaaucuucccaagucucacaagguaaaucuuuuuucauuuuauaagucagaaaaugaaggaucacacagguuaagucacuuuucuugcccagucacacagcuaaauaugacagagcugagauuccaacucacaucugucugauuccaaguccgcagcauuuuccucugauacagcaaugaguuucuaccugaaaauauuuuccaaugaaaacaugauauauaacauaaugacuguauagaacuauuguaugggacuguauacagucccucuuguguagggcuauucugcaugaacucuguuuggauuaaguggguuuuagaggguuaacuccagaacagagccccuuaauaauacuauauccuugaaaggacauuugaauuuuuuuuuuuuuuuuuaagauggagucucacucugucgcccaggcuggagugcaauagugcagucucggcucacuucaagcuccaccucccggguucacaccauucuccugccucagccucccgaguagcugggacuacaggugccugccaccacaccuggcuaauuuuuuguuguuguuguuguauuuuaaguagagauggauuuucacuguguuagccaggguggucucaaacuccugaccucaugauccacccggcucggccucccaaagugcugugagccacugcacccggccaggacauuugaauuuuaaacaacagacucagaggcugaauuuuagaccccaguccauuuauaaauugguaauugaguacaccuaaaagaaaaauccuaaagcagaagagaaaaaccaagagaaaagaugccagccauaggaggaaaugauauaucuucuuaggggcaauuuauagcauuugcauaaaaaaaguagcccauaacucaagcauugaaacauuuuauaauaguuagaguugugucaguuucuacaucuuugggggaagaugaggggcuaccauauaucagcauacugaacaugucacagcuaagcagacuacagugaaaaaugaggcagggaaaacacaggguaauaagaaugaugaauguuaagguugauuuuggaggauugggauggaucaaggaagaaaaaaaaacaguugguuuugggggagaagaucuaaaaucucgaauuacuaccuucuagucagacuucucuuucacuucaggccagugccgguuucauuucuuucauuguaugaccugcguccaagggcugucaguguuuuaugaucucuuugugcacugcugugaccaguaaacucaaggaguccucaggauuaaauaugaggcagcuggcuccuguuuaaguacccuguccuuugggacuauugcccuguggcuuguaugcgggaucucucauucccccagcagacauggcagagcacccacucugggccaggcugucacugaguucuuuaacucacccuaaccaagucuuuucaucugaaaaacuaggaacuuuuccucaugagucuaaagucauccucaugacuuuauagaagagauggaaagauuaaaagggacaauacauaaagcaguacaaggcuuugagacauuguaguaaaccuauuauucuuuuuuguauaauuuuuuuuucuuuuuugcgacaguuucacucuuauugcgugggcuggagugcaauggugcaaucucggccccccucaaccucugccucccggguugaagcgauucuccuuccucagccucccaaguagcugggauuacaggcaugggccaccaugccuggcuaauuuuguauuuuugguagagaugggguuucuccauguuggucaggcuggucucaaacucccgaccucaggugaucugccugacucagccucccaaagugcugggauuacagguaugagccacugggccaggcaucuuuuuuguauaaauuuaagugguacaagugcaguuuuguuacauggauauauuacauagugaugaagucggggcuuuuaggauaaccaucacccaaaauaauguacauuguacccauuacguaauuacucauccaucuccccucucccacccucucagccuucagagucuccaaugucuguuauuccaugcucuuuguccaugugcccucacuauuuagcucccacuuaaaaugagaacauguaguuauuuagcuuucuguuucugaguauuucacuuaaaauaaggccuccaguccuauccauguuuucauuccuuuucauggcugaauaguauucauauauauauaccuacacuccacauuuucuuucuacguuaagccauugauggacacuuaggcugacucuguaucuuugcuauugugaauagugcugcagugaacacacaaguauagcuaucuuauuguuacaaugauuucuuuuccuuuggguagauacugaguaguaggauugugagauugaaugguagcucuguuuuuaguucuuugagaaaucuccaugcuguuuuccauagagauacuaauuuccauucccaccaacaguguauaagcauucucugggaauaguuuccauuuggcuagugggcagacacauaaaaaggcacucuuccuacuccucuguucugucuuguuucuuuuguuuucucuucucuuucuuucuuuucuuuuuuucuuuuucuuuuuugauauggagucucacucuauugcccaggcacagugcaauggcaugauccccgcucacugcaaccucugccuccuggguucaagcaauucuccugccucagccucccaaguagcugggauuacuggcacacaccaccaugcugguuaauuuuuguauuuuuaguagagaugggucuuaccacguuggccaggcuggcgucaaacuccugacuucaagugauccgcccaccucagccucccaaagugcugggauuacaggcaugagccaccacgcccggccaacucucuuauuucaaagaagggaaauagagacacacaaagguuaaacaccuugccuaagguuaaacaccgguugguggcacagcugggauaguaccugaccuucacaucauguguccuuggaucaugccagagaauggcaggcuaagcagacgggaccuugggugacuuaagcuugagucuguugucuucccucagcacucauccauuuuuugcuccuggauaauuuucagaacugaacucuuuugaguuuuauugauuucaguuguccuucauuggcuuuuuacacauagcugauaaacuuccaaugcaguuauugcuagaaacaacaagauuccuagaagcaaagugaugucucuggaaauuuuacccuaugacagcauuuuccagaguguauguccaaacaguucuaagagcuguuaauuggacuuauuuaaaauggggaacuggggaggaggauggggagagcggaguucuauguacuacauaccaaauacuguauuaggaaguccugcagccagaaaaucugauugauuuuguugauccccagcauuucccacaucuauuuuauaucaacacacaggaaagacuccccuuugauuacagaaugccugguaggacaaguuccuuagaagcccacacuuccuuacauaaauacuggcucuauuaagaagaacacaauuuugagcaaaggaagcgccauuguaaagcaguauuuggcgaccauggacauugagccacuaacugagagccuccccuauagaaggcucaggugcaugauauuaacacugggccucagaaagccggagggcuaggcagagaaagggugguccaggaggaguuagaagaucuacuuuugagauucuggaaaagaccauaaauugaauggaucauggguucauaacuuggccgugaucagagaagaguaaccaaggugagcaagagacaaagguuuaauuuuccaguuaucacgaaggggacaggcagguagcauauccagguguacauuugaagauccaaacuauccuugaggaaagggcugcaaaacacauuucagccuagcaagcuacccaguauugagugcccguuguaugcaaggguuugaagacacuuagugaaguugaggauauagagacaaguucaucauaauuccugcccugaaagagccuuacaaacaggggauacagaaguuucaacugcuaauuuccacauaaugugaacaauacugugcaauauugcuuagagguauccaggucagaaaugaaggugcuacauaaaaagggauaguacgaaugaacacaggggccuaaaagaucaugguguccagaaauaacaaggagauaagcagagaguucaggcuguguacuaaggagcuuggaauuuaaacuaugggucacaguacuaaaauacuucuuaucugaccuauuccaaugcaaacauauuuuuacugugguacaugaauacacuauaaaacagaaaaguuucauuuuauuauauguuugaguaauuuuaaguuaauuuaguaauaauaaacccuuuugcucuuaugaaaaacauaaguauucauauguuuaaacauagcaauauuauugaaugugcuucauuauuuuugaaauguugguuuaguacuuugugacacaguguuucauagucuuaguuuuaagggcauguuauacaaauacuagaauuuaauggcuaugacugcaaaaaggaucccuccuaaaauucacagauccaaauggaaaaaaaguacaucauuggcuggcugaauacauuuuauacucauuguuucaguuuaauccaaaagucauacaaaaauauuuguagcauucagcuauuauauuuaagucucucuugaugaccaucauuugcuuuugauaauuuauuaaauauucuuuagcauuuugauaacacauucaaaacccaccauacaauaaguccucacuuaaugucaucgauagguuaacggaaacugugacuuuucagugaaacaacacacuaugugccauagaaacuuaauucuuguuuauaucaacuaacaagguaaauugauuucuuuauaguguauauaauuucacuugaaguugcagccuccaagaacuuaucaaccuuaagugaagacuguaauuuuuuuuauuugcaaguuaauuuucaaaguuaaaucuauuuugaaguuuucuaaguauauagaaaugagggcuuugauagguaacaucauuucuuggccucacaaucccauaacgauggaaacaauuucaaacauuuauuuucuaaaagcucuauccuguuucagaguuucugucugaaagcacaauauuuacuuucucauuugucaccuuuccaccgaagggucagauuuaaaguguguguguguuuucaaaagugugagauagaauacuaccagcaaccauccuuucuucacgugugccaucucuuacauguccuuugcuuugaguuagccagcaaagcuguguguuacagauuuucauugccaccucucaugucauuagaaaguauuguacaauuguaaugcuauuuuuagucuugccuuuauaaaauuaucuaaaucaauggcaucuagcagcgcuugugccugcuggccucagguacucuguugcaggcuugcuuagcaaugauggagucaaggaauucauugcauggugcugacucugugaccuuacuccauaauucuuuuguuauuccaguuaaagcacuguaccucuaaugauuccacauacucucuuuucauaaaauaucguuaucauuaaaguaggaauuuacugcucaguguauaacucugcaggacagcuuuccuuuagugcucacaaaaaaagucauucuuucugucuuucauucucuaaacagaaucuaucacguagcguaagccuacacacaguacucuguacuuugauuuaauuccauagcaaaucucccauguaauucagucuaauacuaguugcuuccauccuucagcgugguuuucucugacucuuccugcaauauuugcugacaaaggaacuuacuucauuuuguuaccauauuaucuuuguguauuuuuacagccauuuuugccaaggcaaaaaaaaaaaaagaaaaaaagaaaaacaaguauucuccuuacuggacuuuauuguccuuuauucugaugaaagaaaucucuaaagcaacuucuaaccucuuuucacagaguucagugaaacauugucaagcuuaagaccgacuuucacaagacuuuaaacaucauccagaaauuauggugacuucaucugcauauucugaaugcuuuguuuuuaaaugucuugcuaaucacacaucuuuguacuaacauuaaguaauauaucaaggcauaauacacaguuugaaguucuuccugaaugauagugguuguaaauucauauuucaaauagucuugaaaauuuacauuuuuugccaguuucuugucagauccaauuagggagucauuucucuacuuuguaauguagcuaaggaagagcuuauacugggaacagaagugucagcucagcuguuuucuugcuauucacaucagcuugucuuauugguauucucaaucuguagcuccuuuguagaacucccuuuuuuaauuauaaacuuuuauuuggaaggauguuagacuuaaaaguuuaaaagguagcauaaagaguuuguauauaucugucauucgguuucaauuuccccucacauuaacaucuuuuuuuuggugggggucggggaauggagucuugcucugucgcccaggcuggagugcaguggugugaucucagcucacugcaaccuccaccucccaaguucaagcaagucucucccugccucagucucccaaguagcugggauuacaggcgccugcuaccacaccuggcuaauuuuuguauuuuuuuuuaaguagagaugggguuucaccguguuggccaggcuggucuuaaacuccugaccucaggugaucugcccaccucggccucccagagugcugggauuacaggcaugagccaccaugccuggccagcaucuucuaacaguuguacauucaucaaaacugacaaaccaacaucaauauauugcuuuucaaguaaacuucaagcuuucauuguauuucacucaauguuuccauuuaagcuuuauuuccuuagucuccuugggucugucauaaugucacagucuuuccugguuuuucgugacugaccucaauaguuuuguggaguacuggucagguaguuucuaaaaugucccuuaaguugguuugucuaguauacuuucucacgauuagacugaggggauagauuuuuggaaagacuaucacagaugugaagugcccuccuccucacauugugucaggagguacaugaugcccacauauaacauuacuagggauguuagccauucuuauguaguaaaggcaauguuugcuagguuucuccacuauaaaguuacuaauuuuugccaggccuugggggcucacgccuguaaucccagcacuuugggaggcugaggcggguggauuaugagcgcaagagaucuagaccaucuuggccaacauggugaagccccaucucuacuaaagauacaaaaauuagcugggugugguggcgcgcacauguaaucccagcuacucgggaggcugaggcaggagaaucgcuugaacccaggaggcgguugcagugagccaagauugcaccacugcacaccagccugggugacucugucucaaaaaaaaaaaaaaguuucuaauuuucccuuugauacuuuauuuuuugaaagugagucauuauaucuacccugcaauggaaguggagggauuaagauccaucuccucgcaaaggggguaguaguaucuacauauauuauuagaauuucucuguaauuaaagauuggucacuuuuucucauuuauauuuauuuauuuuaaaaauaauuuaugucuauauauacucauuuauuuuauacuuuggguuauaaugcaggacucuucuuuaaggcauuauucauuuugugaggguuauuuuaauucaauauuaguaauuauaaaauaauauuaugaaaugcacuaaaaauaaguaauaguaugguugguugacagaagacuuugccagauucauuuaaaccccagaacaccucaauauuugagagcgccaugccaccauaucaugccuucugcauugaugcagcuacauaugggugcucacaugacuuagccucuccccucucucccucucugccuuugcuuuucucuguuauggcaggguggcuuccugaggccuccagccaguagguagagcuuagucauucaacagauauuaauugcacacuugcuaugagcuagacacugguuacacaauagugaacaagacagugcaggccuuugcucuucuugaacuuacauucuagugcagaauacagcuaucacacaagaaaacaaaugaucaauugucauuucaggcaaaacgugcaaugaaaacauaaagaaaucuaaggcuaauggaagagugacuagcacucaugaacccaaauugaagagagaagccccuuuucucuuaaugucuccucaaaaggacucuguugacccuucaugggacagguauccaugcaagaacccaucccuguguucuuaggaauggucaggaaugacucacuggucagcuggaguccgugucugggcuucuggcuggucaggcaugacugacagccccauuagagucaugggaagaaggccugaucuacuucugcaaagggcggugaugcggggcagacaaaagagcaauagugggccucacggaaggugccugcugggaaccaggaagcacagcugccucucccaggguuuccaagcagcgaauccuacggugcccacccccaagggcaugacugaaauucggccaaguuagcaacaucccacgggacucaagccagcugcuccuccacccaccuuggucaaauuccucagcuaaggaucccaugccaaccucuagaggugggaucugcuuccuucuagccugccuguccuccagucacacccccgaggaggacacuguggggaggcuaaaaugugaauacagucuuaguaauuaauuccauagagacaggaagaauacgggcugguuaucacuccuggucuuguguggguugucugcagggaagucgcauaaaggcagcagucauugaggacacuuaacacuguuugcaucuuuuuucauguccugcuaucaagacagcaucaggaauucuuugcauguaacagaauccaguucaaauugguuuuuacccccauuuuauagcauaaaggaacccaacacauugaacaugaugaacauuagagaaaauacagcugaauugucucauggauucaugaccuucccagcccugaguauugugaaaagucuucauuuuccuguuguccuuuuauccccuccuuagccucuaccuccuugggcagggaaaaauaagaaauguuacagagaacagaauaagcaaugauaggauauaagacaaggccugggauucaugcauuggccuaagugucuacauuuuccaagugagaggacuaagucaucaaugaguugggucucuuuucuuccccuuuccuggauaaugauguguuuuugucugggaagaaauuuuucuuuucuuuuuuggcugagacuccuaaaaaccaaaaggcaauaggaaucugugugacaggagccaaagaguuaugaguaccaggacccuagacugcacuguggcaaaacuuccauggcugaaagagaugucuugguauaaagggcaccauuuuuauuuaauuuuuauuuaauagcaguaccugauaauugucaggaauuggaaaggaaaaggaagggggaugaaagggaagcuucagcagcucauggggagcauaaaaaagcugagauacaauccauggggagucaacaaacauugaccaagccuccuuuugcaugcaaaguuggauagaacacagcucuugcauugaaggauccagcaguccgggauguuggacagugucacuuuagcuagugcugagccucccucagagagaaucaugugggaauggagcguguauauuccacagacuugauucacaucacaagcacugagcauggaucugcugcaggcuccauggugaacaccuauauuagauucuccagagaaacagaaccaauaggaaauagaauguauauguaucugaagauacuaauuaugagaauugacccauggguuauggaggcagagaaggcccaccaucugccaucuacaagcuggauucccaggaaagccaguguuauaauucaaucugagucugaaggccugagaaccaaggaagcugaugguuaaaucccuguauucguccaucuucauacuucuaugaagaaauaucugagacugggugauuuauaaagaaaaagagguuuaauggacucacaguuccaccuagcuagguggaggccucacaaucauggcagaagacgaaggaggagcaaaagcaugucuuacauggcggcaggcaagagggcaugugcagggaaacugcucuuuauaaaaccaucagauuuugugagacuuauucauaaucaagagaacagcacaggaaaaacccaccccgaugacuaaauuaccucccaccaagccccucccacaacaccuggagauuaugggcacuacaauucaagaugagauuuggguggggacacagccaaaccauaucgguuccagucugaaaggaggagaagacugaugucccagcucaaauagugagccaaaaaaaaaaacaaaaagcaaauuucuccuuccucaguuuuuuguucuaucagggccucaauggauuggacgauggcucccuguacugggaagagccauuugcuuugcugaguccacugauucagaugcuaaucucauuugcaaacacccucacaaacacaccuagaaauaauuguuucaccaaauaucagggcacaccaugauccagucaaguugacacauaaaauuaccuacuacaaugccauuacagcuuuuguuucauugauccuaugcagcagguauuauuauuuuauuuuaagagguuggaaaauagagguucaaauauaguagguaguuuggaguaacagaaaaggcaaugguuugaaccuaagucuuaccagaucagugccuugccccugcccaacagcacucuugaucucugccuaguacuuuuuuuuugggggggggugggugggggagcggggacagagucucacucuguugcccaggcuggggugcaguggagcaaucuuggcucaucgcaaccuccaccucccaucugcccaguacuuuaaacccaauuuaaagugccuguguuucagaauaguccccuuuucgggucacuccuugaagucuagccaggaggaccugcccuuggccuggcuuccucucugggcuguguugucuguaccuucccuguccuugccccucagguugugugacaaucugcagccccauauuuaaaaucuuguuucuuacuccuccuucccccauagagguucuguuuucauccagccuucuucauugguaaggugacucuuucaugaagucuaaaccagaugucuuuuauaacugaaugaacacaugcaauauaccuuuaucuccaucauuucaucuguccugauauugaccacaacuuugcaaaguacuugugguucuuugcaaaguacuuagguucaaacaccccuucuacagaugaggggcugucucugugauauuaggcaacuaggugcagguuacauagcaacuaagugcagcucagagcuggagcugggucuggcuuguagguuugucugcuccuccuuuucucucaugugucauaaucccgaagaugacaaggaaaaggacuugugaaaauauuguccuucucuuugaaaauccaaacaaggggauaacagcgggagcuuaaacuccuucaagaaaaaaugacaagcucuuugucccuuagacaaagaaaaggggaauauguuucuccauuccaaaucccacauuaguagagcuuuuaucacugauuuacuguagacagacaaaaugugaggauuauugagaaugucaucaucaugauuuccauucuugaaccaaagggcagcuacugaauacuaacugcgugccaagcacuguggcacuccaaaagaauaauaagucaaguucuuuaccagccuggaaauucacaucccaaugcugccaggugcaggcauguaaauaaauaauuacaagaagcaugcaaugaguucucuaauagagcuaccugcaagagccuguagagcacugaagaaggaccuagcaauugccuaggguguuauguuaggaaugcuuacaaugagaaucagaaaacucaauaugcaguggcuuaaaauaaaguaggggguuugaauuucuuaccugagaacucuagaguaagcaaacacagacacuggcucauaggagagcaauguguugaccucucauggucacaagauggcugucaugguucuagucaucacaucucuguuuacgauagaaaggugagugaagugagaagaggacacuagccauaugugaaccuuuuuauuaggaaaucgaaugcuucccuauguaacuuuuugggcauuccuaggucacguggccaccccuggcugcaagguagucugggaaaucagagacuuggaucaucaugauuggcuuggaucuugggucaugauccauucacaggggcaggggacauugcaacuacaaacaaaguuaguguucuguuaggaagaaugggguggagggggagacacacaaggaggugucaaugugaguguucaggaaaagcuuugcagaacaugugcauuugagcucagccaugaaggaugagcuggcauugguagaaaagaagguaggaggccaggcgcggaggcucaugccuguaaucccagcacuuuaggaggccgaggugggcagaucaacugaggucaggaguuugagaccagacuggacaacauggcgaaaccucgucucuacuaaaaauacaaaacauagccaggcguggcggcgcaugccuguagucccagcuacucgggaggcugaggcgggagaaucgcuuaaaccggggagguggagauugcagugagcugagaucgcaucauugcacuccagccugggugacaagauugagacucugucucagaaaaaaaaaagaaaaagaagaaggaggaggaggaggaggaaagaaagagagagagagagaagagaggaaggaaggaaggaaggaagaaaggaagagaaaagaagguaggguauuguagagagaaaauaaggacauucuagcaagggggagagcacagggaaaggcacagcaucaugagagacagguuuaagaaauacuaggauugccuuuuagccuggauauagagcuggaaucauaagugggaggcaguuugcaucaggccuaccuaucaggcuagguguuauucugugggucauagaaggucaguuggaguguugagauggagacccauuuucuaaugccucuuaucccaguaacuuggaagagauaagauccauguucuuauucaccuggccauuugcacacaggcucugauuucuucacuguuuugcaccauuaauuacuuuuaugaacccucuggggucuaagugcaucagaaguauuggcuggacucuuuccacagccuuguccuugcacugaggucuuguuucugccuuugaacugcuuucuucugugcccuugaugggugauagaguuucucgugucuccuuuaaucacauggacuucugcugccuucccagaugauguuuaaguuuccuggacaguaaucaauuucugucaauuuucucuggcucaguagaggccgacuccaagucggcacauauacucagccuuuauaggcauuucagauccaaucagaucacacccauggggccccugaugcuuggcagcuccugcagcccaccuggcaugcaacuuccaugccucccucucucugcuuccugccagacuggaggcucugccuguguaucugggaaauccuaaaucauccugcagccuuaguaucccagggguggguauuagaaggggaaaguagguuucauuucugauccugucaucuuuugucaaucucauguucauuuaaugaugacagauaugggagaaauaagggacacagaauucuaauuuuucuaucugcuuggguucaaauccugacucuccuacuuucuagcuguguaacuucaggcaacgugcuaaacuuuucucaucugacagguaacauaguaagagcaucacuugucucauagaguuguguaaagaguaaaugagcuaucagaagcaaaguuuucagagcagugccuggcauacaguaagugucugauacauguuagcugcuaauaauaauuauuauuauuacuacuugauaaugugccucagaaaguggaacaaguuaucacagauuuucaucacaauccuuguagauccacaugcacuuaucagcuccuuacaaaaaucuauuuugggugcauucuccagugucacucugucucagaugugaaagccugucaauaaaugccuacaccaccagcuuuuccugcccccaagccagcaaugauggcugauccuuucccucaagggaccaggacaagacauucuuuagcagucaccagcuugcugcccccaagccaacaaugaugggugauccuuucccucaagggaccaggacaagacauucuuuagcagucaccagcuugcugcccccaagccaacaaugaugggugauucuuucccucaagggaccaagacguaacauuucuuaguagucagacaagcacugauaaaaauauauauauauaucagcaacacagauccugagucagauuuucagagugagagaugugguuuaguggaaagagcaguggcccaggagacagaagcuggccucuacuucuaccucugcugugugacucucgguaagucacuuuccgacucugggucuugguuucuuuccacuuaaugcgcccuucccaggaaaaaucaccaacagccucuuuaaaugcacguuaucauacuuguaguuuaaaauggacaguuuugugauaccuuccucucuaucuaaguuguaaguuucaggaagagaguauggucucuuguguguaucucugcauucacagcccccagaucagugucuggcacaaaaucagugcucaucuuacuaucuguugaauaaauaaaugagauauaauagaaagaaaaucauuucugagugugaugguuaaaacugagugucaacuugauuggauugaaggauacagaguauugaucccaggugugucugugaggguauugccaaaagagauuaacauuugagucagugggcuggagaaggcaaauccacccuuaaucuggugggcaacaucuaaucagcugccagcaaauauaaagcaggcagaaaaaugugaaaaggagagacuggccuagccucccagcccaccucuuucucccgugcuggaugcuuccugcccucaaacaucagacucaguuuugggacuuggacuggcucucuuugcuccucagcuugcagacagccuauugugggaccuugugaucguguaaguuaagacuuaauaaacuccuuuauauaucuacccuauuaguuccgucccucuagagaacccugacuaauauacugagcaagacagaucugauuuuguuuuaagcuugagcauguacucacuuagugacccugggcuagucugaggcucagacucauccucuguaaaaugaagauaauaauagaaaucaccauaccagguuguuuugauugaaugugaucccacaaucacauucaugaauuuugagggagagugggagacaguccauuacaucuacuaagcuauucaaccccugcaggagagaguaaggacaguagggggcuacugaggaaacgugagagcuauuuuguuuccucuauaaucccaugaucacauucaauguagagaaguaaauaauagguauuauguauuuaauaucauauauauauauggauacauacauacauaaaaaacccuggccuggccggaugcagaugcucaaagugcuguaauccuagccguuugggaggcugaggcaggaggcucacuucaguuuaggaguuugagaccagccuggacaacauagugagaccuaagcucuacaaaaaauaaacaaaauuagcuggacaugguggugugugccuguagucccagccacucaggggaaggaucacuugagucugggagauugaggcugcagugagcccagauugcaccacuguacuccagccugggugauacagcauagacccugucucuaaaacaacaaacaaacaaacaaacaaaaaacaccagccuaaugucuagcauauaauggguauugaauacaugguagcuauuuagguuggugcaaaaguaauugcaguuuuugcaauuuuuaauggcgaaaaccgcaaguacuuuuuguaccaaacuaaauauuauuuauuuagauccuagcacaagguaauggaguauucuauguccugaugauuaaaaacucaggugcaaaauguaaaccugaauauaccuuaacagauuuuuggaugggcuugccgaucagagggagcuggaugggaaagcacucuucagaaccgccuuugcuugccuaagaccucgccauccacucccccaucuuccuucuuauguaacaccagcacuugccuguagugaauacacaaacuagacagaugcagagcgggaugaggcuugaugagcuaacagacggcuugcgguggguuguggggcaccaggagaccuggguccuagucccaacccugacuuggcacagacucaccaugugauguugggcagacucauuucucuguaaauuucacucuccucaucuguaaaaugcucagcccuuuaggacuagauauaauaguaguuaagaaccucagguuugggcuucagaguugacuuccagucucagcacugcaacuuaccagcugugagauacaggcaagucacauaccaucuccauaaaguggacagugggauucaaaugggcuuguuuggaggauuuaaugagaccaugucucuuaaguaccuggcagauuugugcacaauccauuaagcuuuguuugcgggguccauaggccagcccuucuuuucacuuaguuuaaguuucucccuguugaagaagcuuaacauuuccucagucagauccacauccaucaaccuuccugcuggcucagcacuuggcaagcaccggaaucauucgcaaagacgacacgauccccccacugggugugagugacaccagcccacaugcaauuauuuuaaugcauggcccaggaucuuaugcccagaucaaauguguucucaggggagagucuucccucuccuacccuucaaaaggcacaagaagaaaagcacauauugcacacucauacgucccugaaauguaagccucaucgaauaguuucaucccugccagccgucucuacucuccugaaugcggagugcuugcuuucugacugauggcggcaggaaggagaaaggagggcagaacuccuucccugccccaucuuugagaggguaggaaacccacacuuauggaaccacucuaacauggaagcacugagcuaggcauuuguuuaacccucuuaccuacuugcugauccccaccuugcacuugaggaaacagguuccaagaagagaaacgaguuguucaaggacacacacagcuaaguaaagagcauagcuggaauucagaccucggcuggucugagguucauaguucuuacucuggcuacuguaucauucguuguugguuaugggaguucguggggaugugguuuggaccaaauagguuuccccauaauucacugugccaugagagagaaaacuggucuucuagagcaguauuuauccagccaacuucaauggguauugcuauugcacauugccaaaauagaggacagagggagcugggucuuccaguccucucuucagauggcaggcucuggacccugcugcagacucucauagauggaacccaaccaaaggagggaaacaagaagugacugagcuguggauacccaguuccuucccucagugucguaguccagucuggcugcuugauguuuauuucucaguuucuggaggcugggaaguccaagguuagggcgcuggcagauuuggugucuggugagggcaugccuuucgguucauagucagcaccuuuuccaucugucuucacaugguggaagcaagcaagggagcacuuuggggugucuuuucuaagggcgcuaauccacucacgaggguucuucccuugugaccuaaugacuucucgaagaucccaccuccuaaugucaucaccuuggcgauuaggcuuuccacaugugaauuuugugggggaaugggagauaguccauuacauuugauauacuguucaacccccacaggaggagagaguaaagguaguagggggcuauugagggaaaagcuauuucauuuccucuauaaucagacaaagcaugaaacagaauguuuuaaaagcuuggcuucuguccuccacaguguauaggaaagaaugugggcuugggaaucagacaugcuuguguuugaagccuagcucccauguuuaccagcaagguggccauaggcaagucacuucuucacuguuucuuccccuuuacgauugcaugccuugcuagggucauugugaggacuaaaagaagccaaugaauguaaaacugcuggugaaguguucaacccaugggugagccccccaggagaaggcucccagucaagggcaugagcaguggccacucaguacaggcuucccuuucccgucacaggugucccauggaggguucucuggggacugugcucagguauucaugccguugcacugggcugagccuugccuuggugucugccaaggagcauugagaauaugaucauauaugaccagggccaccucacagugcaguccucauggggucuuucccuggcuuagcuguuuuugauggugugugauuucccucaccuggacucaaccuguccccuuggacccucugccuccacccaucauucaggguucagcuuauguggcucaacugugagaggccaucugauuggcccagccaucagucuccugggucccugugugcugaucucagacacagugcaagcccagugaguaguuaagcagguggacucuggaaccaggcuucagagguuccaagccuacuuuucugugaccacaggcaaauuacagagucuuucugugccucuacuuccccaucuguaaaauggaguuaauaaucaugcugccccauaggccuguugugcguauuaaauaaacuaauacaaauuaugucuugcugaucaugguuauucuauaguaauaaugaaucauuuuuaauacuaacaaugaaugccaccagauauuaauaauaaauuaaggugcuuucuuagaauaaauuuuaguacuauuaaauauucuaggccaggcgugguagcucacaccuguaaucccagaacuuugggaggccaaggugggaggaucacuugagcccaggaguuugagaccagccugggcaacauggcaaaaccccaucucuacaaaauacaaaaacuuagcugugcauaguggcaugugccuggucccagcuauucagagggcugaggugggaggaucaccugagcccaggaggucaaggcugcagugagccaagagugcacuuuguuaugaccaugucauaaacaaauaaauauuuuauaaauauuuuauugcuuuucccagauuuuuuuuucuugugcauaucuugucucuccaaucaaacugucuacaaggccuucugucucggcuggaaguuacagcggacucuuaaccaucauccuaggcucuaguuuugcaucucccauccugcgacuugcaucuucuucauuaugaauagagugaucuuucugaaaccuagaguuacggauguuccuccugcugaaaaucugcaguaccuacagucugagugcugaccaugggccucucagguccagggcaugaccccacgacgccacuaccaacauuuuuccgccccuugugcggaaagaccccauaucuuuccgccccuugugcuccagcuagagcacuugaguucucaugcuccaaaugagccaccccaccccaacacaacacaucuucccucugucccaggcccugucucccucaagcuccagcacaagcaucuucuucuuugaugcuucucugaucauucuucagcucucauuucuucuucuucuuuuuuuuuuuuuuuuuuuauuuuuugagacggagucucgcuuuguugcccaggcuggagugcaguggugcaaucucggcccaccgcaaccuccaccuccuggguucaggugauucucuugccucagccuccugaguagcugggauuacaagcaccugccaccacgcccagcuaauuuuuauauuuuugguggagacaggguuucaccauguuggccaggcuggucuugaacuccugaccucaggugaucugcccaccucagccucccaaagugcuggcauuacaggcaugagccaccgcacccggccucucauuuauucuugaucgucucuccauuaucacauucaaauuaccuguuuguggacacuuuuccccaacugaccaugagugugccaagggagggacccaguguccuaugucucuggcugcuucccagcccucuauacucuaggcacucaguagucagaaccagcaucuacugagcacuuaccaugugcuaggcauuauuuacaugcuuuauaggcaugaacuuguuuauuuuucaaaaaagcuuuaugagacaguguaucauucaacguccuagcuggaggcagaaaccacagcaauuauuugaacagagaauuuaaucuuuaaaaauaguuauaaggcauaaaguguucacuugguacaggaagcacuacccuagagcugaagaaauaggaggaggagguaggaaugauuaaaaccuggggccaggacccagaccucuaggauggcaucaccaaccgauuccagaggcagcaucacugggccgagaaguagggacagcgaagcguguucugagugugggaaaaacugcagaauggauguagcugcugcuaaaggaaggaggugccacugcugggcugaaaaaaugggacuagggugaugcccacagggacaggaagcaacaggaggagcaagcgccuuucuccccuuccagacccuucaugucccagucaugcucccucuggguggcaccuacaggcagcagguggccaagcagaauuaggguuuguagagucguggccuaagcaucacaucuuagggcugagagaugacaauguaauaacuggcacagauuauucccauuucacagaugaggaaacugaggcacagagauucagucacuugugugagauuaaaggacuaccuagagcagaggcaggguuugaucccaggugaccuggcccccgagccccuacccuuaaccacucugccaaaauguugaaugagcgaaugagcagacccucaaauaaugcuuagcccagugcugagccauggcuuccuacaggugugagggauccccaccccaccccugccauaccugaccacuuccuuaucucccugccaggucauucacuggaacucccccaagaagcuccgggugaagaacaagcauguggaguuuuuucgcaaccucuaccugaccuuccuggaguaugacggcaaucuucugaggcgggaacuguuuggcugccccagugaggcugaugucaacagugaaaacguaaguggcucgcaaggcugggcagggaaggggcggcuucucugcucauccaucaaggaccucccccaugccaggcucuaugucaggcucauggcaggaccuaggugaacacaacgccaucggugcccaggguccaccaucuagucggggagagagguacaucagcggguccuuugcaugcucaucauuguggaugcagacaggguauguuugguccagacgaggugaagucagaagugaguuuccaagcagaggaaacagaaugaacaaaaccaccagugaaaggaaagaucaagugucucucauagccaggaaacaccaauguuuuuguggacaugauacccacaugggagacccuggauucaguguagucagugcauggggaaacacaaaaagagcuuuucacaaguaacuggcuccuuuagggugagcaugggugaagacaguguuagguagguacuaagucaccgccauagcuacagucuacuauagcuauuccuguuucucugucucuucaccacuuauaauuuguucauaugcuguaucucauuugauguucauagaaacccacuuuuuuuuuuuuuuuugacagaguuucacucugucacccaggcuggagugcaguggcgugaucuuggcucacugcaaccucugccucccggguucaagcgauucucccgccucagccucccaaguaauugggauuacaggcaugcaccaccacacccggcuaauuuuuuguauuuuuaguagagaugggguuucaccguguuagccaggauggucucgaucuccugaccucgugauccgccugccuuggccucccaaagugcuggaauuacaggugugagccaccgcgcccggccagaaccgacuuuuuagaguugaguaaguugaggcacagagagauuaggcagguugcccauggccccacaggaaacaaggagcaacguugagacugguugugaguuucuuaggauauagagaagaggcacuuuaacagaaaaagcagggcauggggagucaggcugaccuggguuuggcuuuaauuccuuccaguuacuaccugugugaucucagauaagugacucaaccucugugcuucauuuucuucaacugucaaauggagaauaaaaacuuuuguggggccaggcgcgguggcucacaccuguaaucucagcacuuuaggaggcugaggcaggcggaucacuugaggucaggaguuuaagacaagccuggcuaacauggugaaaccccaucucuacuaaaaauacaaaaauuaccaggcaugguggcaggcaccuauaaucccagcuacucgggaggcugagguaggagaauugcuugaacccgggaggcggagguuacagugagccgagaucaugccacuacacucaagccugggcaacaaagugagacucucucaaaaacaacaacaauaacaacaaacuuacaugggauguuuugacaguagcugaaaaguugcaugcaaagcaccuagcuugguguuggcccuguguuacaugcauagucaauauuugcacucugcucuuuccuugacccuuaguauuagacacagaaguaccugguucauuccuuuaggcagcaaacauuuacugaggaccuucuacuuauucugcacacuaaguauucguagaugaaaaaggacuuugguuccugaucucaugauguuuauauucugguggaggagacacaguuaauaacuaaacucgcagaaaacaaugaucagccaguggcaacugcuacauagcaauauauuagugagcagcuccacugguuuaaggauuucuaugaggaggugacguuuagucugaaaccuaaaugacaugaaugagccucccagagaagagcaaagggagcacguuccagguagaggaaguagcuggugcaaaggcccugaggcaggacagguucgggguguggaacagaaggauggccagugugccuaggagcuaguggggagggagggcucagguaggcaggagccagauugguaggagguuguauguuggauuucagauucagaauuuugauuuauuguuguugcugcuguuuuuauaguuauuuuuuauaguuauuuuggauguagugagaauucuuuuaggcucccaauggcagggaagggcaccuguggaaggaccagaggcauguacucgccuggccuuuuaucaggaugacccuggucacagugcgccccugcucucugugacuggguccccaagucacaguggaucgccacuggcucuggcccuucuccccaucacccuagaggccuucucagcaucugcccuccuucgcaucuagugauaaaggaaagaaaaccauuaagcacuggaacucuuucagauucugggaagcacuuagaggcucaacaaacacuguucuuucaguuuuuccuucaguucucuuugcucacaucaguauguaucaucaucaagauuugagugcccauucggcacauuuuugcaaacguuaaauggaaacuguucuccuaccucguuuauuuccccccuccauggagaaggcucccauaaaaagccuugcaggaugaagccgucaguuaaucauuuguaucagugcauucccaugccaugcugcugcucaguguuauaagaaaugagacuccuuuuaugagugacucaccagcuuuuccuaccaucuccuuccccuggggggaucggcgaggugaagaagucgucgguggucuuucucggaauccgugaccauacuuauuugcucaggaagaaugcgugaaugcuggccaucugccaggagccguguagcucacggggguugaacuuagagacugagcccaccccuguauguaaguggccugaagcuuaacagcucuuagagaugccaacaggaagggccgucugggcccaggaggcccaugaaugagaaagcagccugcucuaagcagucaccauggcugucaucccagucucucuccccucucucccuugaccacuaugcaugggccacauccaccuccuuucugugcuuucuacauucugggcucaccauagggcuuucgugcuugcuauucccacuggcgggaacacccugacccucuguguuuaaaugucucagcugugacaucacagaaacuuugcaauccccuacccccacacaaaguaauccauuaagucacuguuuaugacaugcccuguuucuuuuuguuugguguuuuuuuuuuuuguuuuuuuuuuuuugagacagagucuugcucugucgccaggcuagagugcaguggcgcgaucucagcucacuguaaccuccgccucuccgguucaagcaauucugcuucagcuuccugaguagccagggcuacaggugcacaccaccaugcccagcuaauuuuuguauuuuuaguagacacaggguuucaccauguuggccaggauggucuugaucaugaucaccuuucaugauccaccugccucggccucccaaagugcugggauuacaggcaugagccaccgcgccuggcuuuuuuuuugagacggaaucucgcacugucgccccagcuggagugcagugccgcgaucucggcucauggcaaccucucccucccagauucaagcaauucuucuuggcucagccucccaaguagcuggaaucagaggugccugccaccauacccggcuaacuuuuuuuguauuuuuaguagagacagguuuucgcugugucggccaggcuggucucgaacuccugaccucaggugauccacccaccucagccucccaaagugcugggauuacaggcaugagccacugcacccagccccuguuuucuuuuugucagagcaucuacuccuguuuacaauuaccugguucauauguucguuuccuacauuuuuucauaaauguaauaccaaaacauaagacucuuaaagacuuuguacuguucaccucugagguucuccguccuaacauaggauagaaccaagcacauaauaagcaccuaauaaauauuuauugagugaauguacuaaguaaauuuaagaaguaagaaugaauuaccaccaaguaaagggaagagcagaugaagaagugaacuguuaaaagagaacaugcuggaaguucauguaccagagcacaggcauguugggggcauggcuaggaacaaagcugaccaggaggcgcccugacugugcugagaagcuuggaguuucuccucagggcagugaggagccacugaaggguuuuggugaugggcagauuuauauuagagaaaaaucacucaagguagaggaugaaaugaaaaagacaaaacuggagggaccacuuaaaggacauugccccggcccagcacaguggcucacgccuguaaucccagcauuuugggaggcugaggugggcggaucaugaggucaggagaucgagaccauccuggcuaacacggugaaacccugucucucuaaaaauacaaaaaaauagccgagcuugguggugggcgccuguagugggcgccuguagucccagcuacucaggaggcugaggcaggagaauggcaugaacccgggaggcagagcuugcagugagccgagaucacgccacugcacuccagccugggugacagagugagacuccguccaaaaaaaaaaaaggacauugccccaucccaggcaaaaacaugauggauggggcucugaucucuaggacaguugcggugggaauggagagagcagauggauuguuuuguggguacuaagaacaugagaguaggugcagcuagcacucauaagucaagacaagcagguuccuguacacugcuccagcccuguuccucugcuggcuggggcuggggcuggggcuggagcuggggcaaagagagagucuguaaacauugcacuccugaaccacagcucuguagggaguuuaccaccuggucuuccgcagcgcgucaaguguuaucugcagacacaaccagagggaaaggguaugaucuuggauccagcccaaagccuaugcucccagcucugugggaagaggucauuagagcugugauaagugcacagaugguggugagucugaaagaaaccaagucaggaaccucuucuuuggacuugagauccuagaugggagcaggcucugauggcagugucuaagugacuuaagacuccuuucauccacuguauuaguccauuuucacgcugcugauaaagacauaccugagacuggguaauuuauaaaggaaagagguuuaauugacucacaguuccacauggcuggggaggccucacaaucauggcggaagagcaagggacgucuuacacaguggcaggcaagagagagaaugagaaccaagugaaagggguuuccccuuauaaaaccaucagaucucaugagacuuauucacuaucaugagaccaguauagggggaaccugcccccaugauucaguuaacucccacugugucccucccacaacauguagcaauuaugggagcuacaauucaagaugagauuuggguggggacacagccaaaccauaucauccacccagcugauaauucagguagucgccagacacagggcuaguguucuagcaggcagcauugcagauuaaagcucggcucuugcagucacuguugagugaggguuacagacaagcagaggauuauuaaguagugcgguuagugccaaaauagugguagugcuuugagagcacacgggaagggcauuuuacacaacuagggagagaaggugcaucgaggaagacuuccuggaggaggugagauuuaaagguugaauaaguaggagugaaggagucugaaggguaaacuuggugggugggagggagcaacaugagcacuggagaccaggagccaacacaagcaugaucacucgaggaccugcugggaguugagagucaaaugaagucagugugagaacuauaaaaauggcugcacaggccaggugcgguggcucacgccgguaaucccagcacuuugggaggccgaggcgggcagaucaccugaggucaggaguucaagaccagccuggcuaacauggcgaaaccccgucucuacuaaaaguacaaaaaguagcugggcaugguggcacaugucuguaaucccagguacucgggaggcugagacaggagaaucgcuugaaccugggaggcagaggaugcagugagccgaaaucaugccauugcacuccagccugggcaacaagagcaagacuccgucaaaaaaaaaaaaaaaagauaagaagagaaagagagagagaaagaaagaaaagaaagagcugcacaaguuaauuuuugcauuauuuuaacuuuuucacugggaaauugauaaugacaacaagaguaugagcucucugguaaucugaaucgcucauuuaauagacacaugaccucagagaagucaccuaaaugcucugagccuuggguuuaccaucugagaaauggguacaugacaccauugccaugggguuuuaugaacaauugaaggccaaaaaagaaggacuuggcaccaggaacacagugugccuugggaugaguuucuucacagaccccaaugccugacccaugugaucauaauccacuguuccacacauaggcuuuagguuuuauuagcaacucugguaaaaagacguagcagagaagggaaccuguagagucucugagaaaucugucuguaaagcaugugagagggugucacauuugcucuaagucaaacaauccccaguauccccacugauucggaaauucaggguaggaagaagaggcuauuugguuugccuugcugccaaaauaaaaauaaggacauccagucagggauguaauucuucaucaaggagccaagaugugaggggcagagcgccauuucagagccacugguugggcugcuugcucuaggacaagacaguuugauuugcaagagaacaggcucccccagugcuauggaaugacaguagcuaauuggucacagccacuugucucucauaguuugggcaucucucccuggaacuuguaaauucuuuauguagugcaguaagcauuugguaugcauugguuauuaugaguugauugauugacauagggauggagguuagaauucuauaccuuagcauuucucucccuuuuccucaacaacccagccccucaagaauauccaagaaauggcagggugcgguagcucaugccuauaauccuugcacuuuuggaggcagaggcacaaggauuguuugagcccagaaguuuaagguugaagugagcuaugaucgauccgcuauacuccagccugugugauggaguaaaacccagucccuaaaauuaaauuaaauuaaauuaaauuuauaaaagaauauccaagaaaccccaggacucuuccagaacauaguuggauaaucagagcuauucucuaccguuuuuucuauucagaauccuuccacaguaucccuaauaggcuugcaucuggcuucugcugaaauucucccaaagacagagagccaccuuccaaggcagcuuacucugcuauuggaaagcuccagaugcuaaauuguucuaccucauguugggcugaaauauucccuucuguaaagaacccacugaucugagcccuguccucuggagucuagguuuuguuggguuuuuuuuuguuguucuguuuuuuuaaugaaacauaaggaaauaaggauccuuccaccucccuaguaccugacagcccagaagauagcauagaaaguuuccauucaguuugcuauuuagaaacaugcaaugcucccuaaguauuguauuuguagggugaugcuuuaucaucaagagggucuugcuccaccuaagggaauuuccaacuaaaggaaccucaucuuuuuaaaugcaaaaaccauuaaaauagauggguuuuaaccaauuuggacaggaaacuugcugcuaaaguguaugccguuccuuuaguaagcaaacacuaaacucaguuuaguauuaaacuaaguuuacaauauuugaugacugugguuacauugaaaaggcuggaggagguggaggggguuguccagaggaggaaagauacuguuuaaccuggcaggaaauggccccagacuguucacugcuuauucuguggauuccuuucugacagcugucacuuucugcuuaucagcuucagaacaacccuuucugggcucgccuccuuguuccuucuuuccaaggcagccaacgcccccuuccccccacaaaaaaaaaacccacaaagguauuuaauuuagaaagacugaugguaaaagaaugaucuguuguuauguuaaaagcuagauuaugaaacauaccaaacauccacaaacuacaaaaaaaaaauacacuggacaccaaugaauuuuugaauguauauggaauuguaagucaacagccagugucuccaaccccugcccacagcagacaucacuaauugaugacugcauuauucaccuaugcccagcuucuuuauccuccucaaaacagcacucugaguaaucaguauuggucuccuagccuccuagugauagcagggaaccaaagccugcuggguaucccuacgauagguauuagucauucuggucucuccugcaugagcacagcucuuugugcuguucuaagaccuuucucugcuugccucuagcuuuugggaauuggaaauuuucuacagggaaagaaagagaaagggaaauacaacuuuaaucuucaccacaaagagugggagucauuaugagucacauuucacagauaaggaaaggaaggcuucaaagaaaugauuuacuuguucaagaccacacaacuccuaagugcuggggccgugauuagaaaccaggucuaccuaacucuaaagccacaagacaaggaagugcuucccaaauggauguagcuauguaugucauauuaauguaauaguaaguuacauuauuacauauauccagguuauuccacaauucuccuaguuguuauauggauacgguuuucuuacucuuucacuaacccuucaagguaguuccuguuaucuccuuuuuuauuauuuauuuguuuuauuuuauuauuauuauuauuauuauuauuauuuugagagagagucucgcucugucacccaggcuagagugcaguggcacaaugucggcucacugcaaccuccgccucccggguucaagcaauucucugccucagccucucgaguagcugggauuacaggcaccugccaccaugccaggcuaauuuuuguauuuuuaauagagcugggguuucaccaucuuggucaggcuggucuugaacuccugaccucgugauccacccaccucagccucccaaagugcugggauuacaggcgcgagccacugcuguuaucuccauuuuauacagaaggaaauagaagcucagagaggugaauucauagaacacguugguggcagggcugaagccgguaucaagcccugauucauaguugaguggucucucuacgacuauuuaaaauacuccucuaucuaaaauugcaaugccugucccauaccccagcacucccucucuccagggcuccuucauuuuucuccauaguacuuaucacuaauauaaucaugacuuauuuauuuuuguugaucaugucucuacccacuagaauguaagcucugugacuacggggcuuuuuaucuguuuuauucaucaguacaucuucauuaaagagugccuggcaccagauccaugcucaauaaaucuuguugaacaaaugaacuauaacaaguccuuuucuugaagcauuuguggugugccagaagcaucccuccacuuggacucagaaaauuuggcccaagcugggaauaguggcucauaccuguaaucccagcacuuugagaggcugaggcaggaagaucacuugagccccaggaguucuagaccaacccaggcaccauagugagaccucgucucugugaaaaauaagcaaaccacacaugccugugguccuagcuacucaggagguuguggugggaggaucacuugagccugggaggucgaggcugcagugaaucgagacggcaccaccacacucuagccugagcgacagagcaagaccccguggcccuagaccagaucuaugauuuuaggcauaacucuagccuuacaugaaccucgguuuucccaucuguaaaauggucaguaaaugcacccacaccaggcuauuugaggaaaguuaaagggguuaaaguauucaaagugcugcaccaucuaggcaguuauuguuacgaguauuuuccagaaagcuugucuuggauacccgcucucucaacugcugggagaucacugccucaccucugaaaugaagaaggcuuccaagcuuaacucucucacgcuaugaaggugacaggccacuuccaaggccacguucccugacacuaagccugcuaagaggaaaaaacaacagcaucaccucaacuagaaguuaaaaauaagacacauauaaacagauucuauaacauuguauggcaucacccugcaagacaaugccaagaaacagauggcucuguggaaacagcuguaucucagaagaaucccggagaaagcccagaaugcauuccugcucucacgugcgagccgcaugucgccaacucuucagucacgcagcaggcagcagagcccaggauggacagacccaaaacccuaagacaggcuaggcugcucaaggccagucuccaaaggacccuccaggaauguguuaagcuccagagagagggggugaagggaagaggagcugugggaucaagagacucaguggauacaagucugggccacgguuuccccuuguggccuggcugcuuugauccuguucagcugcaacuuacacagagcccuguuugaccccucuaggcacugguugucaucucucugcacuugccagguguucggcccucccuugucuauaaagcagcucccucccuuccucuccuuuccaccauaucucccuuucucaaguggcaucucuuacuugugcaguagauaagaaggcagcucuggaaugaggcugccucaugugaaaucccagcuggacugccagcugugggauuccuggugaucugcuuaaacucccugcaccucaguuuucucaucuguacgauggaaauuaguuauuccuaucugauagacuuaagaggaaucaauaaaguaagacagggccaggagcuuagaacaauguggcagauggcaaaggccccccagaauuaagguuuguguugugauugcacuguguuuguaauuagugacuggcuucauugccucuccuccuagaccauaggaauaauacaagugcagaagcaggagcucauuccccauuccuagcacaagacuuggcauaaaauaagagccuaugaauuguaugugaugcgugaauuaauacugauaacugggagggaggagaccaagccuuuuucuuaucuccuccaagucgaggucagggcugggcagacccucucugaaccuucacucaacaguccugaaugcagcccccuaccucccugcaaaagaaugaaaauggacucauaguuugguuuccuuaguaaaaaaaugcuuuggguuccuggaacuuguugauuaauacacacagcaggcaacgaggaaggucgugagcuuuuucugccugucuguguggcuuaauaagauguaacugcuuuguggaaaccacagggacaagcucuggguuagguuucaggagaccagaguuggagccccagcuucucugagcaccuugggcccucaucugucaacugagggcccuaagggcagccuugccugucucaugcaagcgcuggggaggaguaaaaaugaaauaguggauacgaagccaccaaaaagugaaagcaaguugaaagugcaaagcaacaugcuugagugguaauuuccccaucagugauuucacccauugccccaagacaucagaaggaggggugucacaggaaggaagaaacggggccucccagacuccuuaauugguccaucguacuaugucuccaucacuuacaggcuacaagcauucaaaugugccuguuagucaagguagcacaagcagcuguaauguggcucaaccugcuggaaccuugcagaaaguccacauggguguucaugauuggcagguaguuuuucugcagguugaaggacccaggcuccuuuugucuuguggcucugcccuccacagaaccccagccugcucuacaggauucucuugcucuggcugucagccaagaaaagaaggcgaauaaaauuuguuccugagcaaggcuucagaguggugccuguacuagccagagccuuuccagacuccaguggccagagcuguaucacagaguuauucuuaacugcaaggaggcuggagauacagccuagcucugugcccaggaagagagcaaaauauggauauuggugagcacaggauguuucugccaccaugugaaauacauguguugaguccucugcagucacagaaucguuuacuguuagaacuagaaagaagcccagaggcugaccaacuaggcauuguagugaguugguuaccugcaagaauucagaggaaauacaccuggguuugaaucucagcuacucuguucgcgcauuguauaaccuuaagcaauggcuaaaccuuucagaugauggaugucuucuucuacuaaagaggacuaagagugguucuugaucuguagaguugaugugagucuuacaugagaaagaaccugcaaaagcucuccccacuuuaccugacccagugagugcgugauccuugagcgucacuuuaggaaguccaaacccuuugucuuacuaauucagagacaugacuugcucaaggucgcauagaaaaugagugucagagauaucaggucucgcuuuucaguuauccccauaaucucacuccuuaguuugcgcaacugugaacagaagucucuaaggccagagcacaggaugcacuuguacucccucuggauccucagguauaaccagccaucauuuccagcagcucaaaaagucagucuaggccacuguccuuaaagaugaggagaaauaaaugcaaacugccuaacgggccauuuucccuuggguccaaauuucccucugccucagcuggcugcccaaagaagcaguuuagcaaaugcauuuuaucucaggagaaaucugucuuuuguuucugugccucccuugucaggagcccucuguucccuguggcaguggccagagagcagaguacaguagcauucagacccuguuaaugaaauacucccuccggcuccauggcuccccagagaaauuacccaaacccugggugaaaaggaggcagguuuuguuuuuggcuuuuuuguuguuuguuuugggggggggguuguuuguuuuuggcuuuuuguuuuuguuuuuuuggcuuuuuuuuuuuuuuuuuuuuuuuuuuuuuugagauggagucuuggucuguugcccagacuggagugcaaugacaugaucucagcuuacugcaaccuccaccuccuggguucaagcuguucugccuuagccucccgaguagaugggguuacaggcacccaccaccacaccuggcuaauuuuuguauuuuuaguagagaugggguuuccccacguuggccaggcuggucucgaacucccgaccucaggugauccacccgccucagcuucccaaaguauugggauuauaggcgugagccaccgcaucuggccaaggaggcaguuucuaaacugcuagagucuccccauugagauaacauuagccacgcagucaggaauaagcgagccuaaauuagaauuugaaaagguacauaauauaaucauaaccacauugcuuagguuuggguagcacuuuacaguucacaaagcaguuuuacgugcauuagcucauuugagaaaauugcagggaauuaguuaacuacagaaaaguuuaagaagccaauaaaauucaucugugaauccaccacucagaaaaucuuuguuaacauuauaauguguucccuucuuuuuuugaguggguuuuucuuuuuccuuucgucuuuuuccugcacugggaccacaguuuuuuauggccugcuucguucauggaacauugugucuuccaccaucucauuugauucucaccuccaucuccugggaagaaguaauuguguugugaaaugucccugguuugagguccgaagacuggauucccauccuggacuucuucucgcucacugaagcagauuacugaaagcuccugagccuuaguuuccuccuuuguacaacagauaugugugcugaaggauuaaauugaugaagcaaugcaccugaaaacauuuagcauugcgccagucacauaguagguacccaguuaguauuagguggaucaaggugcaaagcaccauguagaggagaaaugaacaugcaaguucaaggauggcuucugguugccccagaguccuguggacagguacgucugacagcauaccuuucuuucuuuccuguuuuguuuuuguuuuuuguuguuguuuuuguuuuugaugguggugguuguuuuuugagacagagccucacucugucacccaggcuggagugcaauggcgugaucucggcucacugcaaccauccccucccagguucaaacgauucuccugccucagccucccaaguagcugggacuagaggcgcacgccacugcacccagcuaauuuuuuguauuuuuaguagagacgggguuucacgguguuagccagaauggucucgaucuccugaccucaugauccgccuuccuucgccucccaaagugcugggauuacaggcaugagccacggugcccggccaccuuuuuuuucuacaauacccacugugguugguaaaugacaauauucccuagauaauacccuuuauacacugcagcaagggcugcaagugagcuugggauguggaugccaccaaaucccauuauugguaccaugaaguucagagcuggagguggccucuucuccaggacugcccuaguccaucccacuagggcaagguguacuuuggaaguccucggagcaucuccguugaccaguacucccucuccuaacauacaggggcugaggacauccaacagaggcuugcugaacauccaagauggaucacaucagccacgcagucagcaauaagcaagccuagguuaggauuugaaaagguacaugauauaaucauaaccacauugcuuaaguuucugcagcacuuuagaguuuacaaaacacuugacaugcauuagcucauuugagaaaaaugcagggaauuaauuaacuacagaaaaguauaaagaagccaauaaaauucaucugugaauccaccacucagaaaaucuuuguuaacauuggauauagaaccuggauauugcuagguucagaugguucagaaaugaaggggauacagcuccugcuguuaggagcucaccauauggaugcuuuuuagaaagugguuccuggagccauuuaccugggaaugucuuuuuccccaacucaaggguauguaccugugugugcauauaaagagaaggagaggccagacgcaguagcucaugcccguaaucucagcacuuugggaggccgaggcggguggaucaccugaggucaggaguucaagaccagccuggccaacauggugaaacucugucucuacuaaaaauacaaaaauuagcugggcaugguggugcgcaccuguaaucccagcuacuaggaaggcugaggcaggagaaucgcuugaacccgggaggcagagguugcagugagccgagaucgugccacuguacuccaaccugggcgacugagugagacuccaucuuagucaaucaaccagucagucaguaaaggggaugagaaacccccauacaugcauguguuucucauucuccacucacuaaugcccauuuucacauggugaggaccagcuacuugucugaagccucaucaaagaaggacccauuucuccacacacauuugccuacccacgcucacacccacgcaucacacacauuuccacuguccucuucauugaacuggaagcccuucauucuucugagcauauuaaaacagaaaccaaaaccaaaggaaaaaaaagccaacccugcucuugcaaagaauuuuguagauguuuagucuccaguggaggauaauuucuugugcucuucugcagugugggugagggaguuuaggagcauagcaguugguuacguuuucugccgggagguaacauuaugguuuauaggcauauuuuaggcccucaaggggaaagccagggggacucccucuaauauguaugaaucagaagggccacccuggcucauccagccccuaccaucccugcccaccaggaucuugccauacagucuccuucaggugagguuugaggacaaaaaguauccacauaggugucuucaggggcccagguguuucccuuuccugugauaaucacuaugauaauaggugacaucuguugaauguuuucuucaaccgcuguuuucucuauaugcagcaucuuucagaauccuucuauaaccuucugggguagugaguuuugucguccucauuuuacagcugaggacccugaagcucagaaagguuaggucacucacccacuuaccugagaugauccaggcagaauggguuagaaccaguguccuuagccacugugcugcaucugcgucuucacaugaggccaagcaggcaucuuuccugaagcagcagcauggugguggaggggcacagacccagguuugacaccuccacccuucucaacuguuggaugaggcugccagugacucaccgggggcucuggggaggagaggaaaucaccuguacccagcaccuuacguggagcuuggcacaugcuuguuugcucuccaaaagcuuuucagccgucacagacccuuggaugcaaauauugaagcaaaucauaggcugaagaaugggcuuauugaucaccuucugugcauauaauuagaggacacaaaaggaaaauugaaaggauagucuuaacuucacagugauuacagguuuuuuguauacagcaaauauuuuucaggcaugcaacacaugauauuagcaccugucacaagccaggcauggugcucaggacaaugguaaaaugucacagucucaccgggaaaguugccguuaaauaauuucaguuuaaguugacaagugcuuuaauggaguuacgaacugagugcucuuggagcgcagagaagaaacggauugcuucuacccagcaggaucugcagaggucucacagagcaggugccaucugggcugaaucuugaaagguaaauggaagguuuuuuagguggaggagaguggagugaagugagggagggcauccccgagagggaagagcauggcacggaacaaagucacggaggugugagggaaaggcagauuuggggagcacacagaccaaugaugaggccacagagugugggggugaugggucagagagagcagcccguaauugucaacaaggaaaucuggauuuaaucauacaggucagaaggaagcaguggggucauagaucuuagauggaaugagaauuucagcuuccuugucuuauauuaaacuguuggcauggugagaaucuucaaauaggcagggacagcaaauugacuugaaaagcugaauaucccuaauugcauccuuuuaacgguuaaaaauuuuagagauaguugacagugucucacagaugauuggaucucagccaguuucccaagcugcauuuggaaauguucaaguacauuuggagcaucacagggcugucuggagaaugcuauaagcauuuggugggcaggagcucgggagguugauuguccuucaauaugugguacagguccccauaauaaaaaagugccccccacaaaauaccaauagcacucuaucaguaucuauugcucagaaccaguaagaucucaguggccuucaagaagcauuuauuggccgggcgcgguagcucacgccuguaaucucaacacuuugggaggguucgguggguggacugccugaggucaggaguucaagaccagccuggccaacauagugaaacccugucucuauuaaaaauacagaaauuagccgggcgugguggugagugccugugaucacagcuacucgggaggcugaggccagagaaucacuugaacccgggaggcagagguugcagugagcugagaucgcgucacugcacuccagccugggcaacagagcuagacucugucucaaaaaaaauaaguaguauuuauugaggcagcugggccaggcuggcuugcaugacuuuggcaauuggggaggagcugcucugccccagaugucucaucuuccagcaagcuagccucggcaucuucucauggcaaugguaggggugcaagaaacacuuucucuugaggucuagccucaagacugagacaauauuacuuccccugcuuuuuguuaacaaaaauacaucaugauucuagcccuuauucaaggcuagagaaauaaacugugccgcuuuaguaagcaccacugcaaaggacaaggauaucugggguggcggggagugggggagagagaaggaauuggagcaauuaaugccaucaucuuccauagcacacaucuugagaaauaaugccaucaaguaaucugucaaggcaauggucuuaacagguacaaagcucuacagaagcaaguuaauauauuuucuuauugacugcuacacuguugauuuggugauuuaaaaaaguacaccuucuuggaaaaacauucuaugguauucagcuagguugguaacccuugccauguaaacuuuugucuguauucuaucgugugauagacaaggcugauuuaacagaaaaaaaaaaauggaaccagcccuccugugaccuuuggcaaauuaucauuuuuuuuuaauauacuuuaaguuuuaggguacaugugcacaaugugccgguuaguuacauauguauacaugugccauguuggugugcugcacccauuaacucaucauuuaacauuagguauaucuccuaaugcuaucccuccccucucccccaaccccacaacaggccccggugugugauguuccccuuccugugucccugugacuacaauagcaaagacuuggaaccaagccaaauguccaacagugauagauuggauuaagaaaauguggcacauauacaccauggaauacuaugcagccauaaaaaaugaugaguucauguccuuuguagggacaugggugaagcuggaaaccaucauucucagcaaacuaucgcaaggacaaaaaaccaaacaccgcauguucucacucauaggugggaauugaacaaugagaacaaauuaucauuuuuuaaaaguuuguuuuuauggaaauacagauugccuccgacaaguccucccauucuuuuuuuuuuuuuuugagauggagucucgcucugucgcccaggcuggcaugcagugucaugaucuuggcucacugcaaccucugcccccuggguucaagcaauucucugccucagccucccgaguagcugggauuagagaugcccgccaccauguccggcuaauuuuuuguguuuuuaguagagacggggugucaccaucuuggccaagcuggucuuaaacuccugaccucgugauccaccugccucagccucccaaagugcugggauuacaggcgugagccaccgugccuggccaaguccucccauucuaagugcacaguuuguugaauuuucacgaaagugcacauccauguacccaucgcuccagucaugguggagcggguuucugucacucccagcccucucuugccucuucccaggcuucacucccccaccccacaugcccgaguccaauuuuugucacuguggauuagcuuuuugcuaaguugugucacuuuuuaauuucaguucuucaucuguaaaacauacaucauaccugccugguagggguucacaugagaccgugucuguugggcagcugcagauuugcacaucuguguaucugccucugcauaucugaaauguuaucuucuuagcucccugucagcaggugugccugcucuuuucacaaguuggugaaggaagagagaaguacagcuaguuaaacaacuucuacaagcagauuaaugaaguaagacuuucagagaguucaaagaaagaaaagagaaaaaaguacgggugccaagauucugauuaaacuuaggugaaaugaaaggaaaagaguuucuguuuuguuaacgugcuaaguuuuguuuuguuuuguuuuuuuccgagaccuaguacaaaaauugaaaucaguagcucuagggagagaaaagcaucaggucauacggagguccuugucaguuuugagcguuuucuucuuugggcauuuuccuguguaauuuuuauuuuuauuuguuuuauuuguuuuuuguuuguuuguuuguuuguuuugaguuggagucucacucugucacccaggcuggaaggcaguggugcgaucucagcucacugcaaccucugccuccuggguucaggagauucuccugccucagccuccugaguaggugggauuacagguguccgccaccaugcccggcuaauuuuuguauuuuuuguggagacaggguuuccccacguuggccaggguggucucgaacuccugaccucaggugauccagccaccuuggccucccaaagugccgggauuacaggcaugagccaccgugcccagcccauuuucccauguuauuugaaauuguuaugcugaguugucuaggaaaacauuucucauuuguuucuaaggaguuuaugguugguuauauguuuuucagugagcaccaccuuuguucuuagcuaagaggggacucauuucucagguguuaaaggcauccucuuuuuuuuguuuuuuucuuuguuuguuuuuguuuugaaacaggguuuugcucuguagccuaggcuggagugcaguggugccaucucagcucacugcagccuccaugucccgggcucaggugauucucccaccucagccuccugaguagcacuacagccacacaccuccauguccggcuaauuuuucuauuuucaguagagacaggguuuugccugguugcccagguuggucucgaacucucaggcucaagcgaucugcucgccuuggccucccaaagugcugacauuacaggugugagccaccacagccgguccccaggcaucugauuuuuaccaucaccuuuuugaaauuagauuaaguugcagagggaaauaaaaguggugaucccuuccauguacgucagacccaucaacaacguccugauggguaauaaacucaggggagggcagggcucaaggggcaagcucaugggcccccucggaccucuucuucacgugcccaagcccucucuccuacccugcagcuccagaagcagcugucugagcuggacgaggacgaccugugcuaugaguuccggcgagagcgcuucacuguccaccgcacccaccuguacuuccugcacuacgaguaugagccugcagcagacagcacggacgucacccuggucgcucagcuguccauggacagguauggcagacggccucacccaccccagucuccucaccgcggcuguuacauggaggauagagaauggagaagggugugccugcuucccagugcaucugcuaaaauuggaggauggagcaggaagagauggcacaugggcuuagaauauugaagccugggccgggcacgguggcucacaccuguaauccuagcacuuugggagccccaggcaggcagaucacaaggucaggaguucuagaccagccuggccaacauggugaaaccccgucucuacuaaaaauacgaaaauuagcugggcaugguggugugcgccuguaaucccagcuacuggggaggcugaggcaggagaauggcuugaacccaagaggcagagguugcagugagccaagaucgugacacugcacuccagccugggugacagagcacggcuccaucuuuaaaaaaaagaaaaaaaaagaguacugauaagggugagcugugucacaucccuaccaccuccccagcaccgaaaaccaagggcucuuaccuuaucauugucugaggauagaugaaaggaucgauucuuaagaaguagagcccgacucgaauuaccucaggaagagggacaguggggagacuggagcuacaauugcggcuggaaagcaacgcuguuucuuuuccuucuauguguauugaugaagcaaacauccaucaagcauuuccaggcaguacggacaugagccccgcccugauguagcuuacaagccaaugcacugcuucucaaccuuguccagggagauugaaucaccucgggaguuguauaacacguucacauccaggcucccuugcagagcaguuaagugaggaccuuuguaggauagagcccuuggcauuguuuuguuuuaagcuuauaacguguagccagggcugagaauauggagcuagucacauaaacagcaauacacgccucccggguucacaccauucuucugccucagccucccgaguagcugggacugcaggcaccagccaccaugcccagcuaauuuuuuguauuuuuaguagagacagaguuucaucguguuggccuggauagucucgaucuccugaccucgugauccucccaccugagcuucccaaagugcugggauuacaagugugagccccugcaccuaucccaauuuauauauuuuuaaaaacaucucuggcugccaagaagugaauggauuugaagccccaaggucacucagccagggcuacauggcuuuucuauacuuggccauuccaggugccccuucccaccuugucagacuggcuuccgcuucaauuuacacauggcccacaguggcugcccuuaccccaacucccucacaugucauccccccucagcuccuacaauuaggaaggaaguuugauuccucauucugucuuuugagccacaucagagaugccuauccagccuaugggugagauuccaugggauuguucuaaggauuaaaugagcuaaugccuguacagugccgagaacagugccuggcacauaaguguuccauaaauaccagguguuauuagucaugaaugacugaagaauggacaaacugaugaaagaacaaacaccuggaugcaaaaacguuuucauaaaggcacuugagagcuccaggaagugagaggaaccuggcgcuggaggcaacguggaaugauucauguugaggguggcucagggaaguggauuccuugcucugugagucccgccacaugcaagcaaaugaccacaugcauaauucaauggcuucaggggccggcggucucuuggggauucacaggcuccaaaagaacuuggagaaaggccacugggacuccugugcacagagaacuuggggauccuagcagguaacagguaaagacagcaugggacaaaagagcaagggacaagcauggaggcucuagcaccagguccaugcuugaccugcugugagggcccuggcgagcccugucccuucuugggcccacaguuuucucaucuccacauccacaugaucacucggcaaauaccgcucaccguucugcaccaggcacuuagugggaggggaauauguguuaaaagaccuaucccugucuucaaggaguaugcagccuauguggggcucaggcaccccauucguuuucuguuguuaggugacaaaguaccacacauugagcagcuuaaaaaguacaccuuuguuaccuuguggccacuaugggucaggaaucuggaagauguuagcagggcccucugcccagggucucaggacugaaaucucaagggauuauccagggcugggaugucaucuggggauuggcauccacauccaagcucauuuggguuggagcagaauucaguuccaggauggaggucccauuuccuugcuggcuguugaugggugucccccucagcuccucgaagccacgcucaguuccuagccaugcagcccccucccugcagggcagcccacuucuucaaggccagcaggagaaucucucuggcccaugacccuggagucuucuauaacaucacaugaucacaaugugauauucagaagcccugcccacacccaagagggcgauaacacagggcauguccgccagcggggcgggaaucuggggggucccucauagaacucugccugucacugacagguaaacaggucuacaguaggauguuuaguucugagugucgugcaggaggugcaccgauucuaugagagcccaaggaaguggagaaaggaaaaggcagggaauguguccgaggggagguaguaccugaguugaguuggaggcugaguggacugagaguagaaggcacagaaggagagaaggagggcuccccgagauagagcgugcagcauguucacgggacagagaagacgucagggccaguggggaacacaauaguaaggugugguuagggcuuaggguguaggagggagaaagaggagaucaaauacacauggccagguaggcaagggcuggaucacagagggccucagggaaaccaggggagguggccagcccuuccagcucaaaucuggcauccugugugucuccauagggacacccaacuggugucccagagucaccccuaaaauucucaggucccuuuggccucucacccagauuucaguuuggacaccuaggcuccccaccacuaagcaucaggaagccaccucaccacaaagucccucuuuucacauauguguuuccuucuccuccauggcauuuauaguaaaaagaaaauggaauacuccaugucagugcugaaugauggucuagauuggucucuuucaacugcaucuguccccucccgugagcuaacugaaacucagguacuauaauccaugcaagugagaggguuucacuuaaagccaggugcccauuucuccaaccaucacuggcucucuguugcauucaggccuccugauaaugcauucagauuaucagcaaaauauucugagucaauauuaguggccaguggcuaccaaagaaaucugauauacuuucuaaucaaaguaaagaguagcauaacagugaaugacacuuggucccuggagucaggcacuguggguucuuuguugcccugucacuuuguuuuuggacaagucacuuaacuuuuuuuuuuuuuuuuuuuuuugagacagagucuugcggugucgccaggccagagugcaguguugcaaucucggcucacugcagccuuccccuucuggguucgagcgauucucccgccucaaccucccaauagcugggacuacaggcgcgcaccaccaggcccagcuaacuuuguauuuuuaguagagacgggguuucaccauguuggccagcauggucucaaucucuugacuucgugaucugcccaccuuggccucccaaagugcaucacuuaacuucuuuaagccucaguuucuucaucugugaucugaaagugguaacuguaucauuauccucaucccuaagguuguuacaaagaucagaugagagaaggcgugccagugcuuaguccugacauacauucagaggcucccagaaugauaccaguacuguugaccagaaucuuaauauuugugauauuggguaaaaaggcacuagacggaaggacagagagcuccggguucaaaucccaccaacucauucaauccucagcugguguucugggcaagucacuuaacaucuuuggguuuccguuuccuccuucuauaaaagaaggauaaaauuacuugccucauaggguccuguuuaggaguaaauaagagauccucuauaaaagcccugagcacauauuugacauccaguaaauacuggcuagaucugaacauccuuacgaaggcaugugcacaugauaguuauuuaggagagguaaagugauguaguagaaaagaaaaaaaagcaagacuuggauucaaaguacacuugugccacuuccuagcuguguaaguuugaacgacuuacuuagccuuuuugagccucacuugacucaucuacgagauggugauaacgucagauucacugauuauugucuggguucuacaaaauaagguguaaagugccuaguaaguaguugaugugagaaaauauuaauuucccuuuucuuaauguuucucaccucucugcuggcuauagaauuugcuaucuggaauuugcaaacaaguagaacaaacauguuucuaguuauuaacagcucaaacccauccuucuguauacacuaguuagcaagaagagaauacagacaaaaccaagugccuccuucuauugccagugggauccauccuucuggccugggcugcagacacagugcauuuaaaagaaaguccggggccgggcgcgguggcucacgccuguaaucccagcacuuugggaggcugaggcaggcagaucacaaggucaggagauggagaccauccuggcuaacacagugaaaccccaucucuacuaaaaauacaaaaaauuagccuggcaugguggcgggcgccuguagucccagcuacacgggaggcugaggcagaagaauggugugaacccgggaggcggagcuugcagugagcugagaucgugccacugcacuccagccugggcaacaaagcgagacucggucucaaaaaaaaaaaaaaaguccgggccccacucacauauacagcaaacaccaaccauagcggucuucccuucaaagcauggacagcccaagcguagcagacacacgauacccacuccuguauugugacauguaucaccaucaggacaguaucucaagagaacccaagggaugccaagcccuaaugagaggcacuuaacgggccacaauuaaaaauuauaaagcggcacugcaggcuuaugaagaaugguagaaauuccugcagccacuuccacucugucaacacauccgauuaugaugcagcacgcggacuggugccuguuggauugauuuuuaauuuaagaaaccuuucagauauauuuguaaaccuucgagucagaaguaggcccuacgugaaugccacaacgaauuaggagagccggccuucgcacucccguacgcagcucccucuggaauuccguucagaaagaaugaacguugcaaccauggccaugaagccaggaguucugcuucuccuucagcagcucagcacccuucccucccaucccagcagaagacaccaauggcaaagggacagagggagcugaucacgagggguucaccuaucuucugacaccacaccagggagagccugguucuuuaguguguuuuugacaaagauguuaaguguugacuacaguugcggggccucauggggaugacaggucacuucucugcucucucugaguaaaggagagagaaugggcugggcucacagagcccuacucucuagaacagcguugcuucaagccugcuccuggaaccagcaacacagcauugcaugggagcuugucagaaauacagauucucaggccccaccccagaccuccugaaccagaaucucggguggugccuggaaauaggggucuuaagaagccccgcaggugaucuuuaagaagcuuacauuugaaagcacugaccguucuggagagugaaagguaauuuuuucuccauguaacaggcagagcgauguuuuaaaaauguaaaucaggucacaucauuaaaacccucagaugacuucuuguuacauguggaacagugucccacccgccugcuguggucuucaaggcccauccagccuggcaucugugcaaccccugacaccuucaucucaccccugccccucaccguccugugcugcacccacacugguccuguuucuuccugcucgaacaugcugagcccauuguuaccccaagggccauccccucuucuuggagagcuuuccccccagacuuuucacaacgccagauccuucucauuaucugcuguaacaaaaugccacaaauuauuugauauaugaacaauggaaauguauuuaucacagugcuggaggcuggaaguccaagaucaaggcuucggucgauuuggugucuggcgagggggcacuuccuggcucacagagagugccucauuacuguguccucacgugguggaaggagccagcuagcucccugggccucuuaaaagggcaugaaggcuaggugugguggcucauaccuguaaucccaguacuuugggaggccaaggcagucaaaucaccugaggucaggagcuccagaccagccuggccaacauggcgaaaucccaucucuacuaaaaauagaaaacuuagccagcugugguggugcacaccuguaaucccagcuacucagaaggcugagacaggaaaaucgcuugaaccugggagguggagguugcagugagcugagaucgcaccacugcacuccagccugggcaacagagugagacucagucucaaaaaaaaaaaaaaggcacgaaucucauucaagagaguuccacccucaugaccuaaucaccccccaaucaaaccucugguuugucgauugucuuuuuuccccacuagaauaaaagcuccugaaaugcaggcgccuaggccccuugccuguauaguauaccagaugcauuggaaauaacaaauauuuauuaggugaagacauguuugagaggcagaaauagaaccuaaggaggaaauuacagcugucauauacugaguaccugcuguauaucuagcuuugcaccagacacuuuguaucaucaucucauuuaacccucaaauccaaguaaauguuacuguuucacaaacugcccugagucuuagcagcuuaguacaagaacuggaaugagcuugugauucuuuggauuggcagugugggcuagacucugcugggcucauuccugugucugccguaaacuagguagcuuuucggggguuugucuggcuaucagcagggaccaugggaacgccagggcaaggugguguagggcuaguucacauggcggcagguacaagccgguugucucaccucuucucaugucauguuugcuaauaucgcauggaccaaagcaagucauguggccaggauucaugugggagauuauuuccagaggguauggauagaggcaaagggacgauugauagcuauuuuguaaucuaccaaaggcauuauuauccccaaaauacauaugugcaaauugaagcucaaagagcugucacuugcccaggaauacugacauagcucagaggacaaauccaggccugucugaccccaaaaccuacaguugcaagcugugugauaugcuacacagccugccucaugggcagugcaccagauuagaaugguccgccuuggugggugugaguuccccaucccagcagacacugagugaucacugccugggcugcuuagucccacugagacucuagaauuccuuccagcccuggucuucuggguuucugaccuggccgucucccuaccuguuccuuuaugacuacagagacugcgugaggcuuccagcuuuaaugggacucucuggaauagcccccaccuguuuuuagaucugccagacauuucugagccuuugcccaccccucccuagaugaagcaguggugggcucgaugggguagugggaaccaacaugggacagagacaggccuucuggguuuagggucagcucuuccauggacucauccagcaaaagaaagccuggccacagagcuuggcaucagcaagaacugcacggggacgacccuuagggaacacaugaggggagagaaccuaggagguagagguugcagugagccgagaucgcaccacugccuccagccugggcaacagagugagacucugucucaaaaaaaaaaaagaaaagaaaaagggcaccaaucucauucaugagaguuccaccuucaugaccugaucaccucccuaaucaaacucugguuuguugauugucuuuuuuccccacuagaauaaaagcuccugaaaugccggugcccaggccccuuaucuguauaguauauccgaugcauuggaaauaacaaauauguauuaggugaagacauguuugagaggcagaaauagaaccugaggagagggccgaggggauuguggaacuuugagacagauaccaagagggacugaggaggggaaagaguggggaggcauugacaccgggagaagaacacgcucuuacuuggggaaacagacaaugaagcaaagauauuugggaacauuguucucagccuaaccccaauccauaguaaauaaugaccuggauccgggcuuuggggugagguagacccgaaugugaaucuauguccuucacuuuguaacugcgugacuugaaagaaguuauuucacccccuuaagcuuccuugccuguaagaggguggugacaaucucaauauuauaguuacuaugaggauuaaauaugauagccacaguguggcaaagacaugacaagcagcagguaaagggggagauggaugagaucaugaucacacuuuaaauauuaccaucauuauuagaaaccucaguuugucacaguuguucagguccuggcagaaaaguugguucuaagggacuaaagauuggagagauuggggcuggagggcauagaaacagcagugcguugugucaccauucugucucgcuuguggagguuccacagaacaacauccagcuguguuaucuguaaagcucaacuuauuuuucaugugcacagcaccuucugagaaccuugaguauuuuuucucuauucuuuuuuuuuuuuuuuuugagacagauucucacucuggagugcaauggugcgaucucagcucacugcaaccuccacccccuggguucaagcgauucuucugugucagccucacaaguagcugggacuacaggcguucacuaccacgccuggcuaauauuuuuguauuuuuaguagagaugggguuucaccaugucagucaggcuggucuugaauuccugaccucgaugaucugcccgccuuggccucccaaagugcugggauuacaggcaugagccaccgcuccuggccucucuguucuuacccuaaacucuuggcugagcuuaggagagggacuguggcaggucacggggcaggggagggguuccuuucuuggaaaacugagacacagaggcaaaaaccaagccagugagagaauccugagaagugguccucucuucaugcccagccaaaccucccuccuuccgcccacuuccuucagcaggucucaugucuacaugcuagaaauuauucuugcguuuugcucuccaauucucagaggaguuguacaaauggcccucucaugaagcgcagagucccccacauuugcagaagguaaaacaggugcaggaggcauaauucaaaauuccagaucagagcccaggagagggcaggcccccacagcagaagucuaguacaaaguucagugcaauuaggcgucauggagaaugcaugccuuuuuaagaaauggcucuggucggccaggcgcgguggcucacgccuguaagcccagcacuuugggaggccgaggugggcggaucacgaggucaggagaucgagaccaugcuggcuaagauggugaaaccccgucuguacuaaaaaauacaaagaagaaaauuagccgggcgugguagcgggcggcuguaaucccagcuacucgggaggcugaggcaggagaauggcgugaacccgggaggcggagcuugcagugagcugagaucacgccacugcaccauccugggcaacagagcaagacuccgccucaaaaaaaaaaaaaagaaaaagaaaaagaaauguuucuggucaauuugguuagcaagcauuauaauggaugagaaauggagagcauuuugcacuggugaauaucuuaauccucccuauugaacgaggaagcaaaucugggcagugccacuuaacagaauuacugagagaaaacucuggaagucaucaaaaaggccauugaaacaagauaggugugcccauuuccuuuuguuuagaagcauggaaaugcauggaaucgauuuccugguaaucguccgaauaaagugggcauucugaccaggagacugcugauuacguaccucuugcuggguaaggaaaaacaauucaaguaggcuuuugcuguuucuuagccauagauuuuauguaccagacgcuucuaacgccuuugaaagaaaauaucuuuauagauuuaucuucagacgucuuugcagaacccucucuguugcaaacccuccacacacaccuuuuuuuuuuuuuuuuuuaauuuuuucccugggcucuauuuuucccccucucccuggcucagcaucucugagguagccuugcacaguugccuggcgcccugggguaguaggggcucugaagacgagugaugcagacagcaucaccccagguagacuuuuguuuccaacauucacauauuuuucuauucccuuuuuuaguguuauuuuuuucucccugacuccaaggucccaucaggguaccugucuacacaugucuggccucuaaguguaagaggccaagcugauugaacauacggcacguccguuccuccaucaggaaaauggggagaaugacagcuagugcucaagguuauugagagaauucugggaagcuccuggcacacugcagcacaucuguaauuauaguuguuguagcucuuguguuuacuguuuauuuuaccguuccuuguaacuuagcagccucuaaguuuguguaaguccucucuggcuggucacugccuuaggagaucagcagagcuuuuuuauaccuuuguggagagagaaguguaggacuuuggggcuggaaggggaucuucaaaucauuuaauauacucaccaccuggcuuugaaacgaggaguccaaggcuuauagugggauacaacuucauaucacauguucaguuggaagcagggaaagaugagaaccagcaagguaaguguuuugaugccuguuuuauagguaaaggaacugagugagucaacguugaaagcagggauuugauccacagcugguugaucaagugucacuggaggcagagccccacaacaggcccggcggaugaugcauggauggcccaggucccgcggcucacccucccugucucuuccaggcuccagaugcuggaggccaucugcaagcacugggaggggcccaucagccuggcccucuaccugucagacgccgaggcccagcaguuccuccgcuacgcacagggcucugaggugcuuaugagccgccacaacgugggcuaccacaucguguacaaggagggccaguucuaccccgugaaccugcugcgcaacguggccaugaagcacaucagcacucccuacauguuccugucugacauugacuuccugcccauguaugggcucuaugaguaccucagguaaggaccugcaggggccuggccaucaggccagaaggcacauagggccaugcagugccaggaccaaaaggcccuuagggucaucaucuaguccaacagguuucuuuuccagauggggcagcagagacccagaaaggggaagggaccugcccacagccacccagcaauagaguucucagugaacagacugaaaccugaguuugcagaaggaaauguugauggcagagcuugguccagcgaacaucucuuuuugucugccagucuauugcuuuuucuguagcaucuaugaaaacauacccuccucaggcaggcacgcgauggcucucgccuguaauccuagcacuuugggaggcugaggcagguggaucacgaggucaggaguucgagaccauccuggccaacauggugaaacccccccccuacuaaaaauaccaaaaaaauuagcugggcuugguggcaugugcccguaaucccagcuacuugggaagcugaggcaggagaaucucuugaaccagggagucggagguugcagugagccgagauugcuccacugcacuccagccuggugacagagcaagacuccuucucaaaaaauaauaauaauaaauagaagaaaacauacccuccuucuucugguuuuggaccagacaaccuucauauaacccaagaaagauuauugcccagucuuuuaaacaaaucuaagugaugaugaugccuagugcuuauggaaguguuugcugcgcgccaggcacuguucugagugcuugagagguaggaucucauuuccucccccaaagucccugccguggguaguauuaucaccuuccuuuucuaaauggggaacugugggaccgagaccaggagccguuggcccgggguuacucaucuaggaaagggaaacugggguggaaacagccagucuggcugcagagccaagugcauaagcaccaugacaacugcuucugugaaucuccagugucccuuuccagcuccccccacaucaugggacggggugucagcagcuggagaaagcacucggcuaauggaaggcuuagauggcugugugaagagugcauuuauuacagaauaguacacaauucggauugauaggagccauggaagucauauggcccaaaggucccauuucacacaugagaaaacuaaagucacacaguaucaugguccaaugacauuuuaaaaaaauccuuuauuuacugccauuggucagcaugaauuaugccaauaccuagugagugccugccuagauccagguaccaugagaggugauuugcauauaucaucccauugguucuacacaucgaaccccagaggcagguauagcuaccugcauucuacaggaaggaagaguggggcccagagaagcaaaauaacaguccaaguccagagagcucacgccagggugugaaccagcgucugcagccccaggucugcccgucacccugcuacacguuguugggcugcgcugggguuucuguuugucgcaaaccaggcaaggucugauuucuuucucucucguucucuugcucucccucccuccuucugacuccgucucucugucucuuaguaucuuucucuuacugccucugucucuuucucucugaaaagagcuucuaggagucuuuaaacuuucugucgggaagccaaagcguagguuuagccugcauacccuccgugcccugcgcugucuggagcaaggucaggcagccuguguucucucuccagcuucugaguccguguccuuccagggacaucuccggguuuccuaguguuaaucccuccccuggggcgggaggagucccuaccagacucuguuaaaaacaguagggucagcgaccccuaggcagcaugacccugaaucgggaaugggaggugcugugguacccagcaccaugagccucaaccccugacccaccaggcugcagaaauggagcacucccuccagccccagcgccugugccagugccugcugggucuuagaauccaguguguggagccagggugcccccauguggccagacggggcuugcagccucugaugccugcagauucugaaacuugggcagcuuccgggaugacaggcucccaagggaacagauagaugaugggagugagugccacccuagacuaagaaaagaggcuucaggauuggaccccugcccacccuccaccccucugggacucuucuucgcuccagccaauugaaagugagcuggccccguaugagucuguggucucuacucccugugcaaggacuauuuaauuauuugaccucaugggcaucauguuuuaaaaagcaauacguaugaacaguuuuuuuuucuuugucuuucuauguuuuauuaauuaaaggcaucguucacugcuaauccagacccuacuugaagugagguagcuagugugcccuucuacuuagcacuugcuuaaugcagagucacuugaggugguaguuggccuuagcuaccuuaucacaggaagguaugugguuccccucagggguuuugaaauauugcaaauugcuuuuaaaacuuuauuacuuucuucccagacuuuucccaagaaugcugaguacaauucaauagagagaccagagcccuggucucagggagccagucgucucuccacacaaucgugccauuauugcuuuauggacgcagggaagguuacuagguauucauauuuuucaagaggaguugggaaucuggauuuucauauaaaauguuuuuuuaauguuggcaacuaauuuuuaaaaauuguuuuuagaugaugauuuggagcaaaaaaaucauuucaaaugcuguugaggccgacaaaauaugccuucaggcugccuugacuccucacacccccaccccaaacuaccagaguguaaccucugaccuagacaauuccuaggcaccaaaguauuuaugagaaucaaugaggaaugucauucucucggaagccccaaauaagcagacacuguucuuuucauaugacauaaucauaucaacuuacccuuggcuucagggacauuuuuucuggugaguagauggauucauuucugacccagacguuaccaguggaugccccuugugcacaccauagcaucacuggugggaguugagguuaagggugcuguuugcuguggcagcugaggacuccaaugaagcccccagacccuucuagaaacugacuuucucagcacugaucucccauaaaauucuguacccaagcucugucaagauauuaauauuggccaggugcaguggcuaacaccugucacccagcauuuuaggaggcugaggugggagaauugcuugaacccaggaauucgagaccagccugagcaauauagugagaccccaucucuacaaaaaauuucaaaaauuggccaggcgcgguggcucacgcguguaaucccagcacuuugggaggccgaggccggugaaucacgaggucagaagaucgagaccauccuggccaacauggugaaaccccaucucuacugaaauaccauaaauuagcugggcaugguggugcaugccuguagucccagcuacuagggaggcugaggcaggggaaucgcuugaaccccggaaggcagagguugcagugagcugacaucgcaccacugcacuccagccuggcaacagagugagacuccaucuccaaaaaaaagaaaaaaaauugcugagcauuguggaacaugccuguuguuucagcgacuugggagguugagacaggaugaucuccugagcccaggcagcugaagcuagagugagccaugauugugccacugcacuccauccugaacagcagggcaacacccuaucucaaaaaaacacauuuguuaauuacuuaagaaugaugacaguuacaaguuacugagcccuuaccaugugccagaaacccugccagcugcacucagucugucauuaccucuguucuucacacugcucuuuaagguaacuaccauuacaggugaccaaacugaggccccagagaaguuaaauguuagcauuagaggaggaggaaagcagccuuccuccaugccagccugcucacucugucgaaggggccagguuacucccaaacccccaggguaccagagcaggccgacuggcagcccucggcuuguacccccaaacacugauuuauaucaccuuuuuugggguucuauuugguuaccaaaaaaaguucagcauguuagcucuuugagcaguugcuuagcaaccagcuaauauuacagccaaaacaaacagaucaauuggaaaauaauggaauaagcuguacgcauggacaauagcugcagaguuuuacuaaaaucuccuuccagccccuucaucuacuuuuucugaagaaugagcuccuggauguacagcuuucacuuuugaucucagaaaugucaggcgaaagucagcggggcauggcagagguugcgcagacuugccuuugaagccagguuccacaacacuaaucaagugugugaguuggggcugcuugcuucaucuccucauucuuucacuuccucaguuaauauaggagcuaaugauagccuccuguggggcuauggcgggugcccagcaggaguucauuuucugccccuuggccuauucaguauuggacuucugugcuaggccccugccccaacccaacccccgccauugcaaacucugccaccuucugugcagccuggguagcuucaugugaccaucucaauuuuuuugcuuucugaaaaugagaaacuauauauugauacuacucauucuuucaaaaacuguguagugagcauguacuaugugucaggcaguaugcuacauuguaggugauguugcugucccugggggucauucagaccugcguuucagugcagaggacucucccuccccuuucccuucccucuuuuccccuccccuccacuccuuuccuucccuuccuuucuuucucucucucuuucuuucuuuuucucucuuuucucauuuucucucuuuaauucauuucuuuccauacugcuuccucucucucucucacucuguugcucaggcuggaguggaauggugcaaucauggcucaccgcaaccucaaccuccccaggcucaagcgaugcucccacuuuagucuccccaguagcugggauuauaggcaugcgccaccaugcugggccaauuuuuuuuuuaccauuuguaaagacaggguuucgcuauguugcccaggcuggucuugaacuccuagucucaagugauccgcccacccaggccucccaaagugcugggauuacaggcaagagccacugcuucccgcgucucucucucucucuuuccuuuuuucuuucuuuccaucuuuccuuuuucuuuucuuuuuucuuuucuuucuucuuucuuuccuuuacuucucuuuagacacagggucuugcucugucacccaggcuggagugcaguggugcaaucauagcuuacugcagccucaaacuccugggcucaagcaaucuuccugccucagccucccaaguagcugggacuacaguuguacaccaccuugcccagcuaauuuuuuaauuuccuuuuagaaaaauaaacauaacccagacccuauuguccaggcuagucucaaacuccugggcucaagcagugcuccugccucagccucccacaacccuaggauuacaggcgugagccaccauggcugacugaugcugaguacucuuuauuuagaauuuauuugaccuugggaaaggcacuuaacuucucuaacuuguuuuaucugugaagugggaaucauacugcuuuuuccucuuccccaguucuuaaggaacugagaagauaagagcuaacaguauuugcagagcacccaggaaugcccgaaacauucuuuguuccaugccucugcguggccaggcacuguuucaggugcuggggcuagaacagugaacaggggagacaaaguucuggcccucagguuuacagccugguggucauugcagcuguaugugccauugcuagcaucgggauucacacagauacgaggcugagagauacaggagcucaaacuaauaagggaaugacccaaugugggugcacacugaaggucucuaaaugaggagagaggaagacgugagacaucguggcauuuccaagaccuggacagcuucacucugcugagacuuuccacauucaugagacugguacagguuucugacaccuuucacugacccugcagaaucaucaucuuuuuuuuuuuuuuuuuuuuuuugagaugaugucucgcccuuguccccaggcuggagugcaauggcgugaucucagcucacugcaaccucugccucccggguucaagcgauucuccugccucagccuccugaguagcuaggauuacaggcgccugccaccacgccucgcuaauuuuuguauuuuuaguagagacaggguuucaccauguuggccaggcuggucuugaacuccugaccucaggugauccgcccaccucggccucccaaagugcugggauuauaggcgugaggaauccucaucuuuaauccaugcccaaaguguaaaguaucucuacuguccucacugccuuuugccuucuuggggacaaacccuucuuuuuuuuuuuuuuuuuugagacggagucuuaugccgcccaggcuggagugcaguggcacgaucuuggcucacugcaaccucugccccucagguucaagcaauuguccugccucagccucccaaguagcugggauuauaggcacaugccaccacaccuggcuaauuuuuuuuguauuuuucaguagagacggaguuuugccguguuggccaggcuggucucagacuccugaccucaggugaucugcccaucucugccucucaaagugcugggauuacaggugugaaccacugcgcccagcccccuucuugaggacaaauaggccacacuggguagagacuguauucugacacuguguaggaaugccagauuucuguucgacucuuuucuccccagcuugacaucuaaccaccuacccccuuacauuuucccuggcacaucauggcuguucuauaaauacuuguugaaugagugcagacaugugaacaaagccagguagagguggcaccaggugaagcugacuggcugccugcccagagacauuaccagguaacauuuccuugggcccauucauugucuuaacucugcuguaucuauaacauucaacauuuacugagcacuuacuaugcgccaagcacuguuaugagcccuuucaccuguauuuuaccauuaaggcucaccacaauucaucuuacaaaugaggacguucaggcuaaguaacaugcccaagggcacagcaguacuaaaaggauaacuggcgggcugggcgcaguggcuuauaccuguagucccagcacuuugggaggccgaggugggcagaucaccugagguugggaguucaagaccagccugaccaacauggagaaaccccgucucaacuaaaaauacaaaaauuaguuggacgugguggugcaugccuguaaucccagcuacucaggaggcugaggcaggaaaaucgcuugaaccucggaggcagacauugcggugagaugagaucgcgccauugcacuccagccugggcaacaagagagaaacuccaucucaaaaaaaaaaaaaaaagaaaagaaaaaagaaaaaggauaacuggcucaucuuaggcuuauccauagguguucuaugcuuagccuguuuauugauccaguugcccgauaggcccauuuuaucuucaucgugauggccaugaccaucaucauggcuuguauuugccaaauguauccuauacaccagggaacuauuuuaaucuuugcaccagauaauccauguaguucuuacaaagucacacagcacagcugcuaauacaguccccagcucacagagaagaaaacuguggcacaaaguuguaacguguucaagaguaugagcuggugaguguccaugcaagugggaucugaauccaggcagucugccgcacagcugcccuccuuagugccaggcccccgugauccccagccagcguuuaacucuaugccaguacguggcaagugcucuacaacguuuagcuauuauuacuaacaguaaacaucaggacagugggguaauuaaacaggaauguugagcauuaccugagaugguggagacagagucucuagcacagagccucgcacauggucaagugcucaguaaacuauggcaaucauuacuacuuuuuauuuguaaaauuuaccccaaaagcuccuucuuagcuucucuuucucaccugccccucucugacugacagguucuuccucuggaaauguuaaugccacccauuaaggaaucaccggaucuugcucaugccugugagcccaucuggcucucagaugacaugcccaugucugaccucauguauuauguguguauucuacaguggcacucugugggcugcccugucucccucauuugcaaguccuugcuguuguccccacaaagcuccuggaagccagucagccaagagcucauuuccuagacaacuggaguagaaucgagcaaacccuauucccuggccuuuauguuuagggaugagacaagaggaggacagggcugugcugagguggccuccagagugagcagcacagguggcuccuuccuuccucucugcccacguauugucacccuaagguagauugcuaaauccucaggugucauucacaugauuucccauugccuuggucaaaagccaugcuuacgucuagcacuauugaagcuagucaguuuaaacagcuaugagggacagcuggagacaagagggcuucucguagucucccaaagucacauaggcacccacacgcauguacacacacaugugugcccuucuuugccucucacugguugaucacaccugugucugcacuggcccugcugcuucucaucacacaucacuagcucacugguucaugcccacacaccuugccaggaauaagcuaaaauaagaaaaugauggugcaucucagacccaggccucugcuuucucuuuaacccccacuggcugauccacuucuuacgagcauccacgagaauaugagugcaugaccgucuguaaaggacccaggaaggaaaaaacacuguuuauaagugcccugucucguggcaggugcugugcuaggcccugggcaaauguuaucuuuuuuaggacaaccuagucaaagauaagugcuuuuauucccauuauacaagugagauuaaaacacagaaguuaaguuugcccaaaggucauauguauuuaaguggcagagcuaucgugucaacucaggucuuugucauuuccaaagaggccucuucacagucccauccucucuaccgcauagggcaguuacaaauagauuccuccauucccuauacacuuacugagugccuaccguuugccuggcacugugcaggaccuggaaacguaaccaugaacagaggcucaccccagaccucaagcccagcagggcugagagguacaugcacaggcagccaccaccagugagcgaaacagucuaggaugaaccagucccaaagaagaugcagacccaacaugaaggggagcaugaaaggagacacaucaaggcccauggagguggggaagggagguacggggaggccgguuuuucuaacuggcuaugcacuaaaucuugagagaaaucagugcuguuccaggguuucugaaacagaugcacacuccagcacagguuucuuuaucuccuccuguccccuuuuaauauaacuuucauaggagucccugggaacuuguaugagaaccacauggauuucuuacgacucagguuugauuaaacagugggcucucugacauuugaugcugcagaacagggcuguggaaacccagggcuccgagagcugacaagucugguucucucccagcauucugacagcagccccagugccuucagcccugcgauucccaauaguuugucacuugucagcauuggccucagccauuuauugcaacaccgcaaagaagucagcacgggcauuucuguuacaggcguggaaaccugaguggcagagauggggaauuccccaaccccugcccgaggaguaggggccacaagaggucccaaaugguuaccagcauccagugggcugaaagucagucauccuggugagaaaagagagaguagaaagaugccuucagaauuaugggaugggcuucuugaaauaaggcuaguaggaguggucauuagugcuaaaugcagagauaauucaaacaaggugagaauggauaaaucuguuagacuugacagugaggggacauugcugacuuuggccagauccacagagucaaagacagauuauaauaguuugagagacucaugggugguaaugaaaggaaauagccaguauaggaggcucaguauaagccagugacauguaggaucaguacacauguucccaaucucauaauacucuuuguuuucugaccuccgcuccacuuugcucauucaagguggaaucugccauguggaugagauugcauuuaaggagcauagguacacagaucguagccuccugccuucucccuuuuugccauuccuaaccacucucccacuacugccuugacccaugaacucaaagaaguucauuuuuccaguugcaagguugggaagacagacacaaucacugcauuaacagacuuggucccaauacaucuugugguuauugaucuuuccugcuuaauuuuaagcuggugcagacuucauuaauaucauuauaugaugaugaugauaacuacuagcugugugguaguuacuuguuaaccucucagaacuuuaauaucuuuaucauuaaacugaaaauaugaguauguaagucauagguugcaauaauuaagagaaguaaugcauauaaagcacuuagcauggggcuugaaacucaaugcauguaagcauuuauuauaauuuaucaaccaccuacaguauaccaggcaggugcugagaaauucaguuucuccaauccuauaugcuuucucguuaucagagcuuugcaaauaaccuggaacacccuuuccugacuggcuaacuccugcuucuugauuggaacacaucucagugaugagaagucuuccaugacucugcacacagagaggaguaugcuucugucuuccucccucccuacacugugagcuaugcauggacaaaguuauauguguucauuuagcucugugcccaagguuuagguguuggcuucauuaauauucauuaauugaugaauauauuaucuuaguucucuuaaucaccaaguccauaaagcauuuauuauuaucaagauaaggaaacaaaagcccgggguguuaagaaaauggcccaugauugcacaguuagggaaguaguggaauuaagauggaaucuacaucauccgauuaaaaagaucaugcucuuuuuuucucacuguucagccucccuucaaacuggcaugccacgagagguacccagccaucaggugugcugaagauaauuucaguuggcuccucuugaaauaucagacucuguggcuccaaucccauaugucaggcacacagcuggaauugaggagcagcuaggcguggacucuccuguuuaucccauccccugcucuccccucucccuuuugucuccucgacauguaagccuggcauccuuugccauugaacaucgugcucucuccccaucagccugcaccauuauccacaucacuggccuggcccugcagcugcuugagguugccccccaaaccccccaguauagaaagacacaaaaaagagauacuuccagaauccuuugucccuguuuaaauuugacugugcucucuccuuuucuuaaccucagugauggauuauuuuucuaauuuuguuuucuugaagauggcaucaaauuggguuuguaauauguccuaguucguuuuguggugcuauaacagaauacuggagacuggguaauuuuuuagaaauguauuccccaugguucuagaggcuuggaagucagaacaaacuugguggcagauucguugucugggagggcugcucucugcugccaagaugguucuuuguggguuuuguuuguuuguguuuguuuuuguuuugagacagagucucacucugucacccagacuggaguacaguggcacgaucucggcucauugcaaccuccgccucccugguucaagcgauucuccugcaucagccuccugcguagcugagauuauaggugugugccaccaugccuggcuaauuuuuuguauuuuuaauagagacgggguuucacuauguuggccaagcuggugucuaaccccugaccuuagguuaucccccaaccucggccucccaaagugcugggauuauaggugugagccaccacgcccggccccaagaugguucuuugaacacugcauccugcagaggggaggaacgccauguucucacguggaagaagguggaaaggcaaaaaaaaugggaccaaacucucucuugucaagcuuuuuuuuuuuuaaucauuauguauuaaauguauugauguaauacauuauguauguauugauguaauacauuauguauuaaauguauuaauguaaugaauacauuaugcauuaauguauucaugaggguggggcccucaugaccuaaacaccucccauaaggccccaccucugcugcugcauugggaauuaagcuuccaacacaugaauguugggggacaccauagcacaauaccuaagcacgcaccagugagagaggaggaaguuauuucagggaaugcugaauagaggagaaugcauaaggguagacagacaggauuuagggaguucuuccuuugguggaaacuggcaaguaacuggaaucccauuuucaggcaaaucgugaccauugugggacuccaggaugggucugauuggaccacaagggucucuucucccgggucuucacucacugugaaggaguuagguguuggucguagaguuuuccuuauauccucuccuguggaccaacauagguuaauuuuucuagacacuuaagaugaaacuaaauuggccagcguugugacauggauccuuuuccugauuagcaauccagccuugcacuguguugacuuauuuuugcagaaccagaggugaggaagggaacuucuuuuuuuuuuuuugagauggagucucgcucuguugcccaggcuggagugcaguggugcaaucucagcucacugcacccucugccucccagguucaaacgauucuccugccucagccuccucaguagcugggauuauagacacgcaccaccacacccagcuaauuuuuguauuuuuaguagagacaggguuucaccauguuggucaggcuggucucgaacuccugaccucaggugauccacccgccucagccucccaaagugcugggauuacaggcgugagccaccgcgccuagcugggaagggaacuucuaaauggccauggcccucacacccaccuacuugacuggugcccuagaugcuagcagucagggaagaugccaccagcgaccuccauguugccaaacccagcugccagcccccagcucucaucucauuugacuucucagccaccuccaacugccggugacuccuccauggcacacguuuuauuuucuccuggcuuuuaggugcucaucgcagucucuuugugguucuucaaucuucuuggucccucccaggaguucccauugcuggcuccucuucucguucuaccugacucccauuuuauagauauuccauguuacagauacggaaauugcagaaccaagagauuaauuaaguaguuagccaggaugcagacccgagcagccugccucuagaaugugaaccacugugacuccgaggaggugaaguugucagaacuaggcagugcacggcguuuccuuaugucuuccgagacacuuucccguaaucucuucaugccaggaaccugggcuguuucccugguuacagggaccugccucuagaggaaaggauggaguuaaaaagagagaaugagauggagggagggagguguguauguaugugaaagagaucaacagccagggucagguugaggauugguaauuccaugccaccguagcaccagggaaacccauccagcuaauacucugcccuuccauccaugcuguuucuuugguuuaugcagaacccgggcaagccuaccaucugcacccaccccuaccccuucauuuggcauaggaagccucacugcucacucacacucacauccccuccccugcucgccaguuuugccagauuggagcaaaagaggauacgaacuacccauauaccugagugagcugagaggaggggcucggggaaaaaagauauacagaagaggaggcuguggggggcuuuggaggauaaccuuuaucaaauucacaguuuccccacugguuagcucugccacgcuggaaaaggugaauuuacucugugagcaacaccugaauuguuuuuguuacaaagagggacucagagggcuggcuagagaccgagaucucauaaguucuguuucuguagaugagcaagcagaagucuucccugguuguaaguaguauguugacuucucugaauccuccuucacucucgcccauucucuugccuuggaugcaccaguaggcucagcugugacaggggaaggggacuuguuuguuaaugaguuaauucuaagucaggcacugcuuugggcucuagagcccugagagaugagagauaagccuuuauuaucuccauuuaagauggggaaccugugguugggagagguugcagaaugggccugaagucaggagagagaggagcagucagguuuggaagcugcugcugucuggcuccaagucacuuauguucacagggcuucccauuguaucagcaagguucugaguuauuuauauuguuuuaagaacuccuugguccagcugggcgcgguggcucaugccuguaauuccagcacuuugggaggcugaggcaggcagaucacgaggucaggagaucgagaccauccuggcuaacacggugaaaaccugucucuaguaaaaauacaaaaaauuagcugggugugguggcgggcaccuguagucccagcuacuugggaggcugaggcaggagaauggcgugaacccgggaggcggagcuugcagugagccgagaucgcaccaccgcacuccagccugggcaacagagcgagacucugucuaaaauaauaauaauaauaauaauaauaauuccuugauccaauauacuauaguagguuugugaauguucuugcaagugucuuggacaagacaagggcaacaaaacuuugaaccugugcauaggcagggacuggagcuggucugcaaagaggagucagaccauaaggaagagacugugucagcucaggcccauguaggggacaagaacagaguggcaguccaagaaggacaucaauagagcuugguaucauugaaugaugaggaggaaucuggaccaggucggaauuaggacacuuuuuauuuuagguaagguaccugguauuaauuucuguugcuugcagcuaaacaacccuaagcaauauauuacaagacccacaguagacagacucaguaagcagcaugucuuaccagcacaguccucaggggucuccagagacacagagccaauaggagauguauauaguauauccuauagauaguaauauauguaucaauaugcagagcuagauagugauauguguacugauagauugacagagcuuaagggauuggcucacacuguugugggguuggcaagucugaaauugacagagcaggccagcaggcuggaaacugaggcaggauuucuguguuacuguccuaaggcaguauuccgucuucucugggaaacucaguuuuuguucuuaaggccuucaacugauuagaugaggcccacccacauuaucaagggaaaucuccuuuccuuaaagguaacugauuguacauguuagcuauuagguuggugcaaaaguaauugcaguuuaacacgucuaugaaacacuugcacagcagugucuggacuaguaugugacccaguaacugggcgccauagccugggccaucugauacagaaagggaaccaucauaggcaucauguaccccgugcuuaaugugugccaggccuuguagcaagcccuuccacaagcacugugcuuauccucaucaacauauuuuucaagugcaucaaccccaggacucaaaauagugaaagugacuugcccaagaagacagccuaguagagucagagcuagacgccuugucuaaugaccacuacaccugacuguccuccaaagcuuccaucuuaauaaucuacauuuagcaaucuaaagaguaauagaguaacccaaagucacucagcuucucagggugggccuagaacugaagucuccuggcuguucgcccagcuuucucacucaucguccugccccacuguuccuggaagacucugcauucuauccucugcaggacucacuuuccagagaacuaauggcugcaaauuguugaccccuaagacagcaagccccauccaggguaagauguacuaacagaacacagaacagaaagacccaggcugcuguuaccuucucaauaaacagaugagcucagaguuuguaccaugaagccuuguuuauugcugaaacaacuucauaaugagacccuuucaggacaucgguauugaaaccuacuugaacugacucugaaauagaucuaucuggugacagauccaucuuuguggcaguuuguauuuuagugagaugaaagggaguuugcagaaagcacucuggaaucuggugcuaucuaugcagagggaaauaaggcuugcuaggacuguaauugugaggcaugcugcuugcugagucugucugcuuugggucuuccaguauauugguuaggguuguuuaguugcaggcaacagaaacuaauaccagguagcuuaaguaaaauacaaacaaaucaaagaaaaacaaagcaaauaauggauggguuaucuuauagaaucaaacuaggacuuggaaaaccaacacauaagacagcaauuaaccagggcagcucugggccccucugcagcaguucagaagucuuuagagcauggucugucaucacugaaagucaauucugugcuuucccagucucuauuucuauucaaauuuccaagaguaagaaacugaugugcucagccugggucaagugucuaauccuaaacaaccugcccuugccaggggugcagguagggcaggcagagagcucugagagcuugcuucuauguauaggggcagguugcccccauagaaaggggaauuauuuucuagcaggaauuaaucucuaagaagcagcuccuauagcaacugaugauaauaguaacuugauccuuauauagauacaaacauccauguuuguagaucucuguauccaucguguauauauguguaugugucuuuauaucuugcccauucccuuuauaguucugcccucgcagccuucuauucuguuucuauagcauuguauucuaaaauaaucagcuacaaaugcaaucuggggccccaguuuagagagauuuguccuuaggcuucuagcaucucgagacguuuauaugaauguaagcaccaugcgggcagagacuuugcuuguucuuuucacccuguaucuucaagugccuggcacaucauaggugcugggugauugcugaauggguagcaaccacccaccaauacugggacaccuuccccccugccccagggauuccaagggcuuugcugucuugguccaaguauauucuuuagauccauauaucccacccccaauacccagaaucaauagauaagguacccaccucuccagggggaaagguaaauagccuagcucugccccuauccaauagaggauugauacaaaagagagugcuagcugacacuagaugccuggccacagaggagggaaucuuggauguuugaaaacuaacauuguucagacagacaaagcgggagaagaauccaggcugggacaggcugacucaaaccucugguccucagacuggcuaaguagagcucguccacacucuguaucuugcugucguccuuuacgaaccuccucuggaauaguggugagagagcuauauauuauuugguauauaguuaacaugagcacuaugguaaagagugaacugcaaaugauauucagaggguuccaaaaugaacuuccagcccaucccaaccacccccucucuacugggagcuggugagauccauuaaccacggaugguuuuaggaaacuguccuuauucugaccugauccagguucccccucauuauucaaugauacgaagcccugcugauguccuguguccuucugggacugccacccuguuuugucccauucaggccugggcuaacuuagucacuuccuuaugguaugauuccucuuugcacgccagcucuagucccugcuaaugcacaggcucaacgucugguugagugaagugacuuuaauaauacagcaauggaggacaagguuuuuuuguuuguuuguuuguuuguuuugugacagggucucgcucugucgcccaggguggaacacaguggcgugaucucagcucacugcaaccuccaccucccagguucaagcgauucuccugccucagccuccugaauagcugggacuaccagcaccccccaccacgcccggcuaauuuuuguauuuuuaguagagacaggguuucaccauauuggccaggcuggucucaaacuccugaccuugugauccgccugccuaagccucccgaagggcugggauuacaggcgugagccaccaugccuggccuucaauggacaguuguauggccaaggagggcugcugcuuucagugguuuuucaaaaugccuuacaaugccuaccuuuuccccaggaaaggcugcuuucuguaucucagagauggaaacagacagccaugaugacccugagacccaaaggucaguguccaagcaggagccagaaugaauuccuagguccuggccaagagugaucacagaauauccaagccagggagucgugauagcacugcaguguaauagugaccacuugucccagcaugccugccccggccaggugugccaaguggcaguauaugacgaccuuguucgguccacaggagguagauguuauugccaucauuuuagggacgagggaccaaagguagugaggagcuaaaucgcuuucccaggauggcaggucucauaaagugaccuugccaggguucaaauccagucuguguuuauuaaaagccucaugcuggccgggcgcaguggugcacaccuguaaucccagcacuuugggaggccaaggcgggcggaucacaaggucaagagaucaagaccauccugccaacacggugaaacccagucucuacuaaaaauacaaaaauuagauggacguggcagcaugugccuguagucccagcuacucgggagacugagacaggagaaucgcuugaacccgggaggcugagguugccgugagccaagauugcaccacugcacuccagccugggcaacagagcaagacuccaucuccaaaaaaaaaaagccucaugccauauggcacuaaaugcuuggccguggauggcucuccaugagccuuucucccuuuccaaguaaccaccacagagcugagaaaaggcagacaaacccaggcgugcaggaucgggucucggaggagcagaguggaaggccaggcacuaaggcaagacuuuaacuuucucuuagggagauaccagagcucugucucaccagcacuggcugccuaggguggcuguggcugcuuuaaaggcuuggagucuggagaauucaaggaguugaggagucacugaaauggaaccugaaagugcccaguuuggugauucucucaucggcucucuguccaccugcucuggugcggccaggggugcagucggagugauugaccagcccagggaaccaagcaggcugggcuguaaccccugugauccuuugaagccuuccuucugugccuggcuggcaggagcacacacugaaaacaugugggagguucucccagccccucagucuggucugcccucuguuuauucuccaggaagaccaaguucucugucucggggacagcagaucccauuccacucuggguuccccaaguguuuagcaacuugcuuugccucccagggcuccccaucuuucuucuuuucuuuuccuuuucuuucuuuccuucuuucucuuucuuuuccuucuuuuuucuuucuuuacuuuuucuuucuuuuccuucuuuuuucuuucuuuacuuuuucuuucuuuucuuuucuuuccuuucuuuucucuuccuuucuuucuuucuuucucuuucuuccccccaccuuuuuuuugacagaaucuaucucugucacccaggcuggagugcaauggcguaaucucagcucauugcaaccucugccucccgggcuccagcaauugucaugccucagucccccaaguagcugggacuacaggugugugccaccaugccccaccaauuuguuuguauuuuuaguggaaacgggguuucaccuuguuggccaggcuggucucaaacuccugaacucaagugauccuccugccucggccucucaaaggcugggauuacagacgugagccaucgcaccuggcccaguuuccccaucuuuaauugagaggaugaccugagcuuucuuucccacacuuccccgggccaaugaccaccccgcccucaugggggaaagaccuuggccuggugucacagggacucugucucucugccuguccccucuuuucaggaagucugucauccagcucgaucuugccaacaccaagaaagcaaugauuguccccgcguucgagacacugcgcuaccggcuguccuuccccaagucaaaagcggaguugcugucaaugcuggacauggggacccucuucacauucaggugaguggcucuagcugcuguacucugggggugcucgaaggccuucuuucuccugggaaacccagaugccaaagcuaucgaucuggaaguuugucgcucgccuuaguccauugugaggccaggaaagcaccgcuuucuccagacaacguccuuguaaucucccuccucuccccaugccgguacgugccauguacuuuuuugugcauggaugacagacguuauguguucagauggaaggguaggcauguuuggaggguggaaggguaggaagguuuagcuuauuucuguuuguccuuuuuucuaaacucaguuuagguuccugcugccaucuccuggcuccgaguucucccuuuugugugcuuguccauucauucgucugguagguggguuucauucuauuagcaccacuguggcaguuuuccuuuuuauuugugguaugaguggucuguucuuugagccccugaggccugggggacguguagccguugugucaacaacuucaagucaucaaggugacccagcacauguggcagccagcuuuccuguugcccaagugacagucgcaaacagaacccugauuuuccuuuuuucccaggcccccgaguccugcaggaacauugcaagggagcuccccugucaccuguccccagugucccaggagucugugccaccgcacaggagcaaacagguuccauguccuggggacaggcugcagcauuacauguagugauccaggggaaaguagguggccugcuaggugccguaacugagcagucuaaagagagggcugguacgucugccugcuccagguguuugcuuguguuuguuuguuuguuuguuuuguuuguuuguuuuugagacagagcuucgcuuuuauugcccaggcuggagugcaauggcguggucucggcucacugcgaccuccgccuccuggguucaagcaauucuccugccucagucaccugaguagcugggauuacaggcaugugccaccaugcccggcaaauuuuguauuuuuuaguagagacgggguuucuccauauuggucaggcuggucucgaacuccugaccucaggugauccaccugccuuggccucccaaagugcugggauuacaggccuaagccacugcgccuggcccugcuccaguguuaaagugaggccacccuugugaaugaugucagaauggccaacacuuccuggaagcuaaaaagcauacguuucuagaccaucggaauuuuacugaaaacauuauagucuuaauaacuuggguuuuccuaccacaauuaaguuucuagaaauuucuagcaaguuuccucaaauaaacuuuaucuugugaaaauaacuuuaugagguggguuguucguucaacaguucagaggcuaucauuuuucacauuuuauacagaugaagaaacugaggaguggagaggucccaguagagccaagacucaaacuccaggcuucuuccucuauccagaauucuggaaaguggccuggaagaguuaguaaccccccacccaacccaagccuuccuucuuuucugaaagaaauaacuaccacuuauugugugcuuagcaugugccaggcaccgugauuacauauuuaauucucacaauaaaccuaugugacagauacuaucauccccauugcauggauaaugaaacugaggcucugagaaguuuaauaacuugcccaaugacacacagccaguaaauagcagagccuggauucguaccaggucugaggaaccuguguucucagucagaaugccauccagcuacugauugaguccugaauuuuuuuuuuuuuaaccaguguuuaaagaugcagaguaaaaacuugcuccucagaauugagacuuucaaaccaaaccuuaauauaagucucccaugaaugccauagucugauggcugagcaccugacacauuuccaaggcauccuuccugccgucuucauaccacagugaaccgagaacucauuucacagccacauuuguggccacaagagcugggguguggccugcuguguccgugauugcugcucuggccagcagcuugccagccaucaugccaagugcuaaguuacagcccuugucuccgagaaauugcuauugucaccugcucuccaaauaacaaacucuucagccucugagcagccgaaaucugcucccuaccacaccuggaaugagaaaacauccacaccccuacaaguccucuagggcgguggcuccagaaugcggucccuggaccaguggcuucagcaucacuuaggaacuuguuagaaaugcagaggcucaagccuagcccagaccuccugcaucagaaacucuggaauuggaaccagucuuccagauaauucuaaugcauacucaaguuugagaaccacugcuuaaagcaaagugccccaaaucucuucuccccaguagcauccuguaagguguaccuaggaaaccucucucaucuucccaucccuuuuuuagcagggaaggaggcuaccuggcauuuggcaauaggucauucacaggcuggggcuuguuuuaacgagagguucauuguaacuugacugcacccugugcugcccagccuuucugcaagcugccaguguccaggcuaaacugaucaaagcugccuccucagccagaugacuagaacugacccagcugucccuacaauggagugcaauggcgccgucucccccauuguuuucccuuccuuuucacauuauaauuuucugagaguuuagauucuaaagguggaugaccaauaacauggcugucaauaucacugagagcaagaccaccaggaauugacaucauaucugggaagcaaacaaggagaaauaauaaagagaauuuucucuuucucuuuuuuuuuuuuuuuuuuuuugaggaguuaccauauaucagaaacuacucugaguacuguaugugaauuaagucacauaaucaucauaaaucuaugaaguagauauugcuguguccguuuugccaagagaaggaaacaaaggugccaaguaguuaauguacccauaccuguugaaugacagaauuggaacccaggcaggcagccuccagaaccauugcuuuuaaccacuuuguuauaaaacuagcauuuauugaauuccucuuagaugucaauacugcgccagacucuuuauauuuucucacuuaagcucuuuggcaguucaaccagauagguauucuuuuccccaguugacacaaaaggaaauuaacggcuaauuaaagcauuuuguucugcaaggcauucagcuccuaaguggcagaggugggauuugaacccuggccugauggcuccauugugcuuuaaaaccucauacaaguucacggccaucagcugugcugugccaguucuguugaaggcaucagguguuaagacugcccauucagcaaguucacaaauggaaaagcaacugcuucugggccuaauuguuggaucaugcccgaaauugacaucucccgcaauaucccuuuuccacacuccaugaaaauggcauugcuucaccuuucauuuuucuuccauuuaaguggcuuugguuuugauggaaguugcuguguugauggagcugaaguucaaguuccugcccuccccuagccuggcugucucacccaacagcacaacuugaucaaagcccacccauuggccagugcccauucagcugcacuggccaguucccugaggguuuggggggaguccagccucagugguagaaaagcaaaagaaggaagcaguugcauucccugccagaaagugucccauuggccacacggaacacucagucucacuuagcgccucccuugcuuuggagagacugcccacaggaugagauggaacccagacuuccacuuccucucucccugcagcuaugcucuuggguucccacccuucugucuuguuuucauuucaugaagcuuuucuuuccagcucuggauacucuuccuaacucuucucuugggcccugucuaguccuucacuagaugcccagcuuccugccgucucucuguagcuucuagaggcauauugccaucucacacauggaccugucucaggugccucucauguuguuagguuacucauucauucauucaguuuagugcacaauuguugaguacucguucaacaggccaggaagugugggggacagggacauauaagagaggugacccagccggccgugguggcucaugccuguaaucccagcacugugggaggccaagacgggcggaucaugaggucaagagauggagaccauccuggccaacauggugaaaccccgugucuacuaaaaauacaaaaauuagccaggcguggugaugcgugccuguaguccuagccacuugggaggcugaggcaggagaaucgcuugaaccggggaggcagagguugcagugagccaagaucgugccacugcacuccagccuggagacagagcgagacuccaucccaaaaaauaaaaaaauaaaaaaagagaggugaagugcuuaaggaggcuccuggccuuugagcaaggcuucccggguuugaaucacaacuccaccacugacuacuuguacuuugacauuugguaaguuauaagaauuuaaaacaauaucugcgugugugugugugugugugugugugugugugugugagagagagagauuuaaaauagucccaguacacaguaagugguuaacuaauauuagcugcuucuuauugugguuauaugauuguauucauuugcuacuacuguauaacaaauuaccacaaacauagcagcuugaaacaaauuugugaucucacagucucuagggaucagagauucaggcauggaaugacuggauucucugcuugggaucucacugggcugaaaucaaggagucagcagaccugcauuucuccucuucccagaucacuggugguuagcagaauuucucuccuuucguuccuaggccuaaggucccauuuuccugcuggcuuuuggccagggacugcucuccuagagucuaguuaauuugccacauggcccccauaggcagcucccaacauagcuccuugcuuucuuccagacccaggucuaaagggucacaugauucaaucaucucccauuuucacacaaaguaaaguggugaguaaccuuauuuauaucuagaacaaucccuucugccauauaauguaccauaaucccaggagugaucacauacauacucacagguucugccucaaggggagagcauuggacagggugagagucaugggggaccgucugauacuccuaccacagucuggcagcaaucacuacacaagcucaccugcagucaauuccugagaaaugacauggagcccuccaggaguuccuuuucauagugagaaucuccucguuagugaaaugugcagauagcagaugggauuaggguuuccugcagcugcugcagcaaaauacuacaaacuggauggcuuaacauaauagaaauuuauucucucacaauucuggaggccggaaguccaagaucaagcugucagcagguccaugcuucuucccugagguccuaggccuccgucuggugauugccagcaguguuuagcaaucuuugauuuauagaugcacccgucauccaaucucucccaaugucuauacaugguauucuugcugugugucucugugucuaaauuuuccccuucuuauaaggacaacaaauauuggauuagugccaccccaauccacugugaucucaugauaaccucauuauaucugcaaagauccugauuccaaauaggucccauucacagguacuggggguuaggacuucaacauagcuuuugggagggagacaguucaacucacccgaggacuacaucaguguacaccccuucuuccuccacaucggcugcauuuggagagcuuggcuuccuucccuacacccaauggcuuuucuccgugugucucagguaccacgucuggacgaaaggccacgcacccacaaacuucgccaaguggcggaccgccaccacgccuuaccggguugagugggaggccgauuuugagccguauguuguugugagacgugacugcccggaguacgaccggagguuuguaggcuuuggcuggaacaaaguggcucauaucauggagcuggaugugcaggugagaagaacggagcauccaccugguauggucgacgggggagaggccuagauccuagagcuuaagggauccuuggagacaagaaagcagagagcuaagagggaacaagauaugcuugaggaccagugguaguacugauccuugggcucuugaucccaaaccauugcuccuuccucaacccuugggugagaguuggguucuuggccaggacccagguaaaugugaguuuccugugacaaaccauuucaucuucucauccucacccaaccugaugaugaagacaagcaaaugugaccauucaucacuuggucuuugagucacguaacagacacgaagcauccuuagaguuccauauacaugacaaagcaugcugcuaagaugcagcuaguuauuccacccuuuacuaaaagauuaauagaugcauccaucauuacuaaaagaguggcgacuuugagacuguguuuaaucacgaacuccuucauucauccaacugauacguauugagcuccuacuucaaaguaugaaucuucuacagaauucuaguaggugaaaccaaggaucagcacacauuuucuguaaaggaccagauaguaaguguuuugagcuucaugggaccuacaggucuccuuuucaacuacuuaacucugcuauuguaguucagucuuacagucuuuaaacaaauggguguggcuguuucaauaaaacuuuguguacaaaaacaugaaauggaccagacaugcuucaauuuuucagccccuguguuaaacaaacaaaagcaaaacugcucugguuaaauuagaagaaggauuccucggucccuccagccuuuuuuuuuuuuucuuuucuuuucuuuuguaugcucuucuccaagaucucuccuccuggugcacagugcaaauauuuuucaacaagagcaccuccaauucagaaaaagcuaagguuggauacugagcgcuggccguucaugagaaucaccaggagaacuuuccuuccaauaguuccaauauguuugagaacagccccaggugauugagaggcguuaggguugagaacacugauguagauagguuauagaaucauguccauauuuaacaacagaaagcagggcugucaguauccauauuuuuuauaauacuuugaaugagcagagugccacucacagacaacaguguucagucagccucagcuucugcuuaaaaggaaugucauguucauguguccagcagugcugugagaugaacuaguucaaagaaaguuaauuuuucuagccaugagaccugggcuuuguuuguuuuggacaguuuugacagaauucuugaaaauacguugcauauuuucuuuuuuuucuuugcgaauagcaugucccagacauacucuuaaccuuuuccaguaccuuaaggaaauaaugagugcacaccugccagguauuaacacccacacccauggggcuagugcgguuggugggguucuuugucccuccauuaaaugucccagacaguucagcucugggagaucuugcauuuucuuuugaugguuuuucucacucauuccucaccagcaacugucuuuucuugcugcuguuguauuguucuaccuaaaacagccgccuuuccccaucccaguuaucccugaguuuauucuuaucugcucugagcugggaaacuagauaacaaaagcuugucagacaauauguccaaaaugagaguaaauagaucugaguaaaagugugcugaguucuccucuaagcgauaugaccuaaaucugggucaccuguuuuggcuauucagaggccuuuuauuuuuggccugaguauuaagcuguauucugccaaguugagaauacugggugacagugugaccugcgauaaagaugugucagggagagguuuguucuuggugagcuuagguccagcaaaauacuuguuuuuauuucaucuggucucucauuccuguuuuguacccucuuuugcacucaucuguugagacugucagaucgcaucaaguccuaugaggaaucauaaacagaugucaguuaaucgagcaagagaauaucccauggcgugugucauccuagacuguccaugugggugugagcucacaucuauuuaucaagaaaccuuuucuaggccaugagcucggcucagcacuguuuauacaguauuggcuucuccgucauggucaucauucaagaauauuauuacuuucaccuuauagaugagaacaugaaggcucagagaagccaguuuccugguccaaggucauggaaacagcccugaauuaccccacuccaaagcuguugugcuguccuuugccaucugcuugugggugccauuaucaagucauucauucacuagccauucaaucauucgcuugggccuucaucaugcaugacccucggcucuugcggguucucacgcugcucuugucuucuuccaggaguaugaguucauugugcugcccaacgccuacaugauccacaugccucaugcccccagcuucgacauuaccaaguuccguuccaacaagcaauaccgcaucugucucaaaacccucaaggaagaguuucagcaggacaugucccgccgcuacggcuuugcugcccugaaauaucucacagccgagaacaacagcuagcaccaagaagcccaccacuagggggagacaugcuguaggggaagugccacucgcuguuuggggcccggccuucaaauucaaaauugagccaugcuuuuucgguuuguuuuuauuuaucucuuuggcccagccaagcugcccucacuacagagaccuuggacaaggauccagccagucccucucugccccacaacccugcauucccagagguuagcuaugcagcccaccuagaugagucucuucaagaaugggaaaucaaggggugacagggaguaaaaggguuaucaucuuacugcaaagccacaagaucagggcagggcuuuaggauguucuggaugcuuuuuaauaauuaugcuucccaucauaacuggggagaaagggaagucaggguucuagggguuauucgucccaggaaauagaagugaaauugucuuuauuaagugaaaacuuuccccuuugcccugcaauguagcugggcauucaaacggagggcaaaccgaugaucuaaaccaaccacuuggaaaaacccaauggggacauuguaaccagaggguccuggaggugggguugauggguuuccuuauccccaaagucacuccuguuuuguuuuguuuuucuuuggggguuuuguuuauuuuuggggcuggcaauccaaaauagaaaaucugauccuuugaggcucuaaaggaaaaucagcugccucuaccaaccacccucuaucagcaguggcccaggaaggaggucaagcaucuucggccgauauuuaaacaugggcagcuuccuucaggaugaucaccgaggcucccgugacuuugaacucccuacucuccagaauccaggggcuauagcgauggggacugcggaauuacgagggcuggcuguuuuacaccggucacauuuucuauuggcagugacugauucaugggaaagggcuuugaaggaacuacuucagugcacacacaagguacgaaccucucaggccuuucgaagaacuuucauaauucaugaaagcccaguucugaagauucacguauccaucuggagaccuacaggaagaaagugauuggguuccucugguucuugccugcuucacuguggaugggaagaggugacaaccucagucucccuuugggaccuguccaaggguaggcaaccaccuucaccuucacacagauugaggagacacuggacuuuuuacccauuuucuuuaaucuucaauauuaauauuguguuuacauugaugagaacaagaguuaaugcccuacccucugcugggcuguuuguauugaguugcaaugugaccagcgaaagcugcauuuaauaaaugaaaguacagacuguuucuucccca

SEQ ID NO: 191904 - RNA, 38356 nt, Homo sapiens
gcucugggcucgacugaggcucccuggccgcucgcgcuuuucucuccuucuccaagauggcggcgaucggcggcguugaggcgggauccgggcgagccgagugaagguagcggcgagcggagaccccaggagaccgggcugggcccccacccugaggcggcagcagccccgccccgucgccacccgccgcccugggcccgcgacaucaccucuggggugccccaggcccuucgcggccuagcccaggggccgagccggggacuggaguagcggccgcagccgcccccaggaaggggcuggagcgggcagaaggaggagggcgggcgggagcuguucaaacggggaaggcgggaaagcugcggggccgggagggggcgugcggccgccccgggggccugcggacccgggccgccccucccccugcccgggccgucuccgcccucgggggcgccgugaggccgccggagacgcgggaacccggguucaggucgagcugugcggcucggaacccgcgaugcgggggucccucgggcugucagggggaaagggcucguggccgcggccacgggagggcuggggcugcggcuggcaggagaaaguacgaggagcuuucuucuuuuccucuucacagagcuuuguugagcuagcuguugccgcaaaacugccgggagaaucccacugguuugccuuggggaccacaaaaauggugguccugggggcuguuuguguaaaucaccugguauuuuguguguuucuugcgugcaacccggcuuggccgugccuucguggugggcgccuucuccaugcaggcccauuuucccuccaccaacuacuacuuguagauucacuuuauagcgugcaaaagcggagaaacaucucuguccccucuuuuggagggcuaagcugguggcugauuauauuuccuccuaauagaacaaaguaaaaaacugaaucccaaauaaagccuguugauuggacaaggcuucucaaaauucgauugcuggucuuauggaauguguguugucagccaaucugugcgguggucgugguuccgcuuaauugcacugcaaugagaggauucaauccccauccccgacugucgggaucucugcagcuuccagagcuggcaggggcugggagugcugccuagguaggucccuggagaagggaguggcaagaggauucggagucaccguguucggagauuggaagaaaccuggacgaaguugagaaggcaucacuugucuguaucguagaaguaacaagaaaauuucagaaauuggcaaccggcggaugugcaucuuccuuuaccugcacugacuggcauuuugaguucuugaaaggagugguuggaagaagagaaugcagaaucuuggacauggcucucauccuggaacagaccuggaguucagaauuucucuuacuguccgugugacggggcuuacuuuguuuccuuuuuuucgauacucauuuacauuauggggugaagaagguuguugauugcaggagcucaaguuaccucaaaaaaagucugaaaccuguuuuuuaacuguaauuugaaguuucaaaaugacaaagugcuauaucugaggacuuuuuccuccugauuacuuuggucaucccaaaggccuaugccugaacauaacuuguaugcuuaucuaccagggaaagagcaacucugcccccuccuuuuucauauccugaagaaaaguccccgaagagcuauuuaacaauuugugcauuucauaaguauacauuuuuaugguaccaguuuuuuacuuguaucaacaguaugaaauagugaacuuuuacuuauguugucauaucuuagcacacugagacaaacaaaauuauucuugccucuuggaguugacaacauugaauuuuauaaacucccaaauuauugaauugagacuggguuuuaacaccuguuucacauuugccaacauuuaauguaauuaugaccucccuuuucuaaugugaaaaucaaaccuaauauucauuuucauuaauccucacaaucuacucucuaccccugaacucugaauuuucacagauuguauucaagaccuggaaggaauaucagggguucaucugaucuuauauaaauguugccugaacucugccuuucuuucacacuguugcuugagauuuaucugguaucuuuccaaaacuaaacccugagcugcaauaauauccugauuuuaaagaacguagaaauucagggcccaucggucugcccaagcuguggcugauacaguccguuguguuuaauuuuaguuuuucaagcucuuggcugccccaguucuucagugaauuggacgugucuucaggccucauuccuucuuuuuucuucagguuauuuaauccaguaauuuauaaaaugcucuucaguguuuuuaagaaaauuuaaacagugguagaccuaauauauguaaugccaacaccacauuuucuugguuggccugugccucugagaagcaguuccuaauuuucuauucccucucacaacuuuuuaauccacuaguuuuuuaaagcagccaguaacgagaccacgauacagucaucuuucuuucuuucugucuucagagguacuuauuucuauucuguuagguugcccaacucuguuuuauguugauuuugauguuaccaaagggaaggccuguuauaagucucaggaccagccuuugcuuacauauacaagugcauuuuguuguugacaaaacacugaugacuguauuuaugacauugaauauuuaaguuuuuugccauuauuucugaaauauucuuugccaaaauucaugcacagaaaguguuuaauuugaggucuccauugguucuuggcauuaucagccuaugaaaaucuauauaaucuauauauuuuucuuauaaacucaguauuuuagugccauugagaggauaugcuguuuucaaauaaauugauauaauucccuguauuucccuucuaccugcaccccuuuuggagucagcaccacuuggguggaaaggggaggacaguaguuuccgcugagaaagugucauccuuaaaugcuggaacauggaaaacuggcuacauuauguaucuugccuccucacauuuuuaucugaggccugaccuuauguccccuucguuuccuaugaaaaggcccuucgaacaggcaguucuccaauugaacuuuaaaacaauccaguuaauauaguuucauuacucuagcuucucuuacuuugaccaaauccauucuuuauuucacuucucagagaagugaagaaaugcuuuuuuauguuucuuuucuuaaucuaauaaaucauucuugguaaugcuucauuuucccauuuaggccuaccuguauguacauuguauuuuaucugauugugcaaauaagucuuuuuaauguaacucuuaugaaagucucccuuguuaaucaaauucaucuuuucuuucacaaaaguuccaugcuucaguauuguccacagcuaccugaaggaauuaguaaugugucauuuaaguguccuucaguauuucuaaauacccuuauaauaaugaagguaaaauuaaauuuaaauaaaugaucaauuagauuaacuuuguaagcaucugacuuaauuggaugagaacauuuccaaaauauuuaauauguaauuuuaaaauuccugaaggacuuaugaaauugcuuguucuuaaaacauuuaaagaacuuuaccuuggcugggcgcgguggcucacgccuguaaucccagcacuuugggaggccgagguggguggaucacgaggucaagaguucaagaccagccuggccaagauagugaaaacccaucucuacuaaaaauacaaaaauuagccaggcucgguggcaggcgccuguaaucucagcuacucgggaggcugaggcaggagaaucgcuugaacccgggaggcggagguugcagugaaccaauaucgugccacugcacuccagccugggcaacagagcaagacucuaucucaaaaaaaaaaaaaaaaauccuuuuaccuuacagugcauuuuauagcauugucaucuucaaagucaaaauggacauauaaacucaaaugccaaaaaagguuguaaaaauucaauaaaaaauacaauaucuagaacauuuaaauuauagcaauucuuauuagugaaggucuuaauaaucauaaaaguuuuaugaccaguggacaaaugauaaaugucucccuauuuucaccuagccuuuaagaaagccuuggugguggugacagcugucauauggucaacugauguaaggaguguaccugcuuuuacaguuacauaaauuugaacaaauucaugucgccccccccaaaaaaugcaaaagacauugugcucuaaagauauuuaacaucccuauacaguuaaucauuucuguuuaaauuacaaugcaauagauuuuaccgcuucaccaauccaguugguaggauuuuguggucuucaaauguuugaugugaucugucuucucugcaucuugcuuuacuuguguauguuguaaccaugauugaaccuaucccucuaacuuaauguugguuucuacccugucucaguguugucaguccuguuggcauuuuagaaauucucauuaauuuugaaaauauuuuuuguauuggagguauuuuauauacuuccccaaaugacaacuuuaauucaugacugaaaucuaauuaagccuaguauacuuccugcaguaucaaccccacuguauuuacaaagagaaugaggaggugacaagacacuuuuuauuucuugcugcccuuccagucagcccuuggaucacugcgcauuuccaucuggaagguugcuucuccucagugauuucgcauuacaggaggguuuuccuucuuuguuucucagaccugguccuguagacgggaaggagccuggacacagugacacauucucaaaggcccugcaggaccaccauggcuuaugaugacuccgugaagaaagaagguaugaccccauaaucugagaagcauuccaaaggggguauccucuucaauccuugcagcccauggauauagagaccaggacugggcaccacagccuggacucccaagugaugguccagagcacuguuaugacacucagccuccacgccauccccagacugggcccauggaaacgaaaaccaggacagggguuccaacacgagagucugaaauaugagucucuuaguuuauuggggugauccccugcagcacucuugguccuugccagcuccagugugcaggagucuggggauaggaaucacauccuggacucccacagagagcagcacagcacaugaauccuuauucuuuucagccuuucgucugcaagucuguguccuccuaccaaaucacaacucagaaaccauaucugagguugcacauggggccuuugcauagcauggaaacauuguuucuucagguuugauucuuguauuugcagcuaggucaucaagaaauauucuguuccccugggucuagcccuguauuucaguggacuugauugaaacauuguuuuaauuuggaaauagaggaacuguugcauuaccugcaugacgauuuggucauuacuuacuugacuuucucauuuccuuucccaaauaaaccugugcuucucagauuguuuugauggugaucauaccuuugaggacauaggacuugcagcuggccgaagccaacgagagaaaaaacguucuuacaaagauuuuuuaagggaagaggaagaaauugcugcucaggucaggaauucuuccaagaagaaguugaagguaaguccugaaaauuuaaauuaggaaagucuuaaacuacucauuuuuuuuuggugaugcagaguuuuuuuuuguuuuuuuuuuuuuucucucauggcccaggcuugaaugcaauggcacaaucucugcucacugcaaccuucgacucccagguucaagcguuucucuugccucagccucccgaguagcuggaauuacaggcgcgggccaccacgccuggccaauuuuuguauuuuaucagagacaggguuucaccauguuggccaggcaggucucaaacuccugaccucaaaugauucaccugccuccgccucccaaagugcugggauuacaggccugggccacugcgccaggaaagucuuaaacuacuucuuaccauauuuccuaauauuugaagaaggaaguauuuuuuaauaacuugagaaaagaaaaauaaaacguuaugcacaucuauuuuuauuauuucuugugcuuuguuucccaaaaucaaaaaucaucaaagacaagagugguuacaaacugcauuugccucaucaucuuauuauuggucaauucuucuuuaauuauaggauagugaacuuuacuucuuggggacggacacacacaagaagaagaggaagcacuccucugaugauuacuacuauggaggugaggaugggaaugggcaacaggugggauaaacacaucgcugguucuuggagucgggguaggggaaagggauccagauguugcugacucaguggccuauuuaacaggacagugguucuuguucugagugccgauaaaccagugugaaggaggagagagguggagggcugguauuuuggaggauucagcauagaagaacagucugcauuugugauacaccagguaccagguuccuucuccccccaaucauccacuuaucuugugcccauuguuaucuagcaucccuuuugccauacguaguccucuggccugcaccugugggucacuucucaaccaguauauauccacucacagaaccaguuuucuuagcuauguuaugcacauagcugaugagacucaacuuucaccagaauggguuuguccugaacacagaaacaaaugauacucugucugcaaucugaauuguuaacuucccauaaucccacagcuauagucaguucuucuggguaugugcucuuugguugcuucugaagacucaaugaagagaaacaacuuuaguggcaagaacuguguccagggucagaggcagacucuaccaagccaagaagcacaagggcaucauuucucaauguuaggaaucaguuaaagggucucccuucaaaucauuccuguuagccucuuucucauguuagcuaggugcuuuugaugagagaggaaacuuguuagaaguugcuucccaucauauugacaguacuucucuugauuauuucuagauauuucgucuuuggaaucgucacagaagaaaaagaaaaaguccagcccacagucuacugauacagcuauggaccuguugaaagcuaucacuuccccacuggcagcaggcuccaagcccuccaaaaagacuggggagaaauccucuggcucuucaagccauucggagaguaaaaaggagcaccacaggaagaaagucaguggaagcaguggggaacuaccccuagaggaugguggcucccacaaaucgaaaaaaaugaaaccucucuaugugaacacagagacacugacccuucgggagccugaugguuuaaaaaugaaacuuauucugucaccaaaggagaagggaagcagcucuguugaugaggagucuuuucaauaucccucccaacaagcgacugugaaaaaauccucaaagaaaucagcucgggaugagcagggugcuuuacuccuaggacaugaguuacagagcuuucugaaaacagcccggaaaaagcacaagucauccucagacgcacauucaucuccuggcccugaaggcugugggucugacgccucccaguucgcagagucccacagugcuaaccuugaucuuucagggcuugaaccuauucugguagaaucagacucauccucugguggggaacuagaggcuggggaguuagugauagaugauucuuaccgagaaaucaagaagaaaaagaagucaaagaagagcaaaaagaagaaagacaaggagaagcauaaagagaagcgacacuccaaguccaagagaaguuuaggacuuucugccgugccagugggagaggucacagugacaucuggcccuccucccagcaucccauacgcuggagcagcagcaccuccccugccacuuccuggccuccacacagaugggcauagugaaaaaaaaaagaaaaaagaagagaaggacaaagagagagagagaggagaaaagguaaagcaucuuuuaagugugguggggguaagagauuaagcagguucuuccuggguagucaguggacuuuuaaguuaagcaguugagguaaaccacugggaauuaagcauguuugggggauauguuggaaugauauaaaguauaaaauauuaccaguagcccagucugucugauauagaagcaaucuuuuuuuuuuuuuuugagauggagucucgcucugucgcccaggcuggagugcaguggugcagucugggcucacugcaaccuccuccucccagguucaagccucacccucccaaguagcugaaauuacaggcacccgccaccacacccgacuaauuuuuuuuuuuuuuuuuuguauuuuuaauagagacgagguuucaccauguuggccaggcuggucucaaacuccugaccucaagugauccacccaccucagccucccaaagugcuaggauuacaggcaugagccaccaugcccggccuaggguuucuuaauagaguuauucucccauugugccaggaauagguuuaguuacacuguggcuuuuuccagcuaguucuuagaauucacagaaggagcuaaacccaauuucuuucacuuagcaucacugucugcuuagggcaguugggagaugucaaaagguguucuuugaguucauuuuuaaaaacagacuaucaaaauugguagaacaaugagcagucaaguuaacagaauagcuaaugacuuuccaccagcugguguuggcuacuuucugguauucuuuuuagugucgaauauauguucuuuuacugucugagugcuugcuguaugccaagcucaaugcuguagauaguaccaggaaguaaaaacacaagcaggacauaguuguugacuuuagggagcucacuguugauuagggagauaggaaugauaaaucagucaccuugguuugauuucuuuccucauaacaguuucuggcagugaacuuuagggucucauaacuaugucauuaaaaguuucuuuuuuuauuuauaguucugcaaaaugcaaugucagauaaaaucuggaagaaaagcgacuaagaacgagaaaaucaaauguauuaagaaucuggggcugggugugguggcucaugccuguaaucccagcacuuugggaggcugaggcagguggaucccuugagcccaagaguucgggaccggccugggcaacauagcgaaacccagucucuacaaaaaaauacaaaaauuugccuggugugggggugcacaucuauagucccagcuacucaggagauugaggugagaggauugcuuaagcccaagagguggaggcuacagugagcuauaaucuugccacugcaacuucagccuggacagcagagugaggcucccugucucaaaagaaaaaagaaaagaaucuaggaaugggaauuuaguuugaucucugagguggaaguuauuucuccacuauaaagggugccuuuuaagaaagucugcuuauaucuaucuguuuauaucuaucuguagaucuauaucuguuuaucaguauguguguguguauauauaauauauauaaaauaauauauuauauauauauacacacacacaucuguuuaucucaaaaaaaccacaaagcuguaccucugagccaggaaucagugugaacauaaagaccuggauauuccaauacuaagucagguuuuauucaguuguuuauuuggaaaauugcuuuaugaaauaaacacuauguguucuuuauaagauucuguuuauccuaagaauuuccagucuagugacgugauaaugccauggacuaaucauccagugcugaaugucggagcacagggucagggaaagcuugaagaaggagaagguuucaguggaaguggacgcauggaggcagagagauguucaggaagcagcagaguaaaauaacuauaacugaacucuacuugugcaauuccagcugccugcuaaauauuucuacuugaaugccuuggguaccucaaacccuuaugucacuaauugacaugaccuagcuacaccuucuguauucccaguaucccgccagucaacccaaacucaaaacugaaugcuuaucgcuuuucucaacauuuuauuaugaaauuuuucagacaaaaaggauugaaagaauucuguaaugaaaacuguaucuccuccaccaggaguuuacaguuaauauuuucuuuuugcuuuaucauauaccugcccauccuuucauccaccaguccauguuaucuuucuuaauguaucucaaaguaaauugcagguaucauacauuucaccccuaaacacuucaguuugcauaucauuaaccugaguucaauauuuguuuucaggaauuuguaaauaugaaauuuacauauagggaggcugaggcaggagaaucgcuugagcccaggaggcaggugcugcagugagccaagaucacgccacugcaguccagccugcgcgacagcgugagacucagucucaaaaccauaaagauaaaauuuacauagggugaaaugcauagauauugaguaugugaugaguuuugauagaugcacacaccugugugaucaaaccucuaucaagauacagacauuaccaucaucccagagagcucucuuguaccccucuccaauccauccccaaccccagagccaacaacuguucugauuuuuuccagucuuaucguucacuuuuacauuucccccuucccuacuccccuccaacuauuucugcacaaauauuaagcuugauagucuuccuccuuaauaucuuucaagccuuuagcuccuccauuaccauugccacugucuuaggccucauucccuucuacacuuacuguaauaaguagcuuuuuuuuuuauucuaccgugcaguuaaucucacacauugaugcuagaguaaucuuaaucuuaaguagcaccuugaugacggcaguccuguguucugcaucuucaguggauucuuacugcuuuuuugguagacucuaagcuccaagaggaccaggaccacgucugucuugcuaucccuaguguauaaccugccaucuggccuauuguagacagucaguaaauacuugucaaaggaauaaauaucagguaaguugaaaccuuagccaaacauucauuaagugucuggauuuagccuaauccucccuuuucagcuuuaccucuuauuagucuauuaaacauacacuguauggaaaucagacuuguuucccauacauucuuaccucuauuccuuugcucauuuuuuacagugaccuuccucuucuuacauauugaagcucugcccucuuugcaagaccuaaucaaaugccaccucuucuaagacauucuguacaccccucauuagaauuaacgucuaaacucccauauuaccuugcugucuuacugcacuuauuuucuuccuuauauuggcauuaucuuuguacauauucuguuucccuuauuaaagacuauaagggaagacugaugcuuagaauucauagaaggagcugggugcaguggcucacaccuguaaucccagcaguuugggaagcagaggcagguagaucacuugaggucaggaguuggagaccagccuggccaacauggugaaacccccauuucuacuaaaaauacaaaaauuaucugggugugguggcaugcgccuguaaucucagcugcucuggaggcagaggcaggagaauugcuugaacuugggaggcagaggcugcagugagccgagauugugccacuguacuccagccugggugacagugugagacugucucaaaacaaacaaacaaaauagaauucauagaaggggcuacacccaauuucuuuaacuuagcagcacugucugcuuggggcagaauguaagcuccuuuaccaccuuauaguaucuucaacucuucaauguccuuaauaagcacuuuguaaguauaugucgaaugaauauguggaugaaaacauaguacugaaaagguagguugggagcaaauuguagagaaucuuaaaugccaaaguaaaggacuuggcagcaggcaguuugggguuuauaagcaagguuuauuuaugaucuaaaugauaagaauaaaaugauagaguuguacaagguggauuagaguagggagagacgaauaaccaagggaguuacuauaguccagaagguuaguaaugaaaaucuaagagacaggaggaucgcuugaguccaagaguucaaggcuggccugggcaaucuagcaagauccagguguggugacgcaugacuggagucccagcuacuccugaggcugaagugggaggaucaguugaacccaggaguucaaagcuucugugaguugugauugugccacugcacucuaaccugguugacagagcaagacccugucucuuuuaaagagaagaagaaaaaaaaaaggcuugagagaaauaaaauugaagagguugauucaagagaggcucugaaggaaaaauugacaagaucuaccuacagcagggguccccaguccccagaccacagaccaguagccguccgcggccuguggggaaccagccacauagcaggaguugaguggcgggcaagccauugaagcuucaucucuauuuacagccacucccugucgcucacauuacugccugagcuccaccuccugucagauuagcagcggcauuagauucucauaggagcacaaaccccagcagguuccuuaugagaaucuaaugcccgaugaucugucacugucucccaucacccccagaugggaccaucuaguuggaagaaaauaagcucagggcucccacugauucuacaugauggugaguuguauaauuauuucauuauauguuacaauguaauacuaauagaaauaaaaggcauaauguaaugaaugcacuugaauuaucccgaacucugccccuaccccugccccagguccauggaaaaauuguuuuccacgaaaccgguacccggugccaaaaagguugaggaccgcugaccuagugggcuuguaucugggaagccagaaacauaaaugagucuaagaaauaucucuucagcuuugaaccuagauaacguuggaaaaauaguaagcucuucaaaguuaaggacuuaucuauaauuugcccauguggcuagcaguugcuagugaaaaaugaauuuuaauuuauagcaaaaaccuuauuaagaguuaauaucuuugauuguggcuguccaaaaaaucugaaguagucauaaucugaauuuaaucauuuauuucuccaacaaauauuuauaguguauauacugugguuuuuaaaccugauuugugcauaaaaaauuccuauaaagcuuuuuaaaaauauauuuuccuggguuuuguuucacuguaaaaaagaacuguauaaaagucagggacaggcaggcgcaauggcaugcaccuguaaucccagcuacuugggaggcugaggugggaucacucaagcccaagaguuugagaccaaccuaggugauacagcaagacucuaccucuuaauuuuuuuuuuuuuaauuagccaggcaugguggcaagcaccugaguuucagcuacuuaggagggugaggcaggaguauugcuugaacccaggaguucacaaccagcugggcaauaugacaagacccugucucaaaaaaaauaaauaaaaagucagggacaaaguccacccagagauagaaaagaaugauuuaggaguaguguuucuucaaccuacagugagcagagacuggagaaacuacugguagaaaugccaaaggccucugugcaccccuucuaccuuagauucuaggaccaggacucuaauaaaaauagagaaggugagaagaauagcugguuugggagaagaagauaaguuaauugagaucgggagauucaacauagcuaagucguugagagcgugggcuguggaacccaccugaguucaauuccuggcucuauucacccacuuacaaacaaugugauguuggauaaguuacagaacaacuccaucucuaaguugaggauaacagacuugcuuccuaggguugugaggauuaaaugaggcaauacaugcggaaguguucagggccucggugugccaaggcgcucugggacgccacaucagacucaccaggacaacgcuugauauuuuaaauacauuuugagacaaacaacaauacuugacaucucucagauaccuuacgaacuacuaguucaaaguaauucccaguuucaacaauguauguuacauucuuuucaguagugccauaucuuuucaaagccaagugugugugcucuagagguaaaaagcaacuaccacauugaaaacccacauaagcacugugaaccaagaacauuggagaacuuugucuuugcacaaugcucagcacauuagugagcauucaauaaauauuauaaucaucucaguggcaauggaaguucaagacccagaauuuggcuggaacuugggugagaaauuggguguucaugugugauaaaugaaauagguaaauggauaagaggaaauugagcucagagcagaauuuuguagaacacuuauacaggggcauuuauauaagagaaggaagagggggcggcuauguuggaggagaaacacagaagggaggagaaaaacaguuucaagaguagaacaaucucaugcuagagaggccaaggaguucaagugcaguagguaggaauggagcuggaucagggguugaggaaagagugagcgguguggaagugaacgcagcagcggugggcucuuacuugagaauuuugacugacacaaagaagggaaauuacacuauuuccugggugaaaaguagccuuucaguuguuuuggaggugguuuuuguuugguugguugguugguuuuacugguuuugaguccugcauucuaaggaagaguagagaaauuauaugguaauaucuugaugauuucccacuaaagaucaucucauugcaguggaagcuuuucauuuauauaggaggagcaggauacaguuacauuuuaaauauaccuuacuuuugguuuuaccccaaauaaaagcccauuuuuuugucacuuaaaauaauagccaggcgugguggcucacaccuguaauccagcacuuugggaggccaagguggguggaucaugaggucaggaguucaagacuagccugaccaacuuggugaaaccccaucucuacuaaaaguacaaaaauuagccaggcgugguggcgcgugccuguaaucccagcuacucaggaggcugaggcaggagaaucgcuugaacccgggaggcggagguugcagugagccaagaucacgccacugcccuccagccugggcaacagcgagacugugucucaagaaaauaaauaaauaauaucccguaauguugccauuucagagacaugccuuuaguuaucuguguguuuccaaaauaugcacauuuucucuaaaccuaaggcagggccagguagccuaaugccuggcacacccagacauuguugaucuaauaaacaaaagucugaaacauaacuagacuugugaugcuguuacauuaguucucucucuggcaaaccugaggcuaaguaacagcaacaauaaaugguagaaauuagucacuaccaucuauugagugccaggcucuccuaggcauuuuccgaauguuaccacucuugauuaauaauuaucauuagccccacugacggaggaagaagcuauaaucuuuccacuaugccacaugccuuuccacaacuuuaagacaugguuacuccgugccaugauagaucuuugacucaaauucagcagacuuggauucuuacucuggucugccacuuacuaggucuguucuccugagauugcuuucucacuucugcucauuuguaaauugggguuagauuaaauuagguggugcauguaacaugcuuagcacagggcauggcuuaguaaaugucagcuguuacaguuacuuucgcuuacgucuuaaguucuucaaaagcacaaaauauauuugaaaacaucuuuuuaaaauuuuguuuucagccacucauuucacauauuagacuaagcaaggagacuauguuuuaugcauauaauacccuaccuuaauauaaccucccaccuuuaggaaccaaaucugugauuacaucacauauuuggaaaauaguuaagaaccagaaagaaaacagggccucuaaggagcaaaagcagauguuauaaaaccuacagcucauuggagagcuucaucgucacuaaaagaaggaccagugagaugaguccugugaccucucugccucuguuccuuuaugcuuaaaauggggaauuagcacccagccuacuucacuuacaaggauguuguggaaaucagaugaggugccacacaugaauacacacuuggccucuucaugcgcaguucugagacuuugcuauucaauaguacauauuuacucugcucuuaaauccucccaggcaguaaggacacaaagaugaagauacagugucugcucucaaagagcuuucagucuaguaaaagguuggaaaggacuugguguguugaacuucagcagaggcaugggcgcggaguacugagagagugcaaggaaagcccggaauggcuggcuuccugugagagcugucauaugaaccaaaucuuaaggccaaguaggaauuaucagguggaaaauaggaguaggcaccucagucauggaauggaaaauaucugugaagucccugagacgccagagggcacaggauguucagagaaacccaggaaguugauaugacugaagcaaagucagcgaaagguauguagaaggcaggaagaauugcugccaggcuggccuucuaggaaggggcaggagaacugaguaggaauuggcaaagcacaauccuaacagcuguacauguagaguuccucguauguucuaggcacuacacuaguuuuuuaucuacuauguaucacugaauuuucacaagaacccaaugagguguagguguugucaucucaguuucacagaaauaagcuuaaauaaacgaaauagcaugccccgggacauaccuguucauggcggaacaggaauuagaacccagguuuuucugacuacaagagccacgcucauuucaauauacagaaagugguuaaauuauauucauugauguggugugacagauagcagaaguauagaguacauguagaaagauuuucauucaagguaguuaaaauaaaaacuuugguguagaaaccuuacuuaucugcugguuuuccuuuuagccagaucagauuuggggaucucagucaaguuaguucagaagagcaucaggugguaaaaugguuacaaguccaggcuccaaagccaggcugccuguguuuaguggcccugccacuccguggagcugugagucuggaugucaguuucuucauuuuuacacuggcaggaaugauggaacuuacuucauaggguuguuaugagguuuaagggaauuucuauggguaaaggucuuacaacaguggcucguacguaguauuaacaucaccaaauuucuuuuuuuuuuuuuuuuuuuuuuuuuugagacggauuuucgcucuugucgcccaggcuguaguacaauggugcgaucucagcucacuacaaccucugccucccggguuuaagugauucuccugccucacccucccagguagcuggaauuacaggugcccaccaccacacccagcuaauuuuugucuuuuuaguggaaacaggguuucaccaccuuggccaggcuggucuugaaccccuaaccucaggugauccaccugccucggccucccaaagugcugggauuacaggcaugagcuaccaugcccagccaccaaauuucauuuuuuagaaucauaagcaguauugugcuuuaacucccaaauauuguauucuuuaaaacagggucuuaaacuagaguuaugagauuuucaucagguucuuacaguucuaugacccaaaaaaguuaagcaggacacuuuauaaagagcauuaacaaguugcauuuugggccaggagcaguggcacacaccuguaaucccagaguuuugggaggccaaggcaggaggaucacuuaaaccuguucaaggcuucagugagucguaaugagccacugcacuccauccugggugacacagcaagacccuguugcuuaaaaagaaguuacuuuuugaauauucuugauacugugacauaccucaucaaauauuuaaaaggagauccugguaguaaaaugguaacaucaugagucacauguaguuaaguggacuuguugcaaguaauuugcuacuaauaauaaaguauccaaguuuuaaaaauauuaacauuuuauuaauuaaagaagggucuguguaucccagcuguaaucuugccauccuguauguuuucuuucaugagaaaauuuagaguggaauuacuggccuugcauuuggaaucucauggaaauguuuuguauuuauagagaucauccucuauuuguauauuuuuaauuuagaaaaaugugccauggaaaauuuuuaacccuuaaguuugaaaucugaacuuuagguccacagacuagaguugcaucuuacacagugguuagguuuuaagucagcacgugaggcgaacaguguaaguagucagaguuucccuugaaaauccuuuagaaaggcucuacauugaaggcugacagagucucaguccaacagaaugucauucuagugcagcuagauuuuucucuccaccaccagaugaagucauuggccuuguucaggaaccaugauuuuauuucauuuuuuaaauuaccuuagcuacaaacgucagaaucacacuuguguaacgaguugcccacacugagagagacacagaaacuaucuggggagaagagauuuauaucuccugucccacucacuccaagguauagguucuuagaguggaaugaguggcagguggaacacccagaauaauuaacccacaccccgccaaauggccacgaguacccuuuacaugaacucaugggcgaggguguguauguguuugggugugcguguggugccucuccauuguaucuuaggcccaauaaaggaggauuugaaagagaggauccuuagaacacuuaagacauuaggagauaaaaagcugauacuaaauuaguaaaggagauccagcacccacaacauacuucuuuaccaucucuaaacaggacuggcuucaccagaagaauacuaaaauaguguuuuuaguuugguuugcuauuucaaugaaaaacuuuaaaauaaaggucuugcugcuauuugucugauaaaggucaaaugauuucacccuauccuccuucaccacaauuuuuauuuuuuaaaaagcuuauauugccuuuuugggugccacaacuucuauuuuggaaaauguauaaggaauagaaaauaauucauauuaguuuucucuuguggcauaaaaaauuaucacaagcuuagcaauuuaaaacaacauccauuuacugucucacaguuguguagaucaaaguccuucuggaggacucaacucgguucucugcucagggucucgcaagacugaaaucaaggcguccaguagagccagguucucauccgaggcucaagcucauucaaguuguuggcagcuuucagucucuuauaguuguagaacucauagcaauuuguuuucuucaaauucgagaccagccagagacugucaugccuucuugucucauuuuauuuguguguuucuuaauguugguucgaugcaaggguuuucuuuguuuuguuuuuguuuauguuuuuguuuugagacacuuuuacucauguugcccaggcuggagggcaauggcaccaucuuagcucacugcaaccuccgccuuccagguucaagugauucucaugccucagccuccccaguagcugggacuacaggcacaugccaccaugccuggcuaauuuuucuguuuuuagaagagaugggguuucaccauauuggccaggcugucuugaacugcugaccucaggugaucugcccgccuuggccucccaaagugcugggauuacaggugugagccacugcgcccagccaaugugguuucuauucaugugaaauuuguucaggaaacucuuuuaagauuuuauuuuuuugcagcagcagcuuuagguuagcaaaauugagaggaaaguacagagguaacccauauaucccccgucccacacaugcacagccuuccacacugucaccaucccccaccagacuaguacauuuguuacaacugaugaaccuacauugacacaucauuaucacccagaguccauaguuuacauuggggcucccucuuacauugguauuguccauucuguggguuuggacaaauguaucaugacacguauccgccaucacagucucaggcagaguauuuucacugcccuaaaaauccugugguccaccuauucauuaccucccuggcagccacugaccuuuuuauugucuccauaguuuugccuuuuccagaaugccacauaguuggaaucauacaguaucuggccuuuucagauugguuucuugcacuuaguaauauguccuuaaauuuccuccaugucuuuccauggcucgacccuuucuuuuuuuccuguuagcacugaauaauauuccauugucuagauauacuacuacaauuuauucauucacugauuguaagacgucuugguugcugucaaguuuuggcaauuaugaaugaagcugcuauaaacuuccaagugcagguuuuuguguggacaucaguuuucaacuccuuuggguaaauaccaaggagcacagcugauggauuauauguuaagaauguuuaguuuuguaagaaccaccaaacuguuuuccaaaguggcuguaccaugggaucucagccccauucguacaaggaucuuggccugucucauuugccauugaguucccaauaccuucaauauaucuugccugaaagaaugagugacugaauauucuuaggaaugagucuacccaagaaaugucauuaaaccccuuccaaaccaccaccuggggucuggggcuuuuaaauuuuauguauuuuuuuuuaauauuauuuuuuuuuaagauggggucucacugugucacccaggcuggagugcagaggugcaauccuagcucacuacagccucaaacuccugggcucaauugauuaucccaccucggccuccugaguagcuggggcuacaagcaugcaccaccacacccagcuaauuuuuuaauuuuuuguaaaguuggagucucacuguggcagcauagcaagacugcaucucuacaaaaaaaaaaaaaaaaaaaauuagccaggcaugguggcacgcacucguagucuuaacuacucaggaggcugaagccagggaaacaguugaauccaggaauucaagacuguagugagcuaugaucgcaccacugcacuccagccugcaugacagagugagaucuugucuuaaaagaaaagagagagagauuuuuggauaauaguucuuaaucagcuaugccccuuguaaauauuuucucacagucuauggauugucuuuuuuuuuuuuuuuuuuuuuuuuuuuuuuugagacggaguuucacucuuguugucuaagcuggagugcaauggcacaaucucggcucaccgcaaccucugucuccuggguuuucaagcaauucuccugccucagccucccgaguagcugcaauuacaggcaugugccaccacacccggcuaauuuuguauuuuuaguagagacaggguuucuccauguuggucucgaacucccgaccucagaugauccgcccaccucggccucccaaagugcugggauuacaggcgugagccacugcgcccggugucuuuuuauuuuuuuaagugucuuuugcagagcaguuuuuaauuuuaaugaaccccaguuuaucaguuccuucuuccauggauuaugucuuugguuucuguuucugaaaaguaauugccaagcucaagaucaucuccuguguuacugucugggaguuuuauaguuuuguacuuuacauuuaggucugagacuuauuuugaguuaauuugugaagggggugaggucugugucuagauuccuuuuuuuuuuuuuuuuuuuuuuggcauguggauauccaauugucccagcaucauuuguugaaaauacuaucuuuucuucauuguauuguccuugcuccuuugucaaagauucguugacuuuauuuagguagauuuguuucugggcccucuguucuguuccauugauguauuuguguauucuuucgcuaaugccacacugucuugguuauuguagcuuaauaguaauauugaaguaggguagugucaguccuucagcuuuguucuucaucaauacugccuuguccauucugggucuguggccucuucauaaaaacuuuagaaucaguugaugucuucaaaauagcuugcugggcuuguugucucuuuuuugugcucaccugcuauggucaggcccagucaggauaaucucccuuuugacuaacucagagucaacucacuagagaccuuaagugcaucugcaaaauccccuugccauauaacguaauaugaccaugucuugcccacccuuacgggaaugcaaacccaggagcaggggucuugggggccaucuuauaauucugcuuaccacaaaaauaacauugaguaccuacugaagugccacacaccaauggaguaauucccaccuuugaguuaaaugguauuauccaaguuuuguagggaaacgaaaugucaggaaaaugaagcaauucacguaacgaguaaauagcguggucaggauucuaaugcagauucgcuggucuucaaagccauuuugccacacuaucucuaauaaauccugucacaucuuccuccuucucaguuuauuugcuuuucucccaacccacugucuugauugugggccaucaucauucaucccuuccccgcacuccugcagcagccuccugauuggucuuccugccuuugcucuuguucuucuccaguuuguucuccauaguccuuaaguguaacccugacuauauaacuuccugcuuaaaauacuugaauggcaucuuccggacagaauccaugcacuuuaauauggguuacauggccucaguugaugggcucugccugccuuucuaacaucaucucuuaccucucucuucuuuggugaaugugcccccauguuguuuccucugccuagaacacucuuaaccacccuucaucugccuacaucuacccaacucucugguuuagauuaaaugucacuuccuccagaaggcuuucuuugacucccuaacuugggaaggcacuccuacuacauguucccauagcacccaaugcuuucccuauaauagcacuguguuuuauuagaaugacauauuuaacugccucauuuguuagauucugcaucugauccuuaucuguauucccagugucuggcacauauggauacucaguaaauauuauuaauaaaugaauaguagaauacuuuaauggguuacuuuuuuucuacuaccuuugaaaucuuagucucugcuuuuccuucauugccauugaaauacuuuuacuaucacauauuagaaaagcuauccacuucccauguguuuuauucaggauccaauaauuaguauauggugaagcugagacaagauugugggucuuuaaacuguaaauuucauguguuuuccacuauuuuaugcagcuuaacuuccuuagaauuagaucuaggcuucaaaagcuuauccuccuaacuacuugcucuaccaccacccagcacagguacucaauaaacgcuaaucuaguuucuacauaaucgaauaaaguccuuuauaagaguuaugaaggaaacccuuuucuucaguaugugaauuuggaucuauaguauauuggccaagaauugugauuagugugacagcuauaguuagccuuauagaauaggaacauuaaccuuuuacaguauuguguuugagaaaacguuguuaaacaccuuccuuguaaguuuuauaauauggccaaacaagcugugaaaucucucaagcauauauacuuucuaauguucucaguauuuaauagugagauugauuguacaguugggaaagauuuggcaguguguagacuuccacaaauuuuucuuucaucauguauucuagcaaaugucaggcauauagauaagccauuauuaaaauauuaguaugaaauuuaacaaacauaccacaaauuuuaucuccaaauaagugcaaucucauucaaagcaguuaccuuggaagguguucuaggaauguuucuauucaucaaaugauuucagaaucgcuuuuggaauuaaaguuggagucaucacauaagcuuuuuauugccaucagccucggucuuuguccuuugagggucguuauuuuaugggaacaacaugaagaacuaaggcagcuaggcagagugcacgaucgagcuuuguuuaaagcaagauacaacucugaaguuacgagacaggacuguguggcugguuugguuuucaucacaaaaccugacucuuaaggcaaacaaaagcccccaagggcuuuuaaagcaccauacauucaugucauauuuuuuguuguuguugaaacggagucucgcucugucgcccaggcuggagugcaguggugcaaucucggcuuacugcaagcuccaccucccggguucacaccauucuccugccucagccucccgaguagcugggacuacaggcgcccaccaccaugcccggcuaauuuuuuauauuuuuaguagagacgggguuucaccguguuagccaggaugaccucgugaucugcccgccuuggccucccaaagugcuggauuacaggugugagcuaccccacccggccacauucaugucauuuuaauaacuguagggccaaaaaggacuaggaguagaugaaagacggagaaucauauuuugaugcuuccagaugaguuuuggaggaaagccauacugaaaauauuuguuuguuagauuaagauuauuaagugauaacucuuucuuuauuuuaaauaguuaacuuuuucuguaagggagcaacauauguucuuucuugggcccauaaugcauggcccugaaagucagggcuaccuggguugugguuauaacugccagggucugguauuauuacuagcuuaguggugguacccucagcaaguuacaguuucucugacuuuauuuuuucccaugcucacaaugagaaauuuggauagaugaaucuaauugcaugucucuuucuagauaggaaaaacuuaacuuuuuccccuuagaccacguauaauugugaaauggaaugcauagaaauauaaucuucuguuuuauauauuucuuguugaacugacuuuaaaaauaauuugauuuuguuucucaaaaaucauauauuccuuuuggcauugucagaauauagugaagaacaaacaugccucagguaguacagagcuguuuguugaagugaaggcguugcaucugacagugacuaccaaagaauugucuucaguuauuuguucacuucucaccuugaacccaaagaaugugaacaaucaaauaaugagaagcuacaaaugacaauaaaagcaggaugagggaaauuacaagauuagaaaucaaaaccagagaagcaaaaagaacauagauuuggcuuuuggguuucuggcuccaaaguuuaaaaggaaauuaugugguucagauuuucaaagaugagaaaaauagacaccccaggagugguaaagauucucuuagcacuuaauucugaaagaaauguguaacaugggauuguauauagggagaaggaaggucuuuacaaguaauuuagcaugugguuuuuaccuacuaaaauuaaaacugauguucaucucugagugguaaguaacauggauuaaaaauguauuuuccuggccaggcaugguggcucaagccuguaaucccagcacuuugggaggcugaggugggcagaucgccugaggucaggaguucgagaccagccuggccaacauggugaaaccccaucucuacuaaaaauacaaaaauuacccgggugugguggcaggcaccuguaaucucagcuacucagaaggcugaggcaggagaaucgcuugaacccaggaggcggaaguuauagugagccaagauugcgccacugcacuccagccugggcgacagagugagacuguaucucaaaaaauauauauauauauauuauccuguuuaggaaagcugguuaguaguuuggaacucuucccuugaugaaaaaguuuagguauccuucuauuuuauuacuauggauucaggguuacuaaaccuggguucuaaucaagucuuacccuguuguaucuucuaugcggcauuagccaaaaaagaagaacaugucggccuaccagguguucuguaaagaguaucgcgugaccauuguggcugaccauccagguauagguaagaacauuacugaucuguagcgcuuuugcuuuccauuuauaucuugaagcagugcgauuaauuucuucuuccuguagcauuagagcauaaaucuuguuucuuuccucaguucugcaaaucacuuuagauuuugccuuaguuuaucucaucuguaaaagagaugaacuuucuauacauaucucuuaaacggauaaggugggaaacuauguaaaaauaaauguuguaaagcacauacauaaaugcacaaaaauauacaauuguuuauuuccaagauucuacaauuggccuuuuccuuaaauugcccuuggauguaaaguuauaaugagauaucuuguauuauauuguuguaaagaugcucuucaacuuaugauaguguuacauccugauaaacccauugaaaauugaaaauacuguaagucaaaaaugcauuuaauacaccuagccuacagaacaucacagcuuagcugagcccaccuuaaaugugcucaagacacuuacauuugcauacacuugggcaaagucauuuaacacaaagccuguuuuauaauaaaguguugaauaucuuauguaauguauugaauacuguacugaaagugaaaaacagaauggcuguauggguacuagaaguacaguuuuuacugagugcauauugcuuuugcauccuuauaaaguugaaaaaucaaaagucaaaccaucauaagucagggacuguauuugucucuguauuagaaguuaaugagguaagaaaaacacuauaccagagauccuggacacaugucacuuaaccgcuacaaauuucauuugccuaauguguaaaaucgcugcccuaccaacuccaaaagacugcaguguuaggcacacaugaauaugcuuuauaaagcauaaaacucuuauacaauggaaggguaagauuacacaucuagaggauugcuucugagcugcucuagggaaauccuucuuugguucuaaucauucagaaauuugguaaaaaccuaacaucuuuuuucaaauucuacacauauuuuuuaaccuaaguugauaggccuuguauugugggaucaaauuaaagacaccagaggcaggaugcaguggcucaugccuauaaucucagcacuuugggaggcugaagcaggagaauugcuggagcccaggaguuugagagcagcuugggcaacauaacgagaccucaucucuacaaauaauaauuuuaaaaaauagcugggcgugguggcucacgccuguaaucccaacacuuugggaggccgagguggguggaucaccugaggucaggaguucgagaccagccuggccaacauggugaaaccccgucucuacuaaaaauacaaaaauuagccaagcauuguggugcacgccugugaucccagcuacuccggaggcugaggcaggagaaucacuugaaccuaggaggcagagguugcagugaguugagaucacgccacuucacuccagccugggcgacagagcgagacuccgucucaaaaaaaagaaaaaagaaaaaaauuuuaaaaaauuagcuaggcaugguagcccacgccuguggucccgcuacuugggaggcagaggugagagggugguuugagcccaggugguugaggcugcugugagccaugaucacaccacugcaauccagccugagcaacagagccagacucagucucaaaaaaagacaccagaaagaugcuuaaggaauaaaucccuagggaguagauggguuacgaguugagacugucuccugaccaucaaaacauccccuucccuauagaaaaaaaucaaagaagagugaugggauugggguugguuuucugaaagcaucuugcaacauuuaaauaugagcuucaaaacccuuuuccaguuuuugcuuucaccaaucuucuauuuuguuaauagcuaacccuuuacuguauugaguguuuuacucuuuuaugccagauuuuggggaacuuaguaaaaaacuggcugagguguggaagcaauuaccagaaaaagacaaacugguaaguacauuuucuuacaaacauauuuuucagugcuucucgccuuccaaaauauguaauucuuccauagacuagccagccagacagcacugaaaauagugaagaaaauuacaaaucaacagaaaaugguuuagcagaggacauuaacacuguuagugccaguucacuguacaugaggauuuagcuauagcaaggcugucuuuucuaaccuggucuguuuuuuccagcaguguuacauuugagccaaaagaugaccuaaguugaggaguaauuaaaguguuaaaagaaagucuaaaaucagagcccuuuacugcaaacaccuaguaaucagucauggucugagaacugaggaaaguuauccacuuagcagucacugcaaacaauaaaaauaugagaaugugauuacuagguaaccagguucaaggucaucauccucaucaaccauuaccaaauaauguacucuacuaucaagaagguaguaagacacugauaaacagucauaucugggcugggcacgguggcucacgccuguaguuccagcacuuugggaggcugaggcgguggaucaccugaggucaggaguucgagacaagccuggcuaacauggugaaaccccauuucuacuaaaaauacaaaaaauuagccaggcaugguggcgcaugcccguaaucccagcuacucgcgaggcugaggcaggagaaucacuugaaccccggaggcggagguugcagugagccaagaucacaccauugcacuccagcuuugggcaacaagaacaaaacuccaucucaaaaaaaaaaaaaaaaaaaaagucauaucugaaucauugagacuuaugauaugaaggucauauaggagcaagaugucaucuagaugaacagccauucuucacccagauuauccuuaguuuuuguuuuccuuguuauuguuauucugcuauuguguugguauugccaacuagcagguuaguagaaccacauagacauuauauugagccagagguuuaaucugugauuuuacauuucaacuuagagugaucuaaaaaucagugccgagauuugaccauuagcauugaggaauguuuauaguccuuuacuaagauauuaauguagucagcugucugaagucaguucggugacccccagcuuaaaaguuagcauuaacccucugucugcccgccucuuacuauugccuuucuuuucuccauuuuguucuuucaugacugcuuuuccuuuuacauuuuguccuucuuaauuuaauuuaauguucacugaugugauugcagauuuggaagcaaaaagcucaguaucugcagcacaaacagaacaaagcagaagccacaacugugaaaaggaaagcauccagcucagaagguuccaugaaagucaaagguagugaccacaucccgccccugcuuuucucuaaagcaugugaauuuugcuuccuugcuaagaaacugggaaaaaagcuugcaguauuagaaguggaccuugauucccagguauuauuaccugggaauguuacaagcuaccaaaaagagauguucaaauuuagaaaaugcaaaucagaagucagcaaacuuuuucuuuaaagguccagagaguagaccaggcgcaguggcucaugccuguaauccuagcacuuugggaggccaaggugggcggaucaccugaggucaggaguucgacaccagccuaaccaacauggagaaaccccgucucuacugaaaauacaaaauuagccgggcgugguggcgcauaccuguaaucccagcuaccagagaggcugaggcaggagaauugcuugaacccgggagguggagguugcggugagccgagaucgugccauggcacuccagccugggcaacaagagcaaaacuccaucucaaaaaaaaaaagguccagagaguaaauauuauaggccuugugugccguaugcauucucgcauucucugucacauauucuuuguuuuucuauagcccuuuaagaauguaaaacuauuccuaacucacaggccauaaaaaacaagagaccauagacugaauuuagcccacaggccacaguuuugcuaaugccugguauaauucauaaaaagggaaaaucaggaagaacaacuuuguguuguucaaggcuguaggcaaguuuuaccugucugccucauugcucuguucucagccucuucuguaggaguacugucaccccagaagaaguccccacccaccaccaugcuguuaccagccucaccagccaaagccccugagacagagcccauugauguugcugcucaucuucagcuguugggagagucccuaagccucauuggacaccgucugcaggaaacugaggugaauacaacuaucagcagcaugacuacaguuucccauauaguuucccauauaauuuugauucauucacucauuuuacauacauguauugagcaucuacuuuaugcuaaauuaugccagguucucaggauggcguaacauagaagauauaaugauaauaacagaaauaucuauagagauauucagucuaccuguuagcucucaaaguuucacuaaugauauccuauugaaacaauggcacaaaaagaaauuggaguacccuguaacuuauuuuuauuuuuuuaaaaugcaguggaggcugggcgcaguggcucacgccuguaaugcuaauuugggaggcccaccugggagaaucgcuuaaggccaagaguucgagacuagccuggucaacacagugagacuccaucucaaaaaauacauauauucaaaaaauuuaaaagaaauaaaaauggggccgggcgugguggcuuaugccuguaaucccagcacuuugggaggcugaggcaggcggaucacgaggucaggaguucaagaccagccuggccaauauggugaaacccugucucuacuaaaaauacaaaaauuagccaggugugguggcaugcaccuguggucccagcuacucgggaggcugaggcaagagaaucacuugaaccugggaggcagagguugcagugagucaagauugcgcuacuguacuccagccugggcgauagagcaagacuccaucacaaaaaagaaagaaagaaagaaagaaaaacgcagugguggcugggcacgguggcccaugucuguaaucccagcaauuugggagaccaaggcaggaggaucgcuugaggccaggaguuggagagcagccugggcaacauagcgagaccccauuucuacaaaaaauuaaaaaauuagccaggcaugguggugcacaccuguagucccagcuacucggaaggcugaggcagauggauugcuugagcccaggagcucaaaggcugcaguaagcuaugauugcugcacugcccuccagccugggugacagagcaagacccuaucuuuuuuaaaaaaacaaaaacaaaaaggcaagaaaaaggaugaguacaaauuccauagcaguuuugauuacuucugucuccuucuaagagacuuugaauuuuucucugcauuuccagcaaagucuugaauauucaauuguauaggagauuaagaguuccucuguuuugaaaauagguaacaaauggagaaguuaagguucccagcucuccauuacucugcacuuaaauuauacagugcuauaugcccuggggagauuuuuguccuuuuaagcuucaauuucaaaaaucacuuaaccugcacagcugucguguuucauuucuauuaccauauucaauuucuaacaauauuguccccuuagcuaacucauuaguauaguaguuccgcuuuccaccaaguucuaguaagacauuucagcaaagaagucagucuaagcuacuaaagccauuuuuaagcuaagaaauuaguguaggaauguaaaacuaaucacuugcuucaauguggaaauugaauuauucaacaaauaaaaugccaaaggccacaagagcugaagcuauaucuaaauucuuuggcuaguuucuaaaaauuuuagcaguagucaaaagaacuucagcaccuucauauaggcucgauaucugaauggauauagauauuuccagaagaaguauucuaugaccuuacuuauuuuucagauuuaaucauucuuacguuucguaagaaguuagaaguaaaaacaguuuguuuuaagcguauucugaauuuucccagauauuuccauuuaguuuaguaaguacaaaguucacccuuuuaaagugcagaauuuagugauuuuuaauauauucacagaauugugaaucacuacuauuucauuccaaaacauauuguuaccccuaaaagaaacccuguaccagccaggcgcgguggcucacgccuguaaucccagcacuuugggaggccgaggcaggcagaucaugaggucaggagaucgagaccauccuggcaaacguggugaaaccccaucucuacuaaaaauacaaaaaauuagcugggcgugguggcgggcgccugugagaggcugaggcaggagaauggcgugaacccaggaggcggagcuugcagugagccgagauugcgccacugcacuccagccugggcgacggagcgagacuccgccucaaaaaaaaaaaaaaaaaaaaaaagaaacccuguacccauuggcaguuauuccccauucucccucuaauccacuuuuggcccgaauuuaaucauuugcauagaucucugcaauuuuauaauuuccacauaccacuuaauacuuuuacuuacuuuauaauuuuauuuaaauaaacuugucugugcuuuuacagugacauucaugacaucucaaggguuauauucuauuuuuuuaauguacaucguaauggacauauaauuaucaaaauaauauguucaguaguaaauuaauguucaucauuuuagcaguaaaacuggaacauacaaugcauaaguuagaaaauuaaggcuagaggccgagcacuguugcuuguuccuguaaucccaggacucugggagccaaagugggaggaucaccugaggcuagcaguucgagaccagccuggccaacauggcaaaaccccaucucuacuaaaaauacaaaaauuagccaguugugguggugcacaccuguaauccuagcuacuuguggggcuaaggcaggagaaucgcuugaaccgggagguggagguugcagugagccgagaucacaccacugcacuccauccagccugggcaacagagugagacccugucucaaaaaaaauaaaaauaaaaauugugcguguguguggcgugugguguguguguaucuuaagaaaguuaaagcuagaacccaaauugcagagggacuucauagacauucugaaguguguauacuucacuguuggggaacuacagggguuuuuacaguggaaagggaugagaucagagcucucauuuacuuuucucugagaauaucuuuuauuuuagauuggaagugaaaagagaccagaauuggggagaaguuaaaacaauaauccuagucuagaugugacaaagauaaauuagcuauaaauaaauauagggcaaaggaaauggaacaauauuacuaauuacugacauuuuugggguuuuagcuauuaucuucccuguauacuaauguuuuauugaaggcucacucacccagcuuugguucagagugcuuaauaugaauuauaucauuuaauucacacugcagcuuugugaggcagaauuuguuccccccauuuuacagaagaauaaacagacuuaaagaggugaagucacuuucucuagaguuuagccccuaagugguaaaauagagacuugaauuuggaaugugaccucaagguccggguucuuaaccucuuacuguacugcugcccucagaaaguauaggggggagauguugacaaggaggaugagggaaaggaagagucagugauggcuaggccuugagacugggcaguuaugugaaugguggugacuuuggcagagaaauggaugcucaaaggagggcuagauuugcaugggaagguuauucuuccuuacaggaaguugagauggagaaauauccaaaaggagagacccaaaagacagccagaaaugcaguuuugaagaucaagauguugguaguaauauucauaauuacugauauuuuuugaguacuuaaccauguauuaagcaccaucccaaguauauuauaucuauuaucucaaucccaucugcugcagaugcuguuaguaucuuacaggcacagcauaguaagcaacuugccuagguacaaaacagugaguaguggagccaggaucuggacccgggcagucuugaauccggagcucauuuucuuaaggacugugcuguguugcuucccaauaugacauauucucacacugcuucuaguuaaagcagauuauacaagaacucggcagcagcaacagucuuucuuaucucuuugaaucacaaauagacaauaugaauuacauaaaauguuaaaauuugaaccaaauucacuuugagagugaacaacucaaccuagaaaaauuguauaaucagcuaucaaaagcuacauacaugcaggguuguaggauucucauaguaaucacaucugagcuauauuugucgaguuuauaacagauauacuuugcauacauaaucacaaaucuuaccaacagcucuccagaguagguaaagcauuuuuuacuguuccuguuaaggagacagaaguuaaggaugugaacuccccaaggucacucagaagguaagaagaugggcuaggauuacggaaagggaacaugggaaugugcuguaaaaguuuucuuucuaaacaacuuacagaguuaucaaaguaaacuuuccauuucugcuguaaaguuucaaauuauaagaguagaacugccuaggauuuaaaguacugugugaggaagucagccggaacacagcaucaggagugugacucaagcaacaaccuccucuccuuuucaggguaugguggcugugucuggcaguuugucagugcuucuggauuccauuaucugugcccuuggccccuuggcaugucucaccacacaacuaccugaauugaauggcugucccaaacaggucuuggugaguuuucccuggauuuuuagagucagauccauugggcgucagagaugcccugccuuaaugagcacugucagacacacauaaggcuuugugacacacagugcuuccuucaucuguuggcccauggaacaugaugcuauauuaucaaaugcaugcuguacuuucacugaaacuagaaaacaagccauuuaccaaaacaguacuuaagaaagcagcauucuagcccuugagguacuacaauuccuguguuuccuguuugcuauucugcacccaaagacaguacaggaauuguuucccucuuuuuuacgaggauuaaugggagaagucagcagaaaaguuccuagcauaacaaacagcaggaugccgucuucauucucaccuguuuuucuaacuccauuugauuuuucuuaucucucuccuugaacaaagaaacaucucucaggaaaccaagguacaguacucuucaguugaacauuuuucuuuguuuugcagucaaacacauuagacaacauugcuuacaucaugccgggacugugacagcaaagaauccugggacagaaaccuuauccuacaccauugcugguuuguguauauaugacuguugcagauuccuucaguggccucuggcuguagguuuuaaauuuuuauaucuauacauacauauauacauauauauauaauguacaauauauacauagacuguaacuacuuugcuuuuaauaauuuuaugaaauggcaaagguuuagccaagaggaaauuuuggcaugaauacaggcuugggauucuuuuuucuccugugguggauaaaucugccuuaaaaaucaauguaacuugggggcugggggcuuguucugggugccaagcgcaucucuuuauggacagcuaaaaugugauuauuuuccaagcucaguuggaccuccagacccaucacugaccauuugccuuaccugucuuagucugaaauguaauaggaaagauaacgggaagaugccaguugacugaaaauucaaagccuuucaauuugaagugaccuaggugggaggugauaaaauuuguucccuuuauaguuauggaaguggcuuaggugaauugaguagaggguucauuccaauuccuacuguauaggugucugugucucaaaauuuauuguaaucauugguaccauugguggccucaacagaggccaaggaguucugugagcccuggcagcaaaaaacaccuuggggggugaagcugucaaugccaccaguuggaccuccauacauucugagcuaacccagaaucuuuagucggcagaauuaagugcuggugucuuucacuggcagcaugaaguuagccaccaaguccucacaagccgugcugcuuaguugcucggugguuauggauaaacuuugcccagcaugauuuuuggguucaucuuaucaguuccccuggugggcagauacacaguguucugcauuccacauguaagugaauugcaaaaacaaaacaaaacucacucucuuguagguuuauuuaugugugugugaauguguauuuuaauuauguguauuuaacucuuuaaaaucucuuagauuuuaauuuauccuguaaauuucuguauauauaauuuaauaacagaagccuccaccagcaacagcauguggaagauacagauuugucauuucucccuuccgcccucccuucuuuccuuccuuccuucccuguuuccuucccucuuuccuuccuuccuccuggucuguuccaaaaacucugaaucaucuacauuuuaagguauuuuaccucaaaaaugaaucauuguguuaggauucuaauucuuuauaaagaacuucaugggcuucaauaaugucuagaaaguaaaauaaagaggaauguuaccauccccagcugcccuuauuuccagagaaccagacguuuguuucccaguuggaaagaagacaguugagcacuucaggaugguuuuuaaauuugguaugagauucucugccaacaccaagcucugaguuaacugugcuuucuucuccuggcccugacagagcacuacagcaucaaaguaaaucuuuggggacaguguagcccaucugcauccuauuuaauuucuucccuucuccccaccaguguugucacagggcuauguugcuuaaagguagucuggcugcugaaucccuuucucagcucagagcaguuuuaagauuuaauugggaauacagagaaacaggauuguuugagaaccaaaaucaagaggaacagaaaucuuaacuugauuucauguguuagaacauuguaccaugccucuucuguaucuguggaaguuuccuguuugacacaggguaucuaggaggggcggggaagacauggauaguauaggaagacauuaauccuagcauugucauuuauauacauuaaugaaauccugaugaggaccugcuuuuuguuuguuuuccuuugaaacccagcccuauuguauuuguauuuaaaauuuguacacauuuguauaauaaucuguaccuugugguauuugguacuauuagaggaaaaacuuuggauucagaccuucuugcaguuuuuauaucauuguuuuauuuuguuuuuuaaauaaauucuagugguuugauccaaaucccauuacaguuguauaaagaaauaaaauuuuguacuuauauuauuaaaaaucacauuuuuaauauuugua

SEQ ID NO: 191905 - RNA, 38356 nt, Homo sapiens
uacaaauauuaaaaaugugauuuuuaauaauauaaguacaaaauuuuauuucuuuauacaacuguaaugggauuuggaucaaaccacuagaauuuauuuaaaaaacaaaauaaaacaaugauauaaaaacugcaagaaggucugaauccaaaguuuuuccucuaauaguaccaaauaccacaagguacagauuauuauacaaauguguacaaauuuuaaauacaaauacaauagggcuggguuucaaaggaaaacaaacaaaaagcagguccucaucaggauuucauuaauguauauaaaugacaaugcuaggauuaaugucuuccuauacuauccaugucuuccccgccccuccuagauacccugugucaaacaggaaacuuccacagauacagaagaggcaugguacaauguucuaacacaugaaaucaaguuaagauuucuguuccucuugauuuugguucucaaacaauccuguuucucuguauucccaauuaaaucuuaaaacugcucugagcugagaaagggauucagcagccagacuaccuuuaagcaacauagcccugugacaacacugguggggagaagggaagaaauuaaauaggaugcagaugggcuacacuguccccaaagauuuacuuugaugcuguagugcucugucagggccaggagaagaaagcacaguuaacucagagcuugguguuggcagagaaucucauaccaaauuuaaaaaccauccugaagugcucaacugucuucuuuccaacugggaaacaaacgucugguucucuggaaauaagggcagcuggggaugguaacauuccucuuuauuuuacuuucuagacauuauugaagcccaugaaguucuuuauaaagaauuagaauccuaacacaaugauucauuuuugagguaaaauaccuuaaaauguagaugauucagaguuuuuggaacagaccaggaggaaggaaggaaagagggaaggaaacagggaaggaaggaaggaaagaagggagggcggaagggagaaaugacaaaucuguaucuuccacaugcuguugcugguggaggcuucuguuauuaaauuauauauacagaaauuuacaggauaaauuaaaaucuaagagauuuuaaagaguuaaauacacauaauuaaaauacacauucacacacacauaaauaaaccuacaagagagugaguuuuguuuuguuuuugcaauucacuuacauguggaaugcagaacacuguguaucugcccaccaggggaacugauaagaugaacccaaaaaucaugcugggcaaaguuuauccauaaccaccgagcaacuaagcagcacggcuugugaggacuugguggcuaacuucaugcugccagugaaagacaccagcacuuaauucugccgacuaaagauucuggguuagcucagaauguauggagguccaacugguggcauugacagcuucaccccccaagguguuuuuugcugccagggcucacagaacuccuuggccucuguugaggccaccaaugguaccaaugauuacaauaaauuuugagacacagacaccuauacaguaggaauuggaaugaacccucuacucaauucaccuaagccacuuccauaacuauaaagggaacaaauuuuaucaccucccaccuaggucacuucaaauugaaaggcuuugaauuuucagucaacuggcaucuucccguuaucuuuccuauuacauuucagacuaagacagguaaggcaaauggucagugaugggucuggagguccaacugagcuuggaaaauaaucacauuuuagcuguccauaaagagaugcgcuuggcacccagaacaagcccccagcccccaaguuacauugauuuuuaaggcagauuuauccaccacaggagaaaaaagaaucccaagccuguauucaugccaaaauuuccucuuggcuaaaccuuugccauuucauaaaauuauuaaaagcaaaguaguuacagucuauguauauauuguacauuauauauauauguauauauguauguauagauauaaaaauuuaaaaccuacagccagaggccacugaaggaaucugcaacagucauauauacacaaaccagcaaugguguaggauaagguuucugucccaggauucuuugcugucacagucccggcaugauguaagcaauguugucuaauguguuugacugcaaaacaaagaaaaauguucaacugaagaguacuguaccuugguuuccugagagauguuucuuuguucaaggagagagauaagaaaaaucaaauggaguuagaaaaacaggugagaaugaagacggcauccugcuguuuguuaugcuaggaacuuuucugcugacuucucccauuaauccucguaaaaaagagggaaacaauuccuguacugucuuugggugcagaauagcaaacaggaaacacaggaauuguaguaccucaagggcuagaaugcugcuuucuuaaguacuguuuugguaaauggcuuguuuucuaguuucagugaaaguacagcaugcauuugauaauauagcaucauguuccaugggccaacagaugaaggaagcacugugugucacaaagccuuaugugugucugacagugcucauuaaggcagggcaucucugacgcccaauggaucugacucuaaaaauccagggaaaacucaccaagaccuguuugggacagccauucaauucagguaguuguguggugagacaugccaaggggccaagggcacagauaauggaauccagaagcacugacaaacugccagacacagccaccauacccugaaaaggagaggagguuguugcuugagucacacuccugaugcuguguuccggcugacuuccucacacaguacuuuaaauccuaggcaguucuacucuuauaauuugaaacuuuacagcagaaauggaaaguuuacuuugauaacucuguaaguuguuuagaaagaaaacuuuuacagcacauucccauguucccuuuccguaauccuagcccaucuucuuaccuucugagugaccuuggggaguucacauccuuaacuucugucuccuuaacaggaacaguaaaaaaugcuuuaccuacucuggagagcuguugguaagauuugugauuauguaugcaaaguauaucuguuauaaacucgacaaauauagcucagaugugauuacuaugagaauccuacaacccugcauguauguagcuuuugauagcugauuauacaauuuuucuagguugaguuguucacucucaaagugaauuugguucaaauuuuaacauuuuauguaauucauauugucuauuugugauucaaagagauaagaaagacuguugcugcugccgaguucuuguauaaucugcuuuaacuagaagcagugugagaauaugucauauugggaagcaacacagcacaguccuuaagaaaaugagcuccggauucaagacugcccggguccagauccuggcuccacuacucacuguuuuguaccuaggcaaguugcuuacuaugcugugccuguaagauacuaacagcaucugcagcagaugggauugagauaauagauauaauauacuugggauggugcuuaauacaugguuaaguacucaaaaaauaucaguaauuaugaauauuacuaccaacaucuugaucuucaaaacugcauuucuggcugucuuuugggucucuccuuuuggauauuucuccaucucaacuuccuguaaggaagaauaaccuucccaugcaaaucuagcccuccuuugagcauccauuucucugccaaagucaccaccauucacauaacugcccagucucaaggccuagccaucacugacucuuccuuucccucauccuccuugucaacaucuccccccuauacuuucugagggcagcaguacaguaagagguuaagaacccggaccuugaggucacauuccaaauucaagucucuauuuuaccacuuaggggcuaaacucuagagaaagugacuucaccucuuuaagucuguuuauucuucuguaaaauggggggaacaaauucugccucacaaagcugcagugugaauuaaaugauauaauucauauuaagcacucugaaccaaagcugggugagugagccuucaauaaaacauuaguauacagggaagauaauagcuaaaaccccaaaaaugucaguaauuaguaauauuguuccauuuccuuugcccuauauuuauuuauagcuaauuuaucuuugucacaucuagacuaggauuauuguuuuaacuucuccccaauucuggucucuuuucacuuccaaucuaaaauaaaagauauucucagagaaaaguaaaugagagcucugaucucaucccuuuccacuguaaaaaccccuguaguuccccaacagugaaguauacacacuucagaaugucuaugaagucccucugcaauuuggguucuagcuuuaacuuucuuaagauacacacacaccacacgccacacacacgcacaauuuuuauuuuuauuuuuuuugagacagggucucacucuguugcccaggcuggauggagugcaguggugugaucucggcucacugcaaccuccaccucccgguucaagcgauucuccugccuuagccccacaaguagcuaggauuacaggugugcaccaccacaacuggcuaauuuuuguauuuuuaguagagaugggguuuugccauguuggccaggcuggucucgaacugcuagccucaggugauccucccacuuuggcucccagaguccugggauuacaggaacaagcaacagugcucggccucuagccuuaauuuucuaacuuaugcauuguauguuccaguuuuacugcuaaaaugaugaacauuaauuuacuacugaacauauuauuuugauaauuauauguccauuacgauguacauuaaaaaaauagaauauaacccuugagaugucaugaaugucacuguaaaagcacagacaaguuuauuuaaauaaaauuauaaaguaaguaaaaguauuaagugguauguggaaauuauaaaauugcagagaucuaugcaaaugauuaaauucgggccaaaaguggauuagagggagaauggggaauaacugccaauggguacaggguuucuuuuuuuuuuuuuuuuuuuuuuugaggcggagucucgcuccgucgcccaggcuggagugcaguggcgcaaucucggcucacugcaagcuccgccuccuggguucacgccauucuccugccucagccucucacaggcgcccgccaccacgcccagcuaauuuuuuguauuuuuaguagagaugggguuucaccacguuugccaggauggucucgaucuccugaccucaugaucugccugccucggccucccaaagugcugggauuacaggcgugagccaccgcgccuggcugguacaggguuucuuuuagggguaacaauauguuuuggaaugaaauaguagugauucacaauucugugaauauauuaaaaaucacuaaauucugcacuuuaaaagggugaacuuuguacuuacuaaacuaaauggaaauaucugggaaaauucagaauacgcuuaaaacaaacuguuuuuacuucuaacuucuuacgaaacguaagaaugauuaaaucugaaaaauaaguaaggucauagaauacuucuucuggaaauaucuauauccauucagauaucgagccuauaugaaggugcugaaguucuuuugacuacugcuaaaauuuuuagaaacuagccaaagaauuuagauauagcuucagcucuuguggccuuuggcauuuuauuuguugaauaauucaauuuccacauugaagcaagugauuaguuuuacauuccuacacuaauuucuuagcuuaaaaauggcuuuaguagcuuagacugacuucuuugcugaaaugucuuacuagaacuugguggaaagcggaacuacuauacuaaugaguuagcuaaggggacaauauuguuagaaauugaauaugguaauagaaaugaaacacgacagcugugcagguuaagugauuuuugaaauugaagcuuaaaaggacaaaaaucuccccagggcauauagcacuguauaauuuaagugcagaguaauggagagcugggaaccuuaacuucuccauuuguuaccuauuuucaaaacagaggaacucuuaaucuccuauacaauugaauauucaagacuuugcuggaaaugcagagaaaaauucaaagucucuuagaaggagacagaaguaaucaaaacugcuauggaauuuguacucauccuuuuucuugccuuuuuguuuuuguuuuuuuaaaaaagauagggucuugcucugucacccaggcuggagggcagugcagcaaucauagcuuacugcagccuuugagcuccugggcucaagcaauccaucugccucagccuuccgaguagcugggacuacaggugugcaccaccaugccuggcuaauuuuuuaauuuuuuguagaaauggggucucgcuauguugcccaggcugcucuccaacuccuggccucaagcgauccuccugccuuggucucccaaauugcugggauuacagacaugggccaccgugcccagccaccacugcguuuuucuuucuuucuuucuuucuuuuuugugauggagucuugcucuaucgcccaggcuggaguacaguagcgcaaucuugacucacugcaaccucugccucccagguucaagugauucucuugccucagccucccgaguagcugggaccacaggugcaugccaccacaccuggcuaauuuuuguauuuuuaguagagacaggguuucaccauauuggccaggcuggucuugaacuccugaccucgugauccgccugccucagccucccaaagugcugggauuacaggcauaagccaccacgcccggccccauuuuuauuucuuuuaaauuuuuugaauauauguauuuuuugagauggagucucacuguguugaccaggcuagucucgaacucuuggccuuaagcgauucucccaggugggccucccaaauuagcauuacaggcgugagccacugcgcccagccuccacugcauuuuaaaaaaauaaaaauaaguuacaggguacuccaauuucuuuuugugccauuguuucaauaggauaucauuagugaaacuuugagagcuaacagguagacugaauaucucuauagauauuucuguuauuaucauuauaucuucuauguuacgccauccugagaaccuggcauaauuuagcauaaaguagaugcucaauacauguauguaaaaugagugaaugaaucaaaauuauaugggaaacuauaugggaaacuguagucaugcugcugauaguuguauucaccucaguuuccugcagacgguguccaaugaggcuuagggacucucccaacagcugaagaugagcagcaacaucaaugggcucugucucaggggcuuuggcuggugaggcugguaacagcauggugguggguggggacuucuucuggggugacaguacuccuacagaagaggcugagaacagagcaaugaggcagacagguaaaacuugccuacagccuugaacaacacaaaguuguucuuccugauuuucccuuuuuaugaauuauaccaggcauuagcaaaacuguggccugugggcuaaauucagucuauggucucuuguuuuuuauggccugugaguuaggaauaguuuuacauucuuaaagggcuauagaaaaacaaagaauaugugacagagaaugcgagaaugcauacggcacacaaggccuauaauauuuacucucuggaccuuuuuuuuuuugagauggaguuuugcucuuguugcccaggcuggagugccauggcacgaucucggcucaccgcaaccuccaccucccggguucaagcaauucuccugccucagccucucugguagcugggauuacagguaugcgccaccacgcccggcuaauuuuguauuuucaguagagacgggguuucuccauguugguuaggcuggugucgaacuccugaccucaggugauccgcccaccuuggccucccaaagugcuaggauuacaggcaugagccacugcgccuggucuacucucuggaccuuuaaagaaaaaguuugcugacuucugauuugcauuuucuaaauuugaacaucucuuuuugguagcuuguaacauucccagguaauaauaccugggaaucaagguccacuucuaauacugcaagcuuuuuucccaguuucuuagcaaggaagcaaaauucacaugcuuuagagaaaagcaggggcgggauguggucacuaccuuugacuuucauggaaccuucugagcuggaugcuuuccuuuucacaguuguggcuucugcuuuguucuguuugugcugcagauacugagcuuuuugcuuccaaaucugcaaucacaucagugaacauuaaauuaaauuaagaaggacaaaauguaaaaggaaaagcagucaugaaagaacaaaauggagaaaagaaaggcaauaguaagaggcgggcagacagaggguuaaugcuaacuuuuaagcugggggucaccgaacugacuucagacagcugacuacauuaauaucuuaguaaaggacuauaaacauuccucaaugcuaauggucaaaucucggcacugauuuuuagaucacucuaaguugaaauguaaaaucacagauuaaaccucuggcucaauauaaugucuaugugguucuacuaaccugcuaguuggcaauaccaacacaauagcagaauaacaauaacaaggaaaacaaaaacuaaggauaaucugggugaagaauggcuguucaucuagaugacaucuugcuccuauaugaccuucauaucauaagucucaaugauucagauaugacuuuuuuuuuuuuuuuuuuuuugagauggaguuuuguucuuguugcccaaagcuggagugcaauggugugaucuuggcucacugcaaccuccgccuccgggguucaagugauucuccugccucagccucgcgaguagcugggauuacgggcaugcgccaccaugccuggcuaauuuuuuguauuuuuaguagaaaugggguuucaccauguuagccaggcuugucucgaacuccugaccucaggugauccaccgccucagccucccaaagugcuggaacuacaggcgugagccaccgugcccagcccagauaugacuguuuaucagugucuuacuaccuucuugauaguagaguacauuauuugguaaugguugaugaggaugaugaccuugaaccugguuaccuaguaaucacauucucauauuuuuauuguuugcagugacugcuaaguggauaacuuuccucaguucucagaccaugacugauuacuagguguuugcaguaaagggcucugauuuuagacuuucuuuuaacacuuuaauuacuccucaacuuaggucaucuuuuggcucaaauguaacacugcuggaaaaaacagaccagguuagaaaagacagccuugcuauagcuaaauccucauguacagugaacuggcacuaacaguguuaauguccucugcuaaaccauuuucuguugauuuguaauuuucuucacuauuuucagugcugucuggcuggcuagucuauggaagaauuacauauuuuggaaggcgagaagcacugaaaaauauguuuguaagaaaauguacuuaccaguuugucuuuuucugguaauugcuuccacaccucagccaguuuuuuacuaaguuccccaaaaucuggcauaaaagaguaaaacacucaauacaguaaaggguuagcuauuaacaaaauagaagauuggugaaagcaaaaacuggaaaaggguuuugaagcucauauuuaaauguugcaagaugcuuucagaaaaccaaccccaaucccaucacucuucuuugauuuuuuucuauagggaaggggauguuuugauggucaggagacagucucaacucguaacccaucuacucccuagggauuuauuccuuaagcaucuuucuggugucuuuuuuugagacugagucuggcucuguugcucaggcuggauugcaguggugugaucauggcucacagcagccucaaccaccugggcucaaaccacccucucaccucugccucccaaguagcgggaccacaggcgugggcuaccaugccuagcuaauuuuuuaaaauuuuuuucuuuuuucuuuuuuuugagacggagucucgcucugucgcccaggcuggagugaaguggcgugaucucaacucacugcaaccucugccuccuagguucaagugauucuccugccucagccuccggaguagcugggaucacaggcgugcaccacaaugcuuggcuaauuuuuguauuuuuaguagagacgggguuucaccauguuggccaggcuggucucgaacuccugaccucaggugauccacccaccucggccucccaaaguguugggauuacaggcgugagccaccacgcccagcuauuuuuuaaaauuauuauuuguagagaugaggucucguuauguugcccaagcugcucucaaacuccugggcuccagcaauucuccugcuucagccucccaaagugcugagauuauaggcaugagccacugcauccugccucuggugucuuuaauuugaucccacaauacaaggccuaucaacuuagguuaaaaaauauguguagaauuugaaaaaagauguuagguuuuuaccaaauuucugaaugauuagaaccaaagaaggauuucccuagagcagcucagaagcaauccucuagauguguaaucuuacccuuccauuguauaagaguuuuaugcuuuauaaagcauauucaugugugccuaacacugcagucuuuuggaguugguagggcagcgauuuuacacauuaggcaaaugaaauuuguagcgguuaagugacauguguccaggaucucugguauaguguuuuucuuaccucauuaacuucuaauacagagacaaauacagucccugacuuaugaugguuugacuuuugauuuuucaacuuuauaaggaugcaaaagcaauaugcacucaguaaaaacuguacuucuaguacccauacagccauucuguuuuucacuuucaguacaguauucaauacauuacauaagauauucaacacuuuauuauaaaacaggcuuuguguuaaaugacuuugcccaaguguaugcaaauguaagugucuugagcacauuuaaggugggcucagcuaagcugugauguucuguaggcuagguguauuaaaugcauuuuugacuuacaguauuuucaauuuucaauggguuuaucaggauguaacacuaucauaaguugaagagcaucuuuacaacaauauaauacaagauaucucauuauaacuuuacauccaagggcaauuuaaggaaaaggccaauuguagaaucuuggaaauaaacaauuguauauuuuugugcauuuauguaugugcuuuacaacauuuauuuuuacauaguuucccaccuuauccguuuaagagauauguauagaaaguucaucucuuuuacagaugagauaaacuaaggcaaaaucuaaagugauuugcagaacugaggaaagaaacaagauuuaugcucuaaugcuacaggaagaagaaauuaaucgcacugcuucaagauauaaauggaaagcaaaagcgcuacagaucaguaauguucuuaccuauaccuggauggucagccacaauggucacgcgauacucuuuacagaacaccugguaggccgacauguucuucuuuuuuggcuaaugccgcauagaagauacaacaggguaagacuugauuagaacccagguuuaguaacccugaauccauaguaauaaaauagaaggauaccuaaacuuuuucaucaagggaagaguuccaaacuacuaaccagcuuuccuaaacaggauaauauauauauauauauuuuuugagauacagucucacucugucgcccaggcuggagugcaguggcgcaaucuuggcucacuauaacuuccgccuccuggguucaagcgauucuccugccucagccuucugaguagcugagauuacaggugccugccaccacacccggguaauuuuuguauuuuuaguagagaugggguuucaccauguuggccaggcuggucucgaacuccugaccucaggcgaucugcccaccucagccucccaaagugcugggauuacaggcuugagccaccaugccuggccaggaaaauacauuuuuaauccauguuacuuaccacucagagaugaacaucaguuuuaauuuuaguagguaaaaaccacaugcuaaauuacuuguaaagaccuuccuucucccuauauacaaucccauguuacacauuucuuucagaauuaagugcuaagagaaucuuuaccacuccuggggugucuauuuuucucaucuuugaaaaucugaaccacauaauuuccuuuuaaacuuuggagccagaaacccaaaagccaaaucuauguucuuuuugcuucucugguuuugauuucuaaucuuguaauuucccucauccugcuuuuauugucauuuguagcuucucauuauuugauuguucacauucuuuggguucaaggugagaagugaacaaauaacugaagacaauucuuugguagucacugucagaugcaacgccuucacuucaacaaacagcucuguacuaccugaggcauguuuguucuucacuauauucugacaaugccaaaaggaauauaugauuuuugagaaacaaaaucaaauuauuuuuaaagucaguucaacaagaaauauauaaaacagaagauuauauuucuaugcauuccauuucacaauuauacguggucuaaggggaaaaaguuaaguuuuuccuaucuagaaagagacaugcaauuagauucaucuauccaaauuucucauugugagcaugggaaaaaauaaagucagagaaacuguaacuugcugaggguaccaccacuaagcuaguaauaauaccagacccuggcaguuauaaccacaacccagguagcccugacuuucagggccaugcauuaugggcccaagaaagaacauauguugcucccuuacagaaaaaguuaacuauuuaaaauaaagaaagaguuaucacuuaauaaucuuaaucuaacaaacaaauauuuucaguauggcuuuccuccaaaacucaucuggaagcaucaaaauaugauucuccgucuuucaucuacuccuaguccuuuuuggcccuacaguuauuaaaaugacaugaauguggccgggugggguagcucacaccuguaauccagcacuuugggaggccaaggcgggcagaucacgaggucauccuggcuaacacggugaaaccccgucucuacuaaaaauauaaaaaauuagccgggcaugguggugggcgccuguagucccagcuacucgggaggcugaggcaggagaauggugugaacccgggagguggagcuugcaguaagccgagauugcaccacugcacuccagccugggcgacagagcgagacuccguuucaacaacaacaaaaaauaugacaugaauguauggugcuuuaaaagcccuugggggcuuuuguuugccuuaagagucagguuuugugaugaaaaccaaaccagccacacaguccugucucguaacuucagaguuguaucuugcuuuaaacaaagcucgaucgugcacucugccuagcugccuuaguucuucauguuguucccauaaaauaacgacccucaaaggacaaagaccgaggcugauggcaauaaaaagcuuaugugaugacuccaacuuuaauuccaaaagcgauucugaaaucauuugaugaauagaaacauuccuagaacaccuuccaagguaacugcuuugaaugagauugcacuuauuuggagauaaaauuugugguauguuuguuaaauuucauacuaauauuuuaauaauggcuuaucuauaugccugacauuugcuagaauacaugaugaaagaaaaauuuguggaagucuacacacugccaaaucuuucccaacuguacaaucaaucucacuauuaaauacugagaacauuagaaaguauauaugcuugagagauuucacagcuuguuuggccauauuauaaaacuuacaaggaagguguuuaacaacguuuucucaaacacaauacuguaaaagguuaauguuccuauucuauaaggcuaacuauagcugucacacuaaucacaauucuuggccaauauacuauagauccaaauucacauacugaagaaaaggguuuccuucauaacucuuauaaaggacuuuauucgauuauguagaaacuagauuagcguuuauugaguaccugugcuggguggugguagagcaaguaguuaggaggauaagcuuuugaagccuagaucuaauucuaaggaaguuaagcugcauaaaauaguggaaaacacaugaaauuuacaguuuaaagacccacaaucuugucucagcuucaccauauacuaauuauuggauccugaauaaaacacaugggaaguggauagcuuuucuaauaugugauaguaaaaguauuucaauggcaaugaaggaaaagcagagacuaagauuucaaagguaguagaaaaaaaguaacccauuaaaguauucuacuauucauuuauuaauaauauuuacugaguauccauaugugccagacacugggaauacagauaaggaucagaugcagaaucuaacaaaugaggcaguuaaauaugucauucuaauaaaacacagugcuauuauagggaaagcauugggugcuaugggaacauguaguaggagugccuucccaaguuagggagucaaagaaagccuucuggaggaagugacauuuaaucuaaaccagagaguuggguagauguaggcagaugaagggugguuaagaguguucuaggcagaggaaacaacaugggggcacauucaccaaagaagagagagguaagagaugauguuagaaaggcaggcagagcccaucaacugaggccauguaacccauauuaaagugcauggauucuguccggaagaugccauucaaguauuuuaagcaggaaguuauauagucaggguuacacuuaaggacuauggagaacaaacuggagaagaacaagagcaaaggcaggaagaccaaucaggaggcugcugcaggagugcggggaagggaugaaugaugauggcccacaaucaagacaguggguugggagaaaagcaaauaaacugagaaggaggaagaugugacaggauuuauuagagauaguguggcaaaauggcuuugaagaccagcgaaucugcauuagaauccugaccacgcuauuuacucguuacgugaauugcuucauuuuccugacauuucguuucccuacaaaacuuggauaauaccauuuaacucaaaggugggaauuacuccauugguguguggcacuucaguagguacucaauguuauuuuugugguaagcagaauuauaagauggcccccaagaccccugcuccuggguuugcauucccguaagggugggcaagacauggucauauuacguuauauggcaaggggauuuugcagaugcacuuaaggucucuagugaguugacucugaguuagucaaaagggagauuauccugacugggccugaccauagcaggugagcacaaaaaagagacaacaagcccagcaagcuauuuugaagacaucaacugauucuaaaguuuuuaugaagaggccacagacccagaauggacaaggcaguauugaugaagaacaaagcugaaggacugacacuacccuacuucaauauuacuauuaagcuacaauaaccaagacaguguggcauuagcgaaagaauacacaaauacaucaauggaacagaacagagggcccagaaacaaaucuaccuaaauaaagucaacgaaucuuugacaaaggagcaaggacaauacaaugaagaaaagauaguauuuucaacaaaugaugcugggacaauuggauauccacaugccaaaaaaaaaaaaaaaaaaaaaaggaaucuagacacagaccucacccccuucacaaauuaacucaaaauaagucucagaccuaaauguaaaguacaaaacuauaaaacucccagacaguaacacaggagaugaucuugagcuuggcaauuacuuuucagaaacagaaaccaaagacauaauccauggaagaaggaacugauaaacugggguucauuaaaauuaaaaacugcucugcaaaagacacuuaaaaaaauaaaaagacaccgggcgcaguggcucacgccuguaaucccagcacuuugggaggccgaggugggcggaucaucugaggucgggaguucgagaccaacauggagaaacccugucucuacuaaaaauacaaaauuagccgggugugguggcacaugccuguaauugcagcuacucgggaggcugaggcaggagaauugcuugaaaacccaggagacagagguugcggugagccgagauugugccauugcacuccagcuuagacaacaagagugaaacuccgucucaaaaaaaaaaaaaaaaaaaaaaaaaaaaaaagacaauccauagacugugagaaaauauuuacaaggggcauagcugauuaagaacuauuauccaaaaaucucucucucuuuucuuuuaagacaagaucucacucugucaugcaggcuggagugcaguggugcgaucauagcucacuacagucuugaauuccuggauucaacuguuucccuggcuucagccuccugaguaguuaagacuacgagugcgugccaccaugccuggcuaauuuuuuuuuuuuuuuuuuuuguagagaugcagucuugcuaugcugccacagugagacuccaacuuuacaaaaaauuaaaaaauuagcugggugugguggugcaugcuuguagccccagcuacucaggaggccgaggugggauaaucaauugagcccaggaguuugaggcuguagugagcuaggauugcaccucugcacuccagccugggugacacagugagaccccaucuuaaaaaaaaauaauauuaaaaaaaaauacauaaaauuuaaaagccccagaccccagguggugguuuggaagggguuuaaugacauuucuuggguagacucauuccuaagaauauucagucacucauucuuucaggcaagauauauugaagguauugggaacucaauggcaaaugagacaggccaagauccuuguacgaauggggcugagaucccaugguacagccacuuuggaaaacaguuuggugguucuuacaaaacuaaacauucuuaacauauaauccaucagcugugcuccuugguauuuacccaaaggaguugaaaacugauguccacacaaaaaccugcacuuggaaguuuauagcagcuucauucauaauugccaaaacuugacagcaaccaagacgucuuacaaucagugaaugaauaaauuguaguaguauaucuagacaauggaauauuauucagugcuaacaggaaaaaaagaaagggucgagccauggaaagacauggaggaaauuuaaggacauauuacuaagugcaagaaaccaaucugaaaaggccagauacuguaugauuccaacuauguggcauucuggaaaaggcaaaacuauggagacaauaaaaaggucaguggcugccagggagguaaugaauagguggaccacaggauuuuuagggcagugaaaauacucugccugagacugugauggcggauacgugucaugauacauuuguccaaacccacagaauggacaauaccaauguaagagggagccccaauguaaacuauggacucugggugauaaugaugugucaauguagguucaucaguuguaacaaauguacuagucuggugggggauggugacaguguggaaggcugugcaugugugggacgggggauauauggguuaccucuguacuuuccucucaauuuugcuaaccuaaagcugcugcugcaaaaaaauaaaaucuuaaaagaguuuccugaacaaauuucacaugaauagaaaccacauuggcugggcgcaguggcucacaccuguaaucccagcacuuugggaggccaaggcgggcagaucaccugaggucagcaguucaagacagccuggccaauauggugaaaccccaucucuucuaaaaacagaaaaauuagccaggcaugguggcaugugccuguagucccagcuacuggggaggcugaggcaugagaaucacuugaaccuggaaggcggagguugcagugagcuaagauggugccauugcccuccagccugggcaacaugaguaaaagugucucaaaacaaaaacauaaacaaaaacaaaacaaagaaaacccuugcaucgaaccaacauuaagaaacacacaaauaaaaugagacaagaaggcaugacagucucuggcuggucucgaauuugaagaaaacaaauugcuaugaguucuacaacuauaagagacugaaagcugccaacaacuugaaugagcuugagccucggaugagaaccuggcucuacuggacgccuugauuucagucuugcgagacccugagcagagaaccgaguugaguccuccagaaggacuuugaucuacacaacugugagacaguaaauggauguuguuuuaaauugcuaagcuugugauaauuuuuuaugccacaagagaaaacuaauaugaauuauuuucuauuccuuauacauuuuccaaaauagaaguuguggcacccaaaaaggcaauauaagcuuuuuaaaaaauaaaaauuguggugaaggaggauagggugaaaucauuugaccuuuaucagacaaauagcagcaagaccuuuauuuuaaaguuuuucauugaaauagcaaaccaaacuaaaaacacuauuuuaguauucuucuggugaagccaguccuguuuagagaugguaaagaaguauguugugggugcuggaucuccuuuacuaauuuaguaucagcuuuuuaucuccuaaugucuuaaguguucuaaggauccucucuuucaaauccuccuuuauugggccuaagauacaauggagaggcaccacacgcacacccaaacacauacacacccucgcccaugaguucauguaaaggguacucguggccauuuggcgggguguggguuaauuauucuggguguuccaccugccacucauuccacucuaagaaccuauaccuuggagugagugggacaggagauauaaaucucuucuccccagauaguuucugugucucucucagugugggcaacucguuacacaagugugauucugacguuuguagcuaagguaauuuaaaaaaugaaauaaaaucaugguuccugaacaaggccaaugacuucaucuggugguggagagaaaaaucuagcugcacuagaaugacauucuguuggacugagacucugucagccuucaauguagagccuuucuaaaggauuuucaagggaaacucugacuacuuacacuguucgccucacgugcugacuuaaaaccuaaccacuguguaagaugcaacucuagucuguggaccuaaaguucagauuucaaacuuaaggguuaaaaauuuuccauggcacauuuuucuaaauuaaaaauauacaaauagaggaugaucucuauaaauacaaaacauuuccaugagauuccaaaugcaaggccaguaauuccacucuaaauuuucucaugaaagaaaacauacaggauggcaagauuacagcugggauacacagacccuucuuuaauuaauaaaauguuaauauuuuuaaaacuuggauacuuuauuauuaguagcaaauuacuugcaacaaguccacuuaacuacaugugacucaugauguuaccauuuuacuaccaggaucuccuuuuaaauauuugaugagguaugucacaguaucaagaauauucaaaaaguaacuucuuuuuaagcaacagggucuugcugugucacccaggauggagugcaguggcucauuacgacucacugaagccuugaacagguuuaagugauccuccugccuuggccucccaaaacucugggauuacaggugugugccacugcuccuggcccaaaaugcaacuuguuaaugcucuuuauaaaguguccugcuuaacuuuuuugggucauagaacuguaagaaccugaugaaaaucucauaacucuaguuuaagacccuguuuuaaagaauacaauauuugggaguuaaagcacaauacugcuuaugauucuaaaaaaugaaauuugguggcugggcaugguagcucaugccuguaaucccagcacuuugggaggccgaggcagguggaucaccugagguuagggguucaagaccagccuggccaagguggugaaacccuguuuccacuaaaaagacaaaaauuagcugggugugguggugggcaccuguaauuccagcuaccugggagggugaggcaggagaaucacuuaaacccgggaggcagagguuguagugagcugagaucgcaccauuguacuacagccugggcgacaagagcgaaaauccgucucaaaaaaaaaaaaaaaaaaaaaaaaaagaaauuuggugauguuaauacuacguacgagccacuguuguaagaccuuuacccauagaaauucccuuaaaccucauaacaacccuaugaaguaaguuccaucauuccugccaguguaaaaaugaagaaacugacauccagacucacagcuccacggaguggcagggccacuaaacacaggcagccuggcuuuggagccuggacuuguaaccauuuuaccaccugaugcucuucugaacuaacuugacugagauccccaaaucugaucuggcuaaaaggaaaaccagcagauaaguaagguuucuacaccaaaguuuuuauuuuaacuaccuugaaugaaaaucuuucuacauguacucuauacuucugcuaucugucacaccacaucaaugaauauaauuuaaccacuuucuguauauugaaaugagcguggcucuuguagucagaaaaaccuggguucuaauuccuguuccgccaugaacagguaugucccggggcaugcuauuucguuuauuuaagcuuauuucugugaaacugagaugacaacaccuacaccucauuggguucuugugaaaauucagugauacauaguagauaaaaaacuaguguagugccuagaacauacgaggaacucuacauguacagcuguuaggauugugcuuugccaauuccuacucaguucuccugccccuuccuagaaggccagccuggcagcaauucuuccugccuucuacauaccuuucgcugacuuugcuucagucauaucaacuuccuggguuucucugaacauccugugcccucuggcgucucagggacuucacagauauuuuccauuccaugacugaggugccuacuccuauuuuccaccugauaauuccuacuuggccuuaagauuugguucauaugacagcucucacaggaagccagccauuccgggcuuuccuugcacucucucaguacuccgcgcccaugccucugcugaaguucaacacaccaaguccuuuccaaccuuuuacuagacugaaagcucuuugagagcagacacuguaucuucaucuuuguguccuuacugccugggaggauuuaagagcagaguaaauauguacuauugaauagcaaagucucagaacugcgcaugaagaggccaaguguguauucauguguggcaccucaucugauuuccacaacauccuuguaagugaaguaggcugggugcuaauuccccauuuuaagcauaaaggaacagaggcagagaggucacaggacucaucucacugguccuucuuuuagugacgaugaagcucuccaaugagcuguagguuuuauaacaucugcuuuugcuccuuagaggcccuguuuucuuucugguucuuaacuauuuuccaaauaugugauguaaucacagauuugguuccuaaaggugggagguuauauuaagguaggguauuauaugcauaaaacauagucuccuugcuuagucuaauaugugaaaugaguggcugaaaacaaaauuuuaaaaagauguuuucaaauauauuuugugcuuuugaagaacuuaagacguaagcgaaaguaacuguaacagcugacauuuacuaagccaugcccugugcuaagcauguuacaugcaccaccuaauuuaaucuaaccccaauuuacaaaugagcagaagugagaaagcaaucucaggagaacagaccuaguaaguggcagaccagaguaagaauccaagucugcugaauuugagucaaagaucuaucauggcacggaguaaccaugucuuaaaguuguggaaaggcauguggcauaguggaaagauuauagcuucuuccuccgucaguggggcuaaugauaauuauuaaucaagagugguaacauucggaaaaugccuaggagagccuggcacucaauagaugguagugacuaauuucuaccauuuauuguugcuguuacuuagccucagguuugccagagagagaacuaauguaacagcaucacaagucuaguuauguuucagacuuuuguuuauuagaucaacaaugucugggugugccaggcauuaggcuaccuggcccugccuuagguuuagagaaaaugugcauauuuuggaaacacacagauaacuaaaggcaugucucugaaauggcaacauuacgggauauuauuuauuuauuuucuugagacacagucucgcuguugcccaggcuggagggcaguggcgugaucuuggcucacugcaaccuccgccucccggguucaagcgauucuccugccucagccuccugaguagcugggauuacaggcacgcgccaccacgccuggcuaauuuuuguacuuuuaguagagaugggguuucaccaaguuggucaggcuagucuugaacuccugaccucaugauccacccaccuuggccucccaaagugcuggauuacaggugugagccaccacgccuggcuauuauuuuaagugacaaaaaaaugggcuuuuauuugggguaaaaccaaaaguaagguauauuuaaaauguaacuguauccugcuccuccuauauaaaugaaaagcuuccacugcaaugagaugaucuuuagugggaaaucaucaagauauuaccauauaauuucucuacucuuccuuagaaugcaggacucaaaaccaguaaaaccaaccaaccaaccaaacaaaaaccaccuccaaaacaacugaaaggcuacuuuucacccaggaaauaguguaauuucccuucuuugugucagucaaaauucucaaguaagagcccaccgcugcugcguucacuuccacaccgcucacucuuuccucaaccccugauccagcuccauuccuaccuacugcacuugaacuccuuggccucucuagcaugagauuguucuacucuugaaacuguuuuucuccucccuucuguguuucuccuccaacauagccgcccccucuuccuucucuuauauaaaugccccuguauaaguguucuacaaaauucugcucugagcucaauuuccucuuauccauuuaccuauuucauuuaucacacaugaacacccaauuucucacccaaguuccagccaaauucugggucuugaacuuccauugccacugagaugauuauaauauuuauugaaugcucacuaaugugcugagcauugugcaaagacaaaguucuccaauguucuugguucacagugcuuauguggguuuucaaugugguaguugcuuuuuaccucuagagcacacacacuuggcuuugaaaagauauggcacuacugaaaagaauguaacauacauuguugaaacugggaauuacuuugaacuaguaguucguaagguaucugagagaugucaaguauuguuguuugucucaaaauguauuuaaaauaucaagcguuguccuggugagucugauguggcgucccagagcgccuuggcacaccgaggcccugaacacuuccgcauguauugccucauuuaauccucacaacccuaggaagcaagucuguuauccucaacuuagagauggaguuguucuguaacuuauccaacaucacauuguuuguaagugggugaauagagccaggaauugaacucagguggguuccacagcccacgcucucaacgacuuagcuauguugaaucucccgaucucaauuaacuuaucuucuucucccaaaccagcuauucuucucaccuucucuauuuuuauuagaguccugguccuagaaucuaagguagaaggggugcacagaggccuuuggcauuucuaccaguaguuucuccagucucugcucacuguagguugaagaaacacuacuccuaaaucauucuuuucuaucucuggguggacuuugucccugacuuuuuauuuauuuuuuuugagacagggucuugucauauugcccagcugguugugaacuccuggguucaagcaauacuccugccucacccuccuaaguagcugaaacucaggugcuugccaccaugccuggcuaauuaaaaaaaaaaaaauuaagagguagagucuugcuguaucaccuagguuggucucaaacucuugggcuugagugaucccaccucagccucccaaguagcugggauuacaggugcaugccauugcgccugccugucccugacuuuuauacaguucuuuuuuacagugaaacaaaacccaggaaaauauauuuuuaaaaagcuuuauaggaauuuuuuaugcacaaaucagguuuaaaaaccacaguauauacacuauaaauauuuguuggagaaauaaaugauuaaauucagauuaugacuacuucagauuuuuuggacagccacaaucaaagauauuaacucuuaauaagguuuuugcuauaaauuaaaauucauuuuucacuagcaacugcuagccacaugggcaaauuauagauaaguccuuaacuuugaagagcuuacuauuuuuccaacguuaucuagguucaaagcugaagagauauuucuuagacucauuuauguuucuggcuucccagauacaagcccacuaggucagcgguccucaaccuuuuuggcaccggguaccgguuucguggaaaacaauuuuuccauggaccuggggcagggguaggggcagaguucgggauaauucaagugcauucauuacauuaugccuuuuauuucuauuaguauuacauuguaacauauaaugaaauaauuauacaacucaccaucauguagaaucagugggagcccugagcuuauuuucuuccaacuagauggucccaucugggggugaugggagacagugacagaucaucgggcauuagauucucauaaggaaccugcugggguuugugcuccuaugagaaucuaaugccgcugcuaaucugacaggagguggagcucaggcaguaaugugagcgacagggaguggcuguaaauagagaugaagcuucaauggcuugcccgccacucaacuccugcuauguggcugguuccccacaggccgcggacggcuacuggucuguggucuggggacuggggaccccugcuguagguagaucuugucaauuuuuccuucagagccucucuugaaucaaccucuucaauuuuauuucucucaagccuuuuuuuuuucuucuucucuuuaaaagagacagggucuugcucugucaaccagguuagagugcaguggcacaaucacaacucacagaagcuuugaacuccuggguucaacugauccucccacuucagccucaggaguagcugggacuccagucaugcgucaccacaccuggaucuugcuagauugcccaggccagccuugaacucuuggacucaagcgauccuccugucucuuagauuuucauuacuaaccuucuggacuauaguaacucccuugguuauucgucucucccuacucuaauccaccuuguacaacucuaucauuuuauucuuaucauuuagaucauaaauaaaccuugcuuauaaaccccaaacugccugcugccaaguccuuuacuuuggcauuuaagauucucuacaauuugcucccaaccuaccuuuucaguacuauguuuucauccacauauucauucgacauauacuuacaaagugcuuauuaaggacauugaagaguugaagauacuauaaggugguaaaggagcuuacauucugccccaagcagacagugcugcuaaguuaaagaaauuggguguagccccuucuaugaauucuauuuuguuuguuuguuuugagacagucucacacugucacccaggcuggaguacaguggcacaaucucggcucacugcagccucugccucccaaguucaagcaauucuccugccucugccuccagagcagcugagauuacaggcgcaugccaccacacccagauaauuuuuguauuuuuaguagaaauggggguuucaccauguuggccaggcuggucuccaacuccugaccucaagugaucuaccugccucugcuucccaaacugcugggauuacaggugugagccacugcacccagcuccuucuaugaauucuaagcaucagucuucccuuauagucuuuaauaagggaaacagaauauguacaaagauaaugccaauauaaggaagaaaauaagugcaguaagacagcaagguaauaugggaguuuagacguuaauucuaaugagggguguacagaaugucuuagaagagguggcauuugauuaggucuugcaaagagggcagagcuucaauauguaagaagaggaaggucacuguaaaaaaugagcaaaggaauagagguaagaauguaugggaaacaagucugauuuccauacaguguauguuuaauagacuaauaagagguaaagcugaaaagggaggauuaggcuaaauccagacacuuaaugaauguuuggcuaagguuucaacuuaccugauauuuauuccuuugacaaguauuuacugacugucuacaauaggccagauggcagguuauacacuagggauagcaagacagacgugguccugguccucuuggagcuuagagucuaccaaaaaagcaguaagaauccacugaagaugcagaacacaggacugccgucaucaaggugcuacuuaagauuaagauuacucuagcaucaaugugugagauuaacugcacgguagaauaaaaaaaaaagcuacuuauuacaguaaguguagaagggaaugaggccuaagacaguggcaaugguaauggaggagcuaaaggcuugaaagauauuaaggaggaagacuaucaagcuuaauauuugugcagaaauaguuggaggggaguagggaagggggaaauguaaaagugaacgauaagacuggaaaaaaucagaacaguuguuggcucugggguuggggauggauuggagagggguacaagagagcucucugggaugaugguaaugucuguaucuugauagagguuugaucacacaggugugugcaucuaucaaaacucaucacauacucaauaucuaugcauuucacccuauguaaauuuuaucuuuaugguuuugagacugagucucacgcugucgcgcaggcuggacugcaguggcgugaucuuggcucacugcagcaccugccuccugggcucaagcgauucuccugccucagccucccuauauguaaauuucauauuuacaaauuccugaaaacaaauauugaacucagguuaaugauaugcaaacugaaguguuuaggggugaaauguaugauaccugcaauuuacuuugagauacauuaagaaagauaacauggacugguggaugaaaggaugggcagguauaugauaaagcaaaaagaaaauauuaacuguaaacuccugguggaggagauacaguuuucauuacagaauucuuucaauccuuuuugucugaaaaauuucauaauaaaauguugagaaaagcgauaagcauucaguuuugaguuuggguugacuggcgggauacugggaauacagaagguguagcuaggucaugucaauuagugacauaaggguuugagguacccaaggcauucaaguagaaauauuuagcaggcagcuggaauugcacaaguagaguucaguuauaguuauuuuacucugcugcuuccugaacaucucucugccuccaugcguccacuuccacugaaaccuucuccuucuucaagcuuucccugacccugugcuccgacauucagcacuggaugauuaguccauggcauuaucacgucacuagacuggaaauucuuaggauaaacagaaucuuauaaagaacacauaguguuuauuucauaaagcaauuuuccaaauaaacaacugaauaaaaccugacuuaguauuggaauauccaggucuuuauguucacacugauuccuggcucagagguacagcuuugugguuuuuuugagauaaacagauguguguguguauauauauauaauauauuauuuuauauauauuauauauacacacacacauacugauaaacagauauagaucuacagauagauauaaacagauagauauaagcagacuuucuuaaaaggcacccuuuauaguggagaaauaacuuccaccucagagaucaaacuaaauucccauuccuagauucuuuucuuuuuucuuuugagacagggagccucacucugcuguccaggcugaaguugcaguggcaagauuauagcucacuguagccuccaccucuugggcuuaagcaauccucucaccucaaucuccugaguagcugggacuauagaugugcacccccacaccaggcaaauuuuuguauuuuuuuguagagacuggguuucgcuauguugcccaggccggucccgaacucuugggcucaagggauccaccugccucagccucccaaagugcugggauuacaggcaugagccaccacacccagccccagauucuuaauacauuugauuuucucguucuuagucgcuuuucuuccagauuuuaucugacauugcauuuugcagaacuauaaauaaaaaaagaaacuuuuaaugacauaguuaugagacccuaaaguucacugccagaaacuguuaugaggaaagaaaucaaaccaaggugacugauuuaucauuccuaucucccuaaucaacagugagcucccuaaagucaacaacuauguccugcuuguguuuuuacuuccugguacuaucuacagcauugagcuuggcauacagcaagcacucagacaguaaaagaacauauauucgacacuaaaaagaauaccagaaaguagccaacaccagcugguggaaagucauuagcuauucuguuaacuugacugcucauuguucuaccaauuuugauagucuguuuuuaaaaaugaacucaaagaacaccuuuugacaucucccaacugcccuaagcagacagugaugcuaagugaaagaaauuggguuuagcuccuucugugaauucuaagaacuagcuggaaaaagccacaguguaacuaaaccuauuccuggcacaaugggagaauaacucuauuaagaaacccuaggccgggcaugguggcucaugccuguaauccuagcacuuugggaggcugagguggguggaucacuugaggucaggaguuugagaccagccuggccaacauggugaaaccucgucucuauuaaaaauacaaaaaaaaaaaaaaaaaauuagucgggugugguggcgggugccuguaauuucagcuacuugggagggugaggcuugaaccugggaggaggagguugcagugagcccagacugcaccacugcacuccagccugggcgacagagcgagacuccaucucaaaaaaaaaaaaaaagauugcuucuauaucagacagacugggcuacugguaauauuuuauacuuuauaucauuccaacauaucccccaaacaugcuuaauucccagugguuuaccucaacugcuuaacuuaaaaguccacugacuacccaggaagaaccugcuuaaucucuuacccccaccacacuuaaaagaugcuuuaccuuuucuccucucucucucucuuuguccuucucuucuuuuuucuuuuuuuuuucacuaugcccaucuguguggaggccaggaaguggcaggggaggugcugcugcuccagcguaugggaugcugggaggagggccagaugucacugugaccucucccacuggcacggcagaaaguccuaaacuucucuuggacuuggagugucgcuucucuuuaugcuucuccuugucuuucuucuuuuugcucuucuuugacuucuuuuucuucuugauuucucgguaagaaucaucuaucacuaacuccccagccucuaguuccccaccagaggaugagucugauucuaccagaauagguucaagcccugaaagaucaagguuagcacugugggacucugcgaacugggaggcgucagacccacagccuucagggccaggagaugaaugugcgucugaggaugacuugugcuuuuuccgggcuguuuucagaaagcucuguaacucauguccuaggaguaaagcacccugcucaucccgagcugauuucuuugaggauuuuuucacagucgcuuguugggagggauauugaaaagacuccucaucaacagagcugcuucccuucuccuuuggugacagaauaaguuucauuuuuaaaccaucaggcucccgaagggucagugucucuguguucacauagagagguuucauuuuuuucgauuugugggagccaccauccucuagggguaguuccccacugcuuccacugacuuucuuccuguggugcuccuuuuuacucuccgaauggcuugaagagccagaggauuucuccccagucuuuuuggagggcuuggagccugcugccaguggggaagugauagcuuucaacagguccauagcuguaucaguagacugugggcuggacuuuuucuuuuucuucugugacgauuccaaagacgaaauaucuagaaauaaucaagagaaguacugucaauaugaugggaagcaacuucuaacaaguuuccucucucaucaaaagcaccuagcuaacaugagaaagaggcuaacaggaaugauuugaagggagacccuuuaacugauuccuaacauugagaaaugaugcccuugugcuucuuggcuugguagagucugccucugacccuggacacaguucuugccacuaaaguuguuucucuucauugagucuucagaagcaaccaaagagcacauacccagaagaacugacuauagcugugggauuaugggaaguuaacaauucagauugcagacagaguaucauuuguuucuguguucaggacaaacccauucuggugaaaguugagucucaucagcuaugugcauaacauagcuaagaaaacugguucugugaguggauauauacugguugagaagugacccacaggugcaggccagaggacuacguauggcaaaagggaugcuagauaacaaugggcacaagauaaguggaugauuggggggagaaggaaccugguaccugguguaucacaaaugcagacuguucuucuaugcugaauccuccaaaauaccagcccuccaccucucuccuccuucacacugguuuaucggcacucagaacaagaaccacuguccuguuaaauaggccacugagucagcaacaucuggaucccuuuccccuaccccgacuccaagaaccagcgauguguuuaucccaccuguugcccauucccauccucaccuccauaguaguaaucaucagaggagugcuuccucuucuucuuguguguguccguccccaagaaguaaaguucacuauccuauaauuaaagaagaauugaccaauaauaagaugaugaggcaaaugcaguuuguaaccacucuugucuuugaugauuuuugauuuugggaaacaaagcacaagaaauaauaaaaauagaugugcauaacguuuuauuuuucuuuucucaaguuauuaaaaaauacuuccuucuucaaauauuaggaaauaugguaagaaguaguuuaagacuuuccuggcgcaguggcccaggccuguaaucccagcacuuugggaggcggaggcaggugaaucauuugaggucaggaguuugagaccugccuggccaacauggugaaacccugucucugauaaaauacaaaaauuggccaggcgugguggcccgcgccuguaauuccagcuacucgggaggcugaggcaagagaaacgcuugaaccugggagucgaagguugcagugagcagagauugugccauugcauucaagccugggccaugagagaaaaaaaaaaaaaacaaaaaaaaacucugcaucaccaaaaaaaaaugaguaguuuaagacuuuccuaauuuaaauuuucaggacuuaccuucaacuucuucuuggaagaauuccugaccugagcagcaauuucuuccucuucccuuaaaaaaucuuuguaagaacguuuuuucucucguuggcuucggccagcugcaaguccuauguccucaaagguaugaucaccaucaaaacaaucugagaagcacagguuuauuugggaaaggaaaugagaaagucaaguaaguaaugaccaaaucgucaugcagguaaugcaacaguuccucuauuuccaaauuaaaacaauguuucaaucaaguccacugaaauacagggcuagacccaggggaacagaauauuucuugaugaccuagcugcaaauacaagaaucaaaccugaagaaacaauguuuccaugcuaugcaaaggccccaugugcaaccucagauaugguuucugaguugugauuugguaggaggacacagacuugcagacgaaaggcugaaaagaauaaggauucaugugcugugcugcucucugugggaguccaggaugugauuccuauccccagacuccugcacacuggagcuggcaaggaccaagagugcugcaggggaucaccccaauaaacuaagagacucauauuucagacucucguguuggaaccccuguccugguuuucguuuccaugggcccagucuggggauggcguggaggcugagugucauaacagugcucuggaccaucacuugggaguccaggcuguggugcccaguccuggucucuauauccaugggcugcaaggauugaagaggauacccccuuuggaaugcuucucagauuauggggucauaccuucuuucuucacggagucaucauaagccauggugguccugcagggccuuugagaaugugucacuguguccaggcuccuucccgucuacaggaccaggucugagaaacaaagaaggaaaacccuccuguaaugcgaaaucacugaggagaagcaaccuuccagauggaaaugcgcagugauccaagggcugacuggaagggcagcaagaaauaaaaagugucuugucaccuccucauucucuuuguaaauacagugggguugauacugcaggaaguauacuaggcuuaauuagauuucagucaugaauuaaaguugucauuuggggaaguauauaaaauaccuccaauacaaaaaauauuuucaaaauuaaugagaauuucuaaaaugccaacaggacugacaacacugagacaggguagaaaccaacauuaaguuagagggauagguucaaucaugguuacaacauacacaaguaaagcaagaugcagagaagacagaucacaucaaacauuugaagaccacaaaauccuaccaacuggauuggugaagcgguaaaaucuauugcauuguaauuuaaacagaaaugauuaacuguauagggauguuaaauaucuuuagagcacaaugucuuuugcauuuuuuggggggggcgacaugaauuuguucaaauuuauguaacuguaaaagcagguacacuccuuacaucaguugaccauaugacagcugucaccaccaccaaggcuuucuuaaaggcuaggugaaaauagggagacauuuaucauuuguccacuggucauaaaacuuuuaugauuauuaagaccuucacuaauaagaauugcuauaauuuaaauguucuagauauuguauuuuuuauugaauuuuuacaaccuuuuuuggcauuugaguuuauauguccauuuugacuuugaagaugacaaugcuauaaaaugcacuguaagguaaaaggauuuuuuuuuuuuuuuuugagauagagucuugcucuguugcccaggcuggagugcaguggcacgauauugguucacugcaaccuccgccucccggguucaagcgauucuccugccucagccucccgaguagcugagauuacaggcgccugccaccgagccuggcuaauuuuuguauuuuuaguagagauggguuuucacuaucuuggccaggcuggucuugaacucuugaccucgugauccacccaccucggccucccaaagugcugggauuacaggcgugagccaccgcgcccagccaagguaaaguucuuuaaauguuuuaagaacaagcaauuucauaaguccuucaggaauuuuaaaauuacauauuaaauauuuuggaaauguucucauccaauuaagucagaugcuuacaaaguuaaucuaauugaucauuuauuuaaauuuaauuuuaccuucauuauuauaaggguauuuagaaauacugaaggacacuuaaaugacacauuacuaauuccuucagguagcuguggacaauacugaagcauggaacuuuugugaaagaaaagaugaauuugauuaacaagggagacuuucauaagaguuacauuaaaaagacuuauuugcacaaucagauaaaauacaauguacauacagguaggccuaaaugggaaaaugaagcauuaccaagaaugauuuauuagauuaagaaaagaaacauaaaaaagcauuucuucacuucucugagaagugaaauaaagaauggauuuggucaaaguaagagaagcuagaguaaugaaacuauauuaacuggauuguuuuaaaguucaauuggagaacugccuguucgaagggccuuuucauaggaaacgaaggggacauaaggucaggccucagauaaaaaugugaggaggcaagauacauaauguagccaguuuuccauguuccagcauuuaaggaugacacuuucucagcggaaacuacuguccuccccuuuccacccaaguggugcugacuccaaaaggggugcagguagaagggaaauacagggaauuauaucaauuuauuugaaaacagcauauccucucaauggcacuaaaauacugaguuuauaagaaaaauauauagauuauauagauuuucauaggcugauaaugccaagaaccaauggagaccucaaauuaaacacuuucugugcaugaauuuuggcaaagaauauuucagaaauaauggcaaaaaacuuaaauauucaaugucauaaauacagucaucaguguuuugucaacaacaaaaugcacuuguauauguaagcaaaggcugguccugagacuuauaacaggccuucccuuugguaacaucaaaaucaacauaaaacagaguugggcaaccuaacagaauagaaauaaguaccucugaagacagaaagaaagaaagaugacuguaucguggucucguuacuggcugcuuuaaaaaacuaguggauuaaaaaguugugagagggaauagaaaauuaggaacugcuucucagaggcacaggccaaccaagaaaaugugguguuggcauuacauauauuaggucuaccacuguuuaaauuuucuuaaaaacacugaagagcauuuuauaaauuacuggauuaaauaaccugaagaaaaaagaaggaaugaggccugaagacacguccaauucacugaagaacuggggcagccaagagcuugaaaaacuaaaauuaaacacaacggacuguaucagccacagcuugggcagaccgaugggcccugaauuucuacguucuuuaaaaucaggauauuauugcagcucaggguuuaguuuuggaaagauaccagauaaaucucaagcaacagugugaaagaaaggcagaguucaggcaacauuuauauaagaucagaugaaccccugauauuccuuccaggucuugaauacaaucugugaaaauucagaguucagggguagagaguagauugugaggauuaaugaaaaugaauauuagguuugauuuucacauuagaaaagggaggucauaauuacauuaaauguuggcaaaugugaaacagguguuaaaacccagucucaauucaauaauuugggaguuuauaaaauucaauguugucaacuccaagaggcaagaauaauuuuguuugucucagugugcuaagauaugacaacauaaguaaaaguucacuauuucauacuguugauacaaguaaaaaacugguaccauaaaaauguauacuuaugaaaugcacaaauuguuaaauagcucuucggggacuuuucuucaggauaugaaaaaggagggggcagaguugcucuuucccugguagauaagcauacaaguuauguucaggcauaggccuuugggaugaccaaaguaaucaggaggaaaaaguccucagauauagcacuuugucauuuugaaacuucaaauuacaguuaaaaaacagguuucagacuuuuuuugagguaacuugagcuccugcaaucaacaaccuucuucaccccauaauguaaaugaguaucgaaaaaaaggaaacaaaguaagccccgucacacggacaguaagagaaauucugaacuccaggucuguuccaggaugagagccauguccaagauucugcauucucuucuuccaaccacuccuuucaagaacucaaaaugccagucagugcagguaaaggaagaugcacauccgccgguugccaauuucugaaauuuucuuguuacuucuacgauacagacaagugaugccuucucaacuucguccagguuucuuccaaucuccgaacacggugacuccgaauccucuugccacucccuucuccagggaccuaccuaggcagcacucccagccccugccagcucuggaagcugcagagaucccgacagucggggauggggauugaauccucucauugcagugcaauuaagcggaaccacgaccaccgcacagauuggcugacaacacacauuccauaagaccagcaaucgaauuuugagaagccuuguccaaucaacaggcuuuauuugggauucaguuuuuuacuuuguucuauuaggaggaaauauaaucagccaccagcuuagcccuccaaaagaggggacagagauguuucuccgcuuuugcacgcuauaaagugaaucuacaaguaguaguugguggagggaaaaugggccugcauggagaaggcgcccaccacgaaggcacggccaagccggguugcacgcaagaaacacacaaaauaccaggugauuuacacaaacagcccccaggaccaccauuuuugugguccccaaggcaaaccagugggauucucccggcaguuuugcggcaacagcuagcucaacaaagcucugugaagaggaaaagaagaaagcuccucguacuuucuccugccagccgcagccccagcccucccguggccgcggccacgagcccuuucccccugacagcccgagggacccccgcaucgcggguuccgagccgcacagcucgaccugaacccggguucccgcgucuccggcggccucacggcgcccccgagggcggagacggcccgggcagggggaggggcggcccggguccgcaggcccccggggcggccgcacgcccccucccggccccgcagcuuucccgccuuccccguuugaacagcucccgcccgcccuccuccuucugcccgcuccagccccuuccugggggcggcugcggccgcuacuccaguccccggcucggccccugggcuaggccgcgaagggccuggggcaccccagaggugaugucgcgggcccagggcggcggguggcgacggggcggggcugcugccgccucagggugggggcccagcccggucuccuggggucuccgcucgccgcuaccuucacucggcucgcccggaucccgccucaacgccgccgaucgccgccaucuuggagaaggagagaaaagcgcgagcggccagggagccucagucgagcccagagc

SEQ ID NO: 191906 - RNA, 45747 nt, Homo sapiens
ggcgaguucacccgcggcggaggguaacuuugcugugcuguuuuuugagcaguugucuggucccuggaaguguagcaucgagagaguuuucuaauuacguuuacaaaauaucuucccuuuggccauacaaguggugacugccaugucgaacucgcggcccaggucccgccgagacgccggggguggcgcuggggcagccggccgggacgagcuggugucgcgguccuugcagagcgcagagcacugucugggcguccaggacuucggcacugccuaugcccacuaccuccucgugcucagccuggcgccggagcugaaacacgacgugaaggugaggguccuuuuuucucacuugcuggcagauccaacguccucguaaaaaaaaaaaaaaaaacagaaaaaaaaaaaagcggaggggcuagggugccugggugggugguugcuguuaauauuuagggcccuuuuuucucacuugcuggccgauccaacguccucguaaaaaaaaagaaaagaaaaaaggcggaggggcuagggugcuugguuggguguuugcuauuaauguuuacuguucaaccuugacaucuuucguuuauucacaccuacgaccagcccagaggaaaauccugccgucuucaccuucgaaauauguccagaaucuuaccaguucucaccaucuuccccuuuacuacccugguucgagcuucagucaucugccggcuguugcagucggcucucaacugagcucucuccugcagucugugucaacauagcuagcuuuuugcaacaaaagucaaauguugucauuucucaguuucaaaacuuucaucucguuuaaaauuuuaaaggcccucgaauuggaaaugaggucucacgugauccucuucuccuuauaucuaauuuaagcaugcccuggcuugagggcuuuuggauuuguuauauuguguguaguaggaauauagugggccucuaguugaauaaaguguguaauuagccuaaagugauuaucauuuaaugaugcguucuuuaaacuucaauuauuggauuauuugcaacaauuacucuguugaaaugcuguucuuuuuugaaguacuuuuagaaucuaaauuacgaaaaaugauuuaacuuaaaauugcaauuacuuugcuucauuuagacugaggguuugucaaccucagcacuauugacauuuugaaugggauaauucuuuguuaugggggaggggagguguccugugcauugcaguauguuuggcagcauccuugaucucuacccacuaaaugucaguagcgucuagauguuuguaguucauguaaacuuaguguaaauuucaggaccagcuguccuacuugaggaggagaugauauguugagauacaguuugcuucucuugguaggcagcaauagaaaaauggaucaacucaagugaucuuuccucaguuacuuguuucuuaguuuccucuucugugaaacagggacgcagccucucuuaaaaauguuuacuggguauuaaaaguauauuuagacugggugugcuggcucaggccuguaaucccagcacuuugggaggcggaggcggguggaucacaaggucaggaguuugagaccagccuggccaauauggugaaaaccugucucuacuaaaaauuaaaaaauuaggccgggcgcgguggcucacgccuguaaucccagcacuuugggaggcagagacggguggaucaccugaggucaguaguucgagaccagccucaacauggagaaaccccgucucuacuaaaaguacaaaauuagcugggcgugguggugcaugccuguaaucacagcuacucgagaggcugaggcaggagaauugcuugaaccugggaggcagagguuguggugagccgagaucacgccauugcgcuccagccugggcaacaagagcgaaacucugucucagaaaaaaaaauaaaaauaaaaaauuagcugggcgugguggcaugugccuguagucccagcuacucaggaggcugacgcagaagaauugcuugaacucgggaggcggagguugcaguaaguccagauugugccauugcacuccagccugggcgacaguguaugacuccaucucaaaaagaaaaaauaaaaaaguauauuuaaaauuuguagugcaaugccugacauucaguaggguaagcaacuagucuguuuccugccgaacaaagucuguguuuguuuguaugggcccccuguaaaaugcucauugccugcuacucuauuccccauacccaaacuccggccacaccaagccacuuaucuguagacccucugauccauuucauauaaucugugcgggguuuuuuuuuuuuuuauagagucucacuguaucacgcaggcuggaaugcaguggugcgaucucgguucacugcaaccuccaccuccuggguucaagcaauucuccugccucagccuccugaguagcagggauuauagguguucgccaccgugcuuggcuaauuuuuauauuuuuaguagagaugggguuucaccguguuggccaugcuggucuucaacuccugaccucaggugaucugccugccuuggccucccaaagggcugggauuacaggcaugagccaccgugcccggccagaaucuccuuucuuauccuugucucucuaguaaacucccucaagauucaguuccaaauaucaacgcuuuuguauaaaauaugugaagaugauuuaaaauguuuuaaugacuaaagcuuucccucuuuccacaguauugcagcauggagaauggauggagggagaugcaguuggaauuagagugacagcguuaaggcuguugcuguaguccagcaagugguuacaagggccagauuagguuguaacugugggaauggagaggagguaacagauuuaaagauauugagagagcauuggcuagguuugaaacaguguauguggaguuaagguaccauuauaaggugacuuugugguuugagguugaguggugucuuaaucuuauagccugugucagaggaguaugaugaguucaguguagaacauuuugaacuuuuccaaaauuaaauuucucucuauagggccucugugaggauaagaacaagauuuauguugcuucaguucuuugcacaaggauuguucaggaaauauuugaguuggacuacauuugcaauggcuggagauccauugccggguugaaaugacuaauaggaagcuguaucuaugagucugagguucagaagagaaggucuugacuagagauguaaauguagcauccauuaacacaugggugauaauaaaugcguuagggauggaugagugaaaaaagaagagggccaaggacaaacuccaaaaacacaggagccgacaaaagugaggcaguucuggagaauaaggagaaugugauacagcagcuaagaguggggggaguuuagagaguggucagacuaauucugcuuauuauugccauguaggugguaaaauucauucauuugugcacuuguucagaaaacagugccuacuaaaguuaaaugaaguuuaaggugauuguucaauagugauuaaguucgauugcuuggaaucuucaacuaaugauguauauucuuucaucuuuuauguuauugacuaauucauaauuuuuuucuuauuuguaaaggaaacuuuucaguacacacuuuucagaugggcugaagagcuugaugcucucagucggauacaagacuuacuugguugcuaugagcaggccuuggaacuguuuccugaugaugaagugauuugcaauaguaugggggagcaucucuucagguuuguagugauuuuaguauuacuuguuaagaauuauucuguauuagucuggauagggauaaaucauacuguaauuuuaacagggaaaguuuaauauggagaauuauuaaggagaauugaaaagaauagcagauauauaauaaucauagcaguuuuaauauuuuguaauauacggcauaauagccacugcccuuaggaguaagacagaauauccaaggaagaguuccccucacugggcugagugccaccccuuauuggagagggcacagcugugauucuuaggauggcagaaaagucacuguagugccuugccagggaacuucuuguaaauuuguuuucuggaccuggguauaguuuugccucuugggaugccagagaaagccucauggggaaguaucuuaucagagguacuccauuacaaaaccauguaguaggguaagaagccuuggggaagcugcugacccuuggaugcugcuagcugccaugcauuucaggagcuuggugcuagacaagcccugugcaggaagcaaaacucuuucuugcuacagugucucuccagcacuguuuuuuuugggggcagagucucacuuuguagcccaggcuggagugaaguggcgugaucucagcucacugcaaccucuccaccuucuggguucaagugauucucguuccucagccuccugagaagcuggcauuacaggcgccugccaccccacccagguaauuuuuguauuuuuaguagagacaggguuucaccauguuggccaggcuggucucgaacuccugaccucaagcgauccacccgccucagccucccaaacugcugggauuacaggugugagccacugcgccuggccuccagcacuuuuuuuuuuuugagacagugugucacugugucgcucagguuggagugcaguagcaccaucauggcucauggcaaccuugaccucccaggcucuggugaucucaccucagcagcgcccccaccugcacuccaguagcuggaauugcaguacaugccaccacaccuggcuaauuuuuugucuuguuuguagagacaggauuuugccauguuguugcccaagcuggucuggaacuccugggcucaagcgauccucuggccuuggccucccaaagcacugggauuacagacuugagccacugcacgcggccucuccgcacuuuuuaccaacaaagcuuacccuugugccaacuggugggagaauauuaaagggccagauacaguuuucacagagcaggcaaaaaagggugaauuuggcaauaaguugauaacuuacauguugggagucuuggaaccacucccagauuugcugauuugcuggaagggcucacaggccucaccauguaguccuagucauggcucuuguguauuacugugaauggauacaaagcaaaauuugcaaaggguaaauguguauggggcaaaguguaaaggaaaaccaggugcaagccuccaaaguuccuuuuucagugaagucacgcaggaugcacuucauucccacggugaguuaugacaguacacgugaaauguugccaaccagggaaacucauuagaggcucagugcccaggguuucuacugggagcuggacacuuggguacccucugccuggcauauacuaaaauccuagauucccagaagaaaagcaggucagcuguugagcauaaaccacauuguuuguauaaucaguuuaggaauacuaucaguuaggauagugagaacccuccccaaauccaaauucccagaugccagccaagggacaguuuuguaaucaggccuuucaaaggauggcagucaggccugcuauguuaacucugcauacuaguacaugugcgugaagaauucugugaaaguacaggaaauaaaaugaaugguuaacauugcuucugaguuugaacguuucagagugauggggacucagcaugguucugccaaguuugaaagugacaauugcucacauucguaggaauuuaguuaaucucauuuuaaauguuccuuuuagguauuuucaugcauuuccucacuaauugcuuucucuuucccucaaaucacauccagcuaaaaaaaaccuuaauguuaugaauaaugaacuacaaaauuccuaagugaccacagaauuucucuuauuaaacguaucucgaguucauuaguucuuaacaaucaaucugcuaccuuugucucuggugcccauggggcccuugcguggcucacuagacugugcagggcuagggcucugggaaugcaguguauguacucuguacaguuuuaagacauuaaauuaauagagcaaucaacucaguauuaugcuuuuuuuuuucaguguggagaaauaauguuuuauaaauaacuuuuaagaagaacauggaucauuaaccugacaaauguacuccccugugauaauuaauguaaacucuuuauauggucauucacaauaaguuguaugaauauuuauuacaauuuuggaucguaugucucuccucagaaaaaauuuugagauuugauguguagaauuuuuuguuaacaguugcuuauuugaaaaaauucuaggucgggcaugguggcucaugccuauauucccagcacuuugggaggccgaagcaggcagaucaguugaggucaggaguucgagaccagccuggccaacauagugcaacccuguuucuacuaaaaaaaaugcaaaaaguaaacgggugugguggcacgugucuguagucccagcuacucgggaggcugagguaggaaaauugcuugaaccugaaagguggagguugcagugagccaaaauugcgcgacugcacuccagccugggugacagagagagacuccaucucaaaaaaaaaaaaaaaaaaaaaaaaaauucuaccugucaagacagaaugacuuucuguugaggcugcuuaauaaauugaaaauauaaacaaaguaguagugaguuuuuuauguauacauaaguguuuuuguaaaugaaauguaacuuuuucauagaacagccuuuuuuuucuuuggaauuuuuguguacucuccauagaaacuuuauaguuaggaaaaacuggugaaaacaaaaaauuuuuguuuuggguuuguuuuaauacaucuaauuucacugccuuguacaaaauaaugggagaauucuuguuuaggaaacaugauuauaauguccuauuuuauauagaaagaucccuuuacauguucaguaauuguucucuaguaucauucuuuuccuuauuugguuauauuaaguuuuuuuuuuuuuuuuuuugagacggagucuugcuuugucacccaggcuggagugcaguggcaggaucucagcucacugcaaccuccgccucccagguucaagcaauuuucaugccucagccuccggaguagcuggaauuacaggcacaugccaccacgcccggcuaauuuuuguauuuuuaguagagaugggguuucaccauguugcccaggcuggucucgaccuccugaccucuagugauccacccgccucggucucccaaaguggcgcccaaagacaugagcuaugacgugcagccaaguuguauuaaguuuuauucaaugaaaaguucuauauaagaaacacuuugccaaacuuuauuagcuagucucaguaauguaacugcaaggcauuuuaauagucuuaauuaacauggccuagggagugacaaugaauucuccuuuaaaaaacaaauauuugauaguuuuuaauuguagaguauguuaauaauuagaaaaauaaggcagauaauuaacugaggguuacuuguucauguuaacagcuaaccugaucagcuacagcauccauuuucuacaaauuagcaaccucuuuccaccuaaaugaaauuuguuugaaaauauuuuuaaaaaucuuuuuuuaugaauaaucuccucaaauuaguuaaaaaaaucuauauuuuaauuccaaaguuuucuuuuguucuuuauauaaugagaguuacucuauaggauucaauuauauuuccagauuauacacauacggugaucauaacauuccaagacuuauguuucaggauaaacucaauuuaacagaaaaguggaacucuacauacuuuugacagauuguaacuuuuggugaccuguuguuguaggacauuagucugagcaguuaccagucauugagacaaaaaauacuugguauuaguuugcuuuggggagauguaacuaagcaaaauuucuaauuuggacgguagcaguucagaauucgggauagugugaauguggcuuuugcuauagaauuuaccuuuguucuugacuuacaaugguucuuguucuauacuccuuuugucaucaaaaauagcguaucauuuacuccccaccaaaagaaucuuccaggagaaaaauauuuccaaaguaaaugauagcugcuucuccugacacuuauuuguguaauaaaaugugucuggagugucucaacuucacaaccuuuuguuaguccaguagcaucagauuuaaacaaaauguauuuaaauugcuaaucaagaagauaauguuuuuccuaguuaaaagaaaaagggcauucuggcauucuuauguuucacugauacguuguaucauaucagugauacauauugggucuuucaaugagauaugcuuuaauggaguagauuauauauuuuuuagauuagaauuucaguuuaaggaaauugauaauguauuaaauaucaaaccuaagggaagcacaaacccaggaaauuauuagggguguguuuaauacccauugcugaauuagucucacaaaaaauaaugauuacauacaauguacaugguacuauacuauguacaaugguaguugcaaauaagaacaagauaguucuaccuucaagauaacuuaaaauaacauauauuaacugaaaacauugaaauuuucaccuaaaucaugaaugucucuuauuugacauaggaccauuguuuuuuguuagagugcagucccguuuggacuucuagaaugucucuuuugcuuaaaccauaccuggaaugaauaguaugauuaaguuucucuagcugggcacgguggcucacgccuguaaucucagcacuuugggaggccgaggugggugaaucaccugaggucgggaguuugcgaccagccugaccaacauggagaaaccccaucucuacuaaaaauacaaaauuagccggacgugguggcgcauuccuguaaucccagcuacuugggaggcugaggcaggagaaucgcuugaaccugggaggcagagguugcagugagccgagaucgugccauugcacuccagccugggcaacaaaagcgaaacucugucucaaaaaaaagaaaaaaaaaguuucucuaaacuuggcagaaugcuuaaagguacuuaugaagaacugugaaugaagaggguucuacuagcucaguucuguuccaugugugguccacacauugcugcucacccacagauuacugguuaaugacagguaaguauagaaauugagaguaaguguuuggaaauggguguagcaacuugacauugcuguaaauccaagcauaugguuaggaaacuguaaugcagaagagaguauauagaucaguuugggugcuggugaaaucugauauuacgugagcuccauaugaaucaugugcaauacagccauaucagucugcaaacaauuagauguuuaagaaagggaggauucucuccuucucaguauugcacuugacuagucuuaaaaauaaaaaauuaagaagaaaagggaggagagguucuucauuacagauaguuugagaagcacuguucuagaggguuggauagguuuuuuuuucuccuuuuauuuuuuauuugcucacauauaauuaaauaguacuuaauuuuaagugacuugccuuugauuuucuuccagagcauuuauuuagcuuagugucuguaggcacaaugguucccuuucugcggugauauuuauuuacuuaguaugauauuuaguuaaaauacguaauuauaauaacaaguacaacugacauaaacugaucuggcagcaaauacaacugacucuugaugacuauucaacucaguugcugagacaaaaggcaugccggcccccacaaagaggagccuacuaagccauaggcauuaguguguuguacagagggaauggaguuggcuaaauggaggaugacugugagagcuucugcuauacauuaguauaacaguaauuuauagucagguacuuguuugucucccggaauauauaaauguagugguucagaaaagaaagaaauacugaggcuugcaguccucacagacagcuucccaaaagagguagcacuuggauuggcaggauuuggggugcuggcauggaauucccaggccaagugaguggcauaaacaaagguacugcaguugguagcauauaguugaauauauuuugucuuuugucauuuuuuacucuagaaugggcuuuagggaugaagcagcuggguauuuucauaaagcagugaagcuaaacccugauuucagugaugcaaaggagaauuuuuaucguguugcaaacugguugguggaacgcuggcacuuuaucaugcuuaaugacaccaagaggaauacaauuuauaaugcagcaauccaaaaggcaguuuguuugggguccaaaaguguuuuggacauuggagcaggaacuggaauacuaagguugguaguaauugcauuuuaaugguauauacauguauucuaauguaaauuaaagauuuugccagauauggaaaauuuaacauuggaauuuaaaaguauuucuuauaaucuuguuaggguuauuuauguaacuauuauguuuuuuacuauaacuuuuaucaagaacuggacauaacugcuaagaaaaauuugggauuauugaaauuuugaauaaugaauuugagucuuuuuuauguuaacauucugauggaaucuaguugucuaaguuaaagcccauuaguauucauuaaagauacaaugccaguugugucuuuaauagaguagaucccaugguuuauuguaugauuuguuucuagacaagaauauuaguuuauuuuuuaaugcagagugaguaaugguuguguuaaagaauaaaaggaaaaaccccacauuuuagcaucaucauuuccuuaaaauuugagaaaauacaguagauuauuuuuucuugauggagaacuuuuuucccuuguagcauguuugcuaaaaaagcuggagcacauuccguguaugccugugaguuauccaagaccauguaugaacuugccugugaugucguggcagcaaacaagauggaagcagggaucaaacucuuacauacgaagucacuugacauagagauuccaaaacauauucccgaaagguauuaucauguaaacuaauuuuaguguuuauacuucucuauuuuuaaaaaacuaagauauauuucuagcuuuuaguccaaacaaaaugcuacaaaacccuuauuuuguaaagauauggauauaggauaagauaguuuauuauaagacauauuuaaauaaaauuauauucuuuauuaaaaauauuuaaagaucuugagaaaaauuuguggcaagggaucaaauaaacuugaucuuagcaaguuacuuuaccuuuguuaauuucaguguucucauuguaaaaauggauaauucauccuguguggucaauaacugcuaaaaaguuguacuuaaaaagaaaacacaagcaguucagauucaauggacuuaucacauuuuguguuaauauacuuguuuaaaaugaaagcuuuggaaaugucagcugucaguauauuuuggcaugggcccuuuaaaugauuugaauauaagucauauaagucuuggcuuuuuaguauguuuucucacuccgauccauaucacaagggugauggaauuuuagagcuagaaggaauuugaaaaugaucugguuccacacuagucauuuuagagacaaaguuuucuuuauguagcacuuacuuuaccugucucuucuggguuuaacuuccaaucuuacuucaauucaguuuguauugaaagaagauguuuuugugccuuauaucaacuaugacuuuaaaaaguuuucuuccauacauauaauaguauuuaucuuaacauaguaccuaacacuuuucaaucgucucuacauuuauucucaugaaaaaauuccuauuagauuaaugcaaaugucauacccauuuuauagaaaaaaacacuaaaaacacuguccucaguugucuuguuccacuugggcugccauaacgaaauaccacagacuggguagcuuuaacaauaggcauuuauuuucucacaguucuggaggcuggaagaccaugaucaagguguuggcaaguuugguuucuugugaggauucucuuccuggauugcagauucugcuuucuuguugugucuuuacacggccuuuccuucuccaguauagucaguuucgggguuaaggccuucaguaugaauuuugagagggacaugagucagcaugaaucaaaguuaccuuaauuuaaucuaccuuuuucucacagauaauguuguagaaagaucuauugguuuugaaccaggagcuauggauuccagauuagacuauuauuaauuuauuuugaccuuaagcaaaugucuagaccucaagguauuggaccagaugauuugaaacaccuuucacauucuaaguguaugcaaucauaaauacuggauauuuucuguauauaagaaguuggguuuagccacuguggaggauaccaaagucauucuuacccucaaggaacuuacagucuagauaggaagauaaagaauauucaugaaacuuuucuuaucuucuaacuacauaaaugagugauacuggcaauaaaugcugaaggaguucagagaagggagaaacuauuuucguaugucuuugaguaaaguuuucuagaaagaaagaauggacagaagagcagaguucuguggacgaggcuuuuucuaagacucaggcaguggguaaagcaagagaagugauaagagaggcacagucaacauauaggaggcaaacauggaugaugcaguaucauagaagguagagauagauuuugagaaggagggcucucuccugcaaucaguguuauuuggagauaaaaaaaugauaacugagaaagaggauucauuuugauaaguagggaguuauugaugguagagaauauuuuuauagacuguuggaguuggaagucuucuugcuuggcauuaaggaagagacugauaaagguaaugggugugaaccacucuuaaagauguaggcaaugaaaaaauagccuggagagagaacaaggccaagugaaguuugucauuccccaccuccccccacccuccaucuuccaaaccaaggagaaggagccaguggagaacaaaggagcuuaaggaacauucgaguaaaguuccucaagauucaguaguagaucuuaaaaaugaaauguauuaggauauauuacauauggacuguuucuauaauauacucuuccuuucuccucucagcuuugacaucuuuauauaauagcaugauauuuuacuuacauauaucuuuaaaaaaucauucuauagagugucccuaguuguaacagaaacugucgaugcagguuuauuuggagaaggaauuguggagaguuugauucaugcaugggagcauuuacuuuuacagccaaagguaagcaguaugaaaauacuuacaacugauuaagaauucguuauuucaucagagauuuauugaauccuuaguauauuuacaaaacaauaugaaauauauuuuccauugccaagguguacauacugugugguuggaaagaaaucuaugcaaaaaacuuuuacuggccgggugcaguggcucaugccuguaaucccagcacuuugggaggccaagguggguggaucaccugaggucgggaguucgagaccagccuuaccaacauggagaaaccccaucucuacuaaaaauacaaaauuagccgggugugguggcgcaugccuguaaucccagcuacuugggagggugaggcaggagaaucgcuugaacccgggagguggagguugcagugaguugaggucacgccauugcacuccagccugggcaacaagagcgaaacuccgucucaaacaaaacaaaacaaaacaaaacaaaacaacauaaaaacauuuacuaacaacaugauucaauguauaauuaugugccugaaugagauauacaggcaaaaauacuccagggaagaauucauaggaauugagauuacuuuauggacggacugacuauggaauucuugaguaggguugaaaaacggagguacuuucagucuuacagaccucacugccuagaauuuuggcaaauuaucagaagggaguauaguaauagcugguuugguucuguuuucagguaccuguugaacccaggcuauggcuuggacaggacuauuauaauugccaaauuauauuuugcauugaaauccucuauuguagcccacaaaucauugauuugguuuauaugauauguguuaucaaugaaaggauuuuaauauguaauaaaaauucaauauuaacagaaaauuauuuggauuuaaaauugcuaguuaaagguugaaaagagcaguuuuuuuuuuuugaaguagcaacaggguuucaccauguuggccuggcuggucuugaacuccuggccuuaagugauccaccugccuuggucucccaaagugcugggauugcaggugugagcgaacgcuccuggccaagcaauuuauuuuuuaaguagguauugauacugauuucuugaucaaagucauacccaagucuuuuuuucuaugcagacuuacaguccuuucccccccauccucccucuuuucuuguauccuuugcauuuguauugugagaaaaaaauauauauauucauacauauauagcaaugaaaauacuuauucuguuuuuuugagauggggucucacucucuugcccagguaggagcacaguggcacguuuuuuagcuuacugcagccucaaacucccgggcucaaguggcccucccaccucagccucgcaaugucaccacacuuggcuaauuaaaaaaaacauuuuuuuucuguagagacagggucuugcuauguugccuaggcuggucucaaacuccuggccucaagugguccucucuccuuggcuuuccaaagugcuggaauugcaggugugagcugccaggccuggccaaaaauacuuuuuuuuuuuuaaagauggagucuugcucuguagcccaggcuggagugcaguggcgugaucucggcucacugcagccucugccuccuggguucaagcgauucuccugccucagccucccaaguagcugggacuacaggcgcgugccaccacgcccagcuaauuuuuuauguuuuuaguagagaugggguuucaccguguuagccaggauggucuugaucuccugaccucgugauccgccugccuuggccuccuaaagugcugggauuacaggcgugagcuacagugcccagcccaaaaauauuuuuuaaggaagaaaaaaaaaccuuuaacuuacuuuauccuuacuuauugucuuuuuagguuuuuuaaauuauauuuucauagcuuaucauuaugcacacacauuuuuacauacaugugauaacauaauucuuauuguuauuuuuuuuagaccaaaggugaaagugcuaauugugaaaaguaugggaaaguuauaccagcaagugcuguuauauuugggauggcaguagaaugugcagagauaagaagacaucauagguaaguguauuaguccauuuucacacugcuauaaagcaccucccaagauuggguaauuuauaaaggaaagagguuuaaaugacucacaguucugaaugcugaggaggccucaggaaacuuacaaacauggcagaaggggaagcaggcacgucuuauauggcagcaggcagguuauggggggcagagagagagagagagacagcacgagaccacgugggugaguguaggaaaaacuaccauuuguaaaaccaucagaucuugugagaauucacucccuaucaugagaacaguguggaagaaaccguucucauaauccagucacuucccucccucaacuuguggggauuacaauuugagaugagauuuggguggggacacagagucaaaccauaucaguaagugacuauuuaaauaguaaauauugaaaaauaguaauuauaaagagaauauuacagagguuaguuagugaauauguauuugggugaggauuuguaguuuugugaccuuuaaauucaugcugcuuacacuggucuuauuuuuuuuuuugccuauuuuaaaugaaacuucaugguuaaagccaguuuuuuuuuaauggaaaauuaauuuugauacaacuuaggacucuaguugugauauauucauguagaaaaauauuaaguucugacugauuuuaggugaaguuggaaugaaagauuccacugugaaaauaaauuuuggucuaauuacuucaauuucccuuuucuuaauaauuucacuaauacuguaaugauuuguaguugggcuggauggaauuuuaggaucuuucuaagcuucuuccaauaacuuaaucguaaauguagcauauaaauauuuuaggacauacugauaagugguuugaaaaaaaugaaaaccacugugaaccccucaccaguaaguaacuacuuuucaucuuuguuauauauuccuuuacucuuuuucuuuguauguuacagggagauaguaaaaauguuuagagauugguaggacacagggcacuaaccagacaguggacuuaauuagcagauuggcugaauuagaauguacugguugaauauuaguuccauuuaaguaaauguagguguguguaaauuuaauuuuguuuaaaaacucaguaaauauauuugcuuuuccuuugugagccuuuucauguaauagauuugguucaugacuuuaaaaaaucaacuucuugguguuguaguuacuggaguuuagaauuuuuggauugcuuccacuuuucugcuuuuaagaaguaggauaaacaucuuugcacuuaugucuuguggacuuguuucuauuauuuucuuaggauaaauuccuuaauaaggaauuacuggguuaaagaauauguacaguuuucaggcuguagggaugccuuacugcauugcccaccagaaaagcuagguugugucuugcugagauuucuugcuguaacauggcuggaccccuucccucaauaguuccucuuuaggagaccacuaauauuguuugucuaagcaaaggagaaauuaaauggcugguaucuacauuuugaaaaagaauaacuuuauuauugacucacuuauuuagcaaaugagugccugauuacaguagaagcaccauaggagcuuuuguaaaaauaaaaaggguuuacaguuugauugaauagguguaggucuggaugaaugaggccaauaucuuuuuuuuuuuuuuuuuuuuuuaaacaaaguucagcauuauggguugaggacuaugaagaaagguguugacaaaauaaaugugagugcuacuguuuuaccugguagaaacauuuauaaaucauuauuauaaaaauugccauuuggcaccuaaucagcugaauuuaaugcucuucucaauaagcaaauguuuaagaauauccaaggaaacuaaacuugccuuauuagauauaaaaaccuagaaguaaaaaacagcaauguauugaugcagaaagacaaauacaucaguggaacacaauaaagaaucuagauacagaccuuugaauuuauauggauuuaguauaugauacaggugugauauuucagaucauugggggaagggauaaacuauucaggaaauggaaauggugugcuucauuuggggaaaaaaguuagaucccuacuuuuaauucugggugaguuaaacaucugagggccaaaaaaucuauuugauggagaccuuccaaagcaaaacacagaguagggcccagaagccacagaacauugacaaaugugaccacauuuuaaaacaauugaaaaaaaucuaucuggugaaggauacuauaaaguuaaaaaacaagugacagacugagauaaauauuugcaacuuuuauaacaaagcaugaauauaauugucuauuaaucagagaaauggaaauuaaaaccaaugggauaacaauuucuaacugcuuauguuagcacauuaaaguuguuugauaucuuauuuucucauagguuuauggaaaauuuauacacuguuagugcaacauuuuaguagcuugauuuggccuuuucuagcaacacuaaagauguuuguguccuugaucuagcauuuccgugucugggaaucuauccugauaaauacucauacaugugugcagugauguguguacaaggauguucacuauaauacuguaauuggaaaaaucaaagcaaacaaauuaucugaauguuuauauuaguaagaaaguauuucaauaaauuaugauguaacagucaccuaauguaguauuaugcaaaaaaaugguuaagguacauguauagacaaggaaggaaguuuauggcauacuauuaagugagaaagacaaggcauaaucuuaggagcagugagcauaccuagaacccagaucuugguuuuuaaauaccauuucucaccaaaaggaacuauagcuucuuggagcaauggcugauuccaguacugggguggaauagauucaauaugauucuggggcauccuguauuagaaagugaggaagugcucaaaaagggauuuggugggggaaaggggagcaaaaggacacagcagcaugcuugaagacucucccacuggccaaaucugggacaauuuaaucaccaaaauaaauaagggcccuaauggauugaaacccacugaauaagaaucccugaauuucuauguaucuuaagcagauuaauaaauacauaaauggggauaaaaguacagcucguccuuacaguaaaugccaacuaauaguauagaaaaaaugaggcagaauuaguuuuuggaaggcaagaaucaucaauagauccuaaaucaauggagggaaaucugaugaggaucagggcauuuauauaguuucaaaguaucuuucaaauuacgacaaaaggaaagauuguaaguauauagggaagaagccagacaacaucuuuuuuuuuuuuuuuuuuuguuuagacagaguuucgcucuuguuucccaggcuggaaugcaguggcgcgaucuuggcucacugcaaccuccaccucccauguucaagugauucuccugccucagccucccaaguagcugggauuacaggcaugccugccaccaugcccggcugauuuuuuguauuuuuuuuuaguagagagggguuucaucauguuggccagguuggucucgaacucccgaccucaggugaucugcuugccucggccuccccaagugcugggauuacaggugugagccacugugcccggccuguuuuuuuaaaaaauuuaauuuaauuuaauuuuacuuuaaguucugggauacaugugcagaacaugcagguuuguuacauagguauacaugugccauggugguuugccgcaccuaucaacccaucaucuagguuuuaagccccgcaugcauuaguuauuuguccuaaugcucucccuccccuugccccuaucccccaacaggcccuggugaccacacaacaucuuaaccaagugauuaaagcuaacaucaacaguaagauugcuccagauuugaugcuuugaggaugcauugcuuauauaguaccacauccaaaauguacagccugcaaucuaauugugagaaaaccuuggacaaacccuaguugggaccauucuguaaaacaauuggccuaccuucuuaaaaaaugucagugacaugagagacaaagcaaagaugaagaacuguuuaagaugaaaggagauuaaagagacaggacagcuaaauugaaacuaugaccuguauuggggaaaaaaacuauauauguauauuuugaucuugcuguguugcccugguuggagcacaguggcucaaucauggcucacugcagucuugaccucccaagcucaagugauccuccuacuucagccuccugaggagcugccaaccacaggugugcaccacuaugucugcuuaauuuuuuaaaguuuuauagagacagggucuugcugucuugcuguguugaacuccuggacucaagggauccuucugccuuagccuccuaaagugcuuggauuacaggcaugagccacugugcccugccugcauuauugauuuuugauucaguugacaaauacagaauaugaacuguagguuagauaauacugaauuugauugcugugauuaagagaauauucucauuuuuaauaaagauacacaaguaucuuuugagagauaaauaggcaugaugaauauaaccuacucacaaaugauacagaauguuucaguaauguacaaauagaguguuauauacaaauauuaaaaaaagguauggaaggauacacauuaaacuuuuaacagugaagaaaugagaggacgaguacugugaagguggacuuuuuaccauauggcuugaaguuuugacaauauauauucacguaguuuauaauacauuagcaagaaauugucuggcugggcgcagugacucacgccuuuaauaccaugacuuugggaggcaaaggugggcagauggccugagcucaggaguuugagagcagccugggcaacacagcgaaacccugucucuauaaaaaauacaaaaauuagcugggcgugguggcaugcaccuguagucccagcuacucaggaaguggagauaggagaauugcuugagccugguagauggagguuguugcagugagccaagaucacaccuuuguacuccagccugggcgacagcaugagaccuugucucacacacaaaaaauugucacaucuuuuuuguuucaacuugugacuuuuaauuuugaguuauugaaaucauaguaggcugggcgcggugguucaugccuguaaucucagcacuuugggaggcugaggcgggcggaucaugaggccaggagaucgagaccauccuggcuaacauggugaaaccccgucucuacuaaaaauacaaaaaaguagccaggcgugguggcaggcgccuguagucccagccacucgggaggcugaggcaggagaauggcgugaacuggggaggcugagcuugcagugagccgagauugugccacugcacuccagccugggcgacagagcaagacucugucucaaaaaaaaaaaaaaaaauuauuaguaguuccauuugcugauucaucuuuugagaguguaauaaucuguaaaaguagauuauuugaacuuuugaaauuuuauaaaggcaaauucucuuaaaaaagugccacugagaugagguaaggugagaugagguuggaguaguuuccuuuuacaaaauguuuaaauuuucauuguaaauuuucuuuuuuguuuuuuuuguuuuuuugagacagggucucgcucuguugccuaggcuggagugcagugaugugaucauagcucauugcagccuugaacuccuaggcucaggugauccuccugcuucagccucccaaguaacuagaacucuaggcacacaccaccauaccuggcuauuuuauuuuauuuuacuuagaagaaucuugcuauguuguccaugcuggucuuuaacuccuggacucaagugauccucccaccuuggccucccaaaguacugggauuacagguguaaaccaccaugccuggcccaauguaaauuuuuguugacaucaaacauuguuauagcaaguguguaagccauaaguuuaugauuugaugaauuuucaugaaguugauagaccuggguaaucagugcugacaucaaggaccagaauauuaccgcuauauaauauaaagugugcaggaagaaaccccaucucuuuaccagugccccacucucccuagagcaccuacuaucugacuucuaacaccguagauuaguguugcuuguuuugaauuuuauacaaauagaaccauacagugugacuuguuuuugcgugccuagcuucuuuuguguuuaguuuguuuauucucauugcggaaucauacuccauuauaugacuauacuagauuugucuguuauauuacugauagauguuuagguuauaucaguuuuuuuucgcuaucagaagcaguguagcuauaaacauucuugaacauucuuuuggugauaauauguauuaauuucuguugacuauauucucagaaguggaaaugccaaacacugugagguuccuacauuaagaaugaaucugaauagguaugcucagcucgaauugguacuacaaaguagucuuccaaagugaucuuacugauuuuauacuccaaugguguaugagacuguauccuuaccauacuugcuauugacuacuuguuuuuuuccauucugucagaugcguaguaugcauugugaauuuuuuuuuuuuuuuuuuuuuuuugagauggagucucgcucuguugcccaggcuggagugcaguggcgugaucucggcucacagcaagcucagccuuccggguucacugcauucuccugccucagccuuccaaguagcuggaacuacaggcgcccgccaacacgcccggcuaaucuuuuguauuuuuaguagagacaggguuucacuguguuagccaggauggucucgaucuccugaccucgugauccacccgccuuggccucccaaagugcugggauuacaggcaugagccaccgcgccuggccugcauugugauuuuaacuccauuuccuggguggcuguugaagcugagcaccuuuucucaugugcuuauuggccauuuggauauguucuuuggugaagugucuaagucuuuugcccauuuuuguuuuuuauugauauguaggaauuuuaaaauauauuuuggacaugagcccuuuauugaauauaguuauuacaaauaucuuaguugcuugcuuuuuacuuuauuacaggguguuuuuuuuuuuuuuuagugagcagacauucuuaauuuuauuauagaccuauuuauaguuguuuuccuuuauaguuagugguuuuauauguguguguauuauguaguuauguuuaagaaaucuuugcucaugagguuuuauuucauuuuuguauuuuuuucuggacucaguauuagauauguuacuugauucuaaaaaaauccaucuuccuaccccuccccuauuuucucucucuccagaguggguauuaaggacauugcugguauccauuugccaacaaaugugaaauuucagaguccggcuuauucuucuguagauacugaagaaacaauugaaccuuauacaacugaaaagaugagucgaguuccuggaggauauuuggcuuugacagagugcuuugaaauuaugacaguagauuucaacaaccuucaggugaaaaaaauucaguuacuauuuucaagcauuaaauuucaugcauuguuuaaaauaauauauaggacagacagucuuuauuuuaugaguuugcaugaagauuccacuuauuguauguaaagaaaaugauuaaaggguaauuagaauuucuuccugaaauuauuugcuuucuuccuugguuuccuugcuuuucuuuccuuucuuucuuuucuuucuuugacagugucuugcucugucacccaggcuggagugcaguggcaccaucucggcucacugcagccucgaccucccagguucaagcaauccuccugccucagucccccaaguagcugggacuacaggcauguaccacugugcccggcuaauuuuuauauuuuuaguagagaugcgguuuugccauguugcccacgcuggucucagacucugagcucaagcgaucugcugaccuuggccuccccaaguguuaggauuacaggcauaggagccacugugccagccugcuuauuuaaauacagagaaaaccccuccuaagauuguugggaauauauagggugccaggugcuuucacuuguguucuuaggcagcucuuaugacauacugccauacaauuauaauuauccuuguguuacacagaugaggaaauuguugcucacauuaaauaauuuccccccaaguuauucaauaugugaauacaggggcaggaauucuaaccuaggucuuucugacuuaucucuauaucaugcugccauuucaaauuaacaaaaugaacaauaauccaaaucucuagguuguaugugcauuauggugaccagccuucaugguuuguccaggacugaaggggguuccaagacuugagacuuucuauuuugaaacuaagacauuccuaggaaaagcaagagaagcuuaucacucuaguguguguguuagugaauggcgugaggauguucuguauaaagaaagugcccagccaggcgagguggcucaugccuguccucccagcacuuugggaggccgaggcagguggauuaccugaggucaggaguucaggaccagccuagccaacauggugaaacccugucucuacuaaaaaaauacaaaaaauuagcugggugugguggcgggugccucuaaucccagcuacuugggaggcugagauaggagaauugcuugaacccaggaggcggaguuugcaugagccaaaauugcgccauugcaccccagccugagcaacaagagcgaaacuccgucucagaaaaaaaaaaaaaagaaaagaaagugcccaaagaaauuggaaagguuacauagaauucucuaaagaucuuuaauagguaagguuaaauguucaaguacauaaauguuguaagugaaaccuguuuggagauagaagacucugugaggguaauuuuagccuaagauuuuuuuuucuuuuuuuucuuuuuuuuuugagacagaguuucccucuuguugccuaggcuggagugcaguggugcgaucuuggcucacugcagccuccacuuuucggguucaagugauucuccugcuucagccucccgaguagcugggauuacaggcacccaccaccaugagcggcuaauuuuuguauuuuuaguagagaugguguuucaccauguuggccaggcuggucucgaacucuuuuuuuuuuuuuugagguggacucucacucugucgcccaggcuggagugcaguggcgugaucucggcucacugcaagcuccaccuuccggguucacgccauucuccugccucagccucccgaguagcugggacuacaggugcccgccaccaugcccgacuacuuuuuuguauuuuuaguagagacgggguuucaccguguuagccaggauggucucaaucuccuggccucgugauccguccgccuuggccucccaaagugcugggauuacaggugugagcaaccgugcccggccccaaacucuugaccucaaugauccacccaccuuggccuccuaaagugcugggauuacaggcgugagccaccaugcccagcuagccuaagauuuuuauaauuuaauagaagcuuuccuuuauuauuuguuaccacauuguucuugaggagaucuggaacuaauuuaacaauuuggccuugcuuacugaggcugagcuuucugagcuucaagagcauuccuuaccuguuacgacuuucaauagcaaguaacacguuuguagcugccauuuacccccgaacuauccuuuuauuauuuuaaggcuuuuuaaaauuuuaauuuuucuuagccacacacaaaucuuacuaagguuuuaauuucaaaagucaugccugccuguuuaagacuuucaagcaauacaggauagaaaggaaaaaguccuaguauuuuucuuccuuuuuaaaaucucaacccuuuccccaggucacuaguuugaaguacaucuuuccagacuuucuuuucuguacacacacacacauacacacucacucucucucuuucucacucucucucuuaaacacaugcucucucucacuacucccucucucucucuaccccccuccaucccccucuauuuucuaaacaaaacaaucuccacugcuuugucacuuaaccuuuucaauucaacaauauauuauggacuucuuuccauaucagcaauauauaucugcuucauucuuuuuaauaauagcugcaugguauuccaauaaaauaggucagagcuucccaaccagugggccuuacaugguuauaggugugccaagauacugaaucccuaagggagcugggcaggacuaagaacuccagagauggaaaaugguaagauacugaggcaaguauauaugaaauauauaaaaccguuucauuccuucuacauuuuucucaggaauuaaaaagucuugcaacuaaaaagccugauaagauugguauuccuguuauuaaagaaggcauacuagaugcuauuaugguuugguuugugcuccagcuugaugaugaacauaguuuauccacaaguccuagugaggaaacauguugggaacaggcugucuaccccguacaggaccuugcagguaggucuuguccauuuuuuuuuuuaaccucuugcuuuaaucuucuaaguauucaagucaguggcaaaaaaaaaauuacuuuggauaugaagguuucagucaaaggagguugguuaaaucuuucagaacuucauuuuuuuucaaaagaaauuugaaauagguaauauuugugguuaagagagacaaacacaacucuguugcauagcauuugaaaaaccuaucauuauuucuucagcucugauuuuucuuuuuucuuuuuuuuuuuuuaacgacagagucucgcucuuuugcccaggccgauugcaguggcuugaucucggcucacugcaagcuccgccucccggguucacgccauucuccugccucagccuuccgaguagcugagacuacaggcgcccgcugcugcgccuggcuacuuuuuuguauuuuuaguauagaccgaguuucaccguguuagccaggauggucucgaucuucugaccucgugauccacccaccucggccucccaaagugcugggauuacgggcgugagccacugcgcccggccgauuuuucuaguuaucaguagaugaaagaaauccugcuccauuauuucauggaaaguacuggaaaaguauugcuuuuagugcaggaguucuuacuccuuagagaagccgauaacgucuguggagcccugcaucauaaaaauguacacacucauauaagcacaaaauuuuucaguuuuagagaguucaugaaucugaacuucccuagggaaguucuguauaaagauuuuuuuuuuguauggaaauuuuuuuuacagugauucgauggguuucaguaaguuuaaaguaguugaauuauauagaaaaacuacccuuuuuaggcuggguaugguggcugacaccuguaacccuaguacuuugggaggcccaggugggaggauugcuugaggccaggaguuuaaaccagccugggcaacauagcaagaccucauuucuuuuuuucuuucuuucuuuuuuuuuuuuuuuuuuuuuuuugagacagagucucgcucuguugcccaggcuggagugcaguggcgcaaucucagcucacugcaaccuccgccucuuggguucaagugauucuccugccucagucucuugaguauaugggacuacaggugcaugccaccacgcccagcuaauuuuuuguauuuuuaguagagacaugguuucacuguguuagccaggauggucucgaucuccugaccucuugauccauccacuucagccucccaaagugcuggcauuacaggugugagccaccgugcccggcugcaagaccucauuucuacaaaaugaaaaaauuuagcuggggaugguggcaagugcuuguagucccagcuacuuggggcacugaggaagaaggaucgcuugaguccaggaggcugagccugcagugagccaagauuauaacacugcacuccagccugggcaacagagggacauccugacacacacacacacgcacacacacagaaaaacucuacccuucuuaaacuggaaguuaauacaucuauuucuguuuaguuucuuaaucaaggaucuaauuuggcaaggucauaaaggccuggaaucaguauauuguuguagccaguauguuguuuuuggaguuagguagauuuggauucaguucuugucucugcuacuuacucauuccuuccuggccauccuugccacuuguuucucagagcuuuuguuguaucauauauaaaaacgggaugauaccauuuaucuugcagcacuguuauagggauucuuagagauaguggguauaaaaugccgaccacagugacuggcacucagugaaugacauuuuuuacuuguguuuauucuaacucucuuauaccuguaguaacuuagacagaugaucuuuuguuuuuuaaaccuucuuagagaaaggacauuuacauguuuaagcauaagaauagcaauuuauggcugggcuuaguggcuuaugccuguaauccuagcacuuugguauccuccugcugagguaggaggauugcuggaguucaggaguuugagaccagccuggucucuacuaaaaauauuuaaaaauucaggcaugauggugagcgccuguagucccagcuauucuggaggcugagguggggaggauagcuugagcccugagauugaggccacagugaucauaccacugcacucccgccuaggcaacaaagcaagacacugucuccaaaaaacccaaaaaaguauaacaauuuguauuuucaacugguuccaggguuaaugagaaggaauugcgauuauacauuuacauuuuaaaauuuuaccacauguaggccaggcacaguggcucacgccuguaaucccaacacauuggaaggcugaggcaagaggaacacuugagcccaggaguucaagaccagccuggguaaaauagcaagaccucaucucuauuuaaaaaaaaaaaaauagcugggccugguggcauguauccguagucucagcuacuugggagacugaggcaggaggaucacuugagcccaggaguuggaggcugcaggggaccauguuacaccacugcaucccagccugggugacagagugagaucuugucucaaaagacaaaacaaacaaaaguuuucccauauaugaagggaguaucauauggucuuuauuguaggacuugguucuuccuuauacuuugaaguuccuagacaugcaagaaugucuaaaauacuuacaguuaacaaauauaacugauacgauucuguugaauguuaccuuguucuuuuggacauuucucuuaaagaaugucccuuuaagcuaaagugagguuugauauuuaucccugaauuuuaucuuuguuguuguuagccuuuauuaccaaagaugauagaguccccugcaguacuccaccaacaccccaauuuggggauauggagagaccuagugauggcauuaaaaacauuaucauacugauagucucagagucaauaauggagcucucaaaugucuccauuaugcuacugguuaauugaguauucaaauuucaguuuuucccuaaguaaaucugguagaguuuuccuaguuuuuuguauauuaaaugaguauuuguaauccuuucuauagugaucuaaagaauggggggcuagauggaggauggagauguuuaugugauccucuggcuuauaaguacuccauauuuuuuuucuuccuuacuauuuaaugaagacuacuggauaaagccuggagaccaugugaugauggaaguaucuugucaagacuguuacuuaagaauccagaguauuagugucuuggguuuggaaugugaaauggauguugcaaaaaguuuuacccagaauaaagacuuguuaucguuaggaaaugaggcugaacuuuguagugcccucgcuaaccuucagaccaguaaaccagaugcuguagagcagacauguauauuggaaucuacagaaauugcuuugcuuaacaacaucccauaucaugaaggcuuuaaaauggcaaugagcaaaguuuugucuucacugacuccagagaaacuguaucagaccauggauacucacugucagaaugagaugagcucuggaacuggacagaguaauacuguacagaacauccuugaaccuuucuacguguuagauguguccgaaggcuucucuguucugccuguuauugcuggcacacuugggcagguuaaaccauacaguucuguggagaaagaccagcaucguauugcucuggaccucauaucugaagccaaucacuuuccuaaagaaacacuugaguuuuggcugagacauguggaggaugaaucugcuauguuacaaaggccaaaaucagacaaguuauggagcauaauuauauuggaugucauugagccaucugggcucauucagcaggaaauaauggaaaaagcugcaauauccagguaaaacacaaaauaauaacuuuuggcuuuguuuuuuuuuugaggucagauuuuauguaaauuccuuaaguucuuuaaucgcuuaacuguaaaaauaagucaagaucacuguaugcuccucaagcauuacuuuucaggacgugugacuucauuugcugcuaaaaucaucgcugguuuggccagugggagguccucuaaacuaguuccugugucuuuuugacacguucccauaauucuuuaagcauguucuuacuuuggugcaaccagauguuuuacuuucaucuugaauuuuucucaaccccagccuuaggauuagucuuucuccaagggacucugguuccuuuugguuccuuuuaguggagaaccauauuuugaaaccaagauauauauauauauauuuuuuuuuuuuaagacggaguuucgcucuugcugcccaggcuggaguguaauggcucaaucucggcucacugcaaccuccgccuccuggguucaaacgauucuccugccucagcuucccaaguagcuaggauuacaggcacaccccaccagcuaauuuuguauuuuuaguagagacgggguuucaccauguuggucaggcugguuuugaacgccugaccucaagugauccacacccccuugaccucccaaagugcugggauuauaggcaugagccaccaugcccggcugaaaccaagaucuuaaugauaggucuguaugcuuauugcuacuggucauugcuuuuaggcucucugaguugaaaaggcuaggaagaggauguguguguuuuugugugcauguacacacgcaugaauccauauaugugugcacaaucacacauacagguauuuuuaauuuaucuauuuauauaaaaucaugagugaauacugauaccuucaguucuaauccacuaucacaugguacauuauaguguucccuuuuuucauauuuauauucuuucuccagcaauaacagccuggcucucacuaacaugaauauacuuacucauuugcucauagggagaauccacauaacauuguuucaaacuugguaacacauacuacuguggaaagcaaaacuaccaacgagaguucaguauuaguuuauagauuuuuuuuuuuuguuuuuucguuuuuuuuuuuuagacacgggguaggguagaauggggucuggugggaugggguggggauagggugggguuguggugguucucacugugcugcccaggcuggucuugaacuccugggcucaagugauuuuuccacuucagccuccugaguagcuaggguuacaggcaugugccacugcuuauagguucauagguuuuaaaguauacauacugaugaaauccuauguguacaauuagguaaguuuugauaauuaagugauuuuuuuuuuuuguuugagauggagucucgcccugucgccaggcuggagugcagcggcgugaucucagcuaauugagugauuuuuaucaaaaaguuuguuuuugaaauugccuucauaacaauacauugauuaggagaaacagcaguggcaaaggugguuuuauuuauuauuuuuuauuuuuugguaaauagccagaaauuuuguggaggccuuuuuauaaugucauuauucaaauuugguaaguucaguuuuuuuuaaauuaauuaaauuagaaaguaaagaaauugguuaaauuaguaccaaagauguauuucagacauguuuugaauaauggaccauuuuggggaucuucuuuuguuuuuguuuuuguaguugcagugugacuguugagaauggugacacaugaauuugcaaauucuucuaugugugcgaaaaaauucaguauaaucacuuuauagccacauuuuauuuuauuaaaaauuguuuugaaauuaugauaaaauauuccuaaaauuuagucagucauuuuucacuucauuagugugaaguauauucaccucguuacauaaauuaucuccagagcucuuucauauuguaaaacacucuauacugaauaaaugacaauuucccauacuccccucccacccuggguccuggcauccagcaaucuacuuucuguuucuaugaguuuaacuaacucuugagaccucaaacaagugaaaucauacaguauuuauuuuuccuuuucugacuggguuguuucacuuagcauaaugucuucaagguucauccauguuguaguaugugucaggauuuacuaaugauuagugauguugagcaucuuuucauacacuuuuugaccauuuguacauaguuuggagaaauaucuauucaagucuugcccauuuuuuaaccggguuauuuuguuauugaguuguaggaguuauuucuguauucuggauacuaaccccuuauuucauguaugauuuguaaauauuuuuuucccacuucauagguugccuuuucacucuuuugaucauuuccuuugaugugcaaaaguuuuaaaauuugauuuaguccuauuugucuacuuuugcuuugguugcaaaacagcuuuugauaucauauccaagaaaucauugcugaauccaguguccucaagcuuuucuccuguauugucuuucagaaguucuauaguuuaaggucuuauauucaguuguuuaauccauuuugaguuaauuuuuguauaugguguauauaaaaauauacauguuuuuguauauuuuggaaaacauauuucggauauguuuucugaacauaauuuguggguuuauuuauauggucucuuguuucuuuuuuuuuugagauggagucucacucuuuuguccaggccagacugcaguggcgcuaucucaccucacugcaagcuccaccuccuggguucaaggggauucuccugccucagccucccgaguagcugggacuacaggcgcaugccaccacagcuggcuaauuuuuuguauuuuuaauagagacgggguuucaccguguuagccaggauggucucgaucuccugaccuugugaucugcccgccuuggccucccaaagugcugggauuacaggcaugagccaccgugcccgccuugggcucuuguuucuaguuccguuggucuguaugucugucuuuauaccaguaccauaccacagucuugauugcuguugcuuuguaguuuguuuaaggucaggaagugugaggccuccaacuuuguucuuuuucaagacugucuuggcgguuuacaguucuuugagauuccauauaaauuuuaggguaaauuuuucuguuucuacaaaaaacacucuugggguuuugauauggauugcagguguucccauccaugaacacagugugccuuuccauucaucugugucuuuaaauuuuuuuuuaagcuauguuuuauaguuuucaguguacaaacaagucuuuugccuaaguauuccuagguagguuuauuccuaaguauuuuauuuuuuagaugcuauuauaaauggauucuuuucuuaauuuucuauuuagcuuagccuuugcuaguacaugcaaaugcagcugauuuuugcauguuuauuuuguaucccauaauuuugcugaagucauuuaugaguuguaacagguuuuuguuguuguuuuucuuuagaguuuucuauauaugacauaucaucuaugaauagagauaauuauacuucuuccuuuccaauuuggauauguuauuuuuucuuguguaauuucucuggugaggacuuccaguacuguguugaacagaaguggaaagagugggcaucuuucccuuguaucugaucuuaggagaaaagcugucagucuuuaaguguggugauguuaacaugauaguugugggcuuuucauauauggcuuuuauuauguugagguaguuuccuucuauuccuaguuuguugaaugcuuuuauaaugaaagugugauuuuugucaaaugcuuuuucugcguccauugagaugaucauguggucuucauucuguuaaugugauguauuguaguaacugggcuccugccuuggcuucccagaguguugggauuacaggugugagccacugugccuggccugcaguuguuuuuaaauguucauucuugcuggaugcgguggcucaugccuguaaugccagcacuuugggaggccaaggcgggcggaucaccugaggucuggaguuugagaccagccugaccaacauggagaaaccccguuucuacuaaaaauaaaaaaaacguagccaagcgugguggcgcaugccuguaaucccagcuacuugggaggcugaggcaggagaaucgcuugaacccuggaggcagagguugcuguuagcugagaucgcgccauugcacuccagcucugggcaacaagagugaaacuccaucucaaaaaaaaaaaaguucauucuuaaguucuauucacucaugcuaguuuaaaauacagaugaaagcuugaagguuugguaagcucuuucguuuuuuguuuuuuuaaaaaaccauggcuaugguuugagugucuccuccaaagcucauggguuggaaaguuaauccucagugcaacaguguuaagaggugugauauuuaaggggggaugaggucaggagggcucugcccucauuagugaauuaaggccauuaucaugggaguggguuuuuuuuacaggaugaggucagcccucuuucccuuucucucucucucccucuucucucucucucucccucuucucucucucccccucuucucucucucucucucugcccucugccaugaacagucagccaaauaaguuucuguucuuuauaaauuacccagucuguuguaguuuguuagacuuuugaguuacaacguuauuuuuuucauugcugaaggcauggaugguucugaaguaucauuuagcuuugcaaaagauuucugaggagccuagcaguugcaguaauguaaguaacaacaaaacacuuaauguuaguaaagauaagcagaguuucaaggcaauggucauuuuaucugaacauagcuaagaucugacacuaucuuuuagcccccaaccuaaggguagggagggggccuuagucaccauucaucucauucacauacauaaguugaguugcaaggauaauaacagagaaaaaaaaaauugcaagcauacauaacagacaacuaaacugauuaucacuuaguugauagugucaggucccacagguugagggcucaguuccacagacugcccccuacuucagaugccaguuacaaguaugucacuuguacuucuuacaggcuguaaaucggaaguuccugagaccaccucuucgaguuccauuacuuugcuagagugguucacagaacucagggaaacacuuuacuuauguuugcccauuucauuuauuaugaaggauauuacaaaggauacagaugaagagccagaugaagagaugcauagaguaagcaugugggaaguggcauggggcuuccaugcccucucugggcacccucuaggaaccuccauguguucagcuaccuggaagcucucugaaccuugucuuucuggguuuuuauggaagcuuuguuauguaggcaugacugauuacaucauuggcuauuagugaucaacucaaccuucagugugucuccucucucuggaggcuaguggguuggauggaaagucccaauccucuaaucuugccauggucuuuuagcccccaaccuagggcuagguaggggcccuuagucaucauuuaucucauuagcauacagaagauacucuuaccauucuguagguuccaaggguguuaggaguucuggggcaggaaacaagaugaagaccagauauauauguaucuuauuauaaucacaauaucauauuugcccuauguauacuuuauauucggcuauuccugaguuguauccuuuguaauaaauccguaaauauaaguaaaguguuuuucugaguucugugagccauucuggcaaauuauugaacucaaagaggacauugugggaacccuugauuuguuacagccugauggguucuucuuacccacugcccagaaaagccaauacagugagaacagcaggaguugcaguagggaaaguuuagguggguucaugccuguaaucccagcacuuugggaggccgagguggguggaucacuugaggucaggaguuugagacuagccuggccaacauggugaaaccccgucucuacuaaaaauacaaaaauuagcugggaauggugaugugugccuguaaucccagcugcucaggaggcugaggcagaagaaucgccugaacuugggaggcagagguugcagugagcugagauuguaccacugcacuccagccugggcaacagagugagacuccgucucaaaaaaaaaaaaaaagaaaaguguaauuaucacaaggcaggcaaguggaagaaugggacauguuuuucgaauccaccucccugagaacucagaggcuaguuuuaaaagauaauuugguggacugguggcuagggaauggauacugcugauugguuggggaugaaaucauagggaugucaaaaacgaucuuccugugcugagucaacuuucugggugggagucauagaaguauuugagucugaaaaaugucucaaagaccaaucuuagguuuuacaauacugauguuaucuauaggagcaauuggggcaguuauacaucuugugaccucuggcaccaugauuccugagcaguagggcauuauagaaaaacaagcuaggguacaaugacuggguaucauuuaacugugccuacauuuuagcagaauucaggcuccucccauaauccuaaccuuguggccuuuccuuaguuuuacaguggcuguuuuggucccugaacaaggaggggguucauuucaggaagggacuauuaccauccgugcuuuaaaguuaaacuauaaacuaaaauuucucccacaguuagcuuacccuaugccuggguccgucaguuugugagguuagaagcaagauggagugagcuauguuagauuucuugcacugccauaauuuuugcaaaggugguuucagauuuauagauggccaaaaguacuaggaccuacaauuggcaucagaacugggggcauucaugugggacugagcuuuuauagcaccugaugcuaacuccagguagugucagaauugauuugaauuguaguacacucaaaaggugucugagaauuuuuuuggggugggaaccuccucccugcaccccccuccccccccuccccagcccaccaccacuuugugucagaaguuuuauuuuuauuuuuuuuaggcaggcucuuacucugucacccaggcuggagugcaguggcaugaucauggcucacugcagccuugacuuccugggcucaaccuauguuuuauaaauagaaaugguuccuaagacuaccuaagugacucacaugguaucguucuccaacucucuuucucccauagauuacauagcuacaagguuagcuuuuauuaaccugugugcuuuuuuagcuugcuaauuucauagaaugauaccucuuuggcuauuuggggaguggaggguuguuagucaagcaacauaaaguucuguggcuagucucuccuuucagagaccuuugugaucuugaagaaaauuagaucugaucuucacuuaaauggaucacaguuagcagauaacuucaguuguucagauaauaacaugaguuuucaggauuaaacuugauccuuuugaggaaaaaagauuuuuccagugauuugggaagacauaaaauuuuagccaguuugguaaaggcauagauugcaauuugguuaagagcugugcaaucuuauuaagaugugugaaauuucacuaacuguggagacugaauuucuaccagacuaccuauuaugacaaaaaguugauaggaaaggaauagcaacaaugaguaaagcacuggggucaggguggaguccauuuuuaggcuaauuuaugaauauaggauuuauuacaacucagaaggaucaugucguuacauuuaguggguaaagagagauuauccugguucaggaacaugacuuaucuuuaucagucuggugccauuacacuuaggagucaucucuaacuuuccuugcugaaucugugcuccucacaucacggcuggggauauggcuuccgguuagcuugucuuuaggagagagugagcuguuacaagagcagacuguuuccuuguuaacuuuuccucaaauguauuauuuugaaaauuuucaaacuuaggaaaaauugcaagaauaauaacagagaacacuagauuauuguuuaguuuacugaaccauuugauaguugauugcuggcaucauaaacuucauauuuucuuuaguauuuagcauguguuuccuaagaacaaauguuuuccccuacauaucacaauaaaauuaucacucaggauauuucacauugauaaaacacuauuauauaauauauagugcauauuaaaauuuuccauuaccccaguaauauucuucauugcuuuucuucccagucuaguucuaaucaagagucuuacauugcauuuaguugccaugucuugucauuauaauuuaauuguccuugcuuuagauaucuuuuaagugguuauaaaauugagauaaucaguuuaguaagagaccagagaauuaauuuaaaucuaauucaagagcaguagugccaaaguaguuuugaggaaugggguguuuuauagcuuagcuuguuuagguuuuaaugaucuauuuagggagacuacauaguauauaauuuuggaaauguauaugaauuacuuuuuaagauaugaaaaaauguguuggugaaauguuuaguucuguauuuuuauaaguggauucuuacucuauuuaacuuaggaguaaaaacauacugugaaauguacauaugauaauauaaaguucaccugccuaguauccuguucuagaaauucaaguaggaacaagcuuggaauauucaguaaaaauguagauuugacauuugauuguaaauguggcaaaugaaaauaauuauuugguuuaaaguauccuccaccuccauuucacuggaugucaguagguggcccacccacccuucucucccuucacacauagcacauagcucaggugugaggaaacaagauuacauagguagguguggaagcugccuugacuuaacagcccuuagcuucauauagcaacucuucucccaugggcacagcuuccacggccuagcaauaugaacaccugguuacacucucagggaagcccacaugugguauggguucccgucaggcauuuauccuuuguucguaguucucuccauccagauauagucuaccuauuaagaggcauucuuuuuuuuuuuuuuuuuuuuuaaccauaagcaguguuccugauaaacacagcugacauucuauucuuauaagauuuucagggaaagagaagguaaacccaaggucaacguaggaagagaaaggauuuuguuaacccuugacucucucuccuccaguauuagaguauuuggacuuuuuuuuuuuuuuuaaauuuugcauuuggaguguguaaccuuuuauuuugaaauaauuuuuaagccuuuggagaaguuaaagaauaauacaaagaacuuaccauauaccuuacacucaguaauaguaauacacuauuacuauuuugccacaucugcuaaauuguucaggaaaaaacauuucaggcucuuucccugaaccauagauacaaugugucuuuacuccuaauaccuuggaaugcauaggacauucacugauauaaucacuguacaauuauuaaaaucaggaaauuuacagggacacaauacuguuaucuaagcuacaaaucuuauccagauuucaccaguugucacaauaauguccuuuguagcuuuuuuguuucuggucuggaauccaauccaggaucauauauuccauuuaguuuucaugucucuuuaguggugcagucacugucacugcaauguggaccuccugggcucaagcgauccucccaucucagccuguugaguagcugggacuacaggugugcaccaccacaccuggcuaguuuauuuauuuguagagauggggucuugcuauguugcccaggcagggguugaaguccugggcucaagcaauccucucaccuuggccucccaaaguauugggauuauaggcaucagccaccaugcccagccugucccauuguuuuugauguuaauacaaucacaugguuuaaguuguaucuacacauuucuccauucaguaaguuacuguuucccccuuugugauaagucauuuuugggggugauacuuggagacuguaaaaggauauuuuccuaaucaaacuuugaccuacuaguuuuagcauccauugaugacucuuuccugaaucuaaagacguguguccauuuaaauagcuaaccugucauuuuucucuuucacugaucaguaguuacuuugacuugggaaauuauuucuagugguuuacuauucugaaauaccagccaugaauaacagaaaguccauuagacucuauguaaucuguagcucuuuacuaauuuaucaugauucuuaguuacugauguuuauacaauguaggggauuacaaaggguuuuuuuuuguuuuauuuuaugauuuuuugagacagagucucacucugucacccaggcuauagugcaguggcgggauguugguucacugcaacugcuaccucuuggauucaagcaguccuccugccucagccucccaaguagguggaacuacaggugcaugccaccuguggaucuaguuggcuaguuuuuguauuuuuuguagagaugagguuucgccauguugcccaggcuggucuugaacucuugggcuuaagugauccacccaccuuggccucccaaagugcuaggauuacaggcgugagccacugucgcccugccccaagagcuuuuuaaaauauguacuuuuuuucuuagguguuuacuacaaucuggaggcaagaucuuuccucaguaugugcugauguuuggguugcuuguggaaucacagacacuccuagaggagaaugcuguucaaggaacagaacguacucuuggauuaaauauagcaccuuuuauuaaccaguuucagguaagugucuagaggagaaguucaaccaggaugcuguugaacagucuaccaucgcucucucuuuagucacuguuuaaucuagcuaaacacagugacuaaaguuuagcuggauuaaucacagugacuuagauuuuuaccuauaauaaguuccuagaacaaaggaacuuauuauagguaaaaaucaaccuagagguuacaauaaccaaggaauuuugucaugacugcugauaaaaguuuauagauauuuggccagguguguggcucaugccuguaaucccagcacuuugggaggcccaggcggguggaucacuugaggucaggcguucaagaccagccuggccaacauggugaaaucccaccucuacuaaaaauacaaaaaaauuagccaggugugguggugcgugccugcaaucccagcuccucuggaaacugaggugggagaaucgcuugaacucaggaggcaggaguugcagugagccgagaucgugccacugcacuccagucuggaugacagagcgagacugcaucucaaaaaaaaaaaaaguuuuuagauacgccuucgaaucacugucauaaauggaagaaggguccuagguuuuaaucuuaugaaaaagaguggucuuuguccaaaaaagaucuauguucuaaacuugaacccuuacauugagaccucaggcuggcagcugauaaguaucagcagcuaaugcucagauucuaagaaaucagacugcagagagcaggaaugcaggagccuaggaaaacagagcucaaggaaaaggggguuagccucuguuuaggaaauaaggagucaagacuuagaaaugggcugggcaugguggcucacaccuguaguccuggcacuuugagaggcaaagguggggcggauugcucgagcucauaaguucaagacuagccugggcaacauggggaaacccugucucuacaaaaaauacaaaaauuaucugggugugguggugcaugccuguagucccagcuacuugggaggcugagguaggagaauugcuugagccugggagguggagguugcgguaagcugaaaucacgacacugcacuccagccugggugauagaguaacaaauuuuuacugaaugucuacuacauguacauuuagauuuggggaauagggcuaugaaauaaagagagaaguuuacucucucguggauuuagcauuuacauuggaagagacaaugaacaaguaaaaagacugcugugauggugagaagugcuguggacauaaagcagguuaagggaguguggcguaugggauauacuauuuuauaaagguuacaccuaaggaaaggacucauggguaagugauaaacagaggccugaaagaaauaagggagcaaaucacacaaaucaaaggaucagcaaguguaaauagcuagaggcaagaucacgauuggaguaucaaaaacagcaagaagcaaccaagagggagagugaugagagaugcagucagaguauuaggggccagauguugaccuucuggccauuuguaaggacuguggcuuuugcucugaaagggguaggaaacaacuggaggguauugaacagaggcuugacaugaugugacuuauguuuugaagggcuugcugugguugcuguguuaggaauaaaacacuggugagaccaggcaaaggcaugaaauuauuguaguaauccaggugagaggugucaguggcuuugacuggagugguagcagugaaaguggugcaaaaauggugagauccucaauauauuuuaaagguagggcuggugugguggcucaugccugaauucccagcacuuugggaggccaaagugggaggauugcuugggcccaggaguucaagaccagccugggcaacaaagugagacugucucucuacaaaaauuagcuaggcaugguggugugccccucuagucccagcuacucgggaggcugcggugggaggacggcuugagcucaagaggcugaggcugcugugagccaagguugugccacugcacugcagucugggcaacagcaagacugacccugucucuaaaaauaaauaaagguagaauuuuugauaaguuggaugugggcuaugaaagaggacuccuuuuuuuuuuaggugaaagcagcuggaagaauaguuuccauacugauaauggggaaaauaggaucaggcuuuguguguagcuguggucacugagcaauuggguaagaauucagagaaagcucugggcugaagauuuaaauuuggcaguuagcagcauguagcugguauuuaaggccauaagacuggaugaaauagcuugggggcauguagauagagagggcugggaacugaacucuagagaacucauaaaguuaugagcuugguuugguugguuauauagaaggaacuggcaaagaugacaggagggccgggcaugguggcucaugccuauaauccuagcccuuugggaggccaaggagggcagauuguuugaguccaggaguucgagaccaaccuggacaacauggcaaaaacccaucucuacaaaaaauacaaauauuagccaagugugguggugggcaccuguaguccuagcuacuugggaggcugaggugggaggaucacuugagcccaggaagcggagguugcagugagcugugauuguacuacugcacuccagccuggggaacagagugagacccuauauuaaaaaaaaaaaaaaaaaaaaaaaaaaaaagacaggaguggaccaguuagugugagaaauaaaagugggggccgacuaugagguauggguucagcaguguggggauuaggaggcaggugauaagaggugacaugagaaucuaaggcuucuucugguuugauguaaaaauaggaacaaaaggcauaacaaggagucuuagaaauggugugggguuacuguugaguuuuuauggggaauaaaggcuggaugcuuucaaggaugcccagggagaggugaauguaucuguguccuguuucgccuuauacaaggaaaagugguuuuuaaaugacaguuuccuuuguuucaaaugaggaugaggcuaaaaaucauuaguauuaauaguagcauucaguugcuacuaaacuugauagaacacuuaauagugauucacaacuuuguacauuggaaacaucuggggauccuaaugccagaugguuugggguguggccugaacagcugggcuuuuaaaaaccuccccaggugauuuuaauuugcagccaagauugagagccacugccuucuggaaauaaacuuauuuuccaaaugaaaucaacuauuguuugauugaaucuggcaucauuucugagacaauucaauuaguguuguaccauuauuucauaagcaaauccuuggguuaaaaauuuuagagcuguuuggcuuaagaaaaaauuuaaucugcucucauccaaaugaaagaucuacagguaauggaaaccagagcaaauuaucuaaccugccuaaaccuugguuuguucauucuuuuuguacuggaacaaugaaaguucuaaugaaagccagccuuagcuugaugugggaauauaaaggagguaauguaaaaagcauucugucaaguacuauugagucaaguacaaagcaaucccugaccacaaaaggaauguguaaaagugaaaaacuugagcccugaccacaaaaagaaaaagugaaagugaaaaauuuauacuuucucuagguaccuauacguguauuuuuggaccuauccucauugcccuguauaccuuuaagcaagccaguggaacucuuaagacuagauuuaaugacuccguauuugaacaccucuaacagagaaguaaagguaaggacaacaugcaaaaugauuucguuuguuauuguuuagaauaauuaucuuaaauuagguaauacuuuuauacauacuuuuagcuacuuuaaagauuuaaaucuagugaaauguauuuuaaauuuuuguauuuaaaaguaacuaaaaagagacuuaucuaagucuacucuaugcacucugauauuuuccuaauuucuuuauuuucauagguauacguuuguaaaucuggaagacugacugcuauuccauuuugguaucauauguaccuugaugaagagauuagguuggauacuucaagugaagccucccacuggaaacaagcugcaguuguuuuagauaaucccauccagguugaaaugggagaggaacuuguacucagcauucagcaucacaaaagcaaugucagcaucacaguaaagcaaugaagagcaguuuuccaaugaaaacuguguaaauagagcaucaacaaguacaaaauucuugucuuaauuaguggggguauauaaaaauuccuuguaauggucaaauauuuuuuaaaauugacauuaauaaagcauauuuuaaaagauucuaa

SEQ ID NO: 191907 - RNA, 13505 nt, Homo sapiens
ugucuuacaaaggacuuuaauacaguauauauaaagaacuuuuacaacucaauaagacaaacaauccaauuaaaagugggcaaaagauuugacagccacuucacagaaaauauacaacuggccaaaaaguaccuuaaaagaugcuuaccagcauuagucacccggggaaaugaaaauaaaaccacaaugagauaccacuagauucccaucagaauggcugaaaacugaguguuggcaguuggaacucuauacaacccuggugggaauauaaaaggguauagccccuuuggaaaacaaacaguuuggcaguuacuuuauuaaacauaaaucugccaugcaacccaaccauuuuacugguagguauuuacccaagagaaaggaaaaccuaugucuacacaguggcuuguacacaaauguuccuaacaguuuuauucacaguagccccaaacuggaaacaaucccaagguccaucaacaggugaguagaaaaacaaauaauggcauauucacauaaugggacacuacucagcaauaaaaggaauaagcuacugauacacugcaaccuggugaauuucaaagucauugugugugaaagaaaccauaaacaaaaaaguacaugcuacacaaucccauuuauauaaaauacuaaacaccaccacaaagcaaacuaauauauggugacaaagacaaaucagcagcgugagggauggacugcaaaggaacuugaggaaucuuuugggggcgauggaaguguucugcauguugauggugacaguggcuucauggcauauacaucugucaaaauaaccauugaguuguaauucuaaacagauacaguuuacuguaacuugauaaagcugaauuuaaaaagcugccagaguauucugaaaucaugccuucuuuucucccucuggaccaagcacccgcccaagcaagccaacuuuaacaaaauuaucucauagauuuuggauuuuuuuuuuuuuugccauguuaaaguuguauuaaguuucaauacaaaacauuccaaaaagugaaaagugaucuauaauacccaaguucuauguucaacuaccacuuaaacaaggaaaacauuuucuaauaucauucuguuuuacaaccaguauaaacccagaagaaucaagaucugauucuuuuuccacacgucugcuaguucaguaaacuauuuaucaaacaggugucuggucauuuuaacauacuccuugcuuugaacaauauucauucauauuugguacaaacucuauauccuauauuuaggauaucuaaauauuuuaaauauuuaggauaucuuaagagccaaaagguccucacagaagcuuuaacccaaguaaucauaagaauauggaaggauucggcuaagacaacuauggaaguguaacaaccacauaaauuuggucauuacccuuguggucugugauuaguaguagucugccaaaugagaguuaaaaauguuguacuuacuaucccuaguugcaaauguuaaaacaugacagugccauaauuacaacaaaaaaaauuagaaguugaguuaguuccucuaauccaacaacucaagucuguuuccuuugagaacauuacacuauuggcucuagucuccaaagcaauaaacuaaaacuuguuuccaagacggggagguaaagcaggcuuauaaaacaauacagcaaaagaaagccaaguggcccaauuguuuccaguguguuugccaucuuagcaugguuguuacuuuccagaugucacucauaaguuuuauucuacaacuaaacuguuuguggauaagccaccacaaaaaaauguuucacuuacugacaagacacuucaccagauagagcuaccacuuauauccaucauuuuuauaauucaucuuaaguucuaaauugaagaguuguccccaugacuuuagcuaaacaaaaugaaacccaaagcuguaaaaucuguguaaaggaccacgagaaccuccugacuaccuccacuuaccaauuuccuuaauuacuuccccuuuuccauuuggucaauuacuuaaguaacuaccacucacucccuaguuaugaguguuaaucaacacugaugccuuccugagauccacaggaacccuugaaggcaaaaucuauugccugcaccaaaccaauucugacagcacugcuuaugcaacugcacugacuuaccaacaaucagccgccuucugcuucaacaacucuuagcauuugauuucucuuacugccagcguuaucuacugugaaucaaucagcacuccacaaacauaaugagcacaaucuucaaccaucuuugcuguuucacaggcauuugaugcuuuaaaucugauguggaaugcugauagauucacuuuuuagaagucauaagccuuuaggaaguuggagauaaauucauugcuuaucuauuuucuccuuugcaaucaagcuguuccuuuaaaagugagacauuagaguugcaaaaauuugaaagaguaagagcaagcaccuuugcagcuucaugguugguuuuggccaaacuuuuuauuuaguauuccguaguuguuuagcacacacuuaaauggucuuauugugggaggggaaaggggagguucuugcagauucccaaggaaaugucagaaaggcaaaauggccagcauuauccauuugcuuuuuuuggguuuacugggugaauagcacuuuccuuacauaggcaucugauuucagguuuugcauacugagaacagugagauuucaguuagaaaacacccugaaaucuuaugaguagcauacuccaaccacccucuaauagcuagcuuguuuguauaggcagaaugauucaucucuccauuuuaguuggcuagauguuuuguggaagaucuuagaauugcuugccucauuuacugggaaaaaccagauaggaaguggucuuuagggacaccuuuacuuggaaaguuacaacacuaguacuacaaggcuuaacacauuuaacauuugcuuguugaaaagcaaugucauaaagucaaauaaaauuaaacauguuuuacuuuuuuccucacaagaacauaaaaauuacggaagggacuuaacagggaauuuaaaaaagguaacacaauuuuuccuuuuaguaguccuuggguaguuaugauagaauaguuuccacucuuuuuuuuguuucuuugaacugggauuuugguccaaaguuuuguuuguuucuaguaucugcuucugccucccccucuaucagaucggcuuccuccagggccagcaccucuuggugcuccgcggcuugaacugcuguaggaaucacgugaagaaggguacccccuuucuacagaagggggaagcccucuuucuugucugccaacccugucacaacuugaguagagaucacuucggcugcuugaguaacugucucgacuuccaccauauccaucacgugagcugcuauaaucaucauagcgacugcuuccaccauaagauggcgggggcccucguguaaguggagcacuacgugaguuaccauaacucucauaugaaucucuguaggaaccuccacuuggaugaucugaauagucacgaucacgaccauauccaucucuaucgccauagccucuugauggauagucaucacgugaacuggaaugaccauaaucacgguaaguauaaucucguggugguggugcauaaucucuuguaucacgagaacuuggguaaucucugcuugaauagcugucuuuaguagaauacccaucaucucuuggggacaaauaaacaucucuacgagaggggagcgguucccuucgagguggaccuccauaacuaucucuuccacgugauagaggagcucuuccucccauuccacugcugcugcgaacuaguccugaaggugcagaucucuuaggagaaggacccccacuucuugguggugguccucuuuuuacugggagugguccccuggaagaacucauguuaaaauucauggaauauccaccaucauccauguguccuccucgugaaggagguccccugguuccuccacuuccuccucuuccagcuccaaaaccucuuggaggaccucuacuucuuggaggugggggcgguccaugucuaccucuuucaaaugaugguuugguggcuuguuccaccuugauggcuuuuccaucuaaugacuuuccauucaugucucuggcugcauccuuagcgucugcugggcuuucaaaggugacaaaagcaaauccucuugauuuguugguuucacggucuuuuaucaagaguacuuccacuauucguccauauuugccaaauacuguuucaagagcuuucucauuuguuuccguauuaagcccaccaaugaagagcuuuccugggcgaucugcuucaaccauuuuuuuuuuugccggugagucggaggggugacaguggguucaagcuccaacaagcucgccgacaggggcuuccuagcagcucagcaccaguggcggcugucaguuaggaggacugaaccgcgaagccgcuagcacuacugcgcaaucuggaugcuuuuuaagguauggcuauccauucaaaaaaccaggaaaauuacuuucuuuugccacuagauggcagaggaaaacaacagaauguuccuguaaugguggaagaaaugaaaguaaaacucagaaguggaaauguaaagcagggaaagaugcuuaaagauacauaaaaaaugcaauuauauuaagcucaaaaguguguauaauuaacaggagcccuuuuuuuguugcuuuuuuuuuuuuuuuuuuuuuuuuuuguagacaggagucucacaguguugcccaggcuggagugcagcggcgcaaucuuggcucacugcaaccucugccucccaggcucaagccauucuugugccucagccaccugaguagcuuggauuaccggcaugcgccaccacaccuggcuaauuuuuguauuuuaguagagcaggguuucaccauguuggccaugcugguauggaacuccuagcccaagugauccgccugccucggccucccaguguugggauuauaagggugagcuaccacggcuggccuuaacuggaacuuugaaacaacauauaguuuguuacuuuauuuuauaaagaauuauuugugccugauacgcuguagcuauuuaacaucuguugacugaacagaucugcugagugaaagggaagcaauuuggacucccucugagagauaauguauuuggggaaaaaauuguacuucaauagaaaacuaugcacuggccacagcacagcuuuagggcugauauuugcagggcuagaauuugccuuugaguuauucugggcuuuuguaaauugaagcuaagugacaggcaugcaaauucugguucuagcauuuugauuaucuucccuccacccuguagaaaaaacaguuuugccuucauuugcaauccaauuccuuuacuacauaugaauuugugcuuuuugacuuuccauauguacugguuauaacuucugucugguuacuucauaucacaugagugaaauaaaaaucuuuagcacauguucauuuuuauauuuguaugagucaugauuuaaccuuuuucugaaaauuauauuuuaacaauuacuucagagaaacaagcuuauuggaaacaaggcuuucucuaaaucugaaagcugauaacagcuaaauacauggcuggaaugccagaaauggagucaggccaaguggagaacaaaaagccugguuuauucucucaaaaaaaauuggguucaagccaagaccuuggaagagugaguaagugaagggagugcgugaguauuguccucacccauaucaauaggccuggggcccuucugccugccuacacuguguaaucucagcucccccaaucacagcuauaaaucagaguuggacagucaggcugaaccaaucaagacaacuagaaguuuggguuugaggcugagaaacaggcuguuucuucugggcacaugaaacagaagauugguaaguuugaaucugggcaagucuguguucaaucccucacacacaugccauguucugugccaaaaacacaccuacguuccaaguauauuguucaagguuguuuaaugcaaagagcuuucaagccagauagaucuuaguucaaaauuaaacaucaaaacuccuagugugugaaguaggcagguuaccugacaucucugaaauucaguuuccuuauuugcuaagcaggaaaaugaauaccugccccauguaagugcuauggcaauuaaaugaggcaaagccauaagcagaaaaauauaguucauggcauacaauauauauacuccaaaacuagugcccacucagaaaguaggaaagauucucuuagauacaaguaaggaugaguaacuuugcacuaaaggaggcaaagagauauuggguauggacuaaauguacaaaaggugauacuuucacaucaaaagagaggguugggcuggacgcagugacucaugccuguaaucucagcacuuugggaggcugaggaggguggaucacuugagcccaguaguuugagaccagccuggccaacauggcaaaaccccgucucuacaaaaaauacaaauauuggccgggagugguggcgggcaccuauagucccagcuacucaggaggcugaggcaggagaauugcuugaacccgagaggcggaggcugcagugagccgagauugcgccauugcacuccagccugggcggcaagagugagagacuguaugaaaaaaaaaaaagagagagagagagagacagagagaguugauuuccuuaaggaaggacagaccuaaggaaaagguuuuguccaguguugcuuuugcgcuucucugguggacauuuaaauuuuagacucucuuaaaaaaaaaaaaauuaauagacuauuuuagggccaggcgcgguggcucacgccuguaaucccagcacuuugggaggccgaggcagguggaucacaaggucaggagauugagaccauccuggacuacaggugugugcccagcuaauguuuuguauguuuaauagagaugagguuuugccauguugcccaggcuggucuugaacuccuggucucaagcgauccacuggccucagccucccaaagugcugggauugcagguguuagccacugcgccccgccuacauuuuuccuuuagcauucaaaacauucuuuaaaauuagagaauauguaaaauguuuuuguaaaaaagcaaguaauacaggaaaauacagccuauccuucauucuauucccuucccggcagauuuucaugacauuaaggaugauguggaugaaacgaauauucuaaguaaguucacaguaacuuaucuggcugguucugacaagucuuucuugauuuaaacuuaucacuauugcuuuuguaacacuggccaguguuuuucauucguccagcaauaggaagaauauuuaucuuuaucccugugcgacuauuuuaaaugcaaagccucugaugaacuguagacacuuuuccaauguaguuaaaaugauacaaacacuuuggcaguuacuuaauuaaacauaaagcuaccacacaacccaaccauuccacugcuagguauggagagggguuagugcuaucccaaauaguccacaaguuugaauaaugcauugucagugguuuuugccugggacauacaucagaaucagcuggaaagauuuuucaaaauacauuccagauauguagaauuagaaugcauaauggugagcccuggcauacguagucuaauaaaaguuccacaaaugaggauugugcacacaaaugcccuuuuagugccaugguuucauauguucaccuuggggaagcacaaccacuucccuggcuucaaccgacuucuauguugggagagggccugaaaaagguggucacgguggcauaaagaggagagaauucaagacaguuaugagguagaauucauaagauuuacauauagaagacacugaugaugguuuuuaugaaaauuuuaaaccacugagaaaauuuuaaaccaguugagagauuagaauuagguugaauacaaaauugucaauauucaaccaguuaugacaaaaaugguacuucauaugccaaaaauggaauuuucauacaaaaauagcaauuucauauacuuuaaccuaauauaaaacacucauaugcacacuacccagauucaguaauucucaagauuuugccucuuuuuuucuguaauugcugaguaacuuuagaauaaaucuuagaccuuaggucauuacaucccuacauacuuggcauauuaucuaaaaaauauugcuacuuauauaacugcaauuucauuaccacaccucaccaacaauaauuucuuguuaacaucuaauacccaguccacauucguaucucucugauugucuuuaaaaaaugucuuucugcauuuugguugacugaaucaaguuccuaaagcagauguacguauuguauuuggugguuauggguuuuaaaccuuuuucgaucccugagcaguccuccugaaauauccucuucuacuuuuuucccaugccacuggaccuauauucauaacuugaaggguuuugugaagacaaaaugagguaaugaauauauaaugaccagcacauggccugauccacagacaggcaagcaguugcucagugaaugucaauucuagucaaugacaagagacaccuucagcauauguaauagaaauguucauuucaauaaaguauuuguaaaaaagcaucugaaaaauuacauauuuuuuggacagugcagaauauguacaauaauuuaucuguaaguaagcaauaccuacagcagaaguagagaauccgaggauuuuggaagaagaaauugucuucaggaauuuugcucuaccgcuaagagagcagaggcuccucugggccaaaaacaugcuauuaaauaaaagaaaaauugagaagaggaauaaauauaugauggguacaucacuaucagacacuuacagcuagcugauguaucauaagcuuacguaaaauccaaguaaacauuuuugauaagugaguuugcuuucuuucaaguuuucuuucuaugauauaaucucucaucacuggaggcauucuaauaaauguauucuuccuacacaaauuuauauucacaucauuuuaaacuagagagcuuuaagaauauucuuaauuaaaaaaauaaggcuuuaauuuagucaagagcauuaaauuucagaaagugaaaguuccauuucuagcagcuauaaaauccagaguauuucaaucuaggaacuacucaaauuucagaauccucuggauaacagucacuaguaaaagcauaguuuguaacaguaaauuaaaguuguuagaaacaguuauuuaaaaaguuguuugaaaagacgaaugauaguagguccuugauaaauauaaagaauauaugagugaaucuuagguuauucugaagguacuuccuccaacaauucccacaagccauuuuaguggauuccaguggcaugauaggcaugcauucugaauugcuucucuaccuguaaguauaaaauugauauccgucauggguaaauggaggaagaucaaggcaaugaaacuauuacaauacugccacuuagaaguggaaagaaaacccagcuuucuaaaaacauucaggcaaauagauauuucucauaagguuuuacucugagaauguuguucucuuaagucuacuguauaaggcugcuguaucaguggauggcaugucgucuaacaguuaucaaaccuuagagaaaaagagaccuaaucuauggaaacuaaauagagcuucuauauaaaacgcuaacaaaucaaacccaguaguauacaagaaggauaauacaucaugaccaagggggguuggguuuauauaagaaaccuauuaaugugauucaccacauuaagagauuaaagcagaauucaaucuuaaaaaaaguuucuaucuguagucaaguuauggacucuugcugggccucaguuucuccauuuuucacaauaggugaauaaauuaauaagguuugaguuaaagcaagcaaguagcgggaacccucuaacgacauaaagauacaauggaauuugcugauuauggcgcagcugucccaaaagacacagcugaaacuuuggaaaauggaagagaaaggaagaccugggucaguugccaggaauuacauugcaugauggagguaaugugcuaauaauaaaagcaaguaagcuuggagugcagcuucugggagauuucaccccagacugggugagccauacucucuagguaccaggccucaaugcccaccuuccuucuuagggagcugccccuaaaucuaagucuacuuguuuucaucuugaaaucucaaagccuaaaucccaaaccccucucuccuaucugucuucuacagcacauuaccuccaucaugcaauguacuuccuggcuguggacugcuggagaaagucccacgggauauugguuucaccacagauuuguggucaucagucuuaaauugacccccaacacugcagcauuucuacuauauuuuguagguaacacuugucucccauaguccaaaaugauucuuuaaauuuuucccacacuccuuuaaacuaaaucccucuaccuucuuccucaguccaagcagauugcgcucucuacuuucccaaaucuaaaaaauccuuguuuuuuccuucccaguauaauaaaggaaauuacccuccuuuaaaaggaucgccucuccuccacgacuuagaucucauucccucuacggauaccuugcuucacugauuauuaccucuuuacuccugcauauucaacuuuguuugucucucccgguuaaaaaacauaaaaaacaaacaaaaaacacaaaaaauaaaacucuugacuguaccaucucccuguugcucauuuuacuagcucucuccuuuuccucaaucuacgcuccucaacccagugcagucugacuuuucacccauuacuccauaauggcaacucuugcuaaagucaguuuugaccuucauauuguuaaauccaguggacauuuugcaauucucacuuuccuagagcucucugcagcuuuagauacuggcaggcaagcccuuuuuccccugagaaacaccauguccccuuggcuuuugacaucuuacaaucucucauuuaucuccugccucucccacaauccgccauugaaugauggaauuccaagaccuagaccuaggcucucuuuccaucucacuuaugacccucucacuagguaaucucauuguguaaggaacugugggagcauaggugaaaaaauggcucugaagaaaucuaagcaggcugauaaaaaaugcagacucagaaccuuugaaucaagcuaguuuacaucugcauuuuauuaaguauuuugagcagcauuuucuaaugcaaucaacauugcauauauauauauucacaaaugagauaaauacauuaaauuuagaugucaucgaaaaguuggagaaaauaaaaagguauauggcuuuuaauucuaaacaauauuuucauuguauuuuucuaguuucucccuaaaaacaauuucugugaagaaaaccuggcaacuuaugaaucaggaugaucuacgugaucuaauuauagcauauuaugcauaaaguccauauuccaaaacgcaugaucuauagaaaugaaacugucgauuuauuaucaacgguuuagacuguuuaaaaugaagauucagaaaguaugcuuggcagauuuggggguggcccgaagcugagaaagcuggugaauuuuggggggccgaauauaaagcuaaaaggcagacaagcccgucaaaauaaauccuaagaaacuuaaagcucuagacuuaaauccaaaugaucaauuuauacuucacacauggggaggagagguaguaagagauuuaauuugacaaaguccagaacaucuggguuaacugcaaguucaagcaagauuaacaugaggcaaaaagggcuacagcuaauaaugcgccgcccacacuguuacaagaguccgaccacuguaaagaugauuuuccuuucacacucuaccuuguuaguuugcuucuagaauguuuauaagguucaccgauacaacagaggguaucuagacggugaacaaaguccuggacgggggaguacaguggaaggaugcgcuucaaagccacgucuuuagaacaagagcggaaagaauuagccaaaguugggcagcauaugcuuuaaggagacacgagccugaaauugcugaaaaacuguucuaugaaaauggauucguguaacuauaaacuucuccagaaggaaagcagugcggcugccuggcugauagcaggaauucgguuuuggcucccgaagucagacuugcuaagggcugaccugcagccccagucccccucagguggccgccaaggagccacgcgugggcgaagcgaaggaaggauuucugcgccacucgacuccaaaagcaacagacugccuuucuguuuuaacuacaaauguuggauucugcuaagcuucauuuauaaggcaacguaacagccuugguauucuuuugguuuuuuuuuuuuugagacggagucuugcucugucgcccaggcuggagugcaguggcccgaucucggcucacugcaagcuccgccucccggguucacgccauuuuccugccucagccucccgaguagcugggacuacaggcgcccgccaccacgcccggcuaauuuuuuguauuuuuaguacagacgggguuucaccguguuagccaggauggucucgaucuccugaccucgugauccgcccgccucggccucccaaagugcugcgauuacaggggugagccucuuucguauuuuuaaauuaagagucccaaagucauucuucucagacugccuucuaaaagcccaaacagcgaaaucaagaguaaaagcgccaagacggugacccgggucuaggggauuccccccuggaggccagucaccucggcgccuuccccucaaacugcuaaucuagggccgacucccugcagccacccccgcaggcggccccgcagcgacuccggcaagaggagcccgaccuccguucccucgccccguacgccgggacggcccuagucaguccgcacggaagcgccgcgccgcgccgcgcgcccgccccacucaccuauccggugcgggaaccucgccucccuaggcucgagucccgacugggcuugagggcccggcugggcgggauucggacgcggggggcggagccgggacagggauugacucugggguuugcacucagugcgcgcuuuggcggagggguaggccaggaucucuaggcuggaagagacuggaugagggguguuuuuuugggaggggaggggcgggauuugggcaguuccgggcuugcgggaacaagggggcggggcgggggcgagcccggauguggccagggauuggcuguggagugugacucacggcgcgcgaugacggugggguccgccgcgaucgcggaauggauggaaauggaggagggaaggggugggggccac

SEQ ID NO: 191908 - RNA, 76369 nt, Homo sapiens
uuaaucaaaguaagcaauaaugacagguuuauugaaaauuuccaguagagaaaacccacuaguuuuggaauaaaaguacucaauguacgagagcauaagugaauacaaaagauuaacagaaggaaaauaaaaccaaacauaguacaaaaaaauuuaaaaaguuugaaaugaauucaaacugggauguucuuuaaauccuccaaauauuuaacagaguuacuaaguuuggcaaaaaauucacuugaaaauuaaagccuauuucuguacuguaaacuccguaaaaacugcuuauuaaauucaagcacuccauauaacugguauugaaacauguaggcaauuucagaauagcaggaauuauucauuugcucucacaguuacaugaauuaaccagcugcagaacugcuuuuugaagaguaugagaaaaaagaaugccgagagagaaaaaaaugauaaaaaucucuaaaaaauggaaacacagcaaaauucagguaucaguuuguuucuuuaaagcaacaaacugaauuuuuacaguauagucuacauuugcaguugucauuucccucuuccccccacccaccucaaauacuccuaaauucacuagucuaaucaauucuuaacuuccaaauacucuguacauacauauuuagcaaaaagcauaugccuagcauuauucugacagcaaguauggucagcauacaauuuuagaaagauuauuauguauaucaucaagauuaaccuuuacuuaaacgaacaaaaccaucgcuaaacaaauaguuuuaaaauauuaugaaaacccaugaaaagaagacucaacaugggcucuaaaccugauaaaacacguuucagaacaacuauuaaugcuaaacuucugcccaacgaugaccuuaaagugccaaacaccaaagaaucucuuaggaccguuuucuaauagacaauuugucccuggcuuggccaucucuccuuuaacuguacacaaaguccugcuaaaagucugaauuuuaguugauuuuacaauagaauguuacaauguaaacuaaacagguucuugauaucaacaguauguuaccaagguguguguguuuuuuuuuuuuuuuguuuaaauuucugaauccaacaguuggucacagaggucaaguauuaucaaggcuccuuugucaguucucaaucgugucugacucauccauccuucaaguacaugcaaggcucaauaguuuuccagaggcagaugccuggggccauuuaagauacagaugaaauaggauuaugaggugaacccauuugaguaagaacuuuauccagccacuggagggggccgugcagauguaucucaauccagcagggggugcuaguaacauccuggcggugguauucugcuccccagcccuaggaaaaacauacuggaggucauuuaacuuguuuaacucagugguuaaacuuauuaaguaagaagaguucacauaaccaaagacucugauuaaagcuaugcaucuuuccucccugacccccccgccccuggggagaaaaaaacacacaugcacaaacgcacgcauaauuucgcaggcaauuucaagggauggauguuagcuccccaggguccauccauggauuccaauaagaauugcuggucuugaggaaugaagguuuuaaaauacauuauaaaguuaucuuaauaaagacacuuuaaaacuuuuaauugcccauuacugauaguaauguaauagcuauuauuaaauucucauuuuaucaucaagaaaauaaaacaaaaaagcuaugcuagacagaaugacauucaauuucuucccuauucagccacugaaggucccccuaucaacacacagcucuugaucuuucaaucucugagcaaaacgggcaggaguacauucaaguauccaaaaagcuauuauugacaccuagccauugccaugaaucaauacauucuaucauucauuuguacaagaagguagcuuggcagaauuagugcauuaagacaauacaguuccauagaauaaagucacuaugaaaaagagaaaaguaacugcuacugcaaagaucaaaaacucauuggugaggguggacaaugaaugugaaguucugauuaauccuuuaaucacuguuucaugaggaauaucagagaagguuggguucuauuuauuucugcuaucuaucuacucccguaguuuuaagaaauacaucuggggccaggcgcgguggcucacaccuguaaucccagcacuuugggaggccgagauggacagaucaccugaggucgggaguucgaaaccagccuggccaaaauggugaaaccccgucucuacuaaaacgagguguggugguguaucccuguaaucccugcuacuugggaggcucaggcaugagaaucacuugaauccaggaggcggaaguuguugugagucaagaucacgccacugcacucuggcgucggugacagagagagacucugucucaggcaggugaucacuuggggucaggaguuugagaucagccuggacaacauggcaaaacucugucucuacuaaaaauauagaaauuagcugggugcgguggccacacgccuguaaucccagcaugcuugggaggcugaggcaggagaauugcuugaagcugggaggcagagguugcagugagccgagaucacaccauugcacuccagccugggcgacagagcgagacugucuuaagaaaaaagaaaaaaaagaagaaaaaagaaaauauaucugaacaucagaacuuguaugaacuacaucuauguagauauauauauaucuacauagauguauguacacucaugcauuuguaaauauaaacaaacuccuaaaauuaauuuacaggcuuaugugcagguuuccuccaucagauagcaagaucuuugaaggcaggaauuuaucuuuaccuccaauauacagcauaaugacagaaagcagaagcucuauaaauauguguucagcugagcugacuuggaauuuucagacauagaauuuaaaguacaaauaauuuauaaaauguguuuuauguuaauauccaaaaaugaucauuuuaaaaacagcacaagauuggcuauuguuaguaaaauguucuaauuucuuuaaaauguugaaugggagaggacaaaguaugcaguccuuauaauaaagaacaguuuuguaaaaacagugugcaaauuuuuuguugcuaacauaugauaaacaacuuuucuuuaacauucagcaggauuuuuaaauaauauuuaccuucagcucuccaaauccaacuuccaggcuaaguucauuauaucuuguauaacucuccauucuagugcuuaucagauuauaauuaaagauauacuagggcauaaggaucuugaugauaagagacuuuaggugcuuuuucaucuuuguauuacuucucugaaauagugcuaaaauaucugcugaaugaaugaaaucuaauaaauuuugaaugcauaacuuugcauuauaaauaccuuuuauuaguguaaagguuguuuuuacuuguguaaaaguaaauuauuaaaacucuacaaaaguaaaauaauuaaaauugauuggguaaacaauaagaaaugaguuugagcagaaagcuaauuggaacauuaaaguaauaaauucucuuagagugguccuucaauaacagacucacugagggaccucaguaauaauuaccacaguucucaacuccauccacccccauuucaaagacgauaaaccugagaaccagagaagaaaucugugccuuaaucacacaguuaaaauggcagaaaaaacuggaaaccgcaucucgacucucaagagcuguucuuuccuccauaccaauuaaaacaauaaacaaaaacacuucuggcaggucacuguucuuauuuuaaaaaucauuugagccaaaugcuaagucaaaaauuaaacagcacauguuaacaaugaauaagauaguucuuuguagucccauauguacauaacauauagguuaaccucuuuaaaggguaaaaaaauuuucuuaauacuaacaagguaccagacucaacuacaaauaacuguugaaguauacugcaaaaagcaaacaagcaaacaaacaaacaaacacacaaaaacaaacacuaagggaacacacugaaaaucuaagaugcuuuaaauaaguaggaaaaguaacuauauucaggaaaagauaucuuugaucuaagggaugauuaacaaguaaggcuccaaaauuauccucaguaauaaauacauuacaaaacagguuuaacaacaaguuuggugagcuucugaagagaagacauaaaagauaauugccucacucaaacauauaauuaguucuguuucucaaaguacgagagaaugaaauuuauuuuugagaauucagagacaggucaguuacuagaaaagucacugacucagaaaucuaaucagacauuuaagguuuuuaagauuucaauggcaucuuaaaaauuuuuauuucucagaggcagaacaugagacagcaaaaagaucaauuauuaugagcaaugucuuuaaccucuucccucaucaaaccuuacaaugcaaucuuugagcuaaggcaucuauuuaucuugggcaagggccuuauuaacuucugaauuguaagaaaaucaugaagcuuacugaaaccacuaaaaaaaaccugaccaaacacaauuuccaaugugaugaacuuuaauuuuuacaaaaagaucacuugcuuacuguugaaacaaaaacaagcauuaccaucauaaaaguacaaaaaacaaagaaugaaaaggaaggaagauaugcuuacucaacugaucucguaaaacaaccauguauuuaaauuauauguuaaauauauaacauaacauauucuacugguaauacaauagcuaaagcggugcuaucugaauaaggaaaaggcuaguaaaaccuacugcuauugauauuuaauacaaguacuccuauguuccaaugauauuuuccuaauaauugaaauuuuuguuaaaguuuaaaaaugccuagauaauaagucagcuaauaugauaauauguuaucaagaggauauagauucauauaucgccaaaaaaaaaaaaaaaaagcacagcaaaaguauguuaggcccuaaauggaggagucggagcucacuuaccuucacaaagcucauacguauaguacacauuuuuguaagcucauagacugucucaaauccaugguucacagacugugccaauaacugagcaaauucuugguuguuaaaaauuuucagacuacacccacuagggaucuugcaaacaguaguaggaugaaauccaugaugguaguugcaguuccgacuuugcacaaagaugcuacugucacuaaggcauucggcauacaccuccccuccaacauaauaaagaugaacuccuauaggaagacaaagcauaccauuuaguuauuauuaauuuuuacagcucaaaggcaccugugcagcuucaacacagaaacuuaaauauacauggauuuaaacuuuggcuaguuagcuagcuauucucuagguccuguacaacaggaguucccaacccccggggccauggaccaguaucaguccguggccuguuagaaaccaggccacauagcaggaggugagugagcaagcauuacagccugagcuccaccuccuguuagaucagcggcagcauuagauucucauagaagcaugaacccuauggugaacugugcaugggagggaucaagguugcgugcuccuuaugagaaucuaaugccugaugaucugaaguggaacaguuucauccugaaacuaucccuuucccauccccuguggaaaaauugucuuccaugaaacuggucccuggugccaaaaagacuggggauggcugauguaugacugauaaaaaucuuaguuaaccgcauuacuuaauacaguaucuaggagguuucuagaaaauaacauaacaaaauguuuuaaaaauaguaauaggccaggcacaguuguucacgccuguaaucucagcacuuugggaagccaugguggacagguugcuugagcucaguucaagaccagccugggcagcacggugaaaccccaucuccacaaaaaaaaaaaaaaauacaaaaaauuagccaggcauaggggugcacaccuguagucccaguuacacagaggcugagguggcaggauugcuugaggcaaggagguugaggcugcagugagcugugauugagccacugcacuccagacugggugacagagugagaccaucucaaauaacaacaacaacaacaacaacaacaacauguagcaauuucauuuugguaagugauuaauguccuauuuggccacacauugaaaguauauuuucacucuaaaaagauagcauaauaaaaccuggaugcuauguauuuacuauaaagcgcucuugcauuuauuguacagcuaagauguuuggaaaauuuuagaaagggaagaaaggagaaagagaagagaggaacuggaaagccacagguggaagaaguauugccgaaagcuguaagauauaagauccaguaaaaaaacaugaaaaugaaacuagaaaagucauacuguguguguaaaauuagaucucacugaacuaucaccugcuccaaacuucuuccugugagacccagagugcuuaaaguguaggaaauugggccuacccugccuuuaaaaaaaggaaaguagggguaaaaaaacccauucucacaaagccccacaccauuauggaagaugacuuuauacaggucacccagcagcguuagaucccauguggguuuaaaugauccaccuuguagguaacucugguauggcuuagucaaggcuauauugugucucacagaaaacauuacaaguuuuguuuauauguauacacagcgguuaggauuucuguaauaauuaaauagcugcuagagcagaaggccauuuuuuuggccugauauagagaaaacaauuuaagagugugugugcuacuaauuuuuccugaugauaaaaaugacaaauuuucauccugaaaaaucagaaaguaaaucaaaauauaaagaagcagaaaauauuaucacucuuuuagugacucagaggcaauaauuauuaauaguuugauacacuguauucaguuuuggguaucauuaaaaugucuuugcaaacauuuaaaauaucuccaugauuguaugaauguuuuuuaaaugauuuucccauuaguggaccacugggaugacagcaauguucugcuuuuauaguuaaugccaugauaaaugucucuggacaauuuuugauaauauccuuaggagagauuccuggaaguuaaauuacuggaucgaaggcugcugauuaacucugccaaaugacuuuccagaaugcaucaauuuacacugucaccagcaguguaggaaugcuuuucucauuucacccaugccaguacugaauuugaguguagagcaaaaacaaaacgucccuaauuuauaguugacaaauaauuguuuaauuugccugugaggcuggauaugcucucguaguuuauuagccaucugcguuucucuugugaauucacuguucacauuucuuaccuauuuaucucacugggguccuauuuguuuuauuuuuuaaugaacuguucauguaagaaggauauacuuucuuauuugcuucccuguuaguccuuugucuuuuaauuuuauuugugacauauuuuuaaccuacagaaguuugcaaucucuuaguuaaaccucuuauggucuuuuguugcuuuuuaugcuuaaaaaauuuccaccucucugaucaagcauauuuucuucuagcuuuuuaauuguuugacucuugaaaaacauucaacucauuaaucuguuugcauauaugguaugaggucaggguuucucuuucccagccucacccaaacgcuaacuugguuauuguagaaccauuagaagacucuacugauuugcuaugcuucauuuaacauacauuauauuuuuauaacaguauagucugaguuuaacucauucuguuuugucuacacacugguuuacuuguaguuuuacaauguuuuauuaacccuaaugccgauaauuuuuucuuuacuuuuccauuuacaaaguuagcuagccucacuuguuuauccuuccagguaauauucagaauauucagaauacauuuuccaauuuucaaaaaaaucacauugugauucugaaaagaguuguuuuaaauuauaaauuaaauuagauggaauuaauaugcuuaaaauguucucacaauauuaagccuucccuuuaaggaacacagacugccuauuuauucaaauuuucuuucucucaguaaaauuugguuucuucauguaauucucacauauugcagguucagauuauuuccaagaaacugauguuuucuguggcuauugggaaggggauauuuccccuuucauuauauuucuaacugguuauuaccagauuaaaggaaacugacuuacauaauuuuuaaaagauagauucuuuggagguuucuagauaaauaaucauaucauuugaauaggcacaaugcccaacuauaauacuggcauggaugaagggagaaaggcacucauauauuucugguaggagugcaaauucauuuuauguaugucuguauuuauuuaucucuuuuguuuuaauuaauuaauuaauuuauuucaagacagagucucucucugucacccaggcuggagagcaguggcuugaucucagcucauugcaaccuccgccucucaaauucaagugauaacuuugccucugucucccgaguagcugggauuacaggcgugugccaccacaccuggcuaauuucuaauuuuuaguagagacccggguuccaccauguugcccaggcuggucucgaacuccugaccucaacugauccaccugccuuagccucccaaagcacuggaauuacuuuuuggaaaguaauuuggugaaauauaucaauggauuuugauauacuaauuucacuucaagaaucuaucccgagaauacugucaaucaaacauaucaucuacacauaaugaucaucuugccuuauuuccauuaucuauaauuguauauuugaguacacuacuaagggcaucuggaacaauuuuaaauaacagcauuccaagauucuuuauuuucuuaauaauguuuuaggaggaaaugucccauagcacaauuuuucuuugcuacuuugggauaagagucaucuuuagaguuuaacgaaaaguaugucuuucccucccaaauguaugcaaaauuguguuuacauacaauuucagagguuuacagaccacagaaagauaucuauguauguuaugaaccuagguucuagcauuucauuauuaaauuuacagucaagaguuuuuuccuuuaauuauauaagagaauaucuaucaauuccuaauuuaagaguuggaguuuucuuccccucaggauuaaauguuacacuuuaucuugagugcuuuuaaagcaucuaauaaauaaccuuuuaaucugguccacuguucuaaauuucauaguaggucacuguuucauacuuuuacucuggaaauaauuucaaauuuguagaaaaguuugaaagggaacaaagaaaaacagaacaaagaacacccauauaaccauuauccagaugcaucuauugugacaauuuacuccauuugcuugaucacuugggcucuccuuccccacugcugcugcacacgcaccgugcaugugugugucugucuguauguauguauuguaacacagguuuuggauagacagauggugaguagacagguaucuuuauacacuaauuucuuccugaaccacuuccuuaaauacuuaaguauuuccuaagaauagggauagucucuuauauagccauaguauaguuggcaaugcuaauacauuuaacauuggucuaaucuaccauucauauuccaguuuugccugcugaucucaauaaugucccuuacaguauuaauauuuuuucuccuguucagcacaggaucauguccagggucagauauugcaugcaggugucauaucucuuuaacugcuuuuaaucuggaacauuuccauaccuuugucuuuucacauugauauuuugaaagaauuacucccccuucuucacccuuuuuaauagaauguuucuugcuuugagucugucugauauuuccucaggauuagauucggauuugcauucucagcuggaauccugcguaggugauguuauggccuucucaggguaugacaucuggagguauaugauacccaucugucucucauuggugaugauaauuuugaucucccagucaaaacagggcaucaauuauacaauuacaauuaaaauacaaaugauacgguuucuccacuguuuaguuaaugcuuuuuauucucccuuguacuaacaggcaguuugaggguaaacacucuuaagaccaugcaaauaaacugauucucauaaacauuuucuuuauauuuagcauccauugaugauucuugccugauccuuacuaugaugguugcaaaaugauauucaaacuuuagcacugacucuacauuuaucaaccagccuuccccauucacuuaucuaucuauuuauuaugaguauggacuuauaaauuuguauuguuuuucaaugguguaaaauucaauaccguacugaggccaggcacaguggcucacacaccuguaauuccagaauuuugggaggccaaggcaggcugaucguuugagguuaguucgagaccagccuagccaacaagguaaaacucagacuguacuaaauauacaaaaauuagccgagugugguggugcacaccuguaaccucccagcuacugaggaggcugaggcacaagaaucacuugaaccugggagguggagguugcagugagccaagauuacaccacuggacuccagccugggugacacagggagacuccgucucaaaaaaaaauaaaauauaaauaaauaaauaaauaaauaaauaaaaugaaguaaaauucaucacuguaauuauuuuggagcucaaauugucugagaguuggccaguggaaggcccucuaaguuggcuccugaggcaugccccaugaguuccauaagcacuucuuuacuuucugccacaacaagaugcuccaggguccuccuaugccuaccuaucccagccuagggguaagccauuucuucaaggagcccuaguuccuuuuagugggacaugguauuagcgaugaugaucugaacacuagaugugcuuauugcuacuggguauguaugcuucugggcccuuucagcaggcagaucagaaacuauacgcaaguaaaaacgcauauacauacccaugcauacacacauacguaauacaugagaacauaaacaugcauacauacauacacauauguauuacuaaaaucagaauuuugcacugauacuucuauucuccuucacaggguuuacuuuuugcuccccuccgcauuuauaugucuguuuuccacaguggaaacccaagcucccaacaauauccacacauuuagucauuugcuucaucuuuacauaugaaaguuucagaaugguuucacucauacugcuaugaaauaaucaaguuuacuaaaaagaguucgggauuuauuugaaauccuaccccuacucuaucuacuccacucagccuaggcugaggauauauagucacuuacuauauucauaacuuacuaggcuuguuuuuuggucuuuauuuuuucuuauuauaaauauauccaugccugauuuuuuguucuuuugaaggugcugucuuauauggacaguuguucaauuuggugucccuguggggguacaaucacugcaggguucuaucgugccaccuugcacgauguuugugcuaaaaucuaguucuuucuuuucuauuuacugaguuaugguauucauuugaaauacaauuaagcaauuaacuguaauuugcuuuuaauuuuagguugugauucauuuuauaacagccaauuuauucugcagcaaaauaucauacagaauagugucuuaaaauggcaaaucauaauuucaacuaauuaauuucaauauuaugaguugaucgaccacaaaaaucacugacugcaagagcuuccagauagcagaaacuggaaaaauauuuacaaacugcagcaagugaacauuaccuggucuuugcuacaacaguuuguuacaggaaugauuuuaagucagcucuggaggaacagggacacaacagauaaacaucugaaagagguuaaagcaaaaacucaccuuuuccaauaugccgccugguguuuucaauaguggaauuccgguuaacauuggagagcagcccaaggcagaaacgguucuuauuguuggaaggaucagugaaaccauccaccaacacacuuguggaggaggcauggaacgcuucacccacacgauuguugagcucauaguagacaauagagcaccaguguuuugguuccucauaagcaaccgccugaacaucuagaggaaagaaaauguuauaucaaccaagguuagugccucaggcucucaaaaacugaaaccguguuguugaauuggcucaggaucauggaaugaagacacuggaaaagcaauugcuauuauaauguauacaguuuuucuaugauguuuaaagcagguacuucuuaauaugacacucuccuuauucuccuaauuggagaaaauuggagaacaauuuucuccaauuacuaucagauaaccaaaacaccagcuaaggaagcacagcaaaaacuuuugcugaauauuaacaauaugcuaauugcucuguaauaugcagaaauggaaaucaccccuaccacagacuuuggcucaccaucuaaagaaacacaagugacaagugaaaaaauaagugggaagagaacaauagaagacugaaaauaugccaaagguacuggcauaaaaaugaauuacuuuuggcaaagacuaaguaugccuaugcuuauucaaagccaugaaaaucaguuucuaauuauugauaagaaguuacuuuaccucauauuaaguugccaauaacuaucacagcuacaguguugcuccaguucucaaacucaggaagaaaucuugccagcuggccauucuuacagaaugaaucauaucuuucucauccagauuucaugcuaacuuccuuauauuugcuuuaagucaugcagagcagguguguuuugucucuccauucccagaaugggccaacaauggaaauuacccaacuuuacugacaggaugcagcuuguuaagucaaaucucuuaagacuaacaaaucuccaaacagaacaugguucuaaacauuugcaacuaaaagguuuuaaagaugaauuccuucuguaguaaaaccucuuguaccacuccuuuagagauuccaggaauacaaaccauauauuuccagcauaccaauauauaaugaucugagguuuaugaagucuuggguguacaauaauaaaaggaggaaaagaaagaaaguccacaucagaagcccagacuacaacugcuaagggagaagcaccucuguguucuuaacaucaaauuccacaaauacuaaaaugcacuuuacuuuagaauuugguaaaaaacaaaacaacaauaacaaacacacacacacacacacacaaaaaaaaaacaaggaaaauacucaugaaaaaacccacacauaaguuagucgcuuuacauauguaaguaguuagcuaaaaacauacacuaucuucccugcuugcuaagcaacucuaccacaucaauuugcuauaauucaaagagcaaaacuuuagugauuuacaagugccaaaucuuaaagcagacugcaacauuauuagcagaaggcuuuuaucagcuaucaggauacuucaaaauacuauucaucuaggucagagguugaugaauuuuuucugugaaaggccagcaagauuuuaugggcuguauaaucuuuaucacaacuauccaauucugcccuuguaacacagaagcagucauagacaauauguaaugaaugaauacagcugugguccaauaaugcuuuauuuacaaaaacagauagcaggcugaauuggccugugggcuguaguuuguucaccccugcucuaggaaaaucaccaaagguuaaaaacaaguuaaaaaaaaagcggggggaagaaaaaaaauggccaacauuccuuccucgugaaaauauuaacugacuauaaacuauaaaggaaaaaaaaauuaaagcuauuuaaaugaaaaaaaucuuaaagcaauuuaaagaucuguuuccugaaaucagacauuuuggguuuaguaauaauaguuacuggguccacaugcuccuaauagugugguacugugccuauucucuccugguauccugguccccaaauauaaauuccacagaugugugagauagggguuauuucccccaaccagaguguucauugacucagaauuauguuugauaagauguucaagagauaaucaggaaccauaaaauacagaggcaauaaaaaagauuuaaaaaaucauaaugauuaaagugguguacauuccaauuuaugacacugcacauccaagaaagguccuuugaguuuaucaccaauuuuuuuuuucuuuuuuuuuuuugagacugaguuuugcucuuguugcccaggcuggagugcaauggugugaucucaguucacugcaaccucugccuccuggguucaagugauucuccugccucagccucccaaguagcucggacaacaggggcccgccaccacacccagcuaauuuuugcaucugcaguagagacaggguuucaccauguuaggcaggcuggucuugaacuccugaccucaggugauccaccugccucggccucccaaagugcuagggauuacaggcgugagccaccgcgcccagccuucaucaccaguuuuuaaaucgauguuuaaagcaguuuuagguucacagcaaaacugaguauaagacagagugauuuuccauaugccccccacccccacaccuuccuagccucccucauuauuaauaucccccaccagaguggcacauuuguuuuaacugaugaaccgacauucauccuacagaccuacaaccaaagucuacgguuugcgucaggguucacuuaugguguacauccuauggguuuggauaaauguauaaugacaugcaguuaccacuguauaaugugucauagagacaaaaucaauuuuaaguacuuaaaaauauaagcaacuccuauuuuaauaaguaucuccuauuuuaauaaaaaagcacuaaaaugaaacaagacauaccuaguaaccaaacuguacuuuaacuucaauuugcauaaacauuauauaaauugcaugacccaugccauguguugagugcagcagcaaagcacuuucuuucaugagagguuauuuaggagcaguuuuauuugccaggguggcuguggauucuaacagauuucucagagagucuaccgaacuuauuuaccugaguucucugcucacuuaagucuauccuacuugccuauguagagcuggaagaaugauggcauccuccacucggucacugcuaaggauauauacagcgcuggaaucaaagacccacccuuuacuaaagggggaaagaaauuuuucauuucugcuugcaaguucuucaggcugagaaggggaaaaacuugugccucaauuccuuuuaguaacaaaguuagaaacaaauagcaagaaauucuauuaguuuguuccaguuguaguugcacauacauaagagcugaaaaacagacgggguuuauguguaucuauccuaauuacagaagaaagccuuuggacagcccaguuauaccaacuuccaacuuuggaaaucaccagugaaaacucuacuucaguacuguuauacuuauuguuucuaaauaccauuuuguucauuuaaaaauacucuuuuuggcuggguacaguggcucacgccuguaaucccagcacuuugggaggccaaggugggcggaucaccugaggucaggaauucgugaccagccuggccaacauggugaaacccugucucuacuaaaaauacaaaaauuagucgggcgugauggugugcaccuguaaucccagcuacucaggaggcugaggcaggagaaucacuugaaccugggagguggagguugcagugaaccaagaucgugcuccagccugggugaccagagcaaaacuccgucucaaaaaaaaacaaaaaaaaaauuuucaucaucaguuaaaaauuauuaaguauuaaagaucuaaacagauaacugcaaaauuauucucagaucuucauuaguuaagucaguguauuuguucuuuaaauuaaagacuuacuuguuauccagcaauuguagugagcuucucuuaacauuggacucuauuuuucucaaguagcucucuuuuuaaagacuaauaaaaauuugugagagaaaguaacaucuggacaaacuuuagacucuaaaaaagggaacaggcagcaauuaguuuuaccuccucuguugauuucugagggcaggggaggcgccaucauguuuguguccaucggcugagagccauccugggucauggggucuucaggaggcagguaagcaggugggggcguaucagcuacaaaguuuuuaaagaaguuauuucuuaacccuuaguaaacauacaugcucaaaacacguauccucuucuguacugaaauucucaagagaucaaguugucauuucaaucuccccauuaaaagacuaaaggcuacaggcacugccuugauguacaauuucugaaaaguauuaaccaugccacaaucauauacauuuuugugaaaauucagugggaggaaaagaauuauacuauaugccaguuccagaagcuguuugccuaugcaggaucaugcuguuuaaaagcaaucagaagaguauuuuaagcacacuuuaauauaaucugcuuugagaggaccucugcauuucaguuucacugauagauggaaaaccucugaaagcuucacuggacuucuuaagaaaaggagcuucagggucuuuugcauuaaaucuaugggcuuuuagaaaauucaccaaguuucauuauagccuacugauuugaacuguuaauuuuccaugacuuuagggaaucuguuaggaccacacucucccuacucauuuaaauaaucacuagcuuuaaaaucucuaguaacagaauaacagaaaaugaaucaguuuaucacagcuaucuccuauuucagaauuuacauauauguuucuucuggcaaauaagaggcaaacaugauuuuuuaaacaaagaacacuaacacaagucuugcauuuucuuaauauaaaacaaaggguauagguuucucacaaauaauccuuuuccauccaaaagcaagcuccucacuagcuaucaugagcccaucuagcauaugugucagagccuuggagacaaaauuuuaccugagggaaucgugaauguuuggauaaguaaucgagaccacucagagcaacugucaaauacaaacaacucauguuguuccuucagagagccccagugauuuccaagacucacucuccagcugaaucacaaccugguaacuucacauccagcugcuaacaagcaacaacucauaguacugagaugggacuacugggaccuucucuggaugccucuuuugccccuuuucagcuucuuuuaauucagccucuucucugcagcuguaaggcugacucggcuuuaucucaagccaggaacaaagacaaagagccuccucugagcccaagucaaugaauuucugccaagaagcuggugaaaauuucauuggcaaccuauggcaucagcacaaccaagaggaacccgauaauucuugauacuauucuacuauuccuacaggcaccuccucccaucccuugcaacuguuuuccauauuuccauuacuuggccuuugccuuaaucccugacauuuagggacaaaguguaaauucaagcaauaaccuuuaauucaaucuuggggccacucugggcugccacugcucaaaagucuucugaaauguaucuccucaccacuaaccugcccaucauacagguuaguggugaggaggaagggagagagguagacaggaagucaccaguuacuuugauuuuuaaacuagucugucucccaacccucaucccaaacagcuuuggacugaaaaccggacaaaacaaugugaaauaaacaagauuuaaauaaaagaagguaauaaauacauaaauaaaagaaagcaauauaaauguggaccacuuuucaauuuuugaaggccuagcacugauguugaauucaaauuuacuuaaaaacauuucaagcagcccaauaaacacacuugcccagucauuuucccuuccgaaaacauuaauagauguuaaguauauuuuuguuuaggguaucuuucuuaaagucuacuggcaagaaauuuggcacucuuuuuuuuuuuuuuuuuggagaugcuugcucauuaaccuguaacuuaaaaauauauaauguccuuauuaaucauuuauuuugauaaccauuacaccaacaguuaugucuagaaaaagaggauaauuguuuuuugucuuugcuaaguugaacaagcagaugguuuccaguacuucuguuguaauuccuuuguuguuaaaguauacguuucuugggauuacaucaucauuugaaugaauuuaauuaaguagggggugggaucccucaggaaauauuuuuucugagguugcacuugcaacaggaguuuuuuccauguaugaaaacgaugcugauugagguuguguucucauaagagcaaauguguguaacacgguauuuuucuuuuuaucaagaguaaagacuguaacaauuaugccacucccagaaggaugcagcuguuucaaaaccuuuuaaaaacaaggggaaaauauagcuuauucaagcaucugugccugacaaauaaaauaagacauuugcuuacuugacuaugaggucuccuuucaccaaaaguuguauccuaaaagugcgagagcacuaugucauauaccagggcugaaaaccucccuccacugcagguugacccagcuuuuccgugacacugugauaacacugucugauaugacuacagaacaucacugaacauuccaaccuaccuggcaucuggaaagggcuuccugggucugagcuggugggagagugaggguaggugcugcugcugcucccaggagaguuuggguaacugcuauugggagagugaggaaacggguggcuguuggguugcuggaaagaaucuggaaaaguggcguugaguggcaugugaggcucauuuuguccuaaguuacggaacugagcuaagaggcugugcugaggauuauauucgcugugucuuggaaccagcacaggaggaaguacuagaaaaaggaagggaaaaaagagaaggacaaacaugagaauuaugaucuauaauuacaucacaauaaaguaaaacauaaucuguaaacaacaacaaauuaucugaucccuguccugcugccaacucaaaagcaucauucaaaugaaaagcuauuuuacccucaagaacaaaugcaggaacaaauacaaucccuuuagaaucacugaugacauaugccugagauuugcaguauucacaaauugcccaaggaaaguuggcaaaauacaaucuuuuagguuaaaaauguuaagguucccucauucuuaauuuuuucauucacuaaaaaccaaagcauaauuguuuaucaccauugacaauuauauuucacagcccuggcugauaagacuucacauuuaagaguuaaugcuuauugaaugauaugaauuauucaccacaaguguuuuaagcugacacacuaauucacuuuaacacaaaaaagcagcauaguaaauaaagcugaagagguaaaaucagugaacuguagaaaaugcaaaugccaugaagauaguuaauuauacaaaauaugaggugcuuugugggacagaauuuaucuuguauccuguccuaggagucacacuuuaugaacaucuuuuuucuaaggaucuuacccacuuuucaagaauccuuaccaccaccugugaggucaaggaagaauuaguucauacaauucacauuuugcuaacugaaaacucaagguacaaaggcggcccaauagguaggcaccuguugagaagcaaagaaaacaacuccugucacuccuaaauguucuacauuaggaagcuaaggaguuaauaauuggcauggucaucaaccuccagaaaccuccugaggcaaagccacuauaaauauaauuauccuggagaggcagggcuggcuaacagucaguuacagagcccuagccagauccuaggguuagauccuaaguuucccugccagggucaccagauggaugcucuaauaaaggucuuugcaaucccuccagcuccuguggccucagcuacaaacagaaaagcagcccguuucauaaacugcaugagaggagagaggagagauuuaaaacuuaugauuauuguugguuguuaggaaucagaauauauuuccccaaagaaacaauauuugguggcaacaggaauuuagcagacuuuugagggcuuuccagggaaucuaugcauaauuuauaucauuucuacaguaaaaagugcucuuaacacuuggauuaucacuuuuuuaugagcugaaaauugcuuuuuagauaaaaacagguuuuuaaaaaaguauuaaaauuucucaugugcuauauuuuauacuccuacauaaucccauagcaucagauuuguuauuucccuauuugauccuucaggaacaaaucuuuugaguauauaauaaauguauuuucuuuuuaguacagugauggaaucuucccaaaccaaaccauuaaaagcauaaauucuucuucuaccuuucaauagucaucugaacuauaaaaugcuuuuguuuuguugaagaaacauuccugauaagggauccccaaugccaauaaaaauuuauauuccaaaacaguccaauaccuuucaauuaccuuugcaaugacaaacauucccuuuucuuuuagcugcugugacuugaauuaccauuucccaacuugccuuuuacaggcaucuagcuauggucucaauuaugauuuuuacccuuaaaagggggaaacauuggccccuaaaccacuccccacaaaugcagcaccagacagcaauccuucauguccucuauccuucagaggaccccucccucucacaacacacacgcacagaguccauuaagguuggugcaaaaauaauuucaguuuuugcauuuaauggcaaaaacugcagcaacuuugcaccagccuaacacuuaguggagcaucuguuuuagcagcucuuguuuccuaacaguuuuagaacuggggacuuacuuguuccuacuacuugcagaugggggcagugagggaggaagaacuagccuuugcaauagccacagcaaagggcaauguauuucugcuucccaaguugaaaaucugcauauguauuccucaaaaugugagacucauccaaugcuguguguguguagcaucuuguuauauauauaaacuacaauuuaucugaugauacaauuuuaucuucugcugcuaaauacuuggguugggggaaaaaaaaccaacucaaugcuuggguuauuuccaguuugaggcaguuauaaaaacuucuaugaacuuuaaaaaauuuaacuuauuuugaaauaauuucaaacuuacagaaaaacugcaauacuacaaagaacacucaaauacccuuuacccagauucaccaauuuuuaacaucuugccacauuaacuuacucauucucucuccuccauuccccagcccuagaacacaaauacacuucuucugaauuaucugagagcagguaacauacaugucccuuuacccuauagcauuucagaguaacucccaaaaggaacauuaacuuacauauacacauuuguuaucaaacuugggaaauuuaacauugaugauuuuaucuaauauaaaaucauauuccaacucugucaacugucucaaccauguccuauguagcaauuuccugauacaggaccuaagguagaaucacauauuguacuucguugucauauuucuuuaguguccuguaaucuggaauaguucuucagcgucuuuuuuccuucuugcuuucaugcuacugacauuuuugaauacaggcaguuauuuuacagacuguuuaucaauuugggucccucuaaugcuuccccgugauuaaacucugagauuuuugguuggacuacuagauaagugguaucauucccuucucaguucacaugcacagaagcacacgaugugucugccuguuugagguuuaauccugaucacuugguuaagguauugugcauuucuuccaccguagacagucucuaucuuuccuuuuguaauuaauaaguagugagagauaccacgagacuguguaaauauccuguuccuuaucaagcuuuauccccuauauuuagcauccauuuugcuugaauaaauuuuugcuauaaugguugugaacugaauuuucuuuaacuccauuauuccuucauuauuagucagaauucuaauaugaagacgugcuuuuccaucucuugugucuauaugccuauauauaacagucaucaguauggcuucauggauucuuaaucaaugagcuauaaucuauaaauaucuuuaucuauuuugauggucauauugucuuagauuuggccauugggugccuguucaagcuagucccugugccuuuguaacauguuccaauuauuugaguauuucuuaauuucuggaacaagacauuccaggcuuaucucuuaccuucccuuuccaccacuccagcaaucucugguucccuuuagugaggaauaguauuuagaaaccaaaaucugggauuuggcugucuucuguaugucuacuggagccacauugauucuaagcccugugugugugcguguguguacuggaaauuggguuaugcuguuacauccaaguguuaagccaacuccacaggguuuucauuugccuuucucuauuuccuaucuguaucuccuuauuucaacagugagaaccuuggcuaccaacaucaaaauauuuaugaaugugcuuaauucuacgauacacugaaaaaauuucagaaauuauaaaauaaaccuacuaagacaaguuuuggguuuauucucuuuaauuuuuuuuuuuuuuuugguauacuaagaacuuggauucauucaaauucauucaaaaucuacuuggauucaucccucucuucucuucaguguuauuuuauuacuuugaaauuuuauucaauuucucccuuucacaguuaguuuauuugaauauaucuguugcuauuugcgcuuaguuuuaggaguuccccucucucauucuuauuguguguauuuaaaaagcaaaauuaaaucaacauuaacaugauuuuaaagucaaaacaauauacucccuaccacaucccuucuaacuuaguccuccaauuuuaacauccuccuagggucaccaauuucauuuuuuucuggcuuauccuguguuucuucuugaaaaaagcaagcagauaaauggaugcuuucuuauuucgucuuuacugcuaaaaagaaagauagccuacuauauaggcucuuuugcacuuugcuuuuuucaccuauauaugagaaaaacuucauauuagugcacagaggucuuccucaugugguuugacagauaacaacaccaaaggugauuuaacaaucucccauaucuggccauucagguauuucacaauauuuuaccagaaaauguaauacugcaaugacugugcauauauaugguagcacugucaaagguguaucuucagggcaaauuccuagauguggaaaugcugggugaauggguaaauguauauauaacuuuguuauugucaaguaccccuuuccaaugguugcaccauuuugcacugucacauaggagugccuuuuucccauaccuuccagaauagagucugucaagcuucugaauccugacaaccugaugggugacaaaugacauuuuggugcaauuuuaauuuacauuucucuuauagugaaaguugaucaucuuuucauguauuucagacagcgcuuuucuaucuuuuucuuugaacuguuggcuuaugccuuuugccuauuuuugguauuuucauccuucauuaaaaaaaacaacauacuagagauacuagccugugauauauguuguggauauuuuaccaugacuaucauuugucuuuucacuuauguauauuuuuugguaggcacauuuaucaacauauuauuuuauugcauauuuauuuuugaguccuagaaagccuucuccuauacccagauuauaaggaggaauucauccaugcauacuucuagugcauauaaaguuucauaauuuauuuagcucugugaucccuuuggaguuuaguuuuauuugugguaugaggaauggaucuaauuuuaucuuucucuaaaugguuagccaguuaaccccaacaccauucauuaaaagcccaucuuugacccagugauuggaguugccgcuuuaaaaaaguuccauaaauguucgagucuuuuagacauuuaauuccacuacauuucauccuguucuagucugugccccaguaccacucuguuuuaauuauaaaggcuuuauagagauuuuaauauccgauaggggccagccccucucacaguucuuccuuuucaguguuuuguuugcaugcuuaagcuuuccauaugacuucaguuaucaccuuguuuaccuccgguaaaaaaaguuauuaauacuuuuauugaggucacauuauauacauaaauuaaguaaagauuaauaucuugaugaugcugaaaugcccuucugaagauguaggaaggucuguucaagccuacuuuuguguucuacaaguauugucugcauuaguugcuagcacugcuguaacacaauaccauagacuggcggcuuaaacaacagaaauuuauuuucucacuguugcugugaaggcuggaaauccaaagucaaaguguuggcagguugguuucccugaggcuucucuucuuggcuugcaggcagcugccuccucaggguguacucacauggccuuuucuccugaggucucugcauguuucaucccucuucuuauaaagaccccagucagacugcauuagggcccaugcucauggucucauuuaauuuaauuaccucuuuuaaaggcccuaucuccaaaaacagucauauucuauggugcuugggguuagggcuucaauauaucaauuuuggggcaugcaacucaguuccuaacaccacauauaggauuugcacauuucuuguuaaauuuaucaaguuguugcuauuuucaaugagauuaaaugaggcuucuucuccaauguaucuucuaacugguaauuacuaccacaugguccacagcagcacuuacaaaaacuuccuuauuugcuuuuuuaaaaacaaauuuuauuauuauuuuuagagcuggggucuugcuauguugcccaggcuggagugcuguggcuauucacaggcaugaucacagagcaauucagccucaaacuccugggcuuaagcgauccuccugccucagccuccugagcagcuaggacuacagaugccugccaccaugcgcaguuaauuuuuauuuuuuguagagacagggucucgcuauguugcccaggcuggucucaaacuccuagucucaagcuauccuccugccucagccucucaaagcacugggauuacaggcaugagccaccacacccacccuggagacuguauaaguagggugucuguaaguucuagcuugccugggauagucccaauuuguaccuguuguccaauguaauuaguaauaggugacucuugucaauuucaagccuccuggcuuggacaauaaauguucacacuaacuauaagcgaugacuaauuaaauucaggaaaguaaagagacaggucuggaacagcugccagcccuagaaagaaguauuaauguggcagagaggagacacauagaaguuagucaggcuggguuaagccuacacacacgugcugcucuaaaauaacaaggcccaggccucucucccuguguggaauccugaaggacaaugcgugguucucucccagaugucucucgcucuacccccacuucaugcuccuuucauuucagcaagauuucaguaaagaauaauuaaaauauguuuucuauuaggcaaaaaggaaagaagaaacauucagauaauuauucauguuuaagcacacuuucuuugugcaauucucauuucuugggugagagauuuaccagccuaaagaaugaggauuugcaaacugcaggcccaacucagaucaccaauaggaagggagagagggugagcaguguuucccucugacuuguucuaugucucgggcuguuccuauuuuauggaaaacaaauaugggaacguagacuuuucuggggaaccacuuucuuagugcacuaaggugacccuuguuugguaacuucaaaauauggcuaaagugugggacuucccucuuuaagggcugcuccuauugguuaauuugaauaagaaucugcuuucaaagaagagcccaauguuaaaacaucuuucuuuguacacaugaauuucuuccgaguuauuuaaaaaucagaccauguauguccuucuuguauccuaggagcucuaacucugguaaaaacccaaaucuuuucucccacccuaaccccucaaauauauucugaaaaaacgccccuaggugauuucaccaauccucuccacccauuugaaaaugucuaauuguguuaugucuuuaaaaggcugaagcuaucuucuuuuccugaucucuuuuccuuuucucucaggagaaaaaaaucuucagauuucugccuuuucucagugacguuaacucugcuuuucaaacugugcaucucuguuaaaaauaaaaucccuuuuccagucaacagggaaacccaacuaagaauguuucaggaagcaaaaguuucagagauauuugugauucugcuauuauacucagcuuuucagcguugcuaagguacacggaaaagcaugaaaaagaacaguuaaaauuguagagaggggcugagcucuggaaaggauuccuguaaacucuagaugugagagcuuuuuuaagauuuugaaguacugcuugaaauucuaucaccaaguugucagugguaaaguagucuaguaaugagacaaagucugacaaauccccacgugggcugugacccaccaaauguucgugagaaagcagcuuuuuucuuuuuuaaacacgcaagagaguucugauauauguuugcccauauagaaguaacagaaaaaaaaaaaagaaguaacggacacaagcuaccuguuaccuggcaguacagaaaugcuuucuaguucugagaaggugguaaaggcauuuagguuagagucaagacaccuuaguucuaguccugacucccguaaccaccuuugugacuuugagccaaucacuuaaugucucagggacucaguuuccucacacaaaagagcaagaaacuugcucuccacagggucuuccugcucuaaauucugcaagucuucugauggaugagaaugcugcucauguacaccuggaguuuuguaauguccaaagcucagccccagauggcaucuaaguugaaucucaggacauuucagugaggccaccuacaagcagaaaggaggcccagggcuagggacagaauggccccagagccagucagcugcagcaauucuugugagaaagggagggcaagcugccagagcagcugugcccaauaugaugccuacacgagacagauguccccaguagaguguguucagugaccuucuaaacagagacacuucaaguaggaagugccggaaaggguaagaguaagaacacuuaaaauuaauaguauacacauuuaugaaauaaaauuccuuaccucagcauaugucagggaaacuuuacgcugaagaaaugauucuuggaaccucaauagagguuaaauuuuaaugaaaauauauaacagccuaaaccccugagugguggcacuuuuuugucugcuuauuggugaugaggugauaguacggagggucuauaauauaagguucacuggguaccauauaugccuccaucaugcagggcacugcagguaugagucaacaggacagacacuguccuugcccauugggaaaagugucuaucacuaaauccucacagcaguuaucucuguuuuacaggugaaggaucaggcucagccuagcuaaguaacccaugcaaggucacacagcugcuaauugagggccaggaugugaaucaaggucugcucauaaccacuagacaaucacucaguacuauaaaacuggaaagagacuguggaaguuguuuuuuaaauucuuuuuccauccuucuguuuguuuuuuugggggcaagaucuuuuuaaaagguaugauaguuuugccuaaagguagcaacacgguaguauuuacuuucugggaguauaguuacucaaguacaaauauauuaaaagacaaagaugugaacauaauuugacauagauaaaugaauuucauucaacaauaucauaaagcauuaaacaaaagccacuaaauuuaccuaaaaaucaccuaaaucuaacucaacuucugagaauccaacuuccuagauaaugccaggccaaugauucuuuuuguauaccacagauuauuuucuugaaaaauaccuucucugggcacccacagaacgucugcuaugacuccauaaccuaguucagauuccugcuucaaccuaucuuuguggcuuuuugcaguuuucaucugcuaguuucauacuucugcaccuuugcucacuuggccauauuuccaagucucaguucuaacagcacucccauggugccuuucccggucuuucuauccaccccugguagaaaagaauuccucccuaugccucagugugcccuacacagacuuucauuguagcaucugcaacauuuuauugcuaaguugacuuuacuucaccuggacuguaaugccuuuguggguagaacugauuuucuuucuuuugaaaggaaauaggugccagugucuggcaccuaauagguccagaaugaauguuuuuucaauauguuuguaaauuguauugcuauuccugaccugucuacuauaaguggguucauauaaaccagucuuucucaaaguucagcccucagacucuuugcaccugaauuagauacuuauuuaaaaaggcagauucuuauaccucaucccagauauaacaagucaaaaccuucagcaauucugggugaauacagccuagguacaggaagacaaaugguuacuacaugcacuggcaagagagcuaggugucuggcccuaucuaugucucuaaguagcuguggaacuugaacuucaauuuuucucaucuuaagucaaauuucuagagaucaucccuuucacuuacaaaaaacucuacacaguauugguccugauucuuugacaguauacagauauaaauccaaaugacauggaaaaggcuggcauggccuuauaguaagcuuacagaaaauuuacagggcccaguuuuuuuggucaagaggcauguugucauggaaaaagcacuggcuugggaucaagauagcccacggucuuagcuguaugaauuuagguggcauaaauucccaccucaguuuccccaaagggauagcaagcccuuaacagcacucugagaaucaagaaugguggcacacagcaguuugucaaaccuaguucccucucugucuuuucucuuccuacuuucacccugguaguuuccuuucuuuugccaaguauuuaucugcuuuacuuccacagaaggaaggugcucuguuauuagagacuucgagaguuguuagagguagaaaaaaacuucaggguauaaccuaaaaacaucaggagaaaaaaaaauaccuucaaaagccacacaugaaguauaguaacagucagaagcagguuuuaguuucucaguuccaaaauuggaaauucugcuuauuuacuagccgauuaacuagggcaauuuacuauuuaaaccucacuuuuaauaauaaaauaggaauaauaguacuucucagauuuucuuuuaauauggugcuuauacauguguguaccaagugccacauaccaagcuguaccagauauuaacucauugaauccucugaacaacucugauccuagguacuacauuaccucuacuuuauaaaaguggaaaaugagauauagagaaugagauagagaauguaucaccaauaaccagggaagacaggauucaaaccuaggcagccuggcacugcaguccaaguucuuagccaccgugcuauggugucucucaacguugcacaaguuaguuuuaacaaaguuccauaagcacacaguaagagguagucauuacacaaagagcaguuagccuauggugucuauucaucuauugcacgauugauauguaaaugauuaaccuaggugucacccaggcaucuuuaauuuguaacugcagcugaauuaauuauauucagcucauucugaguuuauauuugaugcaauuaaauauauuccacgaaaaugagauacuugguaucuaauaaagaacauuauggucaggcgcgguagcucacgccuguaauccuggcacuccgggaggccaaggugggugaaucacuugaggucaggaguucgagaccagccugggcaacauagugaaaccccccgucucuacuaaaaaauacaaaaguuaggccgggugcaguggcuuacgccuguaaucccagcacuuugggaggcugaggagggcaaaucacaagauuaggaguucgagaccagccuggccaacauagugaaucccugacucuauuaaaaauacaaaaauuuagcuggguguaguggcgggcgccuguaaucccagcuacucaagaggcugaggcaggagaaucacuuaaacccaggagguggagguugcagugggccaagaucgugccacugcacuccagcccuggugacagagugagacucaauuucaaaaaaaaaaaaaauauauguguguguauguguguguguguguguguguguguguguguguacaaacaaaaaaauuagccgagagugguagugcaugccuguagucccagacacucgggaggcugaggcaggagaauaacuugaacccagggccggggccggggcggggagcgguggaaguugcagugagccaagguugcgccacugcacuacagccagggugacagggugggauucugucucgaaaaaaaaaaaaaauuacugaucaaugggaaauaaacagaagccuccauaaacacuucaagggcagauguggacucgcaauccaaaacucaugcagcuggugcacauaugaucacauucucuacuaccaaaaacucuggaugccccuccuuuuuguugagagaaaacugauuaaagacuucuuuugggaagcaguauagcacagugguuagcagcauggauuuugcaguuaggcuuuaauuugaauccuggcuuuccagauacaaguugugugaaaaauuuacucaaauucuacauaucaguagccacauugguaccaucuuccggcagucguuguuagaauuaaaugagaauagggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuggcugggcguaguggcgggcgccuguagucccagcuacuugggaggcugaggcaggagaauggcgugaacccgggaggcggagcucgcagugagccgagaucccgccacugcacuccagccugggcgacagagcaagacuccgucucaaaaaaaaaaaaaagaauuaaaugagaauagaugguaagugauaagcacaguguccagcacacagaaagcauaaaaagucacuauuuuaacuuuauuaauauuuuauucuaauaauaucauuccuuuucugaauaucuguuuaaugaaaaguugcuuacauuacaaauuuuguuucuauucuaagaaagauacacagaagugauguuccuuguaucacuauuucagucauauuguuucaagaaugcauuaguacauaaagccuuuucacaugcauuaacuuuauccucaaccugaaaaguagauguaaccacucccccauuuuauggguuagcaaacacaagcucaaagaggacaaaugacuaacccaaggucaaaguuaucaagugccaaaauucaauccagcccuucuaacccuagauucuucccaucauauuuuaacuacuaaagagaaauaaauaucuccuuuaaauggccuuauuguccagaauauccuaaagaacuccacauuuacugguuggcaauggcauucuacugugagcaagagccuuuuccuucucccccauucaucuucagcauggauuccuguuuuucucccagugguuuauaauucacuucuguccuuaauuauuccguugaucaaauugucucagauuugucacaagcuggccucuggguccuugugacaugcucccaucaguuuucucuuaaauaacauuuuaagauuagcuauuauuuuuccuauuuaaaagcuguaaguuauaugugaauagacauuuauccacaacuuuucucccaaguugaucaucuuacuuaaauaucugucaagcacaccaccauacccuggguaaacuuuucaggugcucaaagaaagguauugucacacacaaaaaauacugcaaaaucugcuacaaagcuagcuagcuagaacugauagggaaacuacagggaaacaaaggcaaaaacauauaaggcaauuucacucuguuauuuauauguuuauuuuuaguuuacaauaagcuguccaaaugcuccuuauaaaaucacucuucuuuuacuuuauucucacugaacaucccagacaggccacugggcaauuagucaagugaaggugaugugcgaccacauaagccagaccacgccaggccacaauuuagauaaaaaaaugucuuuucucaugcgaaagaauaaagaacuaagaaaagcagcaucucuuggagagcuguuuuagaaccaggguagugauauagcagaauauaaaccugaucuuccauuuuuaaaaccugcuaagauuccagagcaugaacauuacaauuuagagaacuggaggaaaauugccaaacacuccuuuguugaccuaaaucuugauuuaagccacagaauguguuuccaacacccuagaucuuuuaucaaggaaauuacacuuaccucuaguuacauaguuuuauguggagcagaccugcaauugaguauuauggucaggcuucagugcuagagaaauccuguugaggacugagggcaaugauaauuagaaaaguggaguggguaagcagcaagugauuaucucuccaucucccauacaccaggaggccuggcccagcucagcccagcucagcccaacccaccccagcccaaacccagaggaaacgagucugcaugcagacauucaaacuagauucagcaccaguaucaaacaacuacaccaauccccagccaaacuggcaaauuaacaaaauguggggguuuuagcucuacuauucugcaagcccucuuagauuuuuaccacagugcucaugguauccacccuacagcugcuccaaauccuccagcucugcuucuucaaaaacaaauaaacccuuguugcuuccccaucuccuccccaaacaaaucucauuuuuccaaauaucagggcagagguuugaugaucuggcuaauucaugcuuauuagucaugaugcuuagucuuuccggagaacauuuucauuuuaaggggaaaauggcaaggggauagaacauauauuugagagaaagcaaucucuggucuguucucuggccuuuugauaucuagcaccaaagaggcugaaaguaaaaccaaauuaaucagccugagaucauuacauaagccgaccauccucuucuauuucucuccuuuuuccaaguauccagcaaggccaccgggcacucccacauggggcaaaucaccugugacuccuccuaaacucaaccacauauaaaacuuacucaaaccuccaagaaaucauuguuucaggaugauccacaugugggaauaauaagccaaaaagcacaauucagaaggucuuaauuauuauuucacccuaagcuagucuuggaaacauuggccugguuuuuuucuuuuaauuuaaaauauuaugacaaauguuuuucuaugguuuucaaaacugcuguuuuucuucagucacuuuuuuuuuuuuucguuuucuuuuuaacagcugcuggcuggcugguguucuuucugcucuaugaaccagcaauggaggguggaagacagcugcacuuuaaaugaaucugaaagaucugaaaauaucuucucuugcccaccuaauacugcagaaauagaauaagaagaaaaauaauaaagcagaagacaaacgucaggaaagcaaaaguaugagaaagguacuuuguaugaucuauagacuacugucuuaaaauuucaaauuaaaguagauuuggcaauagaaaaauucugcccagaaacaaaucacauuguaguugucuagaugucugcuuccaucgauguauaacaacuuauguacuuuuacaguuuauguaaaaguaacauacaguaauggcugaaacaguaucuauucaucaauuaauaacccaaaacaaaugccacaaaugcauuuaagaacaguugcucagaaaagaaaaaaaaaauuaaaauaacaagcuucacauuugccuaggauuuaacacuggaauccacuaaaagaucuggguauaaaauccuacucaugacuauauuauuucauguuucuaguaauauuauagaugaaaauaauaaaauuaucaaccauaagccaaugccaaugauaaaauccuggaaagcguucacugucuuaucuccauguccacuaggcuguguggauagaaaucuaaguagugaccuugugcuuuuucaaaaaagaacuuccagacugagcaugguagcucaugccuguaaucccagaacuuugagaagcugaggugggaggaugccuugaagucaggaguuugaggcugcagugagcuaugacugcgccacugcacuccagccugagcaacagggccagaucucgucucaaaaaaacaaaccaaaacaaaaagccaaaaaagaacuuccauguagacugaagaaugaagcccugagaggacuguggaagagcaacugcaaaagccagagggcacccaccccacccuaaggcaccccuccugccagaagccucugcaaccgccucaguggcucugcccggaacccaaccuucaagcgcaaaagcugauuuguaucuccuaacucuuaaaacuuucuuccuucaucuccaagcuauuaauacauacaccucuccccuacaccaaaacuauuacgagaaacaugcaaacuaggauuacaaacauauaauaacgauaguuauuuuuguuuauaguuauacaaauauacauaguauauuuguauuauaguaacuccuauggaacaccuuugugcuaguuuuucucagucuugaucuuucauuguauuuucccuggucuauuuuauuaguaauucuuuucuauuuuauuguauguccaaaaccuguaaacugauuuaaguccuuucugcacugaaacauacacauauaucccaucaccacacagauugcaacaccauguguuauaugugucagagugagcaagcuuuucuguggugacuccuggguguguaagaguuagcugcagccucuauccaguguguaagaguuagucgcagucucuguccacaccucuauucaauuuagaauacagugcuguaauuacaugcuaaccuucuggggcaggcacaguuccugaggaguuaguuuaucaugugcuuuaaaugucugaauaaaaagaaauuuagacacgcaggaacacacggcauaaugccuuauuuuaauuuuuauaguuaauauuauugcuaauuaaucccaaauauuuaaaaacuuaaaaaaaacuugaacuagacugaaguuuuuuguuaccacacacaugucauauaaaaacacauucacagccaggcacgguggcucacgccuguaaucccagcacuuugggaggcugaggcgggcagaucacaaggucaggaguucgagaccagccuggccauauggagaaaccccgucucuacuaaaaauacaaaaauuaguugggcaugguggcgggugucuguaaucccagcuacugaggaggcugaggcaggagaauuguuugaacccgggaggcagagguugcagugagcugagaucaugccauugcacuccagccugggcgacagggcgagacuccaucucaaauuaaaaaaaacaaaaaaacaaaacaaaacaaaacaaaacacauucacaauguggugaagcaagacauuuuuuaaagauuuccauuuguuuuuuuggagacagaguuuugcuuuuguugcccaggcugaagugcaaugacacaaucuuggcucaccacaaccuccaccucccagguucaagcgauucuccugccucagccucugagagcugggauuacaggccgugcaccaccacgugggcuaauuuuguauuuuuaguagagaugggguuucuccauguuggucaggcuggucucgaacucccgaccuaaggugauccacccgccuuggccucccacagugcugggauuacaggcgugagccacugcacccagaccauuuuuuuguuuguuuuuuugagacagagucuugcucugucgcccuggcuggagugcaguggcgcgaucccggcucacugcaagcuccaccuccuggguucacccguucuccugccucagccucccgaguagcugggacuacaggcgcccgccaccucgcccggcuaauuuuuuuuuuguauuuuuagcagagacgggguuucaccguguuagccaggauggucaccucgugauccgcccgccuuggccucccaaaguguugggauuacaggcaugagccaccacgcccagccuguuuuauaaaauauuaauuuuauuacauuuccucucgucuuuuuaauauucugugugacaaaaugaaaagugcacaaagagcaccagugugagcugaacuagcugcuuuuuuuuuuuuuuuuuuacagaaaaccauuuguuaaaucaagguaauuguagauucacaugcaguuuuaaggauaacagagaaauccuacuuacagaaucagaauauuacagacuaucacagaauauuacaaaauuaucacaaucaaaauauugacauugauacagucaagauacagaaaauuuccgucaccccaaggaucucucacuuugcccuuuuauggcuacacccacuccccuuccccucuuuccucuucuuggccccuggugagaacuaaucuguccucuauuucuauaauuuuaagacuuucucuucaagguaaaauuuaccaagacacgaauuacacagugacugaggcagccaaagagugaaaacaugcauucagucaacaggugaagaggauuuuacgugaauuuuaaacagcuggcagccaucaugcugaaaaugaaagcaccuggaagcuaaugccuuaaagaucaaaacugaaaucucagaauuucaagcucagauuuaauaugcccuuucaagcugauuaaguucaaagugcagaagauaauuuucaagaaccaugugaaaaacauuaaaaaaaaaauggccaauggcagguaaucuccauuaaggcauuuuuaauagcagaagauagcaacugaauggucuucucaauaccacaguuagauugcuugcuuaaccacugucagcauuuacucugguaagaaagaauaaacccuacauuuaauucaaccacuaauaaguagcccugauucugaaggcuaguaaaaguccaaguaaacaguccaccuguuaaaucaucagcagggacauagucuucagaagcuccacgaacuuucucuuuccuguaaguauucacacauuugcagaaaaagaaauuccuaacauuuucuacuuucccaaagaucuauuuuucagcaauggucaaaguggcaaauuucaacaaaaggaagguuuuucuccuugcacauuugucauuguuaacuauaauaaacacaaguuguagcaaaguguuuucauaaauuuguuuuuccccacuaccauuuuuuuacacuguuuuauuuauaagaaaauaaauggcauagguuaaggaaaagcaacaauuauucccguccguaauauuacuuuugucaaagagauagagauaguacacucuaaagaacaauuccaaaacuugcacugagccgaauaacaaaagcauagacuucuccccaacuuccccgcccacuuaaagacaacuuaucccaucuuguuagagggcucaucuuaaugaauaucagaaggaaaacucuggaaagagcaauuuucuaucuguauccaaacaugcaaaauuaaaaaugcuggaggauuuaaaagacuagcucauuagcaucucuucugaauucaagacaacuucauccagacaaucggacuugaugacuugccuggauaccuuaaaccagugguucucaaacuuuugcaguaucaguuucacuuggagaacuuguuacaacacagaugucuguccccaucuccagagucugauucaguauuguaggucuguggaaggguuuaagaauuugcauuucuacacauucauccacugaagagcacucagguuaacuucauaccuuggcuauuguaaauaaugccacagugaacuuaguagugcagacaucuccuugacacacugauuugaccuccuuuggacauauacccaguugugagacugcuggaucauaugguaguucuauuuuuaauuuuuugaggaaccuccauacugucuuccaaaauggcuguccccuaucucuacauccuugccaacacuugauaucuuucaucuuuuugauaacagccauucuaacaggugaaagguauaucuuacugcaguuuuugcauuucccugaugauuacuuauguugaacauuuuuuucaaauuaaauacuauucagccuuaaaaaaggaaauugucacuugugacaccuggcggacauuauuguuaagugaaauaagccaggcacagaaagacgaauacugcacaaucucacuacauguggaaucuaaaauagacucauaaaaguagaguguagaauuagaauggugguuaucaggggcugcagggaggggugaacauggacagaggaaaugcuggucaaaggguacaaaccuuaagcuagaaguaguaaguuuuggugaucuauugcacagcauggugacuauaguuaauaauacauuguauauuucaaaauugcuaaaaaaguggguuuuuuuuuuuuuuugauacagagucucucucuuacccaggcuggagugcagcgacaugaugauagcucacuacagguuugaccuccuaggcucaagugauccuccugauuuagcuucugaauagguaggacuauaggcacaugccaccaugccucgcuaauuaaaaaaaaaaaaaauuaagacggggucuugcuauguugcuuaggcuagggguggauuuuaaauguacucaccaaaaagaaauuaguauggugaaaaaaaaaaagguucagcugggcucaguggcucacgccuauaaucccagcacuuugggaggccaaggcagguggaucaacugaggucaggacuucgagaccagcguggccaacaugguaaaaccccaucuuuacuaaaaauacaaaaauuagcugggcguggugaugcacgucuguaauccuagcuacucgggaggcugaggcaggagaaucucuugauccugggaggcagagguugcagugagccgagaucaugccacugcacuccagccuggucaacagagcgagacucuaccucaaaaaaaaaaaaaaaaaaaaaaaaagccaaccaaacaaacaaaaaaaugguucagagaauaggcaguaaaaaaaagagaaaaaaagaaaaagaaagaaauaagcaaauacacaugggaggugacagauauguuaauuagccucauuugaucauuccacaauguauacauguaccaaaacauaacacuguauuccacaaauauauacaauuauuugucaauuuaaaaauaauaauuagcuuuucuaacaaguuccaaggugguacugaugcuacuacucuguggacgacacuuugaaaaccacuacucuaaaccuaaauauucucaauuuuugaguuuuuuucaagagucauugagaccucagcagaagucaccaaguuugggagacuuaaauauguuaaacugcuaaacuguucuuugagauacuucaucagaaguaaaauagugacaaaguucaaaauaauucaguguugagcuguguauaugugcagcuuagaauuccagacccccuuuuucugauuucacaaaaacaauacccagguguacucuguacggcuuuauagagggcuucaauucuggcagugugaggggcuaagucaccuugcacauuuuuauuuuuuuuuuuugagauggaguuucacucuugucccccaggcuggagugcaauggcaugaucuuggcucacuacaaccugcgccucucagguucaagugauuuuucugccucagccucccgaguagcugggauuacaggcgccccccaccucgccaggcuuauuuuuguauuuuuaguagagaugggguuuuacuaugcugcauuuuuuuaacuuuauuuuucugagacagagucucacuacacugcccaggcuagaacguaauggcuauuuacaggcaugaucauagugugcugcagccuucaacucuggggcucaagugauccucccaccucagccuccugaguagcugagacuacaggcauguaccaccacaucuggcugccucuugcacuuugauuuaguagaguuucucuucagaagguacagggacugcuucauaguggucucuggaaaaaguccuuuguuccaauucccacaucagucacuucauaaugugaaaaauauacauaaaaucuugauauguucaaauuaaauagaucuuagccucagccuccauguuuuccagaacuguucuauucuauccaugacucacaagauuccuggguaaaggagaggcugaaauggcauuuguggagucucaaaaugccuauguaagccaguuuuccaccucuuccccauuauuuuauuagcacauauguuauuaagaguaacaaauucaucucaguauugguuuuaacuuuucaccuuguaucagagguguaauagccauaaaaugaccaaagaagggaagaagauggucaaaagguauagauaaacugaaaauucagcacuaaaaaaauggccaaaugacgauauuaaauuaaaaaucagcaucaccauuuaacagcaaaaauuuaucaaauuaugcuuguugcuaaaaauagagauguuaauuauacacauagucccugcccucauggagcuuuauuuacuaucuugcagagaagaccaacagaacaaucauuauaagugugaagaacauucuaaagaaauucagguugcuaugggaaaugagaccuaaccuccccaagcagaguagggagauaugugugaaguaggagguaucaagaaagguuucccaaugaaacugaccuccaucacacaauuacuuaguuuauuaaguaaugaccaugugcuagacacaaacgauaaauaagagugggcuagacaaagagggaggagaaacagguacagauagaggaaacgugcauggaauguuuccagagaacucaagcacacaaagcaugcaagaguacaaaggaaguuggaaagggaggaaaggaccagaaugugcagaccucucuagaggacuucucaagaguagggaaaaguaggacaacaagaggaucaugucugcaucuuaaaagaucccuuucuguagacaauggacugaagggggugaccagucaggaggcaguugcugcauugcaagaugaaaugcuggaagguuagcgcagggugagggggaguauggauggagaagacauauucauagugucuuuuaaauagugaauuuugccuuucaugucaaaugccucuauuuucuaguucuaacacaaggcacuuaacuuguaggggccucaguuucaucgcauauggaguagaauuaaaaucuuaccuauguauuaauacauuuuaagguuacuacgaggaucaaaaaaaucaugugccuaaauaauauugcugguacauauuacuuaucuacuacauuuuacucuccaaaacucuuagcuccauuuccauuucuggcuagaagagggacauguaccucugugcugaguuuagaaaaaagaacacugcaucacagcugauauaacaagcaguaaagaacgucuauauccaaacugguaaggagaauucagcacaguuguuagaaaaaaggcaaugcucucuuaaccaagagcaacuguaacaaaauguaacuuuuaaaaggauacaauaaaaaccaguuaucuagaaauaaaucuaguaagugcaggagcuguauggagaaacuuaaaagugcacuaaauaauauuaugcucaagagcacaguaggccaaucuuccccaaaugaaaucaacgaaauuccaauaaauucccaaaguguuuuucauaggacuuaacaagguaauccuaaaguauauaaucuagaaaucacaaaaacguaauguuggaugaacauaaguuguacaaagaaacuccaauauuauguaacauuuuuaaauauauaaaauauuacauauugucauggacucauacauauguaauaacaguauaaaaacaugcaugagaaugauaagcgucagauucagaacagugguuaccaaagggagcagaaucagaggagcaaaaacagggguuccaguuuacacguaaucuuuuauuucuuaaaaugaguaggggauacagagauguuuguuauacuacuggucuuuaaaaucuuuuuuuaaaauaugucuuaaauauuccacaaaaauacagaaugccuuuuauuugaaaaccauguuauuacaugaucuaguuuaguaauuccuaaacaccaauccaauagcuacaucaguaacaccugaaguacuuguuagaaacaaagauuaccaggcuaucccaggaucaggauuucugggaggagagccaugugauucuaauauacagccuuaguaacccaggaacuauuaacagccaauccaucaacaaaauuggucccaaucgacaaugagacauuuaagugcuugaauaucuaaucacuuuccaaugauccaacucucuagaauguagauucuaacuugagggcaaaaccguauaaauuuuaaaauauauccuuuaccauacccucccaaaagacuauacauguaaaaacuggguauauuuuauaaaguaauagcaucaaaugauuccauagaaggauauaauuccuucauauucaccauaggaaauaugccacagcaaaauuccgccagagaugauaaaaagugcuguucuuaaguucagaaugguuuaagucacuggcaacuacccucaugauguacuucccuuaagcauauagacagcaauaaugcauuucuuuccuaauuuucuucccuuagaauacaauucauagcuaauuuuaucuagagaaaugcagagaaccaugugagacauaaaaaauaaauuuagaaagaaaacaauuuauuaaaaauuagagguauuaguacugcaaugacaauugucauagccugcucccaagacauaauguuaacuagagaugacuaagcuguuaaaauguaugaaacacucaggggcuuucucucuugcauucacacagacacacacacacacacacacacacacacacacacacacacacaguuuccccaaauauuuuuaaauuacaacuaaaaacaagcaaagggauuauuuucauguucuaaacaacacaaaucugguacugggcacacaaagcacaucaacauaaaauaacucacuuaccagggcuuucuacucucuuauagugguagggauugaugcagaccuccuucugcuuggaaccaaaaggaaacucacagcauuccagugguuuuaguucaugguggcucugaagaucgggccagcgccacacacggcaguaaaugacaugaggcagucccuuccggugggagacuugcagccugccauccagagagcggggaauggugacacaguuacucgguugcccugggcagcucaaggccuuuuccaguuccuccauggcaccuuucuuuuucuucaguuuuuucaccaaagcaucaacagcuuucucugcccauuuuucuucuucaucgcccuguuuccacccaagaagucucuucacagcuggacuuguaaaggaaaauaaacuugucacauucauaaugacagcacuaguuauacuccuuggauauggugaaauaaagcugucuccaaaugcaaaaggacagcagaagagauuuguuuauuuacagagaagucucuuuaacuucuuaguuugaaguccagaagaguagaaauuaccauuccuaguguuuaaaaaaguaacccagucagcaccuacaaaacaaaaaaagaaugguuagaaucaucuuuaccauacaaccacauuuauuaaguaaucaccaugugcuagguacuauuuuaagugcuuuuauguaauacaguaugcuguggacugaauugugaccccuaaaauucauaugcggaagcccuaacucucaguaugacuauauuuggagauggagccucuaagaaaguaauuaaaguuaaguaaggucaucaggguggggcccuaaccugauaggacugguggucuuaagauugcuaucucccuccuccagccucuaugcacacacacugaggguacugcaagaaggugaucaucugcaagccaggaagagagcccucaccagagccuguauuguccagaaccuugaucuuggacuuuccagacuccagaacaaagagaaaaucuauuucuguuauuuaagccacccagucuaugauauuuuauuauggcaaccaaagcagacuaauauauagcauuuaaugcuuuucacaauccuuugaguuagguaauacaauugcugccacuuuacagaugaguaaacugagaagcaguuuaaaaaguaagccacuguuagcaaaagcucugggauaaaagcaacaaaguuaaaaagcccaaguucucaaaagauauuguaauauuuuagauuuagauucauuuauaaccucuaaaaauauauuucaaaacaccucaaucaacaaaaacugaaagcaacagggagaaaaaaauagucuaauaucucuguuuuuuugguuuguucuacaaauauuucuuaggcuaaaagaaaauuccucuuauauaaauguaguaauauuuuaggguauuucuucagugaacaagccugugucuaugggcuacaggacaaauaggauaggaaauacaucuccugcuuuaaaaauguugcuauuuauugacauaaaaggaauaaagcacauggacacauacuguaccaaauucuuuagccaaguugccucauuuaaacuguuuacucuuuagcacaugaaaacauaaaaugugaaaaagguuaaggagguuaacuuuguacaaacccuggcuaaacuggaguagcacguaucagaccaaccuccuuccaaacaaacaagccagaaaacaaacaaacaaaagcccagcuuuuuaaaggcaucaaagaggaaccaaggcacucaggacuugagggggccaagauccuggagagaggggaaaugcaaugaagugagcugaauauucgucaccacucuuuccagggauuugccaauagcuaugcuaugagcagcaaaaggucuaggagccgagcagaaagagguaacuaagaggcuaaaaacuaagcagagcuucuaguagccucauagcgcugaggaaccccaaaauaacaacacagcaacaaauggaguugagggccugcugaggagaaacccugguaaauagucuaggcuuucaauggaagcuccuggaggaauaugccccagucuaagggcaaaaaugaaacggaucagucuuuacaaccaaucuagaaucaucuuaauccuagccuuggucuaggugauggguauugcucucuaacagcuugccagaagaaaaacaaauucucuguagaggaagacaacaucaaccuuagccacuacaauuuuaaauucacaguguaugcaaugaaccaaaaguuaucaagcauaccaagaaacaggaccaaaugaucaaaacaaaacagaauagaaacagaccuaacgggugacccagguaauggaguuaccagaaacagacuuuaaaguauuaaugauuacuauuuacuaugucaaggaaagagaagacaagguugaagauuuuaacagagaacuggaauccauaaagaagaaugaaauaaaaauucuagaacugaaaaauauaacuaaugagacuuuaaauaggaugaacuuaacaacagguuaaauacaguagaauaaaagauuagugagcaggaagacugguaaaaaaugcucauacuaaugcaaagagagggaaaaaaugaaaaauaaagaacuaaggagacauaauggcucuagugaaaggucuagcacugcauaaguagagucuuaaaggaaaagaagaaagacuguaacagagcaauauuuuuagauacuagccaaggauuuuuccaaaacugucaacagacaucuaaccauacauucacgaagcccuacaccuuccaaggauacauacagagaaauccacaaauuucaaugugucauauaacaguaaaauucuugaaaaccuaagaugaaacucuuuaaaaaggcacauuaccuucaaguaaguacaaucagguugacagcugacauuucagcauaaacaauggaaaccagaagacaaugaaaugacaucauuagugccaaacguaaauagcugguaacuuaaaauucuacauuuagaggaaaaacacauucaaaaaaugauugugaaauaaagaugcuuuccaacaaucaaaaucugagagaacugguuuacagcagauugucacuaaaagaaauacuaacaggaauucuucaggcagaaggaaaaagacucuagaaauaagcaaagaacugcaggaaaugaggaagagcuccugaaggggaaauaaggguaaguuuaaaugaauacugacuucacaaaacaacaauaggaaugucuugugauguuuaaaauauauguacaauuaaaaugcauggcaacagcaaaaagagauauaugaaguuagcauucuaagguccuuguguuauccaggccaugguaaaguauaauuuacuauuaguacaguaaguuaugaauucaugucauaauaaagcaacaacugagagaauaaguuaaaaauuauaacaagcuaauagauggguuaaaaauauggaauuaaaaaaauauauaugauuagcccaguaaucccagcacucugggaagccaagguagaaggauagcuugaggaguuccagaguagccugggcagcacaggaagacccuaucucuacaaaaaguaaaaaaguaguccagcaagguggcaugugccugcagucucagccacucagggggcagaggcaggaggacugcuugagccuaggaguuaugauagguguuaugauugugccacugcacuccaaccugagugacagagugagagcgucucuaaaaaucaaauaaaaauuuuaaaaaugauuaaugcaaaacauaugaaaaggagacaacagaugagacaaacagaaaauaguaagauuuagauauaaucccaaaguauaagcaauuacuuaaauauaaaugacuaaaauaugacaacuaagagaguuguggggaacauuauuuaaccauauuguacuuaaaagagacacacauuaaauauaagaacacaguauugaaagcaagagaguggaaaaauauauacuaugcauauuccacccaaaaagcuggcauagcuauccauucagauaaaacagacuucaaaaguaagagguaucaccagagauuuuuaaagacaaaaaagaaaaaaaggacauuuuauagugaugaguugagccaccauguaguuuuuaaauuccaaauuuuauguaaauaauaacagucucaaauucauaaagcaaaagacuaacaauuacaaugacaggcaaacccacaauccuagugggagauuaacauaauaaaugauaaaacaagcaaacaaaaaucaauagauacagaaaaaaauuguuuaaaaacuugauccaauucauauacauauuaucacagcacucaacaacuguacaauucauaacacuuucaaauacgcaaggaauacuuacugaaauugaccauauaaugaauaacaaagcaaaucucaaucuguaucaaaauacuaaaaucauauagaacauauucuuugauuuuaguauaacuaaaucaauaaaaacauuguuauugaaaagaaccaaacuuuaaaauaacccaaaggucaaagaagaaauuauagaggaaauagaaaauauuuuuaacugaaugauuguaaaaauaucacaucaaaaaugcaggauguggcucaaggcacagagggaaauuuauagucuuaaaugcauauauuagaaaaggaaaaaagcugaaaacuaacacucuaauacccgccaaagauuuuuuaaaaggaaaaauaaacccaaagaaaguagaagaaaaugaaagcagaaauuuaaagcauacuaaagaaaaccuauaaaaucaaaguugauucuuugaaaauacuaauaaaauuggauaaaucccuagcaaaacugauaaauaaaaaagagaaggcacaaauuaccaauaaauggaucagaauggggaaaucguuagccucagaaauuaaaaauuauaauuauuauaaauagcugucauggcaaacggugcaugucuauagcuacauugugauaaucuacacaucugucaucuucacuacaggaaacaauguaggacuccaacuuauuauuuucuuaccuuuggaacuuggcauaguaccuggcacauagcugauucucacuaaaugccugaugaauaauuuagcuccuugaagaacuuagaaagccaaauacggagcgucaacucuauuugggaggccacaggguguccgcuguuuuccuuuuuaaagaguucacccaaauuuacuaguuuuuuugaaguugguauuauuuucauuuaacauuaaaggaaagagaaaacaaaacuaugcuauuaucaaaagucacacuuggucagaguguaccuauugauaugauaauuuccuuuuacuaaaagguuaguuuugcaaaagaacaagaacuuuuuucuaggcuucugggaauaauuuauagagggaguguauuucuucauauucuauauguccaucucuucuucaaaaacagcuuuuuaacauuuuaagcaauaauuuuuaaacagaauggcuaaguuugcaucaaaauaacuuggggcuauuuuaaaauauauaacaaauacauuuaaacaaauacccccaaaaucacuuggggguauuuauuuaaggcaaguguugggcaacguauuauauaagaaccaccauuucagauuuuuguuuuaacuauucaaaucgacauucauucaacaaagcuguauuaagcaccugcuaaguaugccuagcacagugcuagacacaggagacacagaagcaaacaugucuaacauacuggaggagcucacaauccauugggaaagccaguguguaaacaacuaacucccauaaagcaaauugcuaaccugcaugcuaauucuaaaggacuuugcugagauguuuuauuaggugaccuuccagggacucagucagaagaaauaauacgauuauaccauugcccaugggcacaagaauaaccgaagaagaggcccaugugcugugcauuuaccuacuauuaacuuacucuaauaucaugugauaaaggcuauaaaacaaguaucaacaacacucuggucugaauauuuguauccccucccuaaauucacauguugaaauccuaaccccaaaggugacagaauuagaaggugaguccuuugggaggugauuaggucaugaggacggagcucccauaaauggaauuagugcccucauaaaagagaucccagagagaucucuccucccuuccaccauaugagguuacagagagaagaggccauccagguaccuugaucuuggauuucccaguuacuguaacuuugagaaauaaauuucuguuguuuauaagccacucagucuauaugguauuuuguuauagcggccuacaaacuaagacaauaauauauaaaaacggaaaaggaaagaacaauuccagagauuucagaacauuuuuuuccaagagaaaacaucagacuuaaaggauaaguagaauuuugcaaaacaauagagcaaacauuuuguguguucauuacuugacaaacacuguucacugcuguuuaucuauuaaccaguuuaaucuuagcaacaauaccuuaguauuuacugugaaguaaauacuaucauuuucuuuauuuuacauguaaggaaaauaaaauauagaauaguugaguaucuuguccaaaguuauguagacagcuauaaguggcagaaccuggaucugaacccauuuugccuggcucuagagccagaauuuuuaaaccacuuuuccaaauggcuuguuccaacagacacaugauagaaaugcuaggguuuaauccgcuggagaugaugauacaagcugauaugaaggaaggggcaagacugaagaaucuuaucauauggacaaguggaagguuuuaaaucugagaauuagcauuauuagaucuacauuuuagaaagacaacuaagguaauaucuucaauacagaaagauuucuucauacugggagcaaaaaaaaaaaaaaaaaucuaaaccaagggcauccaaacauuauagaagccaguuaggugguaaaugucuugaggccacucacgaaaauuaaagugaaagaucacagcacuuugcauauaaacaugcccagacaaaacaaaaugcaggcugaugacuaauuuuuaccugaguuaagcauuuuuuaauauacaagucaaacagguaaccuaccucauauaaggaacucaaaugaguccaugauacuauggccuuggcaagacaacuacuuuuuuucugccccuuuuuguacuuccugccuuaguuuaugucaaaagcuaaguggccuuaucaguuuaaagugcaaaauaaaaacaugagucagcaaacagagauuuccuucccucuuguccaaauauaaacauuucacacuaacaaaaaaguauucaucuaguaaaaaaaaaaaaacccagcagccuuaaaaauauugagaucuuuauuccagcaacuuuaucuucagaaauuuacucuaaggaaauauucugaaccagaaagggaaaauuguuuuugcacaaagauuuucaucagagcauuauuuauaauagggaaaaaaagagaaacaucuaauaauugaaaaauaccuaaguaaacugcauacauccacucaauggaauauuauacagaccuuaaaaauuauguucauaaagacuacguaauaauuuggggaaaacuguacgcagaacauaaaaugguugguuauauguaccaugaacaacuauguaaauauaugaaaauauuaaccaugacuggguuuggaagauuaguaaugugucucucuccuccuuuucuaaacuuuucaaacguucuuuaaugaaaaaauguaacuucugauuuuuuauaaaaagguuuucgaagcaaauauuugcuaauuacaaaaaaaaaaaacccacaaaaaucaauucauuaucucaagccacaucuauacucuacuuagaaaucagguuggauuuauagugugaucugguuugagaagcaaaaaaaauauaauguaguuuaaagcaguguucugaacucagaacguuuuccuaaggagucucacccaugggaaggauuucuaucagaacugccagaagugaaauuagaaaaauacucuuauacuacucgacacggcuaauuaauuuuccaacuuauguguuauuccuuaauauuaaaagaaaaaaauguuaaaauacucuuaacugcuauguaacuugcuuuauauuuaaaggaagccuaaucagccaauugcagaacaaaugggcauuuucuucaccuuggccucaucuaguaaagcaacaaguaaauuauccaacuccugugaauaucaacaaaauacacucucuuccauuuaauauguuacagaucccaaauucccacagaaaguuuuuuuuuaauuacccuaauuuguauaugaagauauaauuguuuuuuaaaggaaggaguaaccaccaaauguuacaacccccuuuaauaaaaagauuaggagacaaauaauguucaaccacucucuguaucagcuucagacuagaggcuguuuuauaauucuugcaccaguauggaauucagcagacaaaauaaaugcucccauuaaauauugagggaauaauuguauuauucaauaaaauaaacaaaaaauacaggcuacaaaaagugacugggggaaaaaaauccaaaaacucuccguacuuuaagaaaggcaaauaacagaagauaaauggucuauugucaaaugaagcaggcaacucuuuucucccccuacuucuuguucuuugguucauuacacuuucuuaacuaauaguaaaaaaucauggcacaaagaucaaaagaauuaaggaacuaaaaguacaggguauugauuaacuucacuuugaaaauguuuaacagcuggauacuuuuuuuuucuuuuuuuuaaagacaacuuuauaaaaauucuguuugaucggccaggcuugguggcucacaccuguaaucccagcacuuugggagaccgaggaggggggaucaccagucaagaguucaagaucagccuggccaacauggugaaacccuguaucuacuaaaaauacaaaaauaagccgggcauagugguguacaccuuuagacccagcuacuugggaggcugaggcaagagaaucacuugaacagggagguggagguugcaguaagccaagauugugccauugcacuccagccugggugacagauugagacuccgccucaaaaaaaaaaaaauuguuugaccuuuuuuuuccuuuuuggaaacaaauauuucuaaguaacaaaaccaccuaagugcguauuuccagacuuacaucgccagauauauucuuaaacagauagacuggucuugugaauacacagaaaaaguaagacuugagcuuccagaguagaccuauggugggcuucagagugauuauaagcaaacugcaugaauuuuguaguucagcauuuuuuuuuuuuuuuuugacagagucuugcucugucgcccaggcugcagugcaguggcgcgaucucggcucacugcagccuccaccuccuggguucacaccauucuccugccucagccuccggagcagcuaggacuacaggugcccaccaccacgcccagcuaauuuuuuauauuauuuuccaguauuuuuaauauaugaaacuauuucacaauacaccucauuagaugccauggagaugcaagauaucucagagacauguuguagaaagugaucaauauuaacuggcaauauuaauuaguauuacagaaauguaugugucaucuauccuaacauccaauuuuggauaggauucaaggccuggugagaucaacucuugccuuguuugagaugcuuaaauuaaaacaucaaaaaaggucaaaggggaacaugccaggggacuuguaauguaauucucauuacuauaaaacaaacuacuuuuuucuaaccugcuccauuucacuuagguacucaagucaacuguauaguccaaacaaagauggaauuguccaaauagaucaugauuucaaaggauaauaaagacaccugaaaaauuccugacacuuauagaaaccacagacucacagaagauuauacacuaaagacguaggguuaaaaaugcauaaaaacacaaagguuggaaaaaccauauuauuucagcaauuuaaggccaauaaauauuuuaaaacaauaaagagcaauccaucauugcuugcaucuuucaagccaucuuguaagcaaagaauugcaaugagauuuauugguaaaauaugaaaaauucacaaaauggaaaggggaucauaaucauuugcccuaaauaaaaucaggcugaauuaaucagaaguccagaagaacugggaacuuacaaacuuuugauaaagcugaaauaacuauuacuuaaauguggaacagcagacaacccacaugagacaauggcccagcaagagggcugaggcagaaacugccauccgcucacauuuccaaacagagaaauaguaccccuaaaaaacaguaccccuaaaaaugaagacagguggagacagaacucuagaacaaguagaacacaacgauaaguagcagacaguaggaauuguaaaugguuccuaacaaaaagcaugaaagauuauuguacagcuccuuaaggaaaaugauaaauaucuacccuuaagguuaaggcagacaggcaaaagacaaguuaaaauuugcuauacaaguccaaugccauuacaaugaauauaaaaacagaaauggaucuaguuauuucaguuccagaaaauacccuaaaguagcaauguucuuugaucugguucaacaaauaauguucaaaugcuucuuuaacccaguuacuccaguuaggagcuaaccagguuuucagauacaguaaaguccuuacggguucuuggaaacuguggcucuaagugaaacgauguaaaacaaaauuaauuuuagcaucagcuaauuuauauaaacaagaguuaaguuccuucaggacauuucuggucacaaaaacauuaccaaacuucugagacccaaaacacuucuaaaauuaacacugaaauaaaugugagccauauauacauuuaagaaagaugaacagaaacaagauaauuauuuacccaauuauuccaauucagggucgcaguggcccgagccgaucccagcagcuuagggcacaaggugggaaccaccccuggacaggacaccauuucauggcagggcgcacucacacacacaccuacaugcacugcaauggggacaauguagacauacuaauucaccuaacgugcacaccuuugggauaugggaggaaacuagaguagccagagaaaacccaagcagacauggggagaaugugcaaacuccacacagacaguggccuaggcugggaauguuuuuucucaucaacguuauaaggaaauggcauugaaugaaaugagguugucugaggaccugcuguauuuguauuggaggaggaaacaggugaagugccugcauuccuuuuuccuguuuuaaaacagcaguuagcccucaacuuucaacauuugucucaaucucaaaugagucaaauuuagcuaaauaaaacucaccacuaagcaaaauaagggaggaaaaaaccucuagaacagaaagaaaaaugaaaauggauaaaaccuugcucuuuacugaugcuaacguacuucauaaaguacagcgcuuaacuucauugcuaaaaaggcuauaaugaacucuauuucgcuuuaguccuuaggggaaaaauguauuuaaaccaaauuccuacacaagaaagccauacggagacccacagagaacacagaacucugcugcucucaguucacagcagcaggagaguccuaccaucacaaacaccacaaguaaaguuccaucuuacugagccucuuacuauucagccuugaucuggcuacuuccaaacaugggacugaugaugcagaauagcuaguuugacauuuuucccacugaaaauuuauuuuugccggagacugauuuucuaaaucuggagaaauuggggguuggagauaggagagagguucaguucgugaaauucuauuuauagugaugcaauaaugcagguacuauugccuuuaaagcgcagacacugugcguuuaaagcgcagacacugacagcaagucuuccagucucuccaguauaacuuaagugacaugccagcaagagaugcaauuuggucccucaacaguguuaagugaguagaaaucuuaggaaucaaaaagaaaaggaauaccauguagacugaauuccagcuuacuacuuaccacuuguaaguucacugaagcugugaaauuucagccaaacaauuucaaaaguagcaucuccuugaugaaaaggaagcaaggaacuuauggaugucagaaugacaagagucucuaaggauauaacuguaguuuauuuauuuuaggugugccaagugugcuauuaacguaucuucauuauaucagaaaauucuuuaaaaagaguucuuucugguucuguucugcauacacaaauccuuccauccugacaaaucuaggcugcuaauagaguaccugguuaauuuuucuuaaucacagagauucccuauaaaauagcagcugucacaucuguuuugucugauuagaugauuacuugaauaguuaaggcaauugaaaguuuucuuauuguccccaacuucaacaaacaaaguuggcuuuucuauaucuucuugccauuuccucuaaaaguuguacaacauuccuuaaucccauugaacccccauucccaaauucaugcuuguaauggcauacuguccuucaggacacgguagccuuucaagauguccagcuccccauaagcucauccugauaaaggccauucacauucaugucaacucaaacacuguaaagacuccuggccuacaaaugcucacuccucaaacacaggaaagauugaagaccacagacauuuuaagauuuaauuuuauugacuaucccaggagaaagucuaugguaguugucucagaaaaaacuauucucuuugagucaguuauccuaaaauagcaauuuuagacuacaaagaaugcuaaaugugguagauuuccguaaguggcuaguuaugaaugauucgucaguagcuaauaaacgaaauuguuugaguuaccaacuuauacaagcauuauacugguuguuuuuacaaacauuauuacauugacuccucacaccaaugcuucaagguagaaaucauuaucucaauuuuaguaauaaacuugaggcucagagguuaaaguaacuuucuccagaccauauucugguaaguaguauaucuauauuuuaaaccaguacugacuaauacugaagucccucagucaaguuuaaaaaaaaaaaagguaauccaaauaucaaauucacagaugaaaauggaaucaacuacaggaggaaaaaacuaucccuuuaaaaaaaaaaaaagaaacaaaaauccugcuguauuucauguuuuggaacauauuucucucgcuccacugaucucacaggugcuguuuaugacaacaaacaugcacaucuguaggggugaacugacagacacaaagcaggacggccugaacucucuuccuauauuuagauccuucagcucagcucuuaauugcauaauuuaaucaggacccucuagaagggaaacacauccauauucaucacaggcaucaaaggaaacaucuuuacaaguuauauccuuuuacaaaccaacauauggucucacgccacuuucccaauuguugaacuccuccucugggaagagcauggaauuuuauuucuuuuuaucacuugaaaaaaucacuucccuccuaauucaguaaaacuggguggaggccacuuccuccacaggugagagaaauaaaacuuguugaucugucauugucaggaauuuuaaaguuaaccauuuauuuuacauauuuugaaaauggaaacaaaaggcagacaaaacccagaaugagaaauuggggcacauucuccaugcuuucaaauaaaaccucuaccuacuuuuuugucauuuuaagaugguuucuaaauuagaaaacaaguguccuuaacuugaauagguuugaacugcagcuguccacuuaguagcuguacuuugaagaaaacaacucugagccucaauuugcuuuuccacaaaauugugauaccaucacccaauccacuggguuaggcagauuaaauauaaacaugaaaggcuuacuucaaaauuauaacaugcugaaaaacaaagugauuaacaaagcagguucacaaauaaggcuaauuuuaauauuuugcauauccaaaaaaaugagguuuacagucuaguuuuugucuguuuaaugaaguucuaacuucauacaaaaagagaaaaacuaguaaccacuacaguuauucaauucacucaacaaacagcuaucacaugccaggcacuauucuaagcacuagaaacgcagcacugaaagagacacaaaaaguuuuucaaagucuguuucugugccuugguggggccuacauucugguggucagggaaagccucgucgugaaugugguaucugaacagcccccugaaaggaauuaucuggggaagggcauuccaagcagagagaagggcaauugcaaaagccauuugagccauuuggcaagaaugauccugagauguucaaggaauggcaaggaguccucacugaggcuggaauggagugaggggagagaaaugagagaugaggccagagaggucacaggggaagguaugugcgggacccacagagacuucagagcuuuugacccaaauugagauggaaacacugggagaucugagcagaggagagccaucauccaacuuagaguuuaauagaauuacuguggcuugcuggguugagaacauacugaaggacgcagggaucgaaguagggagugguggguagggagaccaguuaggaagcuauggcaauuguuaagguacaagaugauaaagauuucaaccagcguggcagaagucgucagauucuggauauauucucaaaguacagacaugaacaaauaauacuuuacugcuuauauaaagaaaauaauuaacuguaagguuggagaauuguuuaauuuuuagaaguaugaaaacccguauuaugggaacuguaagacugagcgagauuuuuuucuucuuuuuuuauggaaucuuucuacccagagauugaauaucugagguaggaccaaagacaaggccacuggaggagaaguaguccaagaauuauggacuaaauguccauaauuccuguacaggaauacagguugaguaucccuuaucugaaaugcuugggaccagaugguguuucagauuccagguauuuuuggauguuggaauauucugaauauauaaaaugagauaucuuggggaugggacccaagucuaaacauaaaauuaauguauguuucaucuacaccuuaugcacauaggcugaaauuuuucuuuuuuucuugagacauggucuugcucuguugcccacgcuggagugcaguggcauggcucacugcagccuagaccucccagguucaagugauccuccuaccucagccuccugaauagcugggacuacgggcaagugccaucucgccuggcuaauuuuuggauuuuuauuagugacaggguuuugccacauugcccaagcuggucucaaacuucugggcuaagugauccaccgcuucagccucccaaaggguugggauuacuggcaugaaccaccaugccuggccaaucuuauaaaauaauuuuaauaauuuugugcacaaaaaaguuuugacugugaccugucagauaaaguuaggugcagaauuuuccacuuguggugccauaucaguccucaaaaaguuuuggaucuuggagcauuuugaauuuucagauuagggucgcucaaccuauaguauaaagggaauaacaaccaggaguuaaaucuuguaggaauuagagugaacgauaugggcaauggggcagaaaaugacuaacaaggaagaguaaugagugguauaauuuuacaugauagucgaaguuggguguuuuuuauagaggaugguagaagaauggucugaagguggcaauaagagguaaaagguuuaugggaaaaaccagccacggcuugagagagccacaggggaaacagcucccucagaugaacacacacaaagaucuauguucaaguauauucguguucuaaauaacccaggugccuaacaauaauggaaugauuaaauaaauuaugauacauucgacuaugauguaacuguuaauaaaauaagaaaaaacagauggacuuucauguacaauacuaccaugaaaagaaaaccauaccacaacuguucaguaagaagugguaaaaaguaucuauaguauggucucuuucuaaaaacacaaauagaaacaaaaacugucuauguauauacaugugcauuuuuaaaggccuagaaaaaaauaaaugaaacugaacaaguaguuaccuuuaggagugagcuggguacaagggagugcaggagagccaacuacuuuuaguuuuaaccaauugcuguuuucaaauuuaaaaccacaauaacaaaaauaaauaaaaacugacaguagguaagagaguuauuucuacauggcucuagaagacagcauuaugaccaacagguggcaagauauaucuuuguauaaaggaaaaaaaauaauugaaaguguaucugcauaggauuuucagagaaauguauucugguaaaauacaugacccuauucuggguuaauaugauauggauaggaauggaauguacucuuuuauuaaggauucaggcacauaaucaaaaaauuccauuucaaaaaauggcauauuauagcaaaaaaguaaguuucccucccauuuuagacccuuacuccccuuuuuauuaacuguucaaauauccaucaaauuuuucaaugcaugaauuucuuauuaaaauaaaaauguucuauguuauucaaauaucuucacaagcaauuugguccuguccuuuuuccauuacagaaaucuguuauuugaaagaauaacuucuaaaaaucaaaguuuaucuaaccacugaaacaaacauugacaucggccagauuccacucucauaugacaaucaaugacagacuuuuucaaucugccaaaaacuggacuggaauugcaaacauucauuuggccaccuuggaggagaaacugaacaaauagcagcaacccccucuuccagaaugugagagcucccuccaccuaagagcuaaaagaagcaaaugcaaaguuuuucacugguuuuagagaaauaaugcuuuagauauaagcaagcaucaccuauagaauuaggugagcccugugcccaugaaucuaguccuuucuaccucugaucacuuguucaguacagucuuaucugcuaacuucccuaaaguaauuuauuuaccaauuacaauggaaaaacccaagacaauauucucagaagacuucagaacccaaguucuccuccuuuacacgcucagcuacuaagaaggcuuucguuuccauuaauccaguauuuaacugaacaaauuuuuaagcccuuaucaccaacauaaaggugcaguagaaagaaaaugaguauaacacaguucccauuaccaucaagcuuaugguuaugaaguguguaugggagagaugggagaaccauaucauaugguacacuaugauaagagucacaggaccgccuguucaggcucuucaucuaaggagaaacauacgugcagacagagcgaccuacagucugugcuacaacgacaucuuccacgcauccugagcucgguguuacuuacccuacaguggaaauccaaauaguccaaauaucaaccagcuguuucaguggguaugaaaaaugggacagauaauccaaagcagccuuacuaguaauuaacuauugcuucuacaauguauuaugauucaucaaagcuuuuaaucauuuauauuuugcuuacacuauuaauaaaacuacaauaugcccugagaacauaguaaauucuagagaaaugccuauuuaagauucaaaaauugcuguggaaaaucuguaaauggaugacgguuaacuauaguguuuuaguauauuauaaaaacauaaagacaaacauuuuaugucauauaaaucacucuuucucuuggaauucagaguauaggcaaaaaaacagacuuuuacagaacaccugaaacauacuaguuugaaaacucaagaaacuuuuaucacuaucaccaccaacuucaaagggagaaagugguaggugguuuuaugggaaacacuguauaaaagugcauccauggucuccaucaaauuucaacagaaguauagucaucccuugguauaccuggggcacugguucccagaccccaccacccaauaccaaaauccuugcauacaggucucagugggcccuguggaacucgugcauaaacaaaaagcugccccucugcauauucagguuucaccuucugcaaauacuguauuuucuauccacuuuugguugagaaaaaaaucugaguauaaguggacuccugcgguucgaaccucuauuggucaagggucaacuauauucaaaaacaaucaaaagucauccuuauaucauccucaucaccacaaccacaaccauuaugaaucaccacgcacuguuuugagcacuuuaaauuuaauuaaauaggucucuuaauccuuacacgaguccuauagaacaagaacuauuuuauagaugacaaaacugaggcacaaaaaaaguuaaggaaccugccaagguaaccucucuacugcuucuccacaguagucccccccuugguuugaugcauaaggcagaguaacaggcaaggauuugcuuauaguuuuaaaaaauucccuccaucuccuuccaucccuuucuaauuuauucuuguuuuugcuauugcuuuccuucuugauaccuucccacuuacccagaacaugaaaaaaaaaacaagaguuuuaucaaggcagcagugacaaaauuaaauucacuuuaaucuaaagagcuuagaauaagacauuauaagcuaucauucaacaagacaucagaaaauuggcaccauuagcucuuguauguguucaaaucuuaauaauccuuuucucaugaugaaucuguagaacacuaaaauuaaacuccuuuuaagaaauucauuuucuugacccaggugcaauggcucacaccuguaaucccagcacuuuggaaggccaagguggaaagauugcuugaggcugugaguuugagaucagccugggcaacauagccuuuauuuaaaaaaaaaaaaaaaaaaagccaagcacuguggugcaugccuguagucccagcugcuugggaggcugaggcaggaggaucacuuaggcccaagaguucgaaguuacaaucagcugugaucaccagccuucagccuaggcaacauagcaagacccugucuaguuaaaaaaaaaaaaaaaaaaaggaaauuaauuuucuuuacauucccacugauuauuuuaagauccuuuauugaaaacauaaagaaaacaaaaauugcuagcucuuuuuaucuugagguuaauaguuuuccaaucaaguagauguagagauaaagaaaauuuaaaggaaucuuucagguauauuuuaacauagauaagaugcuaagauauuaauuucaacaccuaauacacaguuguaagucacaaugcuacuuauagauaauggcaaaaauaguacucuggacucugaaggauuugugguaagggguaaggaaagugggaagauaaagcacacaaacugugugcugguguggcagaaacggucaugacacuaccacuucaguuaccccaucugucuccugauccccuuuuuuauccucuauuucaggguuccucaacuuuagcauuacaggauguuuggcugcaucccuggccucuacccacuagaagcuauuugcaacccuccagcgucucccuccaauucgugacaaccaaaaauuuuucugacauagccagauaagccacagcucuauucugccacuuuuccucuccuuuucucuuugcaaucuaagcaccucaggccucaacagcuuucuauaacucauuugcagacuccgggauucacagaacugcugauucuuccacaaagggaaaagggagagaugucaaacacacauauccuuucugucucugcucuccucaaugaaaaaaaggggaagcaaagcagucaauccucagaacuuaacuggugugucugagcacccacaacugacaucacacagugcugggugcuacagaguauaaaagacaugguucauaacuacaaugaacucacaacauaccauauuuccugauguaauucuaaaaacaacaaaaugaaaaaauucauucaccaaguaccuacugugugccagcccaaccguucuuaauguugcuggauauuaacaguauuuuuaaaagcuuccuuaccauaacccuucaauaggaugggcccaggcaucuuuguggugguagcuguucacacgauuuugaugaguagacaagggagaaccacugcacuaggcacugugcgagcacaaagaucauaaagacacuggccauacccucgaggaacucagucuaaagaguuaauaagguaauuguaauaaaaggcauuacaacagaugcuagacuagacaagcagguuuguauuguuccuuaaaguuagaagauccucagugcagguccuguacuuacaauuccuuacccccaacuuuaucaagcugucuaagagauacacuaugaacauaagcauaaauagaaauacagacacucaaaaccuugcugaaagaaugaacuggggccgggcgcgguggcucacgccuguaaucccagcacuuugggagggagaggcaggugggucccaaggucaggaguucgagaccagccuggccaacauggugaaaccccaucucuacuaaaaauacaaaaacuagcugggcaugguggcgggcaccugcaaucccagcuacucaggaugcugaggcaggagaaucacuagagccugggaggcggagguugcagugagccaagaucacgccacugcacuccagccugggcgacagggugagacucugucucaaaaaaaauuaauaaauacagaauaaaguaagguagaagugggccagaggcaaaaagcucuaucaaaugcaucagacuuuuuuccccaaucccuugauuuugaagugaaaguuucaaaugcauaaucuccucuuaccaauuagauugcuucuucagggcagaaaaugacuuacaguuuucucuaucccauccaaaacauaguccagugcuggaugcacagcaggaaugcaugaaauacuugcugaauugauuaauaucagcuuaacaaaaaaggagaacuccacagugaggacacaccccuuuuaaaggagccuuuucuagaauacagaacaucucagcccacacaaauugacaaaacucuucagcaaauauaugcuauaaaugaaugcgaauaaaugcuauaaauacaguuuuugugccaacauuuaaaugauaaucaaauuaauuuuguucacaguuaacagaaaaacauuuaaaacuaaucaaauauucccucaagcuugaauaaacuaaauagaagcccugagcacacaaacauaaacacaugaaaaauaaagagguuguuauuaaauauguuggacugcaaagccagcaaugugcaaaaagcaaaacaggaagcuguaauagaugagauggcaagcuauacgcaaccagcuguauaauuucuacagcaauauccacuguaucauuacucucuuucaugaaaaacuacugucucugauaaaauuaagaccgauuuuccuggcauuucucuucccucuaccacuuagcucaaagaguuugagugacaagucucaccaaugcauaucacuucagggcccguacucccagucacaacccacucagaaaggacuuaaggauggguaggggaugcuagugggccaaguugugagccugaaggugagauuuaaaagccuuuuuuauccaacuuuaaaauguuugcaggucauuuaaaagaaaggagaugguaagacagaagacgcagacaaauucugauucugucuaguggcaagguaagaacucacuuaaggcugaauguaauucaguuagguaaggauccuaccaauaaccagcagacucauccccuuaugggcagcauaugaauagacuuuuaaaccugcgguacuguaaaauauauauuugggcuucaaccuuguuucuggcauacagcuccuaaaauccuuggagacuccaaagugaugucuuuuuguaugcuaaugauugacuguuggcuggcagccccuaacuagcuuuaggaugguggcaagauuagaggauugagacuuucagccccacccuccaaccucaagggagggggcaaggggcugaagguuaaguugaucaccaguggccaaugguauaaucaaucaugccuauaaaaugaagcccuauaaaaaaccaagaggacaagguucagagagcuucuggacagcugaacaugcagagguuccugaagcguggcacgcccaaguuaggcauggaagcuccaugccccuuccuccacaccuugcccuauguaucucuucaucuguauccuuuuuaauauccuuuauaauaaaucaguaaauguaaguuuccccgaacucuguaagccauucuagcaaauuaauugaauccaaagagcggagucauaggagccccaacuugaagcuggucagccagaaguuccagaagccuggacuuauguuggaggugggugggacugaaccuucaaucugugggaucugaggcuaucuccagguagagucaaaauugaauuggaagacacccagcccagccaguguuugguguguagcgaaaaacccacacacauuuagucacaaaaguauuuuguguugacuguuguagugugagagcagagggaaaaacaguuugaguuuucuacugacagaaaacccaugaccccuauuauccuuuaaaaaaauuuguaaaauuaaacacugaugccuaacuuuuacauuuuuuuuaaacauuauaagguuuuacuacaaggggaacuuuucucacuuuauuuaauaccucauaaacucguccaucucaauaaucaaaacuauacuccaagaccaucacugcgucucacaucaaugagcaaaugccacuauaaaaucuaauacugcaauucagguaggagagaaaggggccuauuucaauaugcucuaggaagcacuggugucuucaagguucaucaucuacgccaggugacugagaaacuguguauaacugauagccccucacacugcaauaaggaaacuccuggacgaaaaccauguuauggagggaagcagggugccugccucuuauaacucuacuuuguauauaucuuguaccuccuugacacuccagauucuccuaggaggcugggaaauucgggcuuccuuuccuuaaaugagaaaagcccagucuucccagacugauacuuccuaguauacaaagaauaacaaaauacaggaaaaaggaagacaucauccccauuucaaucaagucugauccaggacauaaccaaaacauuguguguucauuaguaguuuguacuucuuuuuuccuuuuucuugagacagucucacucuguugcccagacuggagugcagugacacaaucauagcucacugcagccuugaacugcuggguuuaagugauccuuuugccucagccuccagaguagcugggauuacaggcgcagaaucuucccgucagcaguuggcauuucauuuguuugugaaaugcuuguucacguccacuaccaauuuuucuauugggguggugcuuccuauugauauaagucuuucuuguaaagaacaauaucuuguugcaaaucucuuuaucugucuuucagguuuuguuuuugaguauguuuggucacauaauaaaugcuaucaaaucuauaaaaaguuuccuuuauuguuucugccuuuggagccacauuuugaagggcucuguggcuggcuauuaauaacccuccccccaguggcauaaaucaaacuccccuuuccuucuaacacuaugacaagaauccacugcagaaucuuucugcauuaagcacauauugguuuaaugaaaaagaaauguuuuuaaccguaaugaaugcuguaauaaaagccacagaaaaauucagaauacaauacuuauuuuuuuaaguucuaauuaacuuaaccuuuaaaaucauuacagggauucuucuguuaguucaauuucuauacuuuucuuagaaaccuuuaucuagaauuguuagggaaaugcucuaucuacaaauucccaaacuugauauuucacuacuucauuaccaagauucucauugcuuacugcuucucaauucauuuaguucaucaggcuucuuauaaaacaaguaaguguuggggcuuggucuuacacccaggcaaucugacucuagagucuuaucucugaacccauuugcuaucccuaagccuaccaggccacaaagugauaccaaaaaguaacaauuaaccuagucuccuauacagcagccucaccacacuucaccccagguuuccccccaauuguuuagaauuugacuucucuauagauugccuggcacacuaccuacggugguucuucuucccuuaccaugugcugaucuuccuccucaccaucccagugaaaggacuuaccuccaacaauacaggaaaaucagcaaaagugcacaggagcucugccacaugcuuucuucucacucggaccccauucuguuucuuucucagacaacucucccuccuuaccacggucaacauuugucacuugugcuccagauggcuaacuccaucaccuccaauugcucucuguccacugacuucuuccccucaaccuucaaauaugaagaggucucaucuaucuuaaaauucaagucacuuaaggcaauauaagacucucucacuucuuaauguauucagccuucucugaaauugcauucacaugauuaucugacuucuucuccuucacccugaacuguacauuuuccccuccaaaccuacuucuagaaucucucuuccaguggcuuccugguuuucccacuccucugaccccaugccuuucuuccaguuucuucuuuggucuaugucaaacagccucucaggcagucuacuucaaauuagccucuuccuucuauuaauuccuaaccgugggcuccaauggaagauucaauccaccaguucuuucucucuuugugguugucucagaauacccagcagaugacugcagagagucuaacguaaagcuuucaaguccucccaaaccuuaucuccaaccugccuguagcauacuuugacuuagauaucgcaccuuaaauuuaacacaucaagucuaauuuaucauuugcacaauuuuuauuucuucuacaaccagcucuucccuauucuuaaguaacaucuuuauuaguuuuccagccaccaaguuuagaaacuuaaggauauaucuccgacaucucuuucucauuacuuuauagccacauaaucaccaagccuucaugguuuuuuguuuuauuuuauuuauuuauuuauuuuuaaauccuucucuuuccaugucuaccuuuaccagagauuuaucaucucacacauaacucaauagcuuucuuacugaucuccuggcacugggcucuaucccuccagugcaaacugcauguucaaacacuuucagugacuucccaauguuuccuuauucuggcacucuaaggcccuaaaauucucacuggaagucaaccuuucugagcaucuccuccacaccaccauacuaggcuccaugaggaacacccacugaggucaggcagggcugcucacugccucuggaucugugcuauuugauaugauaaccacauguggcuacugaaacauaaauuaauuuuuuaaaaaaugcuguuccauguguggcuacagcuacuguauuagcacagauguggaacauuuccaucacugcagaaauucuauuggacagugcugcucuacagauacucaacacucaugcuuaucucccaguuuuucaugccauuacucugucuauaaugucccucuuccuucugccuaugcaaacucacauguccuuccaggccacagugguccugaugugaguugucuguacaauuuacuccuauacuaccuuguaacggcucuuauaauguugcugcauuuaauuuuucauguuuguguauacucuaauuauuaagccucagaacuaauaaauauucagggaauaaaugaagcauauacuuauuacaauacugcagcaaaaugaucaaauaagggcccauuuaauaucccuccuucauuaaaaagauacguuucuuuuccaucuaaacaaacaaaagaucuugcauuuaguuaacugaauaauggcuuaauuaaugccuaauuauaaccguugagagagucucccccccaccuuuuuucuugaaguguuugaaacuaaaagaaaaaaaagcuauaaaggucuggaauacuucuacuuugcauaagcacaccacaaagaaaccacacacacacacacacacacacacacaaaaagacagggagaggauaauacaugaauaguuggaguaacuauacccuaacaaucucagauuguagagcaaaauauccacaguacagcagcccuacaauuaaggggaaacuacaaauaaagcauuaaaacuuauguauaaaaauauauucugaaucaacagagagaccccucucuccuccucuucccaaacaggaccuagugaauauucauuuacauccugaacucaaaagcauauacaugcauaauuaacaauuguauguucuuucuucagauccaggcuuauugucucaaaaaaaauauuuguuaagaaaccaaucuauacugcaaaccuagguucuuauuaaaaaaaaaaaaguuccuuuuucaaacacuaagaacauaaaagagauuugggaaaaucaccagguaaggacuuccucacaccuuagagaauuuaaugcuuuauuuucaagagagagucuucucuaaaguucagauuuuagcuuauaacaaaaauuauaaagaugcugaacuguucaaauacuguaguucccaguaccuuacuaaaacucugauguagucacuggagugaaacugcuuaugaaacuuuuggcuuuucuuuucugaaagauaguuuccuuuaugcaaaugaauguucuagagaagccgcucauuucugcaagucagcccgcaauagcuacagacauuacuguuuugcauauaggacuagcccugcaccucuaaaacugacaccaucuuaauaacgcagagcaagaugaguauuuuaauuuagauuuuaagcaauuacauuaauacuauuuggcucugccuuuuucuucucuuuccuuuucuuuuuaaagguggcuacagcagagugaugaaaauacuucagguauuuuugcugcaaaucagaugccagaucaacagauuagacugaauauuuguacuaccagauaacagcaggaaaggaaaauaaagggucaagagguuucagauuggggcaaagaggacaugccccuauuuguuaucaaaguauguccuaaaaucuugguaccaaagaguaaaaccacauauagaaguagcagaacauuucaucaaccucaaagacaugcuaugacuuaaaaccgauuuuuuccacuuuuuuauauuuaaauuauccuuuuucuccucagaccuguccaauucucucccuaggacucccuagcucccuaaauaccccaaacuuuagcuuuugguuaggaaugugauuuguuuucgagagucaagaggagauucguauauuuugcuagaugucagaguugccugcuuuaauuugaacuuugugcaaucuuggaucucccauuuucuaauaaggucucauugauuaaauuagauauagggcuuuucuuuuccaucuccagaaugaaaaagaaucaauuuuaauauguagaaaauaagcauuucucucugguugucagauuugauuccuacuuagcucaaacaauguuagguauaaaaaguugcuaacaggccaaaaaauucuuuccucccuucccuaaauuacacuggauaugcuuacaccaaagccucagaaauaucgugagcgugguagggagaaaaaaaaccugaaaacaaaagggcacuuaaugccaagaggaguccagaucuuggcuuucccuuuuccaaucacuagacagguaacuuuggaugucaguuaccuucucuggacuucagacuguucaccuugauaugaaccaaccagauuagaaaaucuuuaaagcaacuuuuaauacuaaguaucucuauucucuguaaaggaaauuacaaaucuuaauguuuaugaaagcacuuggcagucccauggacauauuucacccgaaagaccaugagauuuggauaguuaaguguacacauuaacucaccaugacauauaagcauuuugggauaggaaggugggaauaagaagauacaagauccauaguuucaucgauucuuaaacagcccugaccuuguaaaacauuuacaaaaauagauguugaauguuuuuuuaaaaauccccaaugaauuugcaauuacuauucuuacaguguuuaacagcucagggaagauagacuaauuuugguaagacagacaaacugaauuacuacaacuuuccuccuaacuuaauaucaguuugugauuauguaagaaaaugcaagaggaaagugacaagaauuaugcagaaaagcagagauaaaacuaauuuggcuuugaaaugcauuauuuucaugccagauuuauucuucaaauuaugugcugcuuagaugagcauuauuuuuccuuucuuaaacacuuacaaaagaacgacagaagauagcccagaaaggcacaauagaagguaaauuuauuuaaagaccuacaaaauacacaagccaagucaugucuauacuggcauaguaaagcacagcagaacaaugaugauuugggucuucugaacgaaagaccaaaaaacauaguuaagauggaguuucuagaguuggacugccucgaucauaucccagguaagauuagaaaucauaaucauucacuguaccuccugaagcaagauacugaaucauucuguccucaguuucuuuaccuguaaaaugugacaacaauaguacuuauggaaguuuugaggcuuaaaugagauauggguauuauaaacaaugccuggcauacauacaguaaaaauucagaaaaaaggguuagcuacaauuauuucuucucucuaaggcucuaaaccaaauuagaaucgaugacacuaauaauaaauaagaucuacagaaaagucaaacuccuuuuauccagcagcuucaacugucccuuccaaauuguguuuuauuuuaaaaagaacagcuaguuagugauaaaauuaguuuauauaugucuuuccaucuuugacuccacaaaucauuaguagaguuaacaagugagaagagguaaagguccuggggcagcaauggcuagcagaaccuccugugaugauggaacuauucuauauacacgcuguccaguauggcagccacuaaccacaagcagcuacuaagcacuugaaaugcggcuacugcugagaaaacgaauuuuuauuuaauuuuaauuuaaacuuaaauagcuauaaguagccgagugcaguggcucacaccuguaaccccaacacuuugggaggccgaggcgggagaacagcuugagcccaggaguucaagaccagccugggcaacaugacgaaacccugucucuacaagaaauacaaaaacaaauuagucaggcagacaugguggcagugccuguagucccagcaacuugggaggcugaagugggaggacugccugggccugggaggucgaggcugcagugagccaugaucgugccacugcacuccagccuggguaacacagagagacccugucucaaaaaaauagaauaauaaaauuucaaaaaaagcuacgugugacuauggcuaggauagcagagcccuagauaauccauaagcuaaauaaggauugucagaaacuuaagcaaaauaaggaucuucuuuuccugaacuguuuauauguucaauucaaauaucuuuguuucugguauaggccugguaaguuugacuaguuaaagaaauaacaugucaguagauaucaauacagugaaaauucagggguaauaaaaggaucaaaguuaaguaugugguccacugauauuuuauaaggucccuaaggccaaguuaaauucaaacucacaugaagcauucaguacacauaucagagcugcaaagguccuuaucagcaucccuaaagcaucuguuucuccucuaccaaaugaaaagcuacuuauacaauucagauugaauaucucugcauuuaucuuaaauuuuucuacagaaauucauaguucuguaagccuuuucccucuuucacacacacugguaucccuggccaucucagccuuuccacuauaaacaaaacccauguaccacccauaucugaaguauaacgccagacuccugcuuagcuaccccuguaauaugguuuaauuaugaugacugaacuaauaggcugacaucauagacuuuuacaggcugaccccaugucauccugauguaucauuuugcaccaguucagugcuguaaaucaauuuaagaucucaagcagguugaaaaggcugguaaugaugcuuucucugccgucucuggagacucuacauuauacccaacuuacauuauuuauaaagccucagugaugccuccauuagccuuguaagacuacacaaaugagaucuuuuauacacacacacuuggccuugauuauguaggcuacugcagcuuaaacaugcuagucuaauuacuauacccaagcuacuucuuuuuccaaucuacuagguuauuagauuuaauauuuaacccagaauugcuagaaaucaaaauuacaaagugaaauuuaguuuuuaacuaauaaauguaauaaacguaguugagaaaaugugacaacuuccucuuaaugccuuaaugaacuuaguaaaaauaacauaaaauuccaagaaguguaagaggccaaugucuuuaauugccuaaaaauugucauuucucuaaaacacaaaggucaucagcucuucaaggauacgaaaccaaaggauacugcaagagguaaaauguauuugguuacauaccuaugguuguaggggucaaaacuaaaucaaggacaaaucccuacccucagaagaaacucgauccugccuggauccucuagaggcucuggcaucacccaccuccagaaaaaucaucucucacgacccuagcuacaccuuccuaagaacugcaguauuacaccaaugauacaccaccugcacagaaauagcaaauaauugcaaaugggaaagagagugggagagggcagaacaaacacuuuaaucaguacagcauauuuagaucuggcaccuacaucagaauaacacugaugcaacaauauuuauaccaauugaaaaugcuggggcagugaacacuucuguuccgauucuuuuuuaacacgguccaccuaccuucaauacaauuuaaaguaauuacaaacaauuugaaaaaucaacaugggcagggaacaguuuucucauuguguuacugaggugugggcaaguuauccacaacaggcaauuagacccagagauguucugaaauagaggcauucugagauuuagcggcugagaguuucagcaacaggaagaaauaacagaaaucaugcaacuucuguaucauuccacguacuuugaaacuucagauacaauggaaagaaaagaggggggagggcagagaaaaaggacaguugucucagcacucacgaaaaggaugcuuucucaggagaugguucugagaccggccucaauuuucagaaggaacgcgccuuuacugguuaucuugcaccguguauuuaaaaauugcaugcucuucaaaauaaacaaaagcucagcuacuguagcugugagaucuggcaggcauuuguuccuccuccccuccuaaagcacaucaagaaaacguucucccuuuaaagccuucauacaguuucagcaacuagaaaaacaagcccacaucugucucucacgcccaccacccccaccuuccuacagaaacaaccccgagaaacacuaacaaagacagggagcagaguaaaggaacaguuguucaaccgcgaacucacgaauacacaugcagug

SEQ ID NO: 191909 - RNA, 6000 nt, Homo sapiens
cugacugaggggucagugguuccggguaggagcuaggugacccucggcugcugcagggaucugcagcgacugcagccaugggggcccaccugguccggcgcuaccugggcgaugccucgguggagcccgacccccugcagaugccaaccuucccgccagacuacggcuuccccgaacgcaaggagcgcggugaggcccagugcgcaggcgcagccagagggcguggggcgcgggugccugaacaccuggcaccccagggcuggcaccccagggcugggcucuaaccucagguguuguaucuggguuugggucuagacuaggaguccacaggacgugcaugaccccaccucaguguggaggcguuccagcccaagggcacggcuugagcaaaagccagggagcaaaagugaggcgacaaguggggguucgggcaggaaugcgacgcgcagagcugggucgagucuuuuuuuuuuuucuuuugagacggagucucgcuuuuucuuucaggcuggagugcaguggcuuggucucgauucacuggcagccuccaccucccggguucaagcgauucuccugccucagccucgcgaguagcugugauuacagauguguaccaccaugcccagcuacuuuuuuguauuguuaguagagacgggguuucuccuuguuggccaggcugcucuugaacuccugaccucaagugauccgcccgccucggccuccccaagugcugggaucgcagaagucagucaccacgcccggccucgggccaagucuugggggacguggggagucaugggagggcagggacacguucauuguacccccuuccugaugucacugcaauugugggguaugcacaaggaaauaaggaagauucgagcugcaaauacuguccugcaaagugcuuuguuuugcuuugagacgggaucuugcucuguugcccaggcugaguguaguggcacaaucacagcucauugcauccucgaccuccugggcucaaaugauccucccgccucagccucccgaguagcugggacuacaggagcgccccaggaugccagacugauuuuuuauuuuuuguagaguugggggucuugcuguguugcccaggcuggucucaaacuccugggcucaaacgauccuucugcccagccucccaaagugcugggauugaagaugugagccacuacgcccaggaugguuuuuugguucguguguuuguuuuugcuuuuaauguaguaauaucacaggcauaccgagcaccagcucugggccacgucccacauuaggcaccgcggauacagcagggaacuggagggaugcaggcacugucuccagagaacucagcacagugggaaagauuguggaaucaggcagagcugggggugucaaagcaggcuuccaagaggcaguggcuggaaacaaagacgugaaggguggccggucgugguggcucaugccuguaaucccagcacuuugggaggcuaaggcgggcagaucaccuggggucaggaguuugagaccagccuggccaacauggugaaacaccaucucuacuaaaaauauaaaaauugaggccgggcauggugucucacacccauaaucccagcacuuugggaggccgaggcgggcagaucacgaggucaggggauugagaccauccuggccaauguggugaaacccugucucuacuaaaaauacaaaaauuagccaggggcgugguggugcacaccuguagucccagcuacucaggaggcugaggcaggagaaucgcuugaacccaggaggcagagguuauagugagccgagaucacaccacugcacuccagccugggcgacagagcaagacuccaucucaaaaacaaaauacaaaaauuaagccgggcacgguggcuuaugccuguaaucccagcacuuugggaggccaaggccgguggaucaccugaggucaggaguuugagaccagccuggccaacauggugaaaccccgucucuacucuacuaaaaauacaaaaauuagccaggugugguggcgcaugccuguaaucccagcugucugggaggcugaggcaggagaauuggcuggaacccaggaggcagagguugcagugaaccaaggucaggccaccacacuccagccugggugacagagcgagacugucugaaaaaacaaaacaaaacaaaacaaagaugugaaggggcaugaguagggguugaccaaagagagguggcagagccaagcuucuaagcagaggagggacacaaucaguuuugguuggucaaaaggucacacugucuacugagugggcgacaagcuugagacagagaccucuaagcagccuggauuugagagaaaguugggagaugguauaaucacuccaguguccacacuccggguaguccuuccgccccagcugaaccugcaguucauugguccguccaccuuccucccacugccucacauaccuugcuuuccccaagaucagcuuugcaaacgcuagcaaccugcugcccuucucucuugcuuacucuggauaaacucaccucuuucccuuccuuggugccuauccccgugcaacugaacauaauggggggcggggagauaagaaaaaaacagcucuaagccaggcaaaauggcucaugccuguaaucccaacgguuugggaggcaaaggcaggaggauugcucaaggccagaaguucaagaacagccugggcaacauagcaaggcccugucucuacaauuuuuuauuuuuauuuuuuaauuagcugggugugguggcgcauuccugcagucccugcugaccggucucccgauugguacuccaguggacucuuuauggugccuggccuuucucuuaccucccggauccuucacucucucccucccuccuagaucacuguccccugcccucucuuuccuccuuuccacccccuuucagccagucacuuugcucacugcaacaucugccuucccgguucaagcgauucucccgccucagccucccgaguagcugggauuacaggugcgugccaccacaccugacucauuuuuguauuuuuaguagagacaggguuuuaccauguuggccaggcugaucucgaacuucugaccucaagugauccaccugccucggccucccaaagugcuggguuuacaggcgugagccaccgcgccuggcccauauuuauuuauuuguuuguagagaugggcucucgcucuguugcuuaggcuggagugcaguggggugguuaucacccacugcagccucaaacuccuggguucaagcgauccucccgaguagcucuggauacuccgugugcacuaccgugcaaagauaauuuuauuuuuuucuggacaugggaucuuucugugcuccccaggcuggucucccuaauacuuaagcacugccagacacgcuguggugcucugucuucugucuguucugugucucccucugagggcagggacacuuguguguuguguugccugcuguauccccaccacuaagcacacaguaggcagucuaaaguccuugcugcuagcugauuauaaguucaagacaaaagagggaggagucuaggauugccaccuggagcuccaagugcagauagggaacagccaggggcugcaggugauacccaggccuggggcucaagcgaggugugggguggagggaccacaucgggcucaucuacauacggggcggcagcagagaaaaaggcucucaggccgggcacaguggcucacaccuguaaucccagcacuuugggaggccaagguggguggaucaccugaggucaggaguucaagaccagccugacuaacauggcgaaaccccaucucuacuaaaaauacaaaaauuagucgggcaugguggcaggcgccuguaguuccagcuacucaggaagcugaggcaggagaauugcuugaaccugggagacagggguugcagugagcugagaucuugccacugcccuccagccugggugacagagugagacuccaucucaaaagaaaagaaaaaggcucccagaacaaagcguaagguaaggcagccauagagaugggaggaaaccuggggaggagggaugugggaggagccacaggaaagaaggaagcgggaggcugggguccugggcuguuggguggcccugugagagcccgugucugggcagugaggggguagggcagaagccagggaaugggacaaggggcaggagaggaggaccugggccucagugggaugagagaaucgcagcugggaagcaaaggggagagaagccagcaggggacgacugccauugagaugugaauauaucucgucucacuugcgcagaugggaaggagcugggaccgagaaagaugugguggacgucaggagggcuagggaggcugggucugagggaggcgguggggaacgagugcaggaucgccaggcacaggcuccggggugaguguccaggauuccucaugcucccaucggcccccuccugaagguugauuuguccggagucagguuugcuaggugaguggggcaccgggacccagauacuaguccagcugucuucugagcccacgccuaaguaccuuacagguacuguuagcucaguggaugcucggguaacuuccaugaccggauggucaguucugaggcugagagagaggccacgccgccggccagugcagagcugggccuuggguggguugcagacaagaaaggcugggagugcugccuggagccccaggugcagguggaggggcugaggguuacucugggagaagguggauucugaacucggacucuggagagcggggcuguagagagcuggggacgggcaucccugugggaggggaggcaaggauccggcacgggauguugaggugccucagggugauggggagccaccuucuccugucuggcccuuggugucuggaguugccuuugugcaaauuagaaaaggaggccccuucaggacagugcauccgucaaaggcaucugccauccacugccaucuggaugugaaugggggacaccccaagccgugccuuccugaagccgugugccucgguccccuggggauccccggaauugggguggggagccuccagccugguugagccccgcccacucccugcagagaugguggccacacagcaggagaugauggacgcgcagcugaggcuccagcugcgggacuacugcgcccaccaccucauccggcugcucaagugcaagcgugacagcuuccccaacuuccuggccugcaagcaggagcggcacgacugggacuacugcgagcaccgcgagugagcacccccacaccagcccccaacaccccggcccgcaacaccccauacccccagccuuccacaccccuggcccacccaagccccccacaugcccagcccgcccaagccccccucccacccccgccaacacccacagccugcaccccacccaggccuggccccuggcaggauguggcuccagaggccagggaccugaacugccacugagguuucuagccgggccccaccuuagucccagagagggcucucuaggggccuguuugauggggacagggcagguggcugaagccaccuaggggaguggccaagcccagguuccagugggaagcccugccaccugcgugggcagaccccagacccaagccacaggcacucggacaugucuucuucagaggccucccccacagugcucugggacggccccuccgcuucccagggcuuggggggcguguccuggccagggacccugacagccccucucgugcuuuucccccagcuaugugaugcgcaugaaggaguuugagcgggagcggaggcugcuccagcggaagaagcggcgggagaagaaggcggcagaguuggccaaaggccagggacccggggaaguggaccccaagguggcccuguagggggugcaccccccacccuauggaccagucaaauaaaagccuucaggccccucaa

SEQ ID NO: 191910 - RNA, 36414 nt, Homo sapiens
ggaggggcggggcggacgcagagccgcguuuagucuaucgcugcgguugcgagcgcuguagggagccugugcugugccgcgcaguuaggcagcagcagccgcggagcaguagccgccgugggagggagccaugaagcauuacgagguaagaagcgagaaacaggggccguguggccacugcugacccauucuuuuuccuucuuugcgggaccacgggaccccacuuucugguccugugccccgaaggaagagccagacggcgcaggcgcagugggcaagcguugcgccccgggccacucguaaauuccaaugcgcaugugcgcaggaaguauuuauaaaucugcaacccaggcuguuuuggggguacuuuuucuugggggucucugcaggggcugggacgcuugcagguuccuugcagcucccccagcgggcugaguugcagacuuugucaugggagccacgaaggugcgggacccuugcucccaauccgagggagucuugcacaaaucuugcgccacgccgccgucaccagcguaggaaggggcuuugcuaucaguauucuuguguacgaccuuuggaccccuucccucgcccgggacguucccgggagacuuaggcggugagggaggugcagcuccacggcuggcuuucgcagagcagcgaagcugaucuugcuuucugguuaucaaagaggucaucuacgucaacccuugggugucaccaaggagaaaucuuauacccacccacagccacucuugaagcccaagucuucugacuccuaacuugggucucuuuuucccuuaaaacgaagucuucugaugugcuuaucgcccuaggugauaauauaauauuaauaauucaaccaauuaucccugaauuauugcugacuuuuaaguaacuaucaucaaauaauaaaauuuguuauuaaaauucaaaauaacaauuuagcaagugcuuacucuugugcuggugagauucuguuaccuuguauaagaacuauuauuauuccuguuuguaaggaugaauaaagucucagagauauaaagugacuuguucaaaggccccuaguuaguaaaugcaaaacagauaggggaacucaggacgccaaggucuuaguuccuagccacuaugccaugcugguccucaaaugaaaaauagcaggucgagcgauuucuuguuucucacuuccccuccaauuuaaaaaauucuggcaaaauacacauaaaauuuaccaucuugacuauuuuuaagugugcaguucaguggcauuaagaacauucacauuguugugcaaccaucaccaccacccaucuccagaacucuuugcaucuuggaaaacagaagcuguagacguuaaauacuaacuccccauuccucuccaccuccaccucuggcagccaccauucuacucagccaccauuccgucuuaaugaauugacuacucuagguaccuuggauacguagaaggauuuuuuuuuucuuuuggagacagaguuucggucuuauugcccgggcuggagugcaauggcgcgaucucggccuacugcaaacuccgccuccuggguuuaagcgauucuccugccucagccuccugaauagcugggauuacaggugaccgccaccaugcccggcuaauuuuuuguauuuuuaguagagauggggguuucaccauguugaccaggcuggccucaaacucuugaccucaagugauuugcccuccucggccucccaaaguacugggauuacaggugugagcuagugcgcccggcuguuuguuuuuauugacaaguugaauauuacuaccucugccuccugcccccuuuauugcuacuauuuuuggaaauuuacccacaauccuuugaagccuuuuuuugagacggaguuucgcucuuguugaguacgcuggagugcaauggcgugaucuuggcucaccgcaaccuccaccucccggguucaagugauucuccugccccagccuccugaguagccggaauuacagucaugagccaccaugcccggcuaauuuuguauuuuuaguagagacaggguuucuccauguuggucaggcuggucucgaacucccgaccucaggugauccacccaccuuggccucccagagugcugggauuacaggcaugagccacggugccuagccccuuagaagccuuuaacccacaaauccuguaauuuuugacaugguaucaagaaugaggagguuuguauucaauaaucucugucauuuaaguuuucauucuagaaugaaguucugauguggauuccccucucaaacucuauaucuaaaccuguagucccacuacuguagucucagcuacucgggaggcugaagcaggaggauggcuugagcccaggagguugaggcugcagugagcccaaaaaucaggccacugcacuccagccugggcaacagagacccuguuugaagaaaaaaaaaaaaaaaaaaaaaagcuaccauguccagcuugaaacaugcaguuuggaacauccauauggcauuuugcaaauguaguugguuuaguuuugcuaguuaacagucagauaaaguaggccucugagcacccugggggugcgugcuuuuguuccaggaagcugggcacagccugaggcccaagacuuggacuggagaauaugcuccaccguacuuaauccuuuucucucccagaaagaagggggagcuuuggccaggcaugguggcucacgccuguaaucccagcacuuugguaggcugagguggccggaucgcuugaggugaggaguucaagaccagccuggcuaacauggagaaaccuugucucuacuaaaaauacaaaagugagccgaguguuguggcacacgccuguaaucucagcuacuuggaggcagagguugcagugagcugagaucaugccacuguacuccagccuggaugacagagcgagagucugucucaaaaaaaaaaaaaaaaaaaaaaagggaagcuucaaacucacuguucaaagugaccuugaaggaaaaaauaaauuguuauuuugcuguguuguuuguuauucucugccaaccuuugccaaguacccauagaggcgauagcuacagggcuucugggugggagaagcaguuguuucccggcccagcggauugcauagcaagcagauuaguuuaacugcauguguguauuguaggucaguaaaaauagaaaggaugcuuucacucacacuuaacaagcaauuugagaaaagguuugucuacaucaaagaauauauuucuggccgggcgagguggcucaugccuguaaucccagcacuuugggaggcugagacgggugaaucacuugaagucaggaguucgagaccagccuggucaacauggugaaaccucgucucuacuaaaaacaaaaaaauuagcuggguaugguggcacgugcuuguagucccagcuacuggcuucgaggcugaggaaugagaaucacuugaagcugggaggcggaguugccaugagcugagaucacgccacuguacuccagccugggugacagagcgagacucuguuuuaaaaaaaauaaauaaaggauauauuucagcugggcacaguggcucaugccuguaaucccagcacuuugggacaccaaggugggcaaaucaugugaggucaggaguuugagaccagccuggccaacaugaugaaacuccgucucuacaaaaaauaaaaaauuagcugggugugguggcgcacgccugaaaucccagguacuugggaggcugaggcaggagaaucacuucaaccugggagguggagguugcagugagcugagaucgcaccacugcacuccagccugggugacaagaacgagacucugucucaaaaaaaaaaagaaaaaaaucuauuucugcuugggacuaaauccaucuucccacccucaagcagucuguuguccacugaaagguuggccccuggagagaccuuggagauuaugaagugcaguuuacaacugauagagguaaugcccagaggggugcaggacgugcugacugucacgcaacaaauuaaugucugguugaggacuguuaucauggcaguugggaucccagcaguaguggagaucgguggcuguuuccauaguagccucauaucacugccaaaucucaucugaucugagaggaaaaguuuuccacucuguggccuaauugaggugaagccucucucuagaacgggucaccuccaggccuuggcugaagccgucuucuuagaauaccagagcaggccuuagcauugucuuggggucagagcuaggucgguaagcgaacugcuuauccuaggauacaguauuuuuuuaauguauuuuuuuauuuuauugcuguuuuugccacugcagaugagacucaaagcaaugagcccagcagcaacuggaaaaacagcuacuacaucuuguaauugagccuguuaauuccugagaaaaucagucugucuucagccuccagcaguccaggucacugcccauuucccgcagcugaauacccagaagcgagccucuuggggucccccauaacccacauuuaggguguuuucuuucuuuuuuuuuuuuuacacagagucucgcacucucgcccaggcuggagugcaguggcuccaucuuggcucacuguaagcuccgccucccggguucacgccauucuccugccucagccucccgaguagcuggaacuacaggugccugccaccaugccuggcuaauuuuuuguauuuuuaguagagaugagguuucaccguguuagccaggauggucucgaucuccugaccuuaugauccgcccgccucggccucccagggugcugggauuacaggagugagccaccaugccuggccuuuuuuuuuuuuuuuuuuuuuuuuuuuuuugugacagagucucgcucugucacccaggcuggagugcagugaugugaucucaccucacugcaaccuccaccuccccgguucaagcgauuuuccugccucagccucccaaguagcuguuauuacaggugggugccaccaugcccggcuaauuucuguaguuuuaguagagaugggguuucaccauguuaguccaggcuggucucgaacuccugggcucaagcgauccuccugccuuggcaucccaaagugcugggauuauaggugugagccaccgcaccuugcccaggggugagucuuauuagcaccugaucagaugggaacuacuguucuacuuuacagauaaugcaacugaagcucagagagguaaacuaagcuggucaaggucacagagccuggaagccagggagcugaaccuggguuugucagacuccaguuuuguccacacugauggcuucucugcugaugcugcccuaggacagcugguggcucuccugcuguguucugaggacagagcaucccugaagggagggcgaggugcugcgggucaguguggacugcugggagagggucuuucucugcccuaaaaucggaugggcugccccuugcaguaagggcaggauugagagugaugagccuugccugggugcagugguucaugccuguaaucccagcacguugggaggcugaggcaggaggaucaccugaggucaggaguucaagacuagccuggccaacauggcgaaacccccucuccacuaaaaauauaaaaauuggccgggugcaguggcucaugccuguaaucccagcacuuugggaggccgaggugggugaaucacgaggccaggagaucgagaccauccuggcuaacacagugaaaccccgucucuacuaaaaaauagaaaaaguuagcugaguguggugguggguaccuguagucccagcuacuugggaggcugaggcaggagaauggcuugacccgggaggcggagcuugcagugagccgagaucgcgccacugcacuccagccugggcgacagagcgagacuccgucucaaaaaaaaaaaaaaaaaaaaaaaaaaaaaaaaaaaaaauauauauauauauauauauauauauauauauauauauauauauauguauguauauauaaauuagccaggcaucauggugcacuccuguaaucccagguacucgagagacugaggcaggagaauucguuugaaccugggagguggaggucgcggacgagcugagaucgcaccacugcauuccgguccugggcaacagagugagacucugucucaaaaaaaaaaaaaaaaaaaaagggaaaguggugagccuugagcuguggugagcuauaaagaccuuuccuauguuagccugacucaggccaagauccugaggggguuggaggggaucuuaggcuuuucagauuuuccugcaggcuucuugcuuugagcagauggugacucacugggcagauucuccugguggagucccuucuguccuggcuguagcuuuguacuuaggccauuucuuugcuguaggcacucagaaucucagagccccaggcuugagauaauuuuucugguuuaacuucuguaaaguuacagaugagggaccugagacccagagaacaaggccuuuuccagggcugcaggccaguuccccuuuggguugggcaguauugauugauacucuuccugggaagguggcaaugcuuacgggcuuuggaucagugcuaggcucauaugcuuaacugccacugacaagguuuggagcccacgggcaaggucuuuaguuucucgagcuaguuuuuuuuuuuuuuuuucgugagacagagucccccucuguugcccaggcuggagugcaguggugccaucuaggcucacugcaaccucugccuccuggguucaagcgauucuccugccucagccuccugaguagcugggauuacaggcgcccaccaccacgcccggcuaauuuuuguauuuuuaguagagaugggguuucaccauauuggccaggcuggucuugaacuccugaccuuaagugauucucccaccuuggccucccagaguguugggauuacaggcgugagccacagcggcuggccuugaacuagcuuuuuaauccauaaaaugacaccugggugugcgagacccggcugacauuggcugauggugugcaucuucccaacucuguguucagggauaucaggcugacaucucuaagucacagguaggguauuuacaucacggaaaguggcaaaugcuacagcugaggccccuuccucucuccugcccaauguucauauugacugggauaauugucccugccucccaggguuaucguuucaaggguuucuuggucuggugagcaucguaugagcagauacauaccuggaaagccucagcuuggugcagcaccuugcagcagcuaacauuugacaaguaguacggcccuacucaccucuggaccucuggacacggggcagauguggggaggaggggccgaggagggggcggggccgaggaggaggagguggggcuugaggacggggaggggugucgaggagggggaggcgggucccaaggaguaggaggcagaguuuagcaggaaaaggcauguccugaggaggaggagggggcagggcugagguggaggaggugguuccugaggaugaggagguagggcugagaaagaagaggcggggccgggggggaaggggaggccgagggggaggagguggggcucaggaggaggaggcggggcaagaaggaagcggcgggccuggaugggggaggcgggaccagggagggggaggcgggaccagggagggggaggcgggaccgaguaacaagaaggugggacgggaugaguggugggcuuuggugugugccagguggaguagcuguuucagccgcacccagguggauuuagaggcuccaccagcugggcccagcaaagccuucuggacuaacugguuccugagaacagaggaggguugacagccuugagugagggcggugcuuggaaaggccuugcgacucugauaaggugguuggguuuggucgggaauccugcacuuucauugacaagccuggcugcgugagaaaggccagagaccuugagcuaguuggucaaguucaggcugggucuuaacaccuucuugcugauacugauaguggcagcugagaauguuuuaauaccugggacauuuccugcggcagccagaauauaguaaucuuccuaguaaauuacggugaauauagugcuuaauuaucaguguuuuuuuuuuuuuuuuuuugagacgaagucucgcucuuguccccuaggcuggggugcaauggcgugaucucggcucgcugcaccuccgccucccggguucaggcgauucuccugccuuagucucccgaguagcugggauuacaggugcccaccaccacacuuggcuaguuuuuguauuuuuaguagagaugggguuucaccauguuggccaggcuggucugaaacucuugaccucaggugauccgcccaacuuggccucccaaaguguugggauuacaggcgugagccacugcgccggcagugugagugcuucuuaucuaguaacauaucuaaaucguguacuaaacauaagacguagaugcuguucuuaucucuacuugacugauggagaaacugaggcacagaaagugaagcgacuuguccacagcuaguggcuagcagagcugggauucuucuagaaccagagugggcuuugcugugggucgugcacuggggaaagaaucaaguguguggugguggugaaggacuuggaggccacccacucuguccuugggacagugacuuaaccuaagcuucaguuuugucacccugugaggccaggauaacgacaccugggggccugugggggagugugaagugcucagcaugcuucgcggcccacaggcaggguaaaaauccuuaagcggagagggacccacguuaggcagguaaggacagaucagcauccccagggcugccugagaugcuuuuggcaccugaccucuuuggaaggccucaaaacucuuuuuuuucuuuuuuuuuuuuuuugagauagagucuuccucugucaccaggcuggagugcaguggcguaaucuuggcucacugcaaccucugccuccuggguucaagugauuguccugccucagccucccgaguagcugggauuacaggcacgugccaccaugccuggcuaauuuuuguauuuuuaguagagacgggguuucagcaucuuggccaggcuggucuugaacuccugaccucgugauccacccgccucagccucccaaagugcugggauuauaggcaugagccaccacgccuggcugagaaaagcuucaaaacuuaaugaagaagguccaccaggcgccaggagacagacugaugucaaaucauaugcccagaagguggaggaagaagcccagaugccagugccucaguuuugauauaaugucacacaccaugcaagucacauuuuuuuuuuuuuuugagacagagucucgcuccgucacccaggcuggaguucaguggcuccaucucggcucacugcaaucuccgccucccggguucaugcgauucuccugccucagccuccugaguagcugggacuacaggcgcccaccaccacgcccggcuaauuuuuuuuuuuuuuuuuuuuuuuuuuuguauuuuuaguagagacgaaguuuuaccguguuagccaggauggucucgaucuccugacuucgugauccaccugccucggccucccaaaguacugggauuacaggcgugagccaccacaccuggcugcaagucacauuuugagaugaucagcucuuuccuucuucaugggaagacccuuggggaagucacaccacacucagagcccacuuuuuaaccuguugugacaaagaaucaucccaggaaguggaggcuagaagacagucuggccaccaggugccugucacagcugccucaccuaggagcacacugcuucuguuccugcucccuccuagcugacuguuccccaccgagccacaggcagaaggccuuuuugccuguaagugggaggaucuuagugugccauggcucagaaccuucccucagaggcuugucaucuguccccugcuuuccucaguuguuacuaugcuacugucuuucacagauacccaaaaccacguuccugcccuaagcacaugcuauucccucggcccuggaugcccuucccucugcuuuccucaugccuggcccuucguguuaccgagcgcucagcuuccaugucccccagagagaccuuccuuggccauccaaucuaaaguccaaccccuugccugucacccuggcaccccacucaucuccuucgcagcccaucugggcuuggguuguguuuucuuucuuuuuuuuuuuuuuucugagacggaguccugcccuguugcccaggcuggagugcaguggugggauuuuggcucacugcaaccuccaccucccggguucaagugauucuccugccucagccuccugaguagcugggauuacagguacccgccaccaugccuggcuaauuuuugaauuuauuuaauuuuuuuuuuuuuugagacggagucucgcucugucgcccaggcuggagugcaguggcaugaucucggcucacugcaagcuccaccucccagguucacgccauucuccugccucagccucccgaguagcugggaguacaggcacccaccaccacgccuggcuaauuuauuuuuuauuuuuuauuuuuacuagagacaggguuucacugugucagccaggauggucucgaucuccugaccucgugauccacccuccucagccucccaaaguguugggauuacaggcgugagccacugugccuggcuaauuuuuguauuuuuauuuauuuauuaaaaaauguguguuuuugaggcagagucgugcucugucaccuagacuggagugcaguggugcgaucuuggcucucugcaaccucugcgucugggauucaagcauucuccugccucagccucccgaguagcugggauuacuggugcccaccaccacaccccacuaauuuuuguauuuuuaguacagacaggguuucauuguguuggccaggcuggucuugaacuccugaccacaagugauccaccugccugggccucccaaagugcugggauuacaggcaugagccaccgugccuggccauaauuuuuguauuuuuaguagaggcaagguuucaccauguuggccaggauggccucgaacucuugaucuuaagugaucugccggccucggccucccaaguagcugggacugcagguguguaucacuaugucuggcugcuuuuuuuuguuuguuuguuuguuugaguuggaguuuugcucuugcccaggcuggagugcaguagagugaucucgauucacugcaacuuccgcuuuccgguuucaagccauucuuuugccucaggcuccggaguaacugggacuacaggccacacgcugcuaauuuugguauuuuuaguagagacaggguuucaccaugugggccaggcugaucucgaacuccugagcucaagugaucugcccaacuuggccucccgaagugcugggauuacaggugugagccacuguucccggccagugccuggcuaauuuuuaaaggauuuuucuugguagagacgcagucucaccguguugcccaggcuggucuugaacuccuugguucaagugaucuccugccucagccucccaaagcucugggauucuagguguaugccaccgugccuggcuggcaacuggcuucuucuggccucuuggccacaagcccuggguccauccugcccguggcuguccuguuccccaucaucucaacccuccuggcacagcggcccuucugagauggaagcugccgagacaacacugggcacucaccgcacagguugugggcagguccugcugguccaggccuuuucccgucauaggacccugccucuguuuuccaguccaucacuuauucauuaguucauuuguuccaacauguuuuuucccucuuaucaaugcuaagaaucgugggaugaacgaaccacauucucuguccucaagaucuuuucauuuaagccaaggccugaaggucgaggucuuuggggccagggaggagaaugguguucuaggcagagggaaccgaguggugugugcagaggcauggagcccagaguuugcauaugucccacguugagggaugaggcugacagggcagggcuuuguagccacccagagagaccuguggacuucuuuucauuuuuuuuuuuuuuuugagauggaguuucacucuugucaccaaggcuggagugcaauggcacaaucuugggucacugcaaccuucgccuccuggguucaagcgauucuccugccucagccucccgauuggcugggauuaccagcuaacgugccaccacgccuggcguauuuuuuguauguguaguagaccggguuucacauguuggccaggcugguuucgaacuccugaccucaagugauccgcccaccucggccuuccagaaugcugggauuacaggcgugagccacugcccugccucauuuugauggcaaugaaagucccuuuucuguuuuauucaauuaccuaugaauuauuguuuuuaguagagauggggucuugcuauauugcccaggcuggucuccaacucuugggcucaagugauccuccugccuugaccucccaaagugcagggauuacaggugugagacaccaugcccgaccacauucuacugauuuuaccuaaaagauucccuauuggagggcaguucauuuuuaaguccucagggggcccucaugccauaguguuuuuuuuuuuuuuuuuuuuuuuuuuuuucugagauggaguuucgcuuuuguggcccagucuggagugcaguggugcaaucucggcucacugcaaccuccgccucccggguucaaucaauucuccugccucagccuccugaguagcugggauuacaggcauccaccaccacucccggcuaauuuuuuuauuuuuaguagaaauguuguuuuacuauauuggcuaggguggucucgaacuccugaccucaggugaucuacacgcuuuggccucccaaaguguugggauuagaggcauugaggcacugcaccugcccaccaugguguuuguaauaaaaaugcacagagcauuuguuccuuauucugagaaguguaccguggauugcguguggggcuuacugggagcagagcgacucaccccaguuacaugguuagcugcaugugggucaugaguguuucccagcccugcaagguguaaaggcccucucuguggcccuguagcugugucacagugacaggcuggcauggcccugccucugucccugcucgaaucaggcucuuacguaagcagagcccaccagccauucacagacugccugagagaaugcagggcuuuaugcagucuccuggguccuuccaaauucuuuuuuuuuuuuuuuuccauuugaaagugaacagggaucacuggccagagcgugggaucugggcuuguccucaggguggggugccaaguugggggugggggugggaaguuaacacaagcccuggggcuucaggaaacaucuggaaacaggcugaagucacggagcugagccuccaggcuccuuguggggagaagcuguuuccccagacaccucaagugucuaacucaggaggugggcagauggguggagcugcugaaugaauguuucucaggagcugggugggguuggaggauugcagaggguggggugggggugugugugugugcagauacuggaauuccugaggagacauguauaguuggaaacaguguauugccuguauacuacuuguuucagagaauauauauauauauauauauauauauauauauuuuuuuuuuuuuuuuuuuuuuuuuuuuuuuuuuuuugagacggagucucgcucugucgcccaggcuggagugcaguggcgcgaucuaggcucacugcaagcuccgucucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccucccgccucggccucccaaagugcugggauuacaggcgugagccaccgcgcccggcuauauauauauuuuuaaauugagacagagucucccuuuguugcccaggcuggagugcagugguaugaucgcagcucauugcaaccucugccucccagguucaagcaauucugccucugccuccugaguagcugggauuacaggcaugcaccaccccacaccuggcuuauuuuuguauuuuuaguagagacaggguuucaccauguuggccaggcaggucucgaacuccugaccucaaaugauccucccgccucagccucccaaagugcuaggauuacaggugugagccaacgugccgggccuggagaauaguuuaacaaaaucucccagccaggggugggggauccacagaggacagagcuggagaaucccuauccaaauacugguguggggaugguuucuggagaggcuggcuguguggucuuggucugaaugugacaaaauaccuccgagaagccucugccccugacucacccaggccacacucaucaccuugucaccucauguuugaguucuccacacagcacuuggcaccuucugauaaggcauguuuguguaagccccuggcucuccccuguaaccccuggcccuggggagggucucuggauacuuguggaacgaguauguguauguuugauagaggccacugucuuacggagcacacaggacaggcucagccguucagccgcauaauugaugccugcccucaaaagucacugcaacugaucaggacgaggaugcuugcaugaucucggggugugcggccauucuaugggacuggcaggucuggcuuugagugcggguccugagcuuauagcauauccuuggugauaguagcagaggguucugcucuuccaugaaccgggcucaucuuuugcugcugcgguguuuggccauuccuuuuuuuuuuuuuuuugagacagggucucacucugucgcccaugcuggagugcaguggcacgaucacggcucccugcaacuccaacuccuggguucaagggauucuugugccccggccucccaaguagcugagaccacaggugcaugccaucacgcccggcuaauuugaaaauuuucuguagagauggggucuugcuguguugccuaagcuggucuugaacucaugggcuccagugauccuccugccucuguuucccaaagugcugggauuacagacaagagccaccaugcccagcacguggcuuguuuugaaccauugacacaucagaaucuaggaacugcgguguccuuuucacuccuucccuucucuguucccucccugguccaagcaccugagucucugcccugaguuguuucuaagccucucaccacugucucugaagccacauuugcucccuuacuguuccucuguccccagcagagagaugauucuucaagaaaccaaagcagccuguggcauuccagcgauuccucauugcucaaggguaaaaccuaaagcacuugucuuggcucugcuccagccugcugcuuagcugcucccccuaaaauuuacucuguuccagccuccgggugucacccgcuuccccaaagcucugugcuaccccagggccuuugcauuccccgccagggagccucaugcuggcccucagcugaaaucccauuuccucagcaggguccucccgggcacacccacuguggcccucugggcccucugcaccgcugucuccucuccacagcuccugguacaucgugaccccguauuauguaauaggugcuuuguucauguccccuugagcaccagcaagccuagggggugggggggauagccucucucagucgugcgcacugucauaucccggcccuuggaucgcugcccgcacgcucuuguuacacccgccugacugccauucaucacugagcccagcagcuggcacaggcaggcccgacgcagcaaggggcacaguccguguugguugcgugcauggcgagugcaaacugcacaguuagcagaaaagguuuuugggagugacagacaccccugcacacgguugagcccuuuguaggucuccgugugacaaguacaucccugcugugcuugggaaagggcugcggcuugggaaagggcuguguggguucccuggcuucuuccugcuguccccgaggagcaucggaaaugggucacaacgcagcagguaaccgcagccucccucaggcagagcugaguggcucaguauuccauccaaggccugaucagagcuccucugggccacauagagcccccaggacauggcuggacuaggaguugggacccugaucucccuuccuggcugggucacgcccgccaugccacugacucuugggggaccugccuggaaggugaggaagugauccaugcuagcucgucccuggggaccaaguccuucugcaccugggguggucacaaaucugcuuucagaaaaaucaugggggcggcgcugggggcuacucagcugggaaaucauuacagacauuuccgaucauagaucacacugaaaguuuuugggcaucuaacucagaaggaauucuagauuugggauuuuuuuuuuugcucugagaaaacuccacccuaggccagguguaguggcucacaccuguaauuucagcacuuuggaaggcugaggugggcggaucacuugaggucaggaguucaagaccagccuggucaacaugcugaaaccccucuucuacuaaaaauacaaaaauuaaccaggugcaguggcacgugucuguaauccuggcuacuugcgaggcugaggcaggagaauugcuugaacccgggaggcagagguuguagugagcaaccuccugcagaaauuuucuuuuuauuuauuuauuacagaaacagggcucucacuaucuuggccuggcugcaugcacuaccgugucuagccuggauuuuucuuucuaugcuuagaaccuuuggucacugaaauauuucuuaaacauuauuuuuucuuuucuuuuuuuaagacggagucuugcucuguugcccuggcuggagugccgugucgcgaucuuggcuugcugcaaccuccaccucugagggcggguucaagccauucucccaccuuagccucccagguagcugggacuacaggugcacaccacuacgcccagcuaacuuuaguauuuuuaguagaaacaggguuucacuauguuggccaggcuggucucaaacuccugaccucaagugaucugaucugcccgccuuggccucccaaagugcugggauuacaggcaugagccacugcacccagccuaaaaauuaaauuucaauuugaucaacaugauaggguaaucagugcuaaccuucagucauaaacauguauuauaauaagauccuaugaaggagggaaacagaaaccaacgucaaagcaaaaagagagccaauguuaaagagcuuauucauagccucuuauuuuuuuuuaaagggauaaugguagguuucaaauuacugaagcauuuagacucuagauagauuuaacagaguccuguaaauguuuauguaaaauuuuuaauaccgacaguaggccagaaaugacaucuuuugcaacucuuaaagcuuggguaaaaauauuaguuacaggcgugagccaccguaccuggccuauuuuauuuuauuuuauuuuauuuuauguuuuuugagacagagucucagucuguugcccaggcuggagugcaguggcaugaacucugcucacugcaaccucugccucccaaguucaagugauucucgugccucagucuccagaguagcugggacuacaggcaugugccaccacaccuggcuaauuuuuuguauuuucagucgagaugaguuuucaccauguuagcuaggauggucucaaacuccugaccucagguaauccaccugccuuggccucccaaaguucugggauuacaggugugagccacuguaccuaauauuuuuuuuuuuuuuugagucagggucucauucugucacccagguuggagugcaauggugcuauuauaguucacugcagcuugggccuccugggcuuaagugauacucuugccuuagcuuccugauuaugcuaggacuacaggugcauaccaccuacagccggcuacuuuuguuuuuuuuugguagaaauggggucuugcgauguugcccagguuggucuugggucuugggucuuggacucugggccucgagggauccuccugccuuggccucccaaccauguguguguuuaaugggcauuucuuuuuuuuuuuuuuuuuugagacggagucucgcucugucacccaggcuggagugcaguggugugaucucaguucacugccaccucugccuccugggucaagcgauucuucugccucagccucccaaguagcugggacuacaggcgcccaccaccaugcccagcuaauuuuuuguauuuuuuguagagaugggguuucaccguguuagccaggaucgugucgaucuccugacuucaugauccgcccccucggccucccaaagugcugggauuacaggugugagccacugugccugggccuaaugggcauuucaaacuuuacauguccaaaauggagcuucugauuuuuccucuugaaccugcauuuccccacccccuugguggcaguuccggccuguuuguuacccaggcccuaagcuguuugacucugcucuuucucucaugccucauguccaaaugucagcacaucccuuagcucagcauucuagaauuuaaccacuucucaucagccucacugccguuaccaggccuaagccagggguuggcaaacuuaauccagcuagcaaagaucuuaggcuuugccuaagggucucugcagcacugcucaucucugucgucucuuuuuuuucuuuuagagacggaguuuugcacugucgcccaggcuggagugcgguggugcgaucucgacucacugcaaccuccgcuucccagguucaagcaauucuccugucucagccucccaaguagcugggauuacaggcacgcaucaccacgucuggcuaauuuuuguauuuugguagagacggguucaccauguuggccaggcuggucucaaacuccugauuucaagugaucugcucacuuuggccucccaaagugcugugauuacaggcgggagccaccgcauccaaccaucucagacaucucagcagcagugauaccacuguggcagccacagaugacauccagugagcauggcguguucaauacaacucuauuuauggacaccaaaauuugaauuuaauuuucacauaucaugaaauagguuucuuugauuuuuuuuuuccauccgcuuaaaaagguaaaaacgucauguauuuuuuaaaagauaaaacaaaaguuaaagccauuuuuagucgguucaaaagccggcaguagaccagaguugcccuaucggcuguaguuugcugacccauuugucuaagccaucauuaccuucacagaauuauuuccacaaccuuuaauuggacuuuuuuuuuuuuuuuuuuuugagauggagucucacucugucgccaggcuggggugcaguggugcgaucucagcucacugcaaccucugccucccggguucaagcaguucuccugccucagccucccaaggagcugggacuacaggcaugcgccaccaugcccagcuaacuuuuguauuugucauagagaugggguuucaccauauuggccaggcuagucuugaacuccuagucuugaagaccuugugaucugcccuccuuggcccccuaacccggcuaaguuuuuaaaaguuuuuguagagauaagggucuuacuauguugcccagccuggccucaaacucuugggcucaagugauccuccugcccuggccucccaaagugcugggauuacaggcaugagccagcguaccugaccugcacucagcuuuuggccucuuuauaaaauacuguaggccaggcgcaguggcucacgccuguaaucccagcacuuagggaggcuuaggcgggcagaucacgaggucaggaguuugagacgagccugaccaacauggugaaaccccaucucuacuaaaaauacaaaaauuagcugggcaugguggcaugcacccguaaucccagcuacucaggaggcugaggcaggagaaucacuggaacucggcaugcggagguugcagugagccgagauugugccacugcgcuccagccugggcaacacagugagacucugucucaaaaaaaaaaauaaaaaaaauaaacuauacaccugcccccuucaacugccacucccuguccccuuuccuuucuuucuucuuuccaugucgcacgucaccuuugaacauauuacauauagcgauuuauuucauugucacucuuucuuugccaagaugugaguuccaugcgagcagggauuuuugucucuccuucuauagcugaaccccacaguccuuaacagggccuggcaugugucagugaacaaacgagccucaguuuccuuaccugcaaaagaggaugaauacauuguaaaggagaugauucguguugaggaugagccuccgugccuggcugguugugagugggcgggugguguuagcugccgccgcguguauaaagccugccacguagaucccagucuaggcucuuuggcaagcugagcucauggggguggacuaaccugucugcuggacucgggcagucggggguuggcccggaugagcuccuccugcuccuccagucaguuuguaucugcagggcucagccucuggcccccuuccagcuuccugguccgacagcgccuuccugcccugaguuggagagagacccaggugucguccccaacugccacccagcugugggugcagggaugcaguucuggaccauccccugggggucugggaccuggggaguugaguguuuggccuuuacacuggagcuccuugagggcuggccccagcggccaggagugucaguuuuuugguuuguuuguuuuuuagauggagucuugcucuguugcacaugcagcaguauaguggcgugaucucagcucacugcaaccuucaccuccuggguucaugcgauucuccugucucagccucccccguagcugggacuacaggcccguaccacuaugcccagcuaauuuuuguagagacaggguuucaccauguuagccaggcuggugucgaacuccugaccucagaugaucugcccaccuuggccucccagaguacugggauuacaggcaugaacuaccacacccggccgcuccuuuuacuuaugaggacacuccuuucucuuauuaaguccaccuuaaauucaggauaaugucaucuuaagauccuuaauuauaucugcaaagacacuauuuuuuuuucuuuuuuugauauggagucuugcuuugucacccaggcuggagugcaguggugcgaucucggcucacugcaaccuccaccucccagguucauaacgauucuccugccucaggcuccugaguagcugggauuacaggcacccaccaccacacccagcuaauuuuuuuguauuuuuaguagagauaggguuucaucauguuggccaggcuacucucgaacuccugaccucaggugauccacccaccucggccucccagaguacugggauuacaggcgugagccacugcaccuggccaauuauuauauuuuguguagagaaggaguuuugacauguugcacaggcugcaggaauucccuaauuccuaagcagucccuguguuagauggucuugcaggcacacccauuuacuaguuggagaagcagacaggcaaggcaggucugacaccgcccccuguggcagugccucucagucagcauugaggacgcgccccugcuuuucuaggcccauuggcugucuuagcuagugacaggaaaacaugcaggaggcauugccacagcuguaaacccugccugggccccgcugugguaugaguugcugauagaccuuuugcucugguacagccuggcugugugaggcuguggggcagaggccagcgggcuggguccucaggccaggcagagaggcucaguucuuggugucugcuggaggaucgcauccagggugguggguuuuuuguuuuuuuguuuuuguuuuucuuuuguuugguuuuacccuuauuucuuuauuucuuccuuucuuccucuuuuucuuuccuuucucucucucucucucccccucccucccucccucucucucucccucccucccucucucucucucucucucucucucuuucucucuuuuuuuuuuuuugagauggagucucgcucugucgcccaggcuggagugcagucaguggugcagucauaacucagccuugaccuccugggcucaagcaguccaucuaccuuggccucccaaagugcugagauuacaggcaugagccaccgcgccuggccuuuuucuuuucuuucuuucuuucuuucuuuuuucuuuuuuuuuuuuuuugagauagcgugucuucugucccccaggcuggagugcaguggugcaaugauaggucacugcagccuugaccucccgggcucaagcaauccucccagucuggccucccaaacugcugggauuauaggcgugagccaccgugcccggccugccuuuuccuuucucuguugcacauagcccugcucucuaggauggaggcauuauuuuauuguaggagcuuugggccugagcaagcuggguggacacucacaugggcacuuccaggcuacuuaccuugggcgagggcuuccucguucccaagccccaguuuuccaagccacguaacaggcaucacagucuuuuucuuuucuuuucuuuucuuuuuuuuugagaggagucucguucugucgcccaggcuggagugcaguggcgcaaucucuggcucacugcaagcuccgccucccggguucacgccauucuccugccucagccucccgaguagcugggacuacaggcacccgccaccaugcccggcuaacuuuuuuuguacuuuuaguagagacgggguuucacuguguuagccaggauggucuugaucuccugaccucgugauccacccgccucggccucccaaagugcugggauuacaggugugagccacugcgcccggcccagucuuuuucuuauagggccugggugaggccuggguggcagucucagcauaguccuagguacagggugagcaucugauagaugucacgucugaaugaaacgggcgagaucagcgucgcucugggugggccagugcuccucggaggcccugagggcacaaccgcagggauggguguaggcuguggguaccacugagaauggggggcaggcccagggcugagacccagguucuccaacuucccacuguguuugucuugugccauauucauccucuaugaauggcuguggcugcucgcccaagccaggagcucgugcguccgaugaccaucuuccaaggcuggauugcuaccugcucgcucggggcucugcuggaugggaacagcagcuccagcuucuccgggucccgggcuaccgcugccucugcaccuggcccuggccucggauccgagagcccagagacauuggcauugagacccuggcaccucucgucuugccagcacagguagaagacaggagcagagcgguccagggaccugggagugggaggucagccacucucagcccuuccuccccacccugggugacauucugcuuccacuguggcgccucggggaggcuggugcagccgcccccgggugccacugagaaacgaggucauacacugaggccacuggggaaggugguauuucuggccgagcagguguggccugugcaggguuccuggcagcugagcccuaggucuucucagccauccuggcauuagcagguugacuugauauuucuggaagugggaaggaaagggagccgagagggcugagccgcugagccggaguccagaugaaugugccggagucucugcauuugugaugggggcgaggugaugggggcgagguggccggcguggcucugggcaugaucgggccaggccuccgaccucuaugcugggcauuggcuggacagggagcucaggcgaugagugcagcagcgcuugugcccggcgcggggauggugagugccuggcuggccagcugcaggaccugucaggcccuuugugucuuuaccuggggcccugguugcacugaccagggcucgcacccccagccaggccucuugugccccagacucgggagaugcuuccuaccaggaagugcaguccccugcgggguccgagagagccugccggagcuuugagcucaacaggugggcugugcggcaccacaucagcucugcaagggggcccuggaggcccauguguggugggguauggccuggcuuucaacaugcacgcguggucuucugggcucugggauuuacugcuuagaucuuggccucuucaucugugaaacggagcuaauggcuccugcucccuccggcugcugcaggagagaugucugggaagcuguggcaguuccagccccgggcagggaacgugaaauaacuguuggucgcuguucucacucaucaccauuaggcaggucacguccuaggacacacagaaguuucagguucauaagccaugggagaugaggccggcccagaauccaagcuucccgcucuggcccgggucugccccucuucuggggcugagagggcaggcaggugccuugcuggguccugugguguggacucugccgccagcaaggccauugaaccugcuuguuuacagccgggagaggacugggaagcaccagucuuggcuuguuugugaagcuggggaagccgaagcuccagaggccuucugugcauggcugugugugccaggccuucaggcugcgccuccaggggaugagcaggaauugcaggcucagcucuuccagccuuggcucagguggugccugcuccucccuccuucccuguaccucucauccccacacccacuccacucucaggccacacccacucuucaccuccacaucuguccagaauuucacugcuugucucugccuugugcuuuuuuuuuuugagauggaguuucacucugucaccagguuggagugcaguggccugaccucugcucacugcaaccuccgccuccuggguucaaucgauucucuugccucagccuccugaguagcugggacuacaggcgugugccaccaugcccagcuaauuuuuguauuuuuaguagagaugggguuucaccauguuagccuggcuggucuugaucucuugaccuugugaucugcccacguccgccucccagagugcugggauuacaggcgugagccacugcgccuggccuuguuuuuuuuuuuuugagacagggucuugcuuugucccccaggcaggggugccguaguguaaucaaucauggcucacugcagccuggaacuccuaggcuuaagcgauccuucugucacagccccugaggaguagguaggaccauaggugcgagucaccacacccagcuaauuuuuuauuuuuguuuuuugagauggagucuugcucuguggcccaggcuggagugcaguggugugaucucggcucacugcaaccucugccuccuggguucaagcgauucuccugccucagccuccugaguagcugggauuacaggugcccacugccaugcccagcaaauuuuuuuguauuuuuauuuauucuuuuuuuuuuuuuuuuuuuuuuuuuuagacagagccucacucuauugcccaggcuggagugcaguggugcaaucuuggcucaccacaaccuccaucuccuggguuuaagugauucuugugccucagccucccaaguggcugggauuacaggugugugccaccacacuuggcuaauuuuuguguuuuuacacgggguuuuaccauguuggccaggcuggucucgaacuccugaccucaggugaucugcccaccucagccucccaaagugcuuggauuacaggugugagucaccaugcguggacacagcuaauuuuuauaaauacuuuuuguggaggcagagccuugcuauuuugcccaagcuggucuugaacuccugggcuuaagugaucauccugucucagccuccuaaagugcugggauuccaggcgugagccacugcgcccagcccacuuuucaccucucuauagcucccucuuugcucccagcuucugcccucacuccuccagucuguuccacccagcaguggcaagcagguaaagcuggggaagccaagucuugaaccugagccaagucucaucccuccucugcucaagaacccucuauggcugccacuucacucagaguaaaagcuaacguccuccccguggcccacaaagccguggcacagaccgccacaucaccuuucugcccucaccuccucccacucucucccugacucacucugcucaggccacacaggacuccuuccugcucagccacgcuagguaugguccagccucagggccuuggcacuuacuguucccucugccuggacugcacugguucccccacugucuacuggccuuuguucacacgccacuuucucagaaagggcuucucugaccacucucaaauggccauccucuuggagguugcagugagccgagaucgcgccacugcauuccagccugggcgacagcgagacucucucaaaaaaaaaacaaaaacaaaaaaaaccacauugugaccucccccacaaccuucuaguuuuguucacaacucuuggugacaaaacaugcuauggcuaucugcccccacccccugcuugcccagcacgcacaggcuagaauucaggucccaugaaccccagaggcuggcuugguuuuuuucacugccauaucccaggaacuggaacagugccugggguaugggaaggagggagucaggaaugaaugaauggauaaaugaaugcaggcucccugagcucucuuggcugguggcagggccaggguuaaggucccauucugcaccagagcugucuccgucccugacaucggcuuugggacuguuccugagccggcugcugcgggugcccuuccagcaggcgggaguaagucugugcggccacaagggggcaguggggagcgucgcagccuccgccgcuugcagccagucaucccgguggugacgggucagcucggccucugcaccgaaaguaucucgcuauuguuaggguuuggguucacugugaccagcugggcgaggcaucagugcaccagcucucuggcccuggcuuccuguggaugggccccuucaagagcauggucagcgucccaggagaaggggccuguggauccugccaggguuuggcccccuugugcaccuggcauggcuguucugcuaguguuggucuaaucuuauuuauuuauuuauuuauuuauuuauuuauuuauuuauuuugagacagggucuugcugugucgcccaggcuggagugcaauggcauaaacucagcucacugcaaccuccaccguccugaguucaagcaauucuccugacucaaccuccugaguagcugggauuacaggcacacaccaccaugccuggcuaauuuuuguauuuuuauuagagacgggguuucaccauguugggcaggcuggucucgaacuccuggccucaggugaucugccugcuucggccucccaaagugcugggauuacaggugugagccauagugccccgccuaaucauauuuauucuuuuuuuaaauuuugagauggagucuugcucugucucccaggcuggagugcaguggugcgauaucagcucacugcaaccuccuccuccuggguucaagcaauucuccugccacagccuccugaguagcugggauuacaggcaugcaccaccacgccuggcuaauuuuuguaucuuugguagagacgggguuucgccauguuguccaggcuggucuugaacuccugaccucagguaacccgcccaccuuggccucccaaagugcuaggauuacaggcaugagccaccgugcccggucaucauauuuauucuuuuuuuuugagauggagucuugcucugucgcccaggcuggagugcaguggcgcgaucucgguucacugcaagcucugccucccggguucgcgccauucuccugccucagccucccgaguagcugggacuacaggcacccaccaccgcacccggcuaauuuuuuguauuuuuaguagagaugggguuucaccguguuagccaggauggucucgaucuccugaccucgugauucgcccgccucggccucccaaagugcuggcauuacaggcgugagccaccacgcccggccuauauuuauccuuaauaagauuuauccuaaacuggggaugauuacgguaacccugucagauggcagcuggggacagcccacuuugccaugaguagauggaaguucagagagguuggguaacuugcccagggccacacagccaggaaaugggcaggucugcuucucuggguuguucacccaccaggcgggcggguucccaggagcugugacaagugcuuagacaacgagagccccccuuuucacuccuccugcccccauuaguaauaucuucaugaccacaaagacagugaagacgggcucuguugcuugcggcacuccccucugggcuugggaggcacaaaccucgccccugcucccucuugcagggugcgcuucacgccgcaccguguguccuggcucuuggcucugcccugaccucgugcugcgacgaguugcuguuggcugggccccgggaaucuugggccuccuggugagaauuccucucaggcuaguggaacugucaucacagagccacaggccggcagagccaccagccugugccccaggccagagugccugccugucugcccguuccugcccucucccugcccgucgugccugaggcuauguggucucaccccuugcccguggccagugcugggaccucgcugacaccaguagccccccucccacagguaucccuucauccacccagagcaucucagccccucccagccccuccgaguggcuccgugggcuuccucagaagguccugucuguccucccugccucaccgcuucuccuggagauggggccagagccugccaccuccccgucugugcucaggauccccugccuggggcucuguucagcagcugccuguacccucugcagcccugggcuuccccugggagccccugcccccuguuggccucaggccugggcaggcguguguguguguggcaggcacagagcagagauugggguggcagugggguguggggcgcggagcccucgaugaggucucacauuaggcccucccucugagggguggggaaccucuccugcuccucccacccgacuguuuuuauuuugauggguauguggggccuguuuguuaccccucaccccuuuaaacaauaauuuauugaggugaaauucauguaacaugaaacuaaccauuuaaaagugaacaguggcauugagugcacgugcaucauugugcagccuccaccucugucucgucccagaacauuuuccucacucugaaaggagaccggguacccagcagcagccacuccccauuccccccgcccagccccuggccccuccaauuugcuuuucugucugucugcucuggguauuuugcauagauaugggaccuuugugucuggcuuguuuccuagcguaacuuauuucuuuuaccccaccuggaauaucuuauuuaacuuucuuacuuagaaauaauuauaggccgggccagguggcucacgccuauaauccuagcacuuugggaggccgaggugguggauugccugagcucaggaguucgagaccagccugggcaacauggugaaaccccaucucuccuaaaauacaaaaaauuagcuggaugugguggugugugccuguaaucccagcuacucuggaggcugaggcaggagaaucguuugaaccuggggggcggagguugcagugagucaagaucgcacugcugcacuccaaccugggcgacagagugagacucugucucaaaaaaaaaaaaaaauuauagagacacagggaauugcaagaauaguauggagaggucuccugcuccccccagagccuuucaguccucucucuaggaggagauggccgacgagcuggggauuuggggcaggaaaugggagacggacggccgucccacugaggacucauccugcccagguggcccuagccuugggcauuucuugucuguaggggccccuaggugcugccuugcagcccgggcuuaccuccuugcagguuugggcgucuccucuccuugggccucaggcuggccugggcaccacugcugcagcugugagcguggccccucucucgcuacccccuccugccgcagcccggcguccucucccagcagcuagccgggaccccgauggccguacucucccucuugggcccugguuuggugcccagguuggggggagcaggguacgauuucaccccucccacuagcagcuggcuggacagggagaggggcugguuguauuuuaagcuguugagugguucagcaggaacucggaggccuucucucccuguggacgcuaggcugccuuccuacaggccacacgggcuuggaagcaugugggcacugccugccuggggcccaggaacuauuaauauaccugcagccacagggcaggccccgugcccgcccagggcccugcugugcuaacccuuucccguggaucccgccccguguccucugucccuauccuacauauccccuugguggggcccaacguccugcguggugugaccgagcucuuuuuuucuggccccuccaugugccagcucuuuggccuuguuaucgcuguggcuuggaggaguucaguaaccuuccccuagaggccacaaggccaggcagugccuggaguugacagcagggacucaggaggccccgugggccaggauuuccuggcugcugggcccauucccacccuccuguccaggaagugggggcgagugugucauggcuggggaaauaggcccccaugcuguggugacugccaggccagcaggggaguggggaucugaaccaaacccacgggcaacaaugccuccuaucccauggggugccucccaucugucaggggucaccuaguguaccccaugcauugucucaggggaccgucacaguccugggagguagucugcuuccuaccugcccccuucugaggccuagagagaggugacaugccuggggucccccagggacuacaaggcagggcugguuacgguucccgagugcaggccaccaagcccccuugucucccgcugucguugggaaugugcaggagggguacccagcuucucuggcuugaccguggugcccucaucuucaggaugggcccuagcugccguggcccggucucccugggcucugggugggugggccugcccugggauggccccagcccagagguuuguuucugagcauuguguccugcuccuuuuccucaggcagccucugggggcccccgcuggguuucuguggguaggaagggucccccaagaauugcuggcugguggcugacuugggaucaggccugccugcuugccacgaccccuguauaauaggauugcacugaccccugcauagggugggucagauccccgggggcugccucccuccagcccugccccucugcacccccaucguucaucacuggccugggggcucagggagggcugggccagacuccuaccucaggggcuggcacaggccuggcucuuggacgcaggaagcgccgggcuuuaguggggcgcagguccugggugagggugcaguguuugggcugacucaguggaaagccugccccacagguggcuauaaggugagaaguggguggggaggaagguuggggagaccucaucagcccaagcuggaggcgguugccuaaaacuuccacacaccccgauccuuuccacacuucgagagaggcucucugcacccauaacuccagaaucugucaccucccugguaacacaaaugcacaaggaaaauaauccaaagugucucuuacagcucagaaggggaaauggaugaucugucucgcggauucucaaaauagcugggauuucuccaagcccagugaacucccuaggccugagcugcgggcuggggccugcacggcccgcuggccucucacucuccucuagccacuggcucugugcagggcgggggcugggagguguugucaugccugccccuggggcuuucccugugcuggugccguugaggguuuugaggugaccacucaaaagcugcuuucagggcagccuggcuccccggggagacucccaagccccccucagagaaggucuguggcauggcuccuggggggcgcagucuggggugguuuuauauuuagcugggcuguggcugugguugccacucggguuacaucuggcacagaagucggcagugccagggccggcacgggcuccuuuccagcaccgcggcagaauuugaucgcgcuugcccggcccagggcugcuucccguggggaggucgguggugggggcugacggccggcagcuggggcugcuggccaccgugggcagagccgaguggcagggcugguggcaggcggcauggacuugaacuugagcuuguuggcccgggaggccaccccaggccuccucccuggccucaaugggcuccccaggcccacacccccaaagguggccaagaaaccuaaaaaggcuguucucuucuucgagguggagauucuggacgcaaagacaagggagaagcuguguuucuuggacaagguaggacuggggcgugggcugcacugggccaagggcacugggcccgggaccccaauccuuauagcccaggagcuguccaguggggcccuuugugccccacccccugcccuauggagggguaugcccucacuugggguaggguggauagccauguccccuggguguggcggggaaauggaggcacaggagucucaguggacccugcggggauuuugguccugggagggcgguggaggagugagccuugccccugcugaggccgggccugggggaaggggcuugcgcugucccuggggaggacagagggccuuugcuccugggagagucaugggugagaaguggagaggaggggcagagaagcaggcuugccuucccaugcuuaauccgccacuagccgggcugggggccugcuggcugaggguaaaaguggagccccagaccccugcugucacugcacuggcagggcccucggugguccuucccugacugcaggcagaggccuggaccccagcccuucccccuucccauagcuacagcccaacccccagccugccauccccuuuaguaccuccccauccugagucugggcuccccgcagagcugacgucccugcgccugugcuucccccagguggagccccacgccaccauugcggagaucaagaaccucuucacuaagacccgugaguucuagucccggccacacugccccugcaaccccuuugaccagggaccuuagggugggagggaucccauccugcaccccucucccaggggccugcagagaugccccaguguggcccaggcuucuggggcgugacuggggcaggcgccuccacguggcacuccgcaggaacgcccuugcuaggcucugggaaggacaagauccugcuucugcccgcgcucuucuggcuuguguccugaaaccgcacaagccugaggguuugcccccaggugggaggagcuguggaguccugggguccuugcacccugggaacccugagaagcuggcacaguggcugggcagcggaccggcugagcccugccaggcugugggcuguaacugcccuguucuccccgcagauccgcagugguaccccgcccgccagucccuccgccuggaccccagugaguacagcuguccacucggcccgcccccugggcuccuggguggcagugggagaaggcccggguagccccugagcccuggcccgccucucugcagagggcaagucccugaaggaugaggauguucugcagaagcugcccgugggcaccacggccacacuguacuuccgggaccugggggcccagaucagcugggugacggugaguccugacccuacccacggccucuuuucccgucagccacguugggugacucaucuugccccccucuacucucaggucuuccuaacagaguacgcggggccccuuuucaucuaccugcucuucuacuuccgagugcccuucaucuauggccacaaauaugacuuuacguccagucggcauacaguggugcaguaaguggggcaggugggaggaggguaggggaaggcagaagaccugccggaccagccccagcugagccugcuccccccgaccagccucgccugcaucugucacucauuccacuacaucaagcgccugcuggagacgcucuucgugcaccgcuucucccauggcacuaugccuuugcgcaacaucuucaaggugagagcccguccccgccucaccccuaagccccgccuuucugccccaccccgccccgcccccaccgagccccaccccaaggcccuuccugucugccacuacgccccagcagagcccuaccccuaggccccgccuaaccuccccagccccgcccucgcagagccucuagaccccgcccguccuccccagccccgcccccgucgggccccuaggccugccuauccacccuagucccaccccuaggcaccgccuauccccccagccccgccccugcagagccccgccccaguuucaccccuaggccccuccuguccaccacgcccucacagagcccugcccuagccucaccccuuggccccgccuauccuccccagccccgccccaaggccccuccuguccuuucccaccaugcucccaggccccucgggaugagacaugggcagcaucugccuuguccggugcuggcccaagucccaucccugcccugcucccuuucagaacugcaccuacuacuggggcuucgccgcguggauggccuauuacaucaaucacccucucuacacucccccuaguaaguggccucagaccauccuucccucccccacgguccccacccagcggguccuccccucaugggcuccccucccugcuuccucuucagccuacggagcucagcaggugaaacuggcgcucgccaucuuugugguaaggaggcuggguguggggacggggucgggggagucugggcggcccuaggcugauccugcuucucugacagaucugccagcucggcaacuucuccauccacauggcccugcgggaccugcggcccgcuggugagugccugcugggggcagggggacagcugggcugggugagggggucugacuuucuccuucuguccugccugccaggguccaagacgcggaagaucccauaccccaccaagaaccccuucacguggcucuuccugcugguguccugccccaacuacaccuacgaggugaggggcugccuuaccccucucugcccugggacuuggggucccauguggagggaccagccccuaggauggggcgccuggcugggcagcugcuuuugccgccugcacugcgagcauugggagguggagaccgcggccucucugcugugguggcggggaggcgugugccgcugggcuuccgccguauacagccccgccuccgcuggaauuggguucccaucccugacucagaaagcaggggcggcgggagguggcuggcugaguccaggacagccacauacacggguugcgaggcugcccacgcucacucuccgccccugcccacaggugggguccuggaucgguuucgccaucaugacgcagugucucccaggugagccugccgcccucccucggcggggcccugccccuccgggccggcagccccucccugacgcccguucuuuccugcaguggcccuguucucccuggugggcuucacccagaugaccaucugggccaagggcaagcaccgcagcuaccugaaggaguuccgggacuacccgccccugcgcaugcccaucauccccuuccugcucugagcgcucaccccugcugaggcucagccccucaacccgguggcauucugggggaggaguggggcccacagcucuccagcacccggaauaaagcccgccugccccagucgga

SEQ ID NO: 191911 - RNA, 18374 nt, Homo sapiens
uccaacagcagauagauucuuuauguucaagacagcaaauucagauacaaaaacccaccgccaucgucccucccucccuccugcucugggccagggaugggccuggaaggagagaugggagguggggaggagguugcgggguucacagcagacucgugucaaaugcggagguaacaggcuccacagggagggggcuccucucaggaggggugagggcauuauugcauuugcuggggggaaggacaacccucuccccuguauucccugcgucaggaaacuaggaaggucaugacccccaaacagaacccaaggccccagggagacagagggaccaguuuggcagcugaugguggaaagugguggaggcggggguggccgcccaauuuggcugaucccuccccucccugugccugacccagcugagguagguggggaacagggcacaggggggccggggaccccggccagacugggaaccagggaggggaugguaccgauuggagcggggcagggggccuggccccaccuccccucaccaucguccuugggcugcugagcuaggcucaggcuggaggcucggguccugacgucagugucccugcugggggcccccaccagguugcgcccgggucaucaucgcaggguccgggggcaguccuaguagcggccgaccuuggcguccccaauggcgccccagacgucaaagacgaacucgucagggaaggcaaagucacccagccguucguccagggccucggccagcucauccggguuccuuuuguccuuucccagcuccaccaugguggccgcuauugggggaggggucagaacggaggcacaaaugacaccagggaccaaggggcucaggguggauucggcccccagcagaccuagaugcccccucccccaggcagcccucacucacccagcuccgugucccugauacccauguaacucuccagcaggucauccaccuucucaauggccuucucuucaaaggcagagggcugggggccagggaggggugacagcgacaucauaacaaugugaauauacauaguaauuggacggacugccauugucaccacuuuacauauauucguauuuagaccucaggacaacccugagaaggugguaucgguguucagcucauccccauuuuacugaugggcaaacugcggcccaugugcccaaggaaggucccugggagcugggaaguggcagaaguggacuagaauccaggcugucugcccagaguccccucagcuaacagguaaugcugccgguuaugaaaaggaagggagggcugggcgcgguggcucaugccuauaaucccagcacuuugggaggccaaggaggcuggaucaccugaugucaggaguucgagaccaacuccuggccuggccaacauggugaaaccccaucucuacuaaaaauacaaaaaucagcugggcaugguggugggcaccuguaaucccagcuacuugggaggcugaggcaggaguaucgcuugaaccugggaggcagagguugcagugagccgagauugcaccacugcacuccagccugggugacaagagugagacucugucucaaaaaaaaaaaaaagaaagggaagggaugccggagauaggguccggcuggagcacucaccagauccuccaccguggcggggccccgggaucggagccgcagggucccucggccagugcccaguugugggccagagccagggcggccacccgcugaacgcuggcugaucaugucugugggaggcaggagaggagugagugugggggaagcuugguuuuagcacguucugggcaggaacuuguccuuccuggcuuucaccaccaccccaaacuucuccaggcuucugcaaguuucugggggcuggggccggggugaucccaggagggcaggaauccugacucaggccuggcauggauguggggcagagcagggggaacagcugggggccaggaauaggaaaugcuggaggggagacuggaggggccacuucugcucccaggggcugggggacaggaagcagguguaccccagccugagucuccagcugccugaguccgucuccucuuggccaaggggguauggcugcugggccacagaccagcccuaccugcccagggaagugauuuagucccccacccccaccucaggggccuggggcccauuccugagaguuagugaagccagauggaaaagugggggggcuggcacugagcagucaagccuggccuguuggggauagggggcuggccagggcugagggcgcuuggcugggcuaauggccccuggaagcuaggugugagggcaacuuccuccucgcccccgcccuucucccaggcugggccaagggccagcaccccgucuggggucgggaggagcugcaaccccuucccuuucugcaaccccuucccuuucggcaggccaggcuugggcgccaccugcuggccgcucccggcaccaccgccugcgcccaugcgagcagcgccacuggggagguccagggggcggcuccucaccgaaggccuugcgaggcuccgugagcuucagcgugaagguacggccucggggcagcuccuugagcagccgggccaccucguagugccggcagcccagcaggcucugcccguuaauggccucgaucaugucgcccacgcugaugagguggauguggucgaucacgcugcccuccuugaugcgcugcgggggcggggagucaucagcccuuggggcucugcccugguuuccggggucccauggcccacccucacucccaggccuccggggugccccgucuccccaggcaccuugaugaaggcguagccagccccguuguccgugauggugagcccgagugcauccuccgacuugaacaccuccaccuccuugcgcugccccuucacgugggcgaagaugaaguccuccagcccgaucuggccccccaggagcuuguccauguccacuuuguggguguucagggugcagaacaucaccugcaggggugggagacgcugaaaccucuucccccucccucccccuuuucuaaucaccacuggagggcgaagggagagagcugggagaggacuagggggauuccaucccaguaacucaucacccacugagccugagccagggccacagcagggcccacauuagcgugucagcucugcuaggacuaggauuuaguuuuccuuucucuuuuugagacagggucuugcucugucacccaggcuggagugcaguggugccaucauagucacugcagccacaaccucccagauuccggcaauccucccaccucagccucccaaguagcuggaacuacaggugcucgccaccaugccuggcuaauuuuuguauuuuuuguggagauauggggucucacuauguugcacaggcuggucuccaacuccugggcucaagugauccuccugucucagucucccgaguagcugggaccacagacacgugccaccacacccacauaguuaaaauaauuuuuuuuagagaugggagccucauuauguugcccaggcuggccuggaacuccugagcuccagugauccccccaucucaaccucccaaguagcugggacuauaggugugcaccacuguacccagcuaggauuucgguccuagcaaaaauucauugcugugccaggugcgguggcucacgccuguaaucccagcacuuugggaggccgaggugggcagaacacgaggucaggagaucgagaccaaccuggccaacauggugaaauccugucucuacuaaaaauacaaaaauuagcugggucugguggcgggcgccuguaaucccagcuacucgggaggcugaggcaggaaaaugguuugaacccaggagguggagguugcagagagccaagaucgugccacugcacuccagccuggugacagagcaagacuccaucucaaaaaaaaaaaaaaaaaaaaaaaaaaaauucauugcugcuuucagggaacggagccuggcacacagugagugcucaggaaaugcuuguggaggacacagaaacucaucccacuuagggagaccccugcgucuacuucuugcucaaacccacuauugcccuccuugacccccucccaucuauccccacagugcuuggcaccaggcaagccugccucccacagcguugaguuucuccaaggcaucacggagaagugcaucucguaucuggccucuagccuccaccaucucauggggcacuggccucccaaugccugacaggaacucagcauccagcccuggccaucagcucccacagucuguagaggugcaggccucucagugucugaugggaacucagcauuuaacuguggccaucagcuccccacaaucuacuggggugcaggccucccaacgccugaugggaacucagcguccagcccuggucgucaguuuugcacaaucgacugggaugcaggccucucaauccauccauccaaucaauccauccagcccuggccucccacaguccauuggagcucaggucucucagugccuguugggaacucagcauccaccccuagucuugcacaaucuacuggggguacaccccuccuaaugccugaugggaugucagcaugcagcccuggccaucagcucccacaauccacuggggcacaggucucccagugccugaugggaacucagcauccagcccuggccuccaguuccccacaauucacaggggcacaagccucccagugccucauggggacucagcauccagcccaggccauuggcccccaccacugaguggggcccaggcucagcaucugcagcuucagcaucugagccccagcucaugaacaggaugcaggcccagaccucugguccaccaucagggacccuggugcccggcuccccaguggauaccucggcaguuggcaggcggaaggccucggcgaucuugccauacagcuccuugacguuggugaagcccucgaugcggccagugggacugccaugggccagcuggguguggaacacgaggcggggccgcagggcugggggaggggggggcaagcccauuugggggccccccgacccaccuccgcccagaggcccuggcucccccacgcccagcccuccacggccuggcucagccuccucauuuuccacuagagggggcgccuuuuuccgccgccccagucccagcggcaugagcagcgagaaguggggucaccagaagaucugcaggacaggaaguggggcucagggccugggcagaggccuugggugccccucccacacuacucgaaccauacaggcccaaggaaauacucagagaacaaauuggccucgguugaaauccucaucucuuguauagugacaggacacuuauauaaaaguaauaauagggcugggugcgguggcucacgccuguaaucccaccacuacggaaggcugaggugggcggaucacuugaggucaaaacuuugaaaccagcuuggccaacauggugaaaccccaccucuacuaaaaauauaaaaauuagccgggugugguggugugcaccuguaaucccagcuacuugggaggcugaggcacaagaauagcuugaacuggagagguggagguugcggugacccaagaucgcaccacugcacucuagccugggugacagacuaaggcuccgucuauaaauaaaauaaaauaaaauaaaaagcucacaccuguaaucccagcacugugggaggcugagacgggaggaucacuugaggucaggaguucgagaugccugaccaacaugucgaaaucccaucccuaccaaaaacacaaaaaaauuagccaggcaugguggcgcaugucuguaaucucagugauucaagagggugaggcauaagaauugcuugaacccaggaggcagagguugcagugagccaagaucacaccacugcacuccacccugggcaaaagagcaagacucugucucaauaauaauaauaauaauaauaauaauaauaauaauaauaauaauaauaauaccagcuaggauuauugcuuugugaccuuccuuguguguuucauuuguuguugugacagggucuugcucugucacuuagacuggagugcagugguauaauuaaagcucacugcagccuugaucucccaggcucaagggauccucacaccucagucucucaaauagcugggcccauaggcacaugccaugaagcucagcuaaccuuuauuuuauuuuuuugagauggagucucacucuguccccuaggcuggauugcaacggugugaucuugacucacugcaaccucugccucucagguucaagugauucuugaagaagagacccugacucuuuuuuuuuuuuuuuuuuugagacugagucucacuccguugcccaggcuggagugcaguggugcaaucucagcucacucacugcaaucucuugccucccggguacaagcgauucucuugucucagccucccaagaagcugggauuacaugucugugccaccacaccgggguaauuucuacauuuuugguagagaugggguuucaccaaguuggccaggcuggucuugaacuccugaccucaagugauccgcccaccucagccucccaaagcgcugggauuaaaagcgugaaccacugugccuaaugcucagcugacguuuuaaaacuuuuugcaggccgggugcgguggcucaugccuguaaucccagcacuuugggaggcugaggcggguggaucacgaggucaggaauucaagaccagccuggccaacauagugaaacccugucucuaccaaaaaaacacaaaaauuagccgggugugguggcaugugccuguagucuuagcuacucaggaggcugaggcaggagaauugccugaaaccugggaggcggagguugcagugagcugagaccgugccauugccugggugacagaaugacacuccaucucaaaaacagaaaacaaaaaacaaaaaacaaaaaacacuuuuugcagagaugaggggucucaauauguugcccagagugaucucaaacuccuagacucaagcaauccuccugccucggccucucaaaagugcugggaguacaggaaugagccauagugcccgccuguaaucccagcacuuugggaggcugaggugggcagaucaccugaggucacgaguuggagaucagccuggccaacauggugagaccccgucucuacuaaaaauacaaaaauuagcuggccgugguggcgggcgucuguaaucccagcuacucgagagguugagacgagagaaucgcuugaaccugggaggcagagauugcagugagcugagauugcaccacugcacuccagccugggcaacagagcaagacucagucucaaaaaaaaauaauaaaaauaaauaaauaaaagagucagggucucuuauugcucuguccccaggcuggagugcaguggggugaucacgauaauggcucacugcagcuuuaaccuccugggcucaagccauccuccauucucagccucccaaguggcuagaacuacaggcauguaccaucacacccgacuauuuuuuuuuuaaauuuuauuguaggccuggugcgauggcucacaucuguaaucccagcacuuugggaggcugugagcagaacacuugaggucaggaguucgagaccagccuggccaacauggugaaaccacaucucuacuaaaaguacaaaacuuagcugggcaugguggcagacgccuguaguaccagcuacuggguaggcugaggcaggagaauugcuugaacccaggagacgaagguuggcagugagcagagaucgugccaaugcacucacuccagccugggugacagagauagacuccgucucaaaaaauaaauaaauaaauaaauaaacaaauauauauauauauauauagagagagagagagagagagagagagagagagagagagacagagagagggagagagagagaaaggaguucuuuuuuuucuuuuuuugagacagagucucacuaugucacccaggcuggaguacaguggcgcgaucucggcucacugcaagcuccaccuccaggguucacgccauucuccugucucaggcuccggaguagcugggacuacaagugcccgccaccaugcccagcuaauuuuuuguauuuuuaguagagacgagguuucaccacguuagcaaggauggucucgaucuccugacuucaugauccgccugccucggccucccaaagugcugggauuacaggcgugagccacugcgccuggcaaggaggugaucuuucucuguugcccaggcuggucuggaacuccuggcuucaaggagcuuuuggccucccaaagcucuggcaugacagguaugggccaccgugcccggccugugaccuuccuuaacccucacaccacacuguaacacagggaucacguuaugcuacaauuaugcccauugaacagaugagaaaauggaggcugaaagcgacuacgcuucuauuuuccucucagccacagucacuaacacugugugcaaaaaauuucugacucucccccuuuggaccaaacagguggauggcacuuccuggccuccuugugacugggcagauaaaugauuauuucuggcaaauagguugugagaggaaguggcacaugacauuucugggcugaggcauuuaagugcuggagccuccagagaucuaucuuucccaggcagggugaugagccacauuugauaugguggcgacucuaugaggccgggcccugaaugacuacggugaauggugcccccugcugagccgcaauggaaguguagcaggaagaaaaagcaaaucuuugcugaauucagccacuaagacuuuugggguuguuuucuacaccacauacauuuuuuuucuguuucuuucuugcuuucuuucuuucuuuuuuuuuuuuuuuuugagacagagucuugcucugucacccaagcagcagugcaguggugcgaucucagcucacugcaaccuccgccuccuggguucaagcgauucaccugccucaaccucccaaguagcugugacuacagaagacuccugaccucaagugauccacccgccucagccucuugaagugcugggauuacaggcaugagccaccgcgcccggcccgcuucuuuauuucucucuuucuccauucuccccucccuucaaacaauuuuuuuuuucuuuuuaguacuuacuguauucugugcaccauuuuagauacugucuucaauaaaaaaagcaagaucccugacuagggccaccauguucaguuacacaaguuguguacugugcaaaauuacuagaccaagguggcaaguaggacugaaauucggucugugcacugccugccaagcuauauuucuugguguggugucugccaggaggaagagaugccuuucuuuuuuucuuuuuuuucuuucuuucuuuuuuuuuuuuugagacagagucuguucuguguugcccaggcuggagugcaguggugcaaucuuggcucacugcaagcuccgccucccagguuccagcaauucuccugccucagccucccagguagcugggacuacaggugcacgccaccaugcccggcuaauuuuuuuuguguuuuuaguagagacggaguuucacuacguuggccaggcuggucucgaacuccugaccucgugauucgcucgccucagccucccaaagugcugggauuacaggcaugagucacugcacccggccgaagagaugucuuucuaauucacucacagaugcuauauaggcuagcuggggcucugcacaugaccuccagaaguggacaguccggaagaggaaaugcacagggagcagggaaauguguaaaugucuaauauaaauuuuuuccuuuauuuuccuuuuuuuuuuugacagagucuugcuguguugccaaggcugaggugcaguggugcaaucagagcucacugcacccuugcccuccugggcucaagugauccucccgccccagccucuugaguagcugggaccacaggugcuugccaccaugcccugcuaauuuuuuuauuuuuauuuuuuagagacagggucuugcuauguugucccggcuggucucaaacuccugggcucaaguaauccuccugccauggacuccuaacgagcugggauuauaggcaugagccacugugcccagccucauauaauuuuuaauagugauauggagacaaagcaagacaaguucuauagacaagaucagugagggcgucucugagcacgugaagcugaacuugagaccugaaccacaggaggaagcauucaugcaaugauuuggggcaagaacgucccaaguagagagaacagccaguagaaaggcccugagcuggggcugggcaugguggcucaagccuguaaucccagcacuuugggagguugagguugacggaucacaugaggucagcaguuugagaccagccuggccuacauggcaaaaccccaucucuacuaaaaauacaauacacaggugggcgugguggugcacaccugugaucccagcuacucgggaagcugaggugggagaaucacuugaaugcaggaggcggagguugcagugagccgagaucacaccacugcacuccagccugggugacaaaccgagacuccaucucaaaaaaacaaagaaaagcccuagccaggcgcgguggcucaugccuguaaucccagcacuuuggaaggccaaggcaggcggaucaugaggucaggaguuugaggccagccugaccaacauggugaaaccccgucucuacuaaaaauacaaaaauuagccagguaugguggugcaugcaaaccucaucucuacuaaaaacacaaaaauuagcugggcguaguggugcaugcuuguaaucccagcuacuccugaggcugagguugcagugagcugagaucacgccauugcacuccagccugggcgacagagcgagacucggucuaaacaaaaaaaaaaaaaagaaagaaaagccaagcccugaacugggcaugcaauuggcauguuugaggaacagugaggaggccugggggguuggaacagugagugaaggggggauagugagaacaugagggcagggagguaacagguugcuauguuuuccugauuuuuuuuuuuuaauggggucucacucugucguccaggcugcaguggagugaugugaucacagcucacuacagccucaaauuccugggcucaagcaauccuccugucucaaccuccugaauagcugagacuacagguguucacagccaugcccagcuaauuuuuauuuuuuguagagacgggucucacuacguugcccagauugguccugaacuccugggcucaagcaauccucccgccuuggccuuccaaagugcugggauuauaggcaugagcuaccacacccagccugcuaugguuuggauaagguuugccccauugaaacucaugcucgaacaaucgauuggcuaacgaggucgaugacgccaggcacaagaugcugggccuaccgcgguagcgugagggaagccgugcguucuguuccaaggcaucugugagcccauggaguauacaccaugagcaaagcucacccuccugaguugaaaaaauuuacggacaagaaguuuucauugaaauuaaaugguggcagacauguccaaggaauauugcggggauuugaucccuuuaugaaccuugugauagaugaauguguggagauggcgacuaguggacaacagaaaaauauuggaaugguggaaauacgaggaaauaguaucaucauguuagaagccuuggaaugaguauaaauaauggcuguucagcagagaaacccauguccucucuccauagggccuguuuuacuaugauguaaaaauuaggucauguacauuuucauauuagacuuuuuguuaaauaaacuuuuguaauagucaaaaauguuuuuucagauguucugaauauacaauauuagcucucauuccaauuuuuucuaacaugaauuuuccugguugacauugauuucaaaggguuuuauguauuaaagugacagaaucuuauuaaaugugaaacauggcaaggagaaaaaaaaaaaaaaagaaacucaugcuaaaauuugauccccaaagugguggugcgguguugggagguggggccuagugggaggugucuguguuauggggccagaucucuccugaauggcuugaaguagcucuggaagcaaugagugcuugcucucaagagcccggauuaguucuccagaacuuacaguaguuggccaggugcaguggcucacaccuguaaucccugcacuuugggaggccgaggcgggcggaucacgaggucagcaguucaagaccagccuggccaacauggugaaaccccgucucuacuaaaauuacaaaaaauuaggccaggcacgguggugggcaccuguaaucccagcuacuggggaggcugaggcaggagaauugcuugaaccugggagguggagguugcggugaaucaagaccgugccauugcacuccagccugggcaacagagagagacucagucucaaaaagaaaaaaaagaaaauacauuaguuaggccaggaacggugguucacgccuguaaucccagcacuuugggaggcagaggcaggcggaucaccugaggucgagaguucgagacuggccugaccaacauggagaaaccccaucucuacuaaaaauacaaaauuagcuggguguaguggcacaugccuguaaucccagcuacuagggaggcugaggcaggagaaucgcuugaaccugggaggcagagguugaggugagcugagacagugccauugcacuccagccugggcaauaagagcgaaauucugucucaaaaagaaaaaaaaggccaggugugguggcucacgccuguaaucccagcacuuugggaguccaaggcggguggaucacgaggucaggagaucgagaccauccuggcuaacacagugaaaccccgucucuacuaaaaauacaaaaaaaauuagcugggcgugguggcacacaccuguagucccagcuacucgggaggcugaggcaggagaauggcgugaacucgggaggcggagcuugcagugagccgagaucaugccacugcacucuagccugggugacagagcgagacuccaucucaaaaaaaaaaaaaaagaaagaaagaaagaaagaaaauacauuaguuaggccgggugcagggacgguggcucccgccuguaaucccaacacuuugggaggccgaggcggguggaucaccugaggucaggaguuugagaccagccuggccaacauggugugagccaaagaaggcuggugugagccacugcgcucagccuauauuuucuuauguaaaagggacuuccuggugccuccuauccaauggucucuuccagggggccaugcuggauucagcuuggccgcauccaaucuuuuuuuuuuuugagaugaacucucacucugucacccaggcuggagugcaauggcgcgaucucggcucacugcaaccuccaccucccagguucaagcgauucuccugccucagccuccugaguagcugggauuacaggugcgugccaccacaccuggcuaauuuuuguauuuuuaguagagaugggguuucuccauguugaccaggcuggucuggaacuccugaccucaggugauucgcccaccuuggccucccagagugcugggauuagaggugugagccacugcacccagccugcaccuagucucauguauccauuuguucaugcauccauucgucuguccccuaacacacccucucaucucaccugguccaucuccaugaucacuuaccuaaacuagugugguugccuccuguggguuucccagcuuccacccucacccccuacgacuucuuguccagacagcagccagaaugguccuguaaaacauaagucaugucgcauuugucucugcucugaccccuccccgggcucugaccucgcuggaaagaaaaaucagugucggccgggugugguggcucucgccuguaauccuaacacuccgggaggccgaggugggcaugagccaccacgcccagccauauauuuucaaaauuagccaggcgugguggcgggcgccugcagucccagcuacucggaaggcugaggcaggagaauggcaugaacccgggagguggaguuugcagugagccaagaucgugccacugcacuccagccugggugacagagugaggcuccaucucaaaaaaaagaaaaaagaaaagaccccucaucaucccuccaauuccgccagcucuacgcacugggaggcaggaaacuaaaaacaugaaucuggaaccuggcuucaucucuuaauagcugugugacuuugggcaagggucuuaaccucucugagcuccaaggaaaucaugcaugugcuuggaacaguccuggcacacaauaaggguugcauaaauauuggugacaauuacugcuacugccaucuuuuguuuuuuuuuuugagacggagucucgcucuguugcccaggcuggagugcaguggcacgaucucagcucacugcaagcucugcuucccggguucacgccauucuccugccucagccucccgaguagcugggacuacaggugcccgccaccaugcccagcuaauuguuuguauuuuuaguagagacgcuguuucaucauguuagccaggauggucucgauccccugaccucgugauccaccugccucggccucccaaagugcugggauuauaggcgugagccacugcacccggccuugcuacugccaucuguaccaagauucaagcuuccuccuuuucccaagaucccuacauccugaccaccaauucccagccuccuuacucucucucucugcccaccccacugcccugguucaugccagcuuccguguccccacccgugaggaggcauuaacagcagugaggaaagugagugaguaaugaaucugccugccacggccauaagaggcuucguggccuggguucaaaucccaccccugccacuuaccagcuguguggcuggggggcaagucacuucacaucacagggccucaguuucuucaucugaaaaauggguggaauuccugucacucucaaggugguuguggaaauccaaagagauuacccacguaucccaucuacacucugccucagacuccauuuaaggacgcuguugucauuacuaugggugucuccuccucugcccugcccugcccaggaauaucccaacccucucugccugccaauaccuacuccaggcccacuccuccaugaagccucccaggcuugccccagcaugcuggaacugccccugugguacagauggcucaggcccaugaacuuaauugcaugcugcccuggcagaacucuugucuuccagcuucaggcugucauuuaacuucaugucucuauuuuaaaacguaaaccagauggcaucacugcccugccugaaacuuuacaacaguuucccaccuucuggaagaaaaacugcaaucuccuuacugugacccacaaaccccugcagaaucgcugcucuggguucaucuucugcuccaaccaugugauuccaaacuugguccagccuaaagaccuuggccuugcccaucucucucucuuuuuuuuuuuucgagauggagucuugcucugucacccagguuggagugcaguggcgccaucucagcucacugcaaccuccaccuccuggguucaaacgauucuucugcccuagccuccugaguagcugggauuacaggcacgcaccaccacauccggcuaauuuuuguauuuuuauuuuguauuuguuuauuuuuauuuauuuauuuauuuuugagacggaguuucauucuuguugcccagguuggagugcaauggcgcgaucuuggcucaccgcaaccucugccuaccggguucaagcgauucucuccugccucagccucccauguagcugugauuacaggcaugugccaccacgcccagcuuauuuuauauuuuuaguagagacaggguuucuccauguuggucaggcuggucuugaacuccugaccucaggugaucugccugccucggccucccaaagugcugggauuacaggcauaagccaccacgccuggccuauuuuuauuuuuuuuugagauggagucucgcucuguagcccaggcuggagugcaguggcacgaucucagcucacugcaaccuccgccucccggguucaagcgauucuccugccucagccuccugaguagcugggcuuacaggcgugcgccaccacacccagcuaauuuucauauuuuuaggagagaggggguuucaccauguugaucaggcuggucucaaacuccugaccucuugacccaccugucucagccucccaaagugcugggauuacaggggugagccaugccccuagccaauuuuuguauuuuuaguagagacaggguuuccccauguuggccaggcuggucucaaacuccugaccucaagcaacccacccgccucggccucccaaagugcugggauuacaggcgugagccaccgcgcccgggcccccuugccugaucuuugcugggcuggcaccccuugcccacaacuacucucuacaguaccacccgcucauauuuuauucauagcaguuagugccaucugaaauuaucuucuuuauuuacuugcuaacuuguuuguuggcugcuuccuuccuuucagagugccaacuccucaaaaguagggauuuuguuuuguucacuguugcauuuucugugccaagaacagugccuagcacaugcacguagcaggugcucacuaaauauuuguagacugagugaaugaaugugucucagguccucguucugauugcucucugugcuccccauccuugaaacagcccccuaaacaugccugcugugcgguugccaacuguccuaggcuccccacuuucccuggcuccccucacaccugaacacagagaugaagagccacuucagcccggauauugaguguuugggcuggaauuucagcauccucacccccucauccugggaagggccugaaacuuagcaaccccacggccacacagaagcaguguggccagcaggaggaggggaaggggguuccugggagcacacagaagcuaggggaagggggaaaccacgcccaggcuccccguuccagcacaguguugcuuuggagagaaggagggaaagaggccucugauucacucuugaaaaaccggcuccuggguguuuccggggagaacgccuacuucccagccucggcccagguugccaggggggaacccagugggcccagaccccagcauccuggcccccugcagacgccacucucuucucuggacccagguaguuagaccugcccucuccagcucuggggagaagggaaaggagggcagcuuccuguuugaguggcugguaaagcaaaagaccagcagguguggcccugaugaugaguacgggguagggggugggagggguagggggccggagcuacucagcaacaacugagccguggaguuauugguauccagucuagugggugugacuccaguucuggacccuggggcaugaguuccagucccagaugugccaguuacuagcugugugaccuugggcaagucacuccaccucucuggguaggcugccucaccuuuuuuacaagaaggcacagcaccucccaugagguguuuagagucaauuauccucaugguaaaugccugacacggaagcucuccaauaaaugcuagcugagguggaguuuuucaugacgauuauuauucagaccgugguccucacugcgucccccccaaggcccuggaggguucagacgcgguuagcucaggggaagugcccaggaaagggucagaaacacugaccccgcgccuguccacgcugggauggggacaguccagccgggggacggggggaggggcaagcccagaaaccccagcccagcguugggaggcguuuguccccugcccgccagcaggaagggagcugcccccaccaccccccacccccgcuuccccugggaaggggccuccggcauccccgcgcgcagccuagaccuccagucgcguccacggcgccggccccacccugcaggaucggccggauccucgcaggcccgcgacccccgaggcccccggagcagacacauccuucucgcagaggccacucaccugcuccgccgccgccgccgccgccgccgccgccgccgcugccuccgccuccccgugcgcacccggcucggcccuccgcaaacuccagaccgggcc

SEQ ID NO: 191912 - RNA, 17120 nt, Homo sapiens
ucauucuaaaugaagugcuuuuaauuuucagaccaaacauuuuuaauauaaaaacauuuugauaauauacaaacagcaaucacaacagcauccacauggcagcaaggggaccagggcacagagagggggagcgggcuggggagggacaguuuucagggucccaguugcuucccuggcuugaaaucacccugguccuagcagaggacagguuaaggcugccagaggcagagggucccugacccuggcccggagacagacugcccaggcaggcccucugauaccaucuuccaaccauggcagccuccaggaaaagccagauccauuuaggagauaacaggaagguggcugugauugacaggaaaggcaacaugguuccucagcauccugcugaucacaccucugggaggggcugcuggauugaagaggaccuaagaaucuuccugggagcaggacagaaaugggaucuaagucuaccuacuaacuaacauucccgccugugacaccagaaagcuggagugggucugcucagauguacaggaagagaaaggaaugacaaagccuuuggcucagcaggacuggagccuugacaggcacugaccaagaaagccucuaggugggccagggaggucugugggaaagcuuuggaucaaugguacucaagggugcacaguggcacaguggccuuaguuagaauuuaugaagacgaaaagaacacaagucagaauuuagaacugaaguaccugcuucuuauaggccuguagaggaaaagcgagaucauccuucuggccaggacuaggggagacccaaggccuguucuuuccuaggggcugaguuugacagaccuggauugcagcugauggcccccaaaguccucuagaugggcccugcaggacucgcugggaggccugguugccccucccggcgugcugggacacucuggguuccugcaguuagaugcaguccauggaguucucagggaggaggccagggaugcagccagggagccccaagcccuugauaggagugcaguugagugggaggccgcagcccagggagggguccugggucucuauggccuccagccuguccauguuguugucccaguugauauggaagcgggucacccggggguucgaggccaagauguuccgcuggagcuggggcaggaagaggaacgucaacccuuguagguacgcccucuccuuggucccauagagccaggacacccccaaucacccaucucaagcccagcaagagcaaccuacauauggaacuccagaaaacaccuguggccaggaccuuauuuauuuauuuauuuauuuauuuuuugagacggaguuuugcuuuuguugcccaggcuggagugcaaugcugugaucucgucucacugcaaccucugccuuccggguucaagcgauucucuugccucagccuccuguguagcugggacuacaggugcaaggcaccauaccuggcucauuuucguauuuuuaguagagacgggcuuucaccauguuggccaggcuggucucaaacuccugaccucaggugauccuacagccucggccucccaaagugcugggauuacaacgcgugagccacugugccuggcccaggacuuuuuuuuuuuaagggacagucucacucuguuggucaggcuggaaugcaguggcacgaucugagcucacugcagccucaaacuccugggcucaagcgauccucccaccucagccuccagaguagagcacaccacccaugucuggcucauuuuuuuuuuuuuuuuuuuuugcggggguuagggacagggucucacuauguugcccaggcuggccuaaucuuaauucucuaagacaugccuuugagagacaaaggucuuuuucuccucuucuaacacaguacuguaagaacugaauauuacuugaaaaccuuaagaagugaccuugacucucaauuugaauggcugaacuccccccaaguauaaagaacggccuugugggaagcaggaaguggaaacaggccccaccugggagaaaucuggcuucaugggcggguucucacgcagcucaggguugagguacucguuguugacguaguagcccacucggaugaacuccuguccaugguaggugcaggugaugaggaccacagucacacccacggcaucagucucugggaugagggauggguugggggcgucggccuaggggagacacauccuaggccuuagcagugccacagccaugccucgaugucauuaguacaaagauucccaagcaucauguauuuacugagcaaaaaguaugcucucugcccucaguuuucuuuuuuuuacuucugccucucggguucaaacaauucugccucagcaucccaggcagcugggacuacaggcacacaccaccacacccggcuaacuuuuuuuuuuuuuugguauuuuuuuuuaauggaguuuugcucuguugcccaggcugaagugcaauggugcgaucucggcucacugcaaccuccgccucacggguucaagcgauucuccugccucagccucccgaguagcugggauuacaggugcccaccaccaugcccggcuaauuuuuguauuuuuaguagagaugggguuucgccauguuggccaggcuggucucgaacuccugaccucaggugauccacccgucuuggacuccuaaaguguugggauuacaggugugagccacugcgcccagccuuuuuuuuguauuuuuaguacagacgggauuucaccauguuggccaggcuggucuuaaacuccugacuucaggugaucugcccaccucggccucccaaaguguugggauuacaggugugagccauugcgccuggacuuuuuuuuuuuuuacacagggucuggccucccucuguuacccaggcuggagugcaauggcgccaucauggcucacugcauccuugaacuccugggcucaagcaauccuccugcuucagccucccaaauagcugggacaacggugugugccaacaugucuagccaauuauuuuuuguagagacaggguuucuccauguugcccaggcuggucucaaacuccugggcucaagcgauccucucaccucagccucccaaagggcugggauuacaggugugagucacugugcccagccaggaguugucaacugauggaaacacagaaucaaucccacaaaugacuacaaaacguugacuguggcagggagaggugcgugguacucuggaggaguguggugagccgggggacaguggcaugaagcugaacaggugaggcaggugguaucaggccacccgggggccagcuaagggauugggaaagggcaagagaguaagcaggagguuaagugccacaucacucuugugaucugaaaagaagccucuggcaaaguguggagccgugacaggagacuguaguggagcagaaggcuuacaccagucauccuggagaggcaguggacuuggcuuagaccaggcaguaaagaacagauucaggguguacuacugcaaacaagaccagccacguaauuggugcaaaauaaaaccaaugcaaaaugaaaacaccacgccccuccagaaaagcuauuagguuucagacggugacagcagaguaucgcaccaagugugggguccugugcagcugccuggguugcacacccaggaggccaguccugacuguugaguagauagggccugucaguggauuuaguagugguggcugaagggguuagauaggaugugguagcuuggauuagggcgguaacagcagugauggagguaagggaguguauccgagcagaggauccugaaaaaucaccuggagaacucagaaucuccauuuguuuuuucuuucuucuuuuuuuuuuuuuuuuuuuuugagauggagucucacugucacccaggcuggagugcaguggcgugaucucggcucacugcaagcuccgccucccagguucacgccauucuccugccucagccuccugaguagcugagacuacaggugcccgccaccaggccuggcuaauuucuuguauuuuuuaguagagauggggcuucaccauguuagccaagauggucucaaucuccugaccuugugauccgcccaccuuggccuuccaaagugcugggauuacaggcgugagccacugcaccggccuucuuuuuuuaaagagauagcuuuucccucugucauccagacuggagugcaguggugcaaucacagaucacuguaaacuccuggaacuccugggcucaagcgagccuauuuuuuuuuuuuuuuuuuuuuagagacagggucucacucuguugcccaggcucgagugcaguggcgcaaucucagcucacuguaacuuccgcccccuggauucaaauaauucucgugccucagccucccgaguagcuaggauaacaaaugugcaccaccacauccagcuaauuuuuguauuuuuuaguagagacaggguuucaccauguuggccaggcuagucuuuaacuccugaccccaagugaucugccugccccagccucccaaaguguugagauuacaggugugagccauggcaccuggccucaagugagucuucugcuucagccucccuaguagcuggcacuacaggccugcaucacuaugccugguuaauguuuuuuuuguagagacaggucucgcugucacccagaaugcagugcagaggugcaaucauagcucgcuguagccucaaacucucaggcucaagcaagccuccugcuucagccucccaaguagcugggacgacaggugcaagccaccacacccggcuaauuuuucuauuuuuuguagagaugggggucucgcuauguggcccaggcuagucuggaacuccuggccuuaagcaguccucccgccucugccucccaaagugcuggaagccaccacacccggccagaaucuacauuugacaacccagguggggugcugcaugagagccauuuaggaguuacaguccauccucauuauucauggguuccauaugugcaaguucaccuaccugcuaaguuuauuuguaaccccaagaugaacaccugcuugcuuucacagucacuugcagacaugcacagagcagggaaaaacuggaguuaccuaccaugccuguucccaccuagaguuaccuaccacgccuguucccaccugaggucaaacaaggcaacacucugucuucuggucucagcucucacugugaaugagcguccuuuccucagccuacuuagugcuuuuuuccauguuuugugcuuuuuguuggugaguuugcugucuaugauggcacccaacgguagugcugaagugcaguguaggauacaagaaaggcuuuauggaaaauaugcguauuagagaaguuucauucaggagaguuauagugcuguuggcugugaauucaacauaaaugaaccacuguauauauuaaauaagguaucuuuccuuuuuuucugagacagaguaucgcuguaucacccaggcuagagugcacuggugcgaucucagcucacugcaaucuccaucucccagguucaagcgauucucccgccgcagccucccgaguagcugggauuacaggcaugcgccaccacaccuggcugauuuuuguauuuuuaguagagacgggguuucaucacauuggccaggcuggucuugaacuccugaccucaggcgauccacccaccucagccucccaaagugcugggauuacagguuugagccaucauagccguccuggugucuuuucaacauaaacacacauacaaguuuacguauuaaccagcugacgaaaaugugacuuccaagaaucuaacccuguauuuccccuggggcaaugguucaguauucacuaauucaguguucgcggcaacuuuauagaacguaacucuuguaaauaaugggaauugccuguaaaucaguggcagcuuugacacagaggugggggaagggagggccugacggccucugagaggucagauaguuccugacaguagaacuaggauuugaaccugaacuuuuaaauuguuuuaauugauugauugagacugggucuuacuguugcccaggcuggagugcagugguguggucuuggcucauuguagcuuccaucucccaggcucaagugauccucccauuucagccucccaaguaucugagacuacaggcgcacaccaccaugcucugcugauuuuuacauuuuuuguagagaugcggucucacuauauugccccagcuggucucaaacuccuggccucaagcaauccucccaccucggccucccaaagugcugggauuacaggugugagcaacugugcccggccucuauguuuuuaauacuuguuuuuuucuuuuuuagagacagggucucacuguguugccuaggcuggagugcaguggcucacugcagccucagacucccgggcucaagcaauccucucaccucagucccuggaguagcugggucuauaggcgugagcccgugcccagcugaacuugaacuuuugauuccugaagcacucugugggauuucagguaaaagaggauguuucuaggaaucaagggcuaaggccuaaggccucaucuuucuuaccugaaagacaaacaugugucucccugcuggcacagggcccaccagcaccgagucuaggaucugaucaaauuccucacucucagccgagccaacauaaaugaucuuccacuccaggucugcaaagauauaggaggguuaacuaauugaaauagcucaacagcaagaaggcagggauaggcucuuguauuuuuuuuuuuuuuugagauggagucucguucugucacacagguuagaauacagugaugcgaucucagcucacugcaacuuccgccucccagguuccagugauucucauaccucagccucccgaguggcugggauuauaggugcccgcugccacgccuagcuaauuuuuuuuuucuuuuuugagauggaguuucacucuugucacccagguuggaguacaauggugugaucuuggcucacugcaaucucugccucccagguucaagcgauucuccugucucagccuacugaguagcuggaauuacaggcaccugccaucauggcuggcuaauuuuuuuauuuuuaguagagacaggguuucaccauguugaucaggcugguuuagaacuccugaccucaggugauccacccgccuuggccucccaaagugcugggaugacaggugugagccacuguaccuggccuguuuuuguauuuuuaguagagaugggguuucaccauguuggccaagcugguauccaacuccugacuucaagugaucugcccgccucagccuuccaaacuggugggauuacaggugugagccacugcgcccggccacaucuucuauuuuauuuuuauuuacuuauuuuuugagacagucucccucuguugccuaggcuggugugcagcgggauguucauggcucacuguagccucaaccuccugggcucaagcgauccuccugccucggacucccaccauguugggaucacaggugugggcugcugugcccagccuugugguaauuuuagacagauccuuaauauguuaaaagacuauuauuccaucugucagacacuuagugccaggcacugcagucuugaaugcugaggugggcacaaagcucuaccuccauuagggaauucugucuuguaagccuagcuaugacaggugaccuugacuauaccucuggggaaaccugggccucucaaggccugagcgugaacuguauggcagaggcugaauuaagagccacgugacacagacgugcugagaagggaacggcagggaguugggucauuucagggcccugcccacugggugcugggauaggaagcagcauccucuuucacacacagggaccggugccacucaacgaaguggaucccucgacaacuggggcaggguggcagauuccaauccggcaggagagccagccugcaggagggggaaggugagguugcucagggagccagccacccuggucuuccagaucuggcaccaagucaugccuacuuagagacauuugggcaacucagucaacaaauguggcaucccggggugauccuccaaacacuuuuuuuuuuugacaguuucacucuuguuguccaggcuagagugcaauggugagaucucggcucacugcaaccucugccucccggguucaagugauucuccugccucagccuccugaguagcugggauuauaggcgcccgccaccacagccggcuaauguuuuguauuuuuaguagagaugggguuucaccauguuggccagguuggucucgaacuccugaccucaggucauccauccgccuccgccucccaaagugcugggauuacaggugugagccaccgugcccagccucaaacccuaacucuugcaccccauccagcaggagggcccccuccccugaauaugcuccauugagaugaaaggaaagugcuuauggaaccucuggcugucaaucacaggaaauuccggucaacauggccucuugcaggagguccaaguguaucaggggcaaggucaugcugguacagggaggcuuggcaagaggcuugaaacuuauuuuuggcucuuuagaaauuacacaacccuucagcucuagcagcugggggaaguuucacaagcugugauuuucacaggaagcaaacucucucagaagcugcccuguuccuugguccagugucccacaagagcauccaacuuuggaagcaugcugcugccaggucaugacuacagaggcuugucaccugagccccaugcccuucuuugaugcacuggcugccugucccuuugugguuucacucaggaacccuauagcaggucuguaggauacgggugaccauugaacucacagguguuuggucgaacuagccucuuacuauuugcagggaggaaguugacuuuuuucacuggagauggggucucgguccgucacccaggcugcagugcaguggcauaaucauagcucacuacagccacaaauuccugcgcucaagugauucucuugccuuagccucccaaguagcugggaccacaggcuugugccacacgcccagggaauuuuuaaauuguuuuuagagaugaggucuugcuugguugcccagccuggucucaagcaauccucccgccuuggccucccaaagugcuggaauuugucugagccaucauguccagccuguugauuuauuuuuguuacaaguagugacacaacuggaaucaaguuuugggggaagacagaaaagccagccagcccugcucucuccuuucuaaagcaguuguaucauuuugguguauauccuugagcccuuuccucucauagccgguagaauccuguacgggugcauuuaauucauguccugggaagguagacaaaaaagacuaaaguguacccacgagcaccugauguuguccagcugaggucaauacuaaucggcaaaaccuaaacaaagagcauguggaaacucaccgaaauaaaugggccccugcaacauaggcagacucgacucuauuaaaaaucaacaaaauuaauugggugugguggcgcgugccgguggucccagcuaugcgggaggcuaagguuggaggaucgcuugagccuaggaguucagggcugcagugagccaugaucgagccacugcauuccagccuggacgacagagacccuaucucaaaggaaaaaaaagaaaaagaaaaaauguacuguguugacugucaggcacaggggcugaaauggcucuuucaaccagggcuggaaagaaacuggagaauuaacuaacggcuguagagaaauacugacucaagaguuacagaagcugguugggcacggcagcucacaccuguaauccuagcacuuugggaggccgaggcaggcagauugccugagcucacgaguucgagaccaaccugggcaacauggugaaaccccaucucuacuaaaaauauaaaaauuuagcugggcaugauggugugcaccuguaauuccagcuacucaggagucugaggcauaagaacugcuugaaccugggaggcagcagagauugcagugagccgagauuuugccacugcacuccagccugggcaacagagccagccuccgucaaaaaaaaaaaaaaaaaaaaaaaaaaaaaaaagaagaaagaaggaaagaaaggaagaaaaaaagaguuauagguauagggccaggugagguggaucauuggaucauggcuguaauccuagcacuuugggaggcugaggcggguggauugcuugagcucagaaguucgagaucagccugggcaacauggugauacaaaaaauacaaaaaauuagccaggcgugguggcaugccccuguagucucagcuacucgggaggcugagguugcagugaacugagaucgugccucugcacuccagccugggugacagagugagacuccaucucuacuaaaaauauaaaaaauuagcugggcgugguggugugcaccuguaauucuaauuuauuuuauuuuauuuugacauggagucucacucuguugcccagacuagagugcaguggcacgaucucggcucacugcaagcuccgccucccggguucaugccauucuugugccucagccuccuaaucagcugggacuacaggcaccccccaccacgcccggcuaauuuuuuuuucuauuuuuaguagagacgggguuucacuguguuagccaagauggucucgaucuccugaccuugugauccgccugccuuggccucccaaagugcugggauuacaggcaugagccacuaugcccagucgagaaucaucuuaaauuugcugaagugcccaggcauggugaugugcaccugugguuccagcuacuuaggaagcugaggugggaggacugcuuaagcccaggaguucaaguccagucugggcaacauagugacacccuaucucuuuaaaaaaaaaaaaaaaaaucuggcugcaguguuauaaguagagacauacguguaugauuucaucucuaaauauaaucuuucuuuagaauuauacaugggacacaaaucaccaauacagcaggaacucauagcuaugaguacaggacacagcuguacacaugacguguguaccuaaccuucugagcaaugucaaggcaacucaacugugucccauguuaucucucugcgcuaacuucacaagcuagucccugugcaagacauaccuccacuguguguuuguguguauauauauauauauauauauauaaaugauaagacuaaagacauguacacaauuaguauagcugaacuagcuaaaaagucugcuuccugcuuuuuuguuguuguuuuuuugagacagucuugcucugucgcccaggcuggagugcaauggcgcaaucugggcucacugcaauuuccaucucccggguucaagcgcuucuccugccucagccucccaaauagcugggacuacaggcaccugccaccaagccuggcuaacuuuuguauuuuuaguagagacaggguuucaccacauuggccaggcuggucucaaacuccugaccucagaugauccaccugccuuggucucccaaaaugcugggauuacagggguaagccacugugccuggccauuuuuuuuuucuuuuuuuuuuuuugaaacagagucucgcucugucacccagguuggagugcaguggcacaaucucagcucacugcaaccucugccucccggguucuagcgauucuucugccucagccuccugaguagcugggauuauagcugcgugccaccaugccuggcuaauuuuuguauuuaguagagccgggguuucaccacgucgguuaggcuggucucgaacuccugaccuugugauccauccgccucggccucccaaagugcugggauuacaggugugagccaccacaccuggcuuuuucuuuuuuuuuuuuuuugagauggagucuugcuuuguugcccagguuggggugcaguggugcaaucucggcucgcugcaagcucugccuccuggguucacgccauucuccugccucagccucccgaguagcugggacuacaggcgcccgccaccacacccggcuaauuuuuuguauuuuuaguagagacgggguuucaccauguuggccaggcuggucucgaacuucugaccucagguaaucugcccgccuuggucucccaaagugcugggauuacaggcgugagccaccaugccaggccuccuuuguuuguuugcuuuuugccuuuguucauaaucaaagaugagcucugcugccauaacaacuucguuauuucugggucagaacaucuggcuucuaugacuuauucaaccagugucuguugaauuucucagcuaaauguggaagaaucuauuuccagauguggaagauaaaagugcaaagggggcuuggggccccugagaaauaggggucacccaacuggggcuuagggguuagggugguuuuuuuuuuuuuuuuuuuugagaugggggucuugcucucucacccagguuggagugcaguggugcaaucauggcucacugcagcccugaccuccugggcucaugcaauccucccacuucagccuccugaguagcugggaccacagacacgugccaccaagucccguuaauuuuuugauguuucuguagagacaagguuuugcuauguuacccaggcuggcccaaauuccugggcucaagagauccuccuuccuuagccucccaaagugcuggaauuacaggcaugagccaccucacacagcuggguuggggguuuugucagauuuucaguugacgcugcugagagugaggcagauucucccuuuuucauggagaggaguccagaaggaggcagaaagcaagcuggcagaucagucacagagagcccuaggacuggaagagccaggauuucucacuugaguuacucaaaggaaaagcuuuaucauccagguacaauuaacaauagcauucucuggccaggcgcuuaggauucaaaguguaaucccagcacuuugggaggcugaagugggcauaucacuugcgaucagguuugagaccagccuggccaacauggugaaaccucgucucuacuaaagacacaaaaauuagccgggcaugguggcucaagcuuguaaucccaacuacuugggauacugaggccggagaaucgcuugaacucgagagguggagauugcagugagcugagauugcaccacugcacuguagccugggugacauagugagauuccauuucuaauaauaaucaucaucaucaucauaaucauacgacgggcacgguggcucacgccuguaaucccaggccgaggcgggcggaucacaaggucaggaaaucgagaccauccuggguaacacagugaaaccccgucucuacuaaaaauccaaaaaguuagcugggcaugguuucgggcgccuguagucccagcuacuugggagauugaggcaggagaauggcgugaacccgggaggcggagcuugcaaugagccaugaucacgccacugcacuccagccugggugacacagcgagacuccaucucaaaaauaaauaaauaaauaaauaaauaaauaaauaauaauaauagcacuucccuucacugcauuuugaguguccugauuaggcaauaaauucuguggucauuccuaucuaugcuccaccccugaaacagggaauccuuccuuucuuucccuggauuggagcaaagauaaagaauuuagauucaaaacuucagugccaauacuucuacaaacuggcugugugacucuggugaagucacuccauuucuauuaaaaaaugaucagcagaggcuggacgcaguggcucacgccuguaaucccagcacuuugggaggcugaggcgggcggaucaccugaggucaggaguucaagaccagccuggccaagauggugaaaccccgucucuacuaaaaauacaaaaauuagccaggcgucauagcaggcaccuguaaucccagcugcucgggaggcugaggcaggagaaucgcuugaaucugggagguggagguugcagugagccaagaucgcgccauugcacuccagccugggggacaagagcaagacuucaucuccaaaaaaacaaaaaaaggaccagcagguugaauuuagcccuuccggcucuaauucuauaaauaaguuaguaaagucacagggcaggggcuuccuaggaguagaaguaccagauaaugaccgcacaaccauuuuuuuuuuuuuuuuuuuuuuuugagacggagucucgcucugucgcccaggcuggagugcaguggcgcgaucucggcucacugcaagcuccgccucccggguucacgccauucuccugccucagccucccgcguagcugggacuacaggcgcccgccaccacgcccggcuaauuuuuuguguuuuuuaguagagacgggguuucaccguguuagccaggauggucucgaucuccugaccucgugauccgcccgccucggccucccaaagugcugggauuacaggcgugagccaccgcgcucggccacaaccauuuuuaaaugcaaggaacacaaacaggcugauugaaaccugaucuccugccgucggggagcugggaaucccucaaccuauuacuuccuuccaucuccuccuggcuuuuaaauuaaaucuuauuccacagcgucauucuacacuuuauuuauuuauuuacccgcugccuuguuccagaaaggauuuaacucggcauauucuauaguuagccacaaguagacuccuuaauuuaaaaaggagcgagagagaccggggagagacagacccacuggccuacccaaagcacauccacaucucacucuaucagcuccaagcuaguccaggcgaccagcuuugagggcaaaacaccuaccugcccccgagaggcacuaguuagcauauccuggcuucacaggcccccagaucaccaccuccucggcugcugccuuuucucuuucaaccaccaaguagaaaaauggccuaauggaguacuucuuccugaaagcaggacuugccuguuaguggugccaaggcucccuaggugaccuuagauuuuggauuuguacaggccuugacuugaaaggucuuuugcguuuuguggcuccugucuucucaucugugagaugagagccaugcccaccuuuaagucacacagauuaauaaguacaucuacggaagcaccuuggaaaagauguacaggaggcugugaccuccaagcuccagccgacuguuugaagcuggagcccgucacagcucagcccaauccacccaccccccagacuaggucagaccaucaaaagcaacgggagcuuggcacugauuauccagcuauauuaaaaaaaaaaaagaagaagacggggcacgguggcucacgccuguaaucccagcacuuugggaggccaaggcggguggaucacuugaggucaggaguucgagaccaaccuggcuaacauggugaaacgcugccuccacuaaaaauacuaaaauuagcugggcguggugacaggcgccuguagucccagcuacucgggaggcugaggcagaagaaucgcuugaacucgggagguggagguugcagugagccgagaucgugccauugcacuccagccugggcaacagagugagacugucucaaaaaaaaaaaaaaaaaaaagaagaggaagaagaagaaagaaaaagugacagaaaaauugcugcaguaacucagcuggaaacgggugggcaaaccuggagaacuagcuaaugccugccuggcuaugccaccccucggaucucaguguguuuauccaagcccacagagaaagguggggaaggggagcuggggagacaaaguuccccucaaagacgguagcauccuuucccagggagagcucaagcauagggggguugggccccaacgaaggagagaaaccagguuccaggguaugugcauuggggcagaaaagcggcagcaacuggugggcgugggguuauugaaauauuggcagguuggggaggggacuggugggacacaaaugggaagaugggguugagagagguccugaaaagggguugagggguuuucacaggaaaaaaagguuacuggaggggagggucuucacggcaaggagagaggagcuugggugagaggucuccauagggaaaauaggagauggcugggauuucccccggggaaaaugggaaggggcuggauauugggggucuccagagggaaaaugggaggugugaguaucucacuacaggaaagagggaauaagugggcaaaaaugggugggugguugaagcgggggucuugccacagggaaaccacgguggcugaagaucuccguggguuaagaaauggaggccgagaaggucuccccaugaaaacggguaccuaggaagagcuccagagaaaaaagauggaugagguuccccacgcgggaaauggggcuuggaggggguuaaucucuauggggaggucggggcgggcagugggggaagaggccacugggagguccgaguuagcuggcggggggucuccacccgggaggucaaggcgggcagugggggaggaggucacggggagguccguguuggcugguggcggggggucuccaccgggagauccgguugacuggcgggcugggggagaucgggguuggcggaagggggacgagggguuucaugggggagaucaaguuggccaugggagcgguucucugaggggaggccggggucggcccggggguggggguccccgcacaggcccagccucaccguccgccagggcuucacugcacucgaagcugaucucgaaccggaaggggcuguggaaagggcucggguucuccaggaccgccacguucagcaccgacaccuuggccaucgccucgccucgccgcgccgcagcaggggcaggggcuguggcuguggcggaggccgcgccuggguccgguggggucagugggguagggcugaccagguccacucccgccucuucucuccgagaacugaagugcgcaccuaguccgcgcgccgccuucaaauagccggccucc

SEQ ID NO: 191913 - RNA, 36771 nt, Homo sapiens
uaaaggggccgcaucacccugccggcccggcgcgggucgggggugggugcgguaggggucccggggcggccgagcgcagaggacggacgggaaggagggcagggggcgcgggagccggcgaagcggagcgggcaucggaccgagccccccaaagaggccccgccccggcccuggccccggccgggccggauggaaccccccgcggccaagcggagccggggcugccccgcgggacccgaggagcgcgaugccggggccggggccgcgcguggccggggccggcccgaggcgcugcuggaccucagcgccaagcggguagccgagagcugggccuucgagcaggugaccgcgggggaagggggcgggggcagggacgcacccccagcaccuuccccaccugucuucuccucccccacaauccccagacuccagagcuaacccaaucagagacacccccugagauuccacccccaggacccuuaacccugccuggaaacacccccucauccuccuguuucuguccuucaaacccaguaacccacccccaucccuucucugccaucucugccccucagcgccccagaucccaaaucaggacacuuccuucuucuccuaccaaccccagaucucugagaucuggcccccauggcccgccuacaacccugggcaccccucuuuucccgccuuaucccccaacgguaccccucuuuucccaccuuaucccccaacgguaccccucuuuucccaccuuaucccccaacgguaccccucuuuuccuaccgcaucuuuauucgccaaucagggcaccccauucagucuucaauccucucuucggccccccgcuuggggacacccugucucccuccaucguagccucuagagacucacacuaccccauuccugcucuccagaucccuaccguacaccccaaguaaauaacucccccaucucuccagauuccagcucaagacaccccuuuuuuccccauucauuccugcccucgagccuccagauuccaccuguuccuuggggaccccucucuacuccuccagauuccucuuucggggcugcccgucuucuccuggcuugccgcagggauuacugaaaugccagggucccuccuccuccccaccucaucccccugaccuauccuaucucuucccauaggaaaacagcaggggcggagccugggugguggucccuggacaggugcaccuagaagcucucuucuguggcuucugguggcacugacaggaugucccagagcuggggcccuuuaaguccccuuuuucagcuucagugugggcccccaaggaacuggagacauggcccagacuugaacaggaagcacacacgggcucuauccucuguccagcuucagggggcguucuuuccugcccggccucucuggaguuaggaagucggccuggacggauggguuugggccaaguguggaugggcaggcucugauucauggacuggaaaaucccuccuuagucauuugccaacugucccugaggccugggcuggucauugccucucccacuuccccuagaaacccagguggaguaggggcuaaggagggccccuucauugcaugugagacacacagaacaaucugaaaaccaucuccgagccucccacaaaccugcccuggccaagccgagcccucagaguucuugacccacagaagcucauggaauccccugcaacccuuuggcaguuguucuuguucccacuuugaggaaacuggggcacagagaaguugagaaacuugcccaaggucacccagccagggaauagcaaguccagauuggaaggcaggcucagccagcucacuguauugcccagagcccacagcgguggccaggacacccccuccccuccuggggccccuucccagggauggggcauggaagggaaacugaggaacgacagagucugucuuaggaguugaaacaacucacagcucugggacccugaacaagugaauucaucccacuaagucucagauucucccagcuauaaaacagguucaugauuuaguaucaaugugccaucaaggguguucaaucuuuuagcuucccuaggccacacuggaagaagaacugucuugggccacauauaaaaugcacuaacacuaacaauagcugaugagcuuaaaaagaaaagaaaagaaaaucuuuguauuuauuuauuuauuuauuuaucugaaacgagucucagucuguugccaaggcuggagugcaguggcacgaucucggcucacuguagccuccaccuccuggguucaagcaauucucccgccucagccuccugaguagcugggacuacaggugugagccgccauacccagcuaauuuuuguauauuuaguagagaugggguuucaccauguuggccaggcugguuucaaacuccugaccucaagugauccucccaccuuggccucccucccaaaguguuggaauuacaggcaugagccaccgcacccggacguaucuuauaauguuuuaagaaagcuuacgaauuuguguuggccugcauucaaagcucuccugggccagggccguggggcguggguuggacaagcucacacuagguggcugugagaauuuggaaauuacauacauaaaguguucagcauagugugugcauucuuuucuuuucuuuucuuuuuucuuuucuuuugaggcagagccuugcucaguagcccagugaaacaaugauugcgcaaugacacaaucauaacucacugcagccucaaacuccugggcucaagcaauccuccugccucagccucuugaguagcugggauuccagacgcccaccaccacaccuggcuaauuuuuaauucuguguguguguguguagacauggggucucacuauguugcucacgcuggucuggaacgccugagcucaggcaaugcugccgccucagccucccaaagugcugagauuacagguguccagccaagaugggcaccuuaaucauuauuaucacuuuuuucuaacuucuuccugcuccaccaaagccuggugggugggaagaucucacaacagaaucccaagacccugcagcuaggaggauccaggagggaaaccgcaagaaaguucuagaaugcuaacuaugggccagguguuauuguaaguucuuuaagcucuuuacauccauacugcauauuuagucuccacaauccucaagagguuggugccguggaccuccccacuuuacaccugagaauacugaggccaagugacuugccuggggucacagugcuccuaaauaguaaagcuaggauucaagccucgguuucucuguuuuuuuauuuuuauuuauuuauuugagacggagucucgcuccguggcccagacuggagugcaauggcgcaaucucggcucacugcaaccuccgccucccggguucaagugguucucgcgccucagccucccaaguagcugagauuauaggugcaugccaccacaccuggcuaauuuuuguauuuuuaguagagacgggguuucgccauguuggccaggcugcucucgaacuccuggacucaagugcaccaacugccuuggccucccaaaaugcuagaauugcaggcaugagccacugcccugaccuauuuuuuuugagaugggaucuugcucuguugcccaggcuggagugccgcuggugcaaucauggcucacugcagccucaaacucauggccucaagugacccuccugccccacccucccagguagcugggauuccagaugcaugccaccaugccuggcuaauuuuuuuuauuuuuuuauuuuuuuaucuuuuuuuuuuuuuuuucgagaugcagucuugcucugucacccaggcuggagugcaguggcaugaucucagcucacugcagccucugccuuccagguuccagcgauuuuccugccucagccucccgagcagcugggacuacaggugcucaccaccacacccggcuaauuuuuuuuaucuuuaguagagaugggguuucaucauguuggccaggcuggucuugaacuccugaccucaggugaucugccugccucggccucccaaaaauccugggauuacaggcgugagccaucgugcccggccaguuuuuuuguaaagaugggagccucucuauguugcccaggcuggucucgaacucuuggccucaagcgauccucccuccuaagcuucccaaagcgcugggauuacaucaaccccaggcuccuaacccacuggcccuuccuacagguggaggagcgguucucccgggugccugagcccguccagaagcgcaucguguuuuggucguuuccacgcagugaacgggaaauauguauguacucgucgcuggguuacccgcccccagagggcgagcacgaugcccgggugcccuuuacccgcgggcugcaccugcuccagagcggggccguggaccgcguguugcaagugggugagucuuugucccccacuccugcuggggaggccaggagguccauaccaggccuggaaaugggggaguuggagggaggccuggggccaggggaugggagguuacagaccucaggcuucgaggcccagauaggauuguacaagauuuuuuuuuuuuuuuuuuuugagacggagucucgcucuuuggcccaggccggagugcaguggcgcgaucucggcucacugcaagcuccgccuccuggguucacgccauucugccucagccucccgaguagcugggauuacaggcgcccgccaccgcgcccagcuaauuuuuuguauuucuuuuuuuuuuuuuuuuuuuuuuuuuuuuuuuuuuuuuuugagacggagucucgcuuuuucgcccaggccggagugcaguggcgcgaucucggcucacugcaagcuccgccucccggguucacgccauucuccugccucagccucccaaguagccgggacuacaggcgcccgccaccaagcccggcuaauuuuuuguauuuuuaguagagacgggguuucaccauguuagccaggauggucucgaucuccugaccucgugauccacccgccucggccucccaaagugcugggauuacaggcgugagccaccgcucccggccccauuuuuuguauuuuguauuuuuaguagagaugggguuuuacuguguuagccgggauggucucgaucuccugaccucgugauccccccaccucggccucccaaagugcugggauuacaggcaugagccaccacacccagccuguacacgauguuuugagcaaaagcucaaggaucacccuagaacccaggcagcaggguuuagacaagggguugggggagaggauggugaaccagaaacaggggaggagagaucccagaacuuacacaucagagcccauguaaaggaggggugaggccagauguggugguucacaccugugaucucaacacuuugggaggccaaggcaggaagaucacuugaggccaagaguucaagaccagccugggcaacacaaugagaccuugucuucacaaaaaaaucaaaaaaugagcugggcaugguggcgggugccuguggucccagguacaugggaggccaaggcaggaggaucgcuuuugcccgagaggucgagccugcaguaagcuaugauugcaccaccguacuccagccuggguuacagagcgagaugcuaucucaaagagaaaaaagaaaaaaaaaaaggaagagaggugagggccacucuagggacaaggguagagguugagacaugguggugaaggugccagaccucaggcuucagguccagaugggguuggguucgggauuaugagcugaagguggaaagugcuccuagagcccuagaccucaggcugcugagcuggggaauggggaaugaaguagugagacggagagaagagcaggucccagcugaggaucagagaagcagcugucagccagcagugagaggaggcuccagaccucgggcugagggacccagugaugcuuugggccagggguuuagagccagagguaagaaugauccuagaccucaggcaguggggcccacgugggaguuggacacaaagauuuagagccacaggugagagucuuagaccucaggcagagaggcugggauuucaaaggcuuagagcuauuguugagcaauggucuuagaccuaaggcaacagggcugaggugggaauguagaguagaaguuuagaauucuuuuuuuuuuuuuuuuccgagauggagucuugcucuguugcccaggcuggagugcaguggcacgaucucagcucacugcaaccuccaccucccagguucaaggaauaccccugccucggccucccuaguagcugggacuacaggcacccgcuaucaugccuggcuaauuuuuguauuuuuguagagacaggguuucaccauguuggccaggcuggucuugaacuccugaccucgugauccacccgccucagccucccaaagugcugggauuacaggugugagccaccaugcccagcuuagaauuuuuuuuuuuuuuuuuuuugagauggagucucacucuguugcccaggcuggagugcaguggcacaaucucggcuuacugcaaccuccacuuccuggguucacaccauucuccugccucagccucccaaguagcugggacuacaggcaccugccaccacacccagcuaauuuuuucuauuuuuuaguagagacggcguuucaccguguuagccaggauagucucgaucuccugaccuagugauccgcccgccucagccuccuacagugcugggauuacaggcaugagccaccacgccuggccaaauuuuuuuuuuuaagagauagagucucggccgggcacaguggcucacaccuguaaucccagcacuuugggggcugaggcggguggaucaccuaaggucaggaguucagccuggccaacauggugaaaccccgucucuacuaaagauacaaaaauuagccaggugugguggcacaugccuguaaucccagcuacuugagaggcugaggcaggagaaucaguugaacccgggaggcagagguugcagugagccaagaucaugucauugcucuccagccugggcaagagagagagacucugucucaaaagaaaaaaaaaagggagauagggucucacucuguugcccaggcuggagugcaguggcgcgauaauagcucacugcagccacaaacaucugagcucaagugauccucccaccucagccucccaaguaguugguaccacaggcgcaggccaccacacuugacuaguuuuuaaguuuuuuguagagaccuggucucacucuguugcccaggcuggucucgaacuccugggcucaagagauccuccugccacagccucccaaagcacugggauuacaggcgugacccaccaugccuggccaaguaucagguuaagaucagcugugaagggugggcucagaccucaagcuaagaaaacaaaagggcugcagagacugggagagauguaaugagaauaguggaaaggccuuggaucucaggcagccagacucagaaagggaccaguagaggcugagccagaaaacaaaagugaggccugggacuccagaccucuggcugcagcaggccauuucucccagcuagaggucggggcugggcugauaugaugccccgucggcucuaucugcuuuggagccccuuugcugggacauggccccgcugaccacgggcuccuugccaccuccagcugguaugaggaagccaucucccugcaugacccaggcugggccugagcugccgaaccagucagaugagccuggcaccugggcugcccagggaggggcagggggagugaaggggacaccuggccccuggcuuacuucaucagccccucgccccaagcgccacgggucuuuggcauuuucucaggaaauugaggggcuccugaagcccuggccauauucauuguaacccaaggaaucagaaaaccaccuucaaugucaugguaugauacuauucauaauuaaaauaagagcaaguguugggcugggcucgguggcucgcgccuauaaucccagcacuuugggaggccgaggcggguggaucacuaggucaggaguucaagacuacacuaggucaggaguucaagacuagccuggccaauauggugaaaccugaucucuacuaaaaauacaaaagauuagccgggcaugguggugcacgccuguaaucccagcuacacaggaagcugagguaggagaaucgcuugaacccaggaggcggagguugcagugagucaagauagcgccacugcacuccagccugggugacagagcaagacucugucucagaaaaaaaaaaaaaaaaaagcaaguguuuacuuaggacuuaacuucauaccaacagcguucuaagccuuuuuuugagacagagucucauucuguuacccaggcuggagugcaauggugcgaucucagcucacugcaaccucugccucccggguucaagccauucuccugccucagccuccugaguagcugggauuacaggcgcccgccaccaugcccggcuaauuuuuuuauauuuuuaguagagacaggguuucaccauguuggccaugcuggucuugaacuccggaccucaggugaucuaccagccucggccucccaaagugcugggauuacaggcaugagccacugcgccgggcugucucuucuaaaaauacaaaaauuaggcugggcaccguggcccacgccuguaaucccugcacuuugggaggcugaggcaggcggaucaccugaggccaggaguucaaaaucagccugaccaacauggagaaaccccaucucuacuaaaaauacaaaauuagccgggcaugguggcgcaugccuguaaucccagcuacucgggaagcugaggcaggagaaucacuugaaccugggagguggagguugcggugagccgagaucacaccauugcacuccugccugggcaacagagcaaagcucugucccaaauaaauaaauaaauaaauaaauaaaauuagccgggcaugguggugugugccuguaaucccaguuacuugggaggcugaagcaggagaaucgcuugaaccugggaggcggagguugcagugagcccaggucgcagcacuacacuccagccugggccacagagcgagauuuuguuucaaaaaaaaaaaaaaugcaaagugagugaggugacuugugcuagugaagugacucggcugggcuuugcaaccgggucuugcuguguaccacaaacaccgccugucucugggaugacacggaugcgacaguuuggcuuugauccuaggauuccaccugagcggaaacauccgcgagccagggaguccuggagagcccgagcgccucuaccaugucuccaucagcuuugaucgcugcaagaucacguccgugagcugcggcugugacaaccgcgaccucuucuacugugcccacgugguggcccugucccuguaccgcauucggcacgcccaccagguggagcugcggcugcccaucuccgagacgcucucccagaugaaccgggaccagcugcagaaguucgugcaguaccucaucagcgcccaucacacugaggugcugcccacugcucagcgcuuggcugaugagauccuccugcugggcuccgagaucaacuuggugaaugguaagggcaccccggggguccgguggggagaggaugcccaagcgcacagccacgccacuugcugugugcccagugcuggucacuuacugacagaaaguugugggggcggggggcggaaaacgcgccauggccugcaucaucugaggucacccaccuggugaguggcagaucccagauaucuggacacaggacagaugaguaguugcaaaucagccuacgggcagagggcgagggcaggaggggagauccugcguuagagggcaagugggaggucuggccccagggcuggguaugucaauagauggagcauccuggguaugggaggagaagagggggcgugaagggaaugugggacguuugugggugucagagguguuaugggugaggggauacaccaggaggcguggugagggcugggaggguuuggggggcuccgaggggcuuggguugccuagcuaggauggggaaggugaguaguagguggaggcauggauggaugauggagggaggugcuggguggguacagaaaguguucgugauuggcugggcgcaggggcucacaccuguaaucccagcacuuugggaggccgaggugggcggaucaguugaggucaggaguucaagaccagccuggacaacauggcaaaaccccaucucuaccaaaauauaaaaauuagccgggcgugguggugggugccuguagucccagccacucaggaagcugaggugggagaauggguugaacccgggaggcagagguugcagugagcugacaucgcgccauugcacuccagccugggagacaaagugagacccugacuccaaaaaaaaaaaaagcguucaugaucagucacugagggcaacugaugguguggaaaaacgaaugggugggugggggauauuuuuuuuuuugagauggagucuuccucugucacccaagcuggagugcaguggugcaaucucagcucacugcaaccucugccuccuggguucaagcaauucuccugucucagccuccugaguagcugggauuacagaugcacaccaucaugcccggcuaauuuuuguauuuuuguagagacagggguuuccccauguuggccaggcuggucuugaacuucugaccucaggugauccaccugccucagccucccaaaguccugggauuacaggugugagccaccacacccagccuggacgggauauuaacaaugccguuaggugaaugggaauuggaagcugagugugguggcucauaccuauaaucccagcauuugggaggcugaggaaggaggaucacucgagaccagcaguucaagaccggccugggcaaaauagggagaccuccucucuacaaaaaauaaacaaaaguaguugggcaugauggcacacacacgccuguagauacuugggaagcugagaugggaggaucaugagcgugggagguaaaggcugcagucagcuaugaucgugcuacuacacuccaaccugaugacagacugagacccugacucaaaaaacaaaaaaaaaaaaagaagggaaggacagaacugguggugauuggaggugaggaugagugguuggguggggagggcuuugacuaguggaguuaagguagacugacagugguggacagaugaaguuagugaaagaaugaaagauccaauggguacaugcauugggagugaguugaugggugaauggaaggaagguucacauauguggaucaacaucgugggugggcagagugggugggcgcuuuguguaggguggauggauggacgaaugggguaguggguguuuugagagguacauaugaauggaugguuugauaaugaaugggugguuuaauggaagcauagagaguuaggauuaguuauugggugauaacuaauaguuaucaccuagauaacuaggguuaguuauuggaugauaguuacugggugggguggauaguguacuugugugggucaauggacaaaugggcggguggguauuuugagugguuaguucacguggauuggaaagauaaaaggggugagugggcagauagaucaauaagaugaguauauagauggguggaugggugggaauuauggguaggguggaugauggacccaugaugggguaggugguuguuuaaaggguauggacauguggaugaagugaaaugggggauauggccagguagauagaggcuggcaugacuuggguggggguggauaaguggguuguguuucaggugagacagaugaguaaacagaugggucggugguguuuugagugggauggguaaauggaugaguggauggguagauggauagauguguaguguuucaggagagauagaugaauggauuggauggguaaguaaauggaugaaugaacaaauggaugaaugagcuccugguguuuugggcaagauggauggauggauggauggauggauggauggauggauggauggaugaauauuacuacaggggagauagauggauuggauggaugacucaguggauaaaugagcaaauggaugagcugguggcguuuuggacaagauggauggaugcauggauggauggacagauggaugcauggauggaugcauggauggauggauggauggauggauggauggauggauggguguauggguguauggguguguuguguuucagguaagauagaugaauggauuggaugggugauguauuacucuguucucacacugcuauaaagacauaccugaaacagguuaauuuaaaggaaacagguuuaaucggcucauaguucugcaagcuacacaggcuucugcauuuggggaggccucaggaaacuuacaaucauggcggaaggugaaggagaagcaaacacaucuucacauggcugucaggagagagagagcgaagggggagacacuacacacuuucaaacaaccagaucucaugagaacucuaucaugagacaacacuaagggaauggugcuacaccauuagaaaccauccccaugauccagucaccucccuccaugccccacuuccaacucuggggaucauaauucaacaugagauuuggguggagacacagagccaaaccauaucagaugacuaaguggaugaaugagaaaauggaugcaugagcuagucauguuuaggacaagauagauggauugauggagggauggauggauggauaaacaugaauagauggucgggugggauggacaagcagaugggugggugggguuuaggugggauggauggaacuuuagacuggguugggugacuuggaagaauggauggaugggucgggcacaguagcuuaugccuguaaucccagcacuuugggaggccaaggcggguggaucaccugaggucaggaguuugagaccagccugaccaacauggugaaaucccgccuguacuaaaaauacaaaaaaaauuggcaaaguguaguggggcgugccuguaaucccagcuacuugggaggcuaaggcaggagaaucacuugaacccgggaggcagagguuguagugagcgaagaucgugcuacagcacuccagccugggcaagaagagccaaacuccgucuccaaaaaaaaaaaaaaaaaaaaaggacagcucuccucaacccaacccaaccccaacuccagccccagccucagcuuccuuucccucccucccggcaggugccccagaccccaccgccggcgcaggaaucgaggacgccaacugcuggcaccuggacgaggagcagauccaggagcaggugaagcagcuacuguccaauggcggcuacuacggggccagccagcagcugcgcuccauguucagcaaggugccgugcgggccggcggggcgcggggugcagaaggccccggcggacgccccagcccuuccucaccacccuguccccggcacaggugcgggagaugcugcgaaugcgggacuccaacggggcgcgcaugcugauucucaugaccgagcaguuccugcaggacacgcgccuggcccuguggcggcagcagggcgcgggcaugacggacaagugccggcagcucugggaugagcugggugaggcccaaaccccggugcgugguggacaccgggacuucggcucccaugggggcuggcccacuccaagauuagggucuguucccugaauccgcccuccauucguuuggcaaacauuuaugagcgccucuaaagugccaggcaugguacugggcacuggugguccggcagagaacaagagagucaaaauccuguucacguggaucugacaggaggcacaggcaaucaaaugucauuggcccagggguugauacacacguacacacguuuucuuuguuuugagacaggguaucacucuguugcccaggcuggcgugcaguggcacaaucucggcugacugcaaccucugccucccggacucaagugauccuacaccucagccucccaaguagcugggucuacaggugcacacuaccacauccagcuaauuuuuaauuuuuugaagagacagagucucacuaucuugccaagucuggucuugaacuccuggacucaagcaguccucucacccagccucccaaaguacugagaugacaugcaugagccaccacacccagccuacauguuuuguuucuuuuuuucuuuuuuuagagacaggaucucacugugcgcccaggcugaaguacaguggcacagucacggcucacuguaacuucaaacucuugggcucaagugauccucuggccuuggccucucaaagugcugggaugacaggcaugagccacuguaccaagcugacauauuuuuguuuguuuguuuucuuuucuuuucuuuuuuuuuuuuugagaaggagucucgcucugucauccaggcuggagugcuggagugcagugguacuaucuuggcucacugcaagcuccgcccuccggguucacaccauucuccugccucagccucccuaguagcugggacuacaggcacccgccacuaaguccggcuaauuuuuuguauuuuuuuuauuagagacgggguuucacuguguuaggcaggguugucuugaucuccugaccuugugaucuacccgccucagccucccagagugcugggauuacaggugugagccacggcaccuggccuguuuucuuuuuuugacacggacucucacccugucucccaggcuggagugcaguggcacgaucucggcucacugcaaccuccaccuccuggguucaaaugauucuccugccuuagccuucucaguagcugggauuauaggugcgugccaccaugccuagcuaauuauuguauuuuuaguagagacggaguuucaccauguugaucaggcuggucucgaacuccugucuucgugauccacccgccucagccucccaaagugcugggauuacaggcgugagccaccacacccagccaacauauguuuucuuuuuucuuuuuucuuuuuuuuuugagacggagucuugcucugucacccaagcuggagugcaguggcacaaucucagcucacugcaagcucugccuccuggguucaugccauucuccugccucagccucccgaguagcugggacuacagaggcccaccaccacgcccggcuaauuuuuuuguauuuuuaguagcaacgggguuucacuggguuaaccaggauggucucgauccccugaccucaugauccgcccgccucggcuucccaaaggguugggauuacaggcgugagccaccacgcccagccuuuuuuuuuuuuuuuuuuuuuugagauggagucuugcuuugucacccaggcuguagugcaguggcacgaucucggcucacugcaagcuccgccccccagguucacgcuguucuccugccucagccucccgaguagcugggaucacaggcgccugccaccacgcccggcuaauuuuuuguauuuuuaguagagaugggguuucaccguguuagccaggauggucucgaucuccugaccucgugauccgccugccuaggccucccaaagugcugggauuacaggcaugagccaccgcaccggccaacauguguuuucuguaagagacacagaguuaauguuauucagcccugcaggccaucuggucucugucaugaagaccucacucugucuauuauaguaaaaaaggcagacacagacauauauaccaaacgggcaugguagcauuucaauaaaacuuuauuuaagagcugggaggccaggugcaguggcucacaccuguaaucccagcacuuugcggggcugagguagggggaucacuugggccccggagguugaggcugcagugagccaugaucacaccacugcacuccagcccgggcaacagagcaagacccugucucaacaacaacaaaaaaaggcgcuuggcacaguggcaggagccuguacucccuacuacuuggaaggcugagugaggcaggaggauugcuugagcccaggaguucgagugcagcuuagacgacaugaugagacccugucucuaaauuuuuuaaaaaccggcuuuauuuauagauacuuacuaauuuauuugaauuuuauauuauucccacaaguugcaaaauauucuuuugguuguauuucccugaccauuuaaaacuggaaaaauaggccgggugcaguggcucacaccuuaauuccagcaguuugggaggccgaggugggcagaucacuugaggucaggagaucgagaccagcuuggccaacauggugaaaccccgccuuuacuaaaaaugcaaaaauuagccaggcauuguggcggacgccuguaaucccagcuacuugggaggcugaggcaggagaaucgcuugaacccaggagguggagguuacagugagcugagauugcgccacugcacuccagccugggugacagagugagacucugucucaaaaaauaaauaaauaaaaacaaguacaaauaaaaagggaaaaauaaaucuuagcgugcaggcuaaucaaaaauaaagggugguucaguuuucaccaugggcagugguuugcuaguucgcagaccccugcaugagauggugauaaaugcuacccaaaaaaccccaaaacaccuugagaggagucuggaggccugguuuuuuuguuuguuuguuuuuguuuuuguuuuguuuuguuuugagaucgagucucacucuguugcccaggcuggaguacaguggugugaucucggcucacugcaaccucugccuccuggguugaagcgauucuugugccucagccucccaaguagcuaggacuacagaggcccgggauguaaucccaacuuuuuuuuuuuuuuuuuugagauggaguuuugcucuuuuuacccaggcuggagugcaguggugugaucucagcucccugcaaccuccaccucccggguucgagccauucuccugccucagccuccugaauagcugggauuacaggcacccacaaucaugccuggcuuuuuuuuuuuuuuuuugguauuuucaguagagacagggcuucacccuguuggccaggcuguucuuaaacuccugaccucaggugauccgccugccucagccuuccagagugcugggauuacaggcgugagucaucacgccugacccucuaaucccaacuucuaacuuaccagcggugugacccugugcaagccguguuaugucucugugccucaguuugcuugucuguaaggugcaaaggcugcgaguugcaacuuccgagggucgaggugagggguuagcagaucaucagguggcacacagugggcacugcggaaguguguguugcugccacuguuggcaggaauauugagccugccccgugccuccucaggggcccuguggguuugcgucguccugagcccccacugcaaaccagaggaaagggcaggcuggcuccagcuacucagcaggugggacaagcucgacgucugcccacuggaagagggcaacuacuccuucgacggccccagccugcagcccaccauggcccccgccccagguaggagagaggggucuuuaccaugccccccaaaaaccaucaccacuaacuguggccccacuuaccaucaugguccucuucccaggagagagagggaguggggcagagcaaagcagaccccaguccuuggcuguucuuccaggacuaaucccaacuugucuagccaggaaagagcgagugccaagggcaggagcaauggcagcccaagugggcaagugaaguaaaaugcuuaaaacaccugcaguccugggcuggucuggcuuggccuucugcuagcuaugggaccaaagagaggaugagagaggaaaaaaggaggaaucaaacagaaggggaaagugagauauugaggagagagaaacaagugaagagaggcagagauggauggagagagggagaggcagacagaggagcagauaggaaggaagacagagagagauugaggagagagggaaaaaaaaauuuauagcaaguacaggccaggcauggugucucacgccuguaaucccagcacuuugggaagcugaggggggcagauugcuugaggccaggaguucaagaccagccagaguaacauggugagaccuugucucuacaaaaaauacaaaaauuagcuggguguugugacgcacaccuggaaucccggauacucagggggcugagaugggagaaucgcuugagccugggaggcggagguugcagugagccaagaucgcaccacugcacucuagccuggacgacagagugagacccugucucaaaaaaaaaaaaaaagaaagaaagaaagaaaagaaaaauagcaaguaggaagaggaagacagacagccaguuaguugcucaaccucaguuuccuaucaaugugaugggccuguacuagcuccuaacacauacacgcauccuuuuuuuuuuuuuuuugagacagucucacucugaugcccaggcuggagugcagugacgcaaccuuggcucacugcaaccucugccuccuggguucaagcgauucucauuccucagccucccaaguagcugggauuacaggugugcaccaccacgccaggguuaauuuuaguagagauggggugucgccauguuggccaggcuggucucgaacuccuggccucaugugauccucccaccuuggccucccaaagugcugggauuacaaguguaagccaccaugcccagccuacacaugcaucuuugaaggguggcuucaaggacugggcagaugauguaugcccauagcuuugcccaggccuaaaccccaguuaguacuuggugggaaaagcuggacacggcucaacugcuauagggacccccccucacugagccauguugggugccucucugcaggcucggaggaagaggaagagguggcagccacaaguccccgccacacgguauuuggccgcgccuugcuggcuggagagcuacacuggaaugacgccuaccugcagaggauccuggccagugacuccuacgggcccagccucacaggcagcguggguggggacaaaccgacuuucgacccccagggccgcccacuguggcugggagaaccuuuccccacugccugugcccguguggacacccugcgugcccacggauacccccgccaggcccugcggcuggcaagugccaucaucaacacacuccggcugcagcagcggcaucagcuagagagcuacaagcagcagaaaaaaggucagccucagccgggcacgggggcucgcaccugugaucccagcacauugggaguccgaggugggaggauugcuugaggccaggaguucaacaucagccugggcaacauagugagacaaugucucuacaaaaauuaaaaaaaaaaaauuagcuggaugugguggcucacaccuguagucccagcuacucuguaggcugaggcaggaggaucacuugagcccaggaguucaaggcugcagugagcuauaauuaugccacugcacucuagccugggugacagagcaagaccucaucucuuuuuuuuuuugagacagaguuucgcucuuguugcccagguuggagugcaauggagcaaucucggcucaccgcaaccuccaccucccagguucaagggauucuccugccucagccucccaaguagcugggauuacaggcaugcgccaccaugcccggcuaauuuuuuuguauuuuuaguagagaugggguuucuccauuggugagacuggucucgaacucccaaccucaggugaucugccugccuuggccucccaaagugcugggauuacaggcuugagccaccgugccuggaaauuuuuuuuuuuuuuuuuuuuuuuuuuuuuuuugagauggagucucggucuuucgcccagucuggagugcaguggcgcaaucucagcuuacugcaaccucugccucccagguucaagcaauucuccggccucagccuccugaguagcuugggacuacaggcacccaccaccacacccaguuaauuuuuguguuuuuaguagagaugggguuucacuauguuggccaggcucuucucgaacuccugaccuuuugauccacccaccucagccucccaaagugcugggauuacagguguaagccaccgugccuggccuacugaaaauauuuuuaaaauuagccaggcgugguggcgcacaccuguauuuccagcuacuagggaggcugcggcaugagaauugcuuuaaucugggaggcagagguugguugcagugagccaagauuacaccacugcacucuagacugggugacagagcgagacuccgucucaaaaaauuaaaaaaaaaaaaagagagagagaggagagcgaggagagagagaagaggaaagaaagagguggggagggagggacagagagagauggggggagagagaggggaaggaaggaagggagggagggaaggaggcuguaugagccccaaaaaccacauuguguacuagauaugggggugggggacaggagggaggccaccaguugagagagcuagucgaugggguugauggaucagcuaucaggaaauugaacgaagaaaagugugucguggaggaaacaugggggcccugggacccgagcagagcucugaccaggcuuggcagcaucagugaaaggccccuagauuuuaaaaauuagccagguggcuaauuagcugaguauuuaaggaugugcauggccaggcacaguggcucacaccuguaaucccaacacuuugggagguggaggcagguggagugccugaggucaggaguucaaaaccagccuggccaacauagugaaaccccaucucuacuaaaaauccaaaacaaauuagccaggugugguggcacguaccuguauucccagcuacucaggacacugaggcaggagaaucccuugaaccgggagguaccuggagguuguggugagcugagaucacgccauugcacucuagucugggcaacaagagcaaaacuccaucucagaaaaaauuuaaaaaaagaaaaaggaugugcaggaguuacccaggagaaggggauggaggaagugcucagaauagaaggaacaccaugagcagcagccaggagggaagagaguacguggcuuggaggacgaggcuggaggauuggccuccagaugaggcaggucaccaguauauggaaaaacuucauacugguccuugggggcccuaaaggcuguuggggcuuuaucuucagagagguggagagggaauaagggcaaugaggaggggaaugacacuucggguguuuuagaaagcguccaguggccaggcaugguggcccaugccuguaaucccuuugggaggccgaagcaggaggaucgcuugagcuccagaggcugcagugagcuaugauugggccacugcacuccagccugggcaauaagcgagaccccaccucaaaaaaaaaaguugaaggugaccauugggugagcagguggugggcauuauggggcuaggcuggcuggcaggucaagaagaggaauaucccucccuccuagagacuugggcaggugugugggcauugagcccccucuuuccaccugcagagcugcuccagaagggcuccaccugcaucaccaacaccgaaggauggguggggcacccccuggaccccauuggcugccucugcagggcgcuccuggaggccugucgucuggaggaggagacacuuacccuuuacccagguacucacaugggguacucuuggaggaggugggacaaccccgccucguuggccacgcccccuggcccaguaccccuauaagguaacucccagacucugacccuuggccacgccccuacccuuggcuaccuccucuggccagugcccagagccaauaggcuuagcuucuccugaaagugaggccaccauaggccuagcugcugcuagaagguggggcucccgcgcucccccaaccccgugagugcugggagcuucugggcucccucuaaagccuacccugcgcccaggucuccaugcuugaggccaagggcuacagggaccuuagggaaggggauccgucuccagcagcccuggcccugucucccccagacucaggccccgagaagcggaagguggccuaccagcacgugccugugcccgggagcccuggggaguccuacuuggugcuggcgcuggagguggcacugcuggggcuggggcagcagcgggcccugccggaggggcuguacgcccaggacaagguggugcgcaacgaggagcagcugcuggcccugcuggaggagguggaguuggaugagcgguuggugcaggugcugcgcaagcaggcggggcugcugcuggaaggugaggccgcgccccuaggccuggcuguugcugaaggguaggguccagccccugguccuguagcggcccgguugcugccagaugggaggccccgccccagccccgccccuagccccgccuccuggugauacuguccccucauaccuuggcaguuucuaaaaggagagagccagcucuuuuucccgccaccuagugcgugcugccagccagcaacugcugcgugugcugaggcgccgcccccuucccucccgggagccagugagccaagugguugauguuaaagcgagggcgucccaccuucauccgcaacuuagacaccgccccugucccggccugcuccucauuggccccgccaauggccaggcccuauugaccuguguguugugagacuccguccccuagcgcuacagggagccguuuaucccugccccuucaaggcccccuacgcuaucggacuugcuggucuuggccgcuggucccguuccccaaggcaggugcagccccaccuccacccucuggccccaccuuguaucugaguccugcuccucaccugcgagugugccuggagucucuucuuuuccuuuuccuuuuuuccuuuuuuauuuugcgacagucuucacucugucacccaggcuggagugcaguggcgcgaucucggcucacugcaaucucugccucccggguucaagugauucuucugccucagccucccgaguagcugggauuacaggcgugcgccaccacacccggcugauuuuuguauuuuuaguagagaugggguuuccccauguuggccaggcuggucucaaacuccugaccucaagugaucugcccgccucggccucccaaagugcugggauuacaggcaugagccgugguccccugccuccucuuuuuuuuuuuuugagacggagucucgcucugucucccagguuggagugcaguggcgcaaucucggcucacugcacccuccgaucccggguucacgccauucuccugccucagccucccgaguagcugggacuacuugcgccugccaccacaccuggcuaauuuuuuuuguauuuuuaguagagacgggguuucaccguguuagccaggauggucucgaacuccuaaccucgugauccgccagccucggccucccaaagugcugggauuacaggcgugagccaccgcgccaggccuccucuuuuauuuggauuacccagagauugccucagucucagaccugaaccccuaccccagagacccaucuagccacagccacucuacccaggggccagcccacccucuacuuaaagccuggggucuagugagaccuggggaagggcagaggcgagcccacacuuggggacugagcucaggcuguuccugcagggggucccuucaguggcuuuggggaggugcuguuccgggagagcgugcccaugcacaccugugcccgcuaccuguucaccgcacugcugccucaugacccggaccuggccuaucgccucgcgcugcgagcuaugaggugaggauagguggccaaggcaguggcagggggagcuggggggaagaggggcgggcaugggggguagcucagagccccacccauccagccugaacucacagccuaguuaauucagucucucucacccuggcauuugaugaugccaugugcuuuucauuauuauuauuuauuuauuuauuuauuuauuuauuuauuuugagcuggaguccucugugacccaggcuggagugcaguggcgcgaucucagcucacugcaaccuccaccuccuggguucaagcaauuuccugccucagccucccgaguggcuaggauuacaggcaugcaccaccaugcccagcuaauuuuuguuuuuuguuuuuuuuuuuuuugagacggagucuugcucugucacccaggcuggagugcaguggcgcgaucucggcccacucccagggccgaucucagcuccgccuuccagguucacaccauucuccugccucagccuccugaguagcugggaccacaggcgcccgccaccacgcccggcuaauuuuuuguauuuuuaguagagacgggguuucaccguguuaguaauuuuuguauuuuuaauagagacaggauuucgccauguugcccauguugucucgaacuccugaccucaugauccacccgccuuggccucccaaagugcuaggauuacaggcauaagccaccucgcacagccgugcuuuuuauuauuaaguauaaauguguguuuuuuguuuuguguuuuuuuuguuuugagacagggucuggcucugucacccaggccagaguaaaguggugccaucucugcucagugcaaccucugccucccaggcucaagcgauccucccaucucagccuccugaguauccaggacuccaggcgugcaccaccgcacugggcuaauuuuuguauuuuuuguagagacgggguuucaccauguugcucaggcuggucucgaauuucugagcucaagugauccgcccaccuuggcuuuccaaagcucugggauuacaggcgugagccacugcaccuggcuaaauguguaauauuauuuugaguuugagaauauucacaugauacaugaaaagauacacaaagcugaaaucuuuucuaggcaguuuuaucucagccuauccagaucucuccggaugcaagcaggguuaucacuuuugugucuauccugcaagaauugagguuucugcaaacccauaaucuggaaauugaacguugauccuccuuuuauaccagugguacauccuguaucuauucuuugcaccuuuuucucacugagcuuugcaucuuacaggauuugucuuaucacacaguacgugaaucacugcguagccuuccacucuaaggacacgucauaaaagaaccacuuggaagcugauagacauuuacgcaauuuccaaaaaaaaaaaaaaaaggcaaugaauaaccugguuuucauuuaucacguacaccagcagauucacagaaggagaauauuugaaagccaacuuggccgggcaugguggcucaugccuguaaucccagcacuuugggaggccaaggcggacggaucaccugaggucaugaguuugagaccagccuggccaacauagugaaaaccuaucucuacuaaaaauacaaaaauuagcuggguguggaggugcauaccuguaaucccagcuacuccggaggcugagacaggagaaugacuuaaacccgggagguggagguugcaaugagcccagaucgcaccacugcacuccagccugggagacagagcgagacucugucuccaaaaaaaaaaaaaaggccaacucaauaguaaaccaugcccaaaaaggugcaaccuauuccacaccuucugaaaccauccuucagagguaccuauaaacaacuugggauccagccugguacacaucuaugguccuagcuacuugggaggcugaggagggaggauugcuugagcccaggaauucaaggcuguagugaucuaugaucccaccuaugaauugccacugcacgccagccugggcaacagagcaagaccccaucucucucuuuuuuuuguccuuuuagagacagucucgcuccauugcccaggcuggauaugcaauggcaggaucauagcucuucacagccucauauacaugggcucaaaggauccucccaccuaagccucccaccaaguaacugggacuacagguacuugucaccaugccuggcuaguuuuaaauuuuuuuuuuuuugagagggagucucacuuucucgcccaggcuggagugcaguggcacaaucucagcucacugcaagcuccgcucacugcaagcuccaaaccucccggguucaagugauucuccugccucagccucccaaguagcugggacuacagucacccaccaccacgccugguuaauuuuuuguauuuuuaguagagacagguuuucaccaugucagccgggauggucucaaucuccugaccucgugauccacccaccucagccucccaaagugcugggauuacaggcaugagccaccacacccggccuaguuuaaaaauuuuuuuuguaaugaugggaucucauuacauugcccagguuggucucaaauuccuggccucaagcgacccucucgccuuggcccaucucuuuaaaacacacaaacacacacacacauacacacacacacacacacacacacacacacacacacacacacaguuuggaguguuuuuccagaauauuuagaaagaacagccuguaagagccaagauuuagacaacagacuuuucuaugcaagaauuuuuuuucucagcaaaauacagcccauggggccuaauuuggccaaccaccuguuuucguacagcccaugagauaagaaugguuuuuacauuuauaaacgguugaaaaaaaucaaaagaauauuuuguaacacaugaaaaauauaugaaauucaaauuucaguguccagaaaugguuuuauuggcacacagccauguccauucaucugugaauugucuguggcuuuucuggcagaacaaugacagaauuaagucauugaaauacagaucaguggccaggcaugguggcucaugucuguaaucccagcacuuugggaggccaagacgggcggaucacuugaggacaggaguucaagacuagccuggccaacaugaugcaaccccaugucuacuaaaaauacaaaaauuagggccaggagccaugguucacgccuauaaucccaguacuuugggaggccgaggagggcggaucaccuaaggucaggaguuugagaccggccugaccaacauggagaaaacccgucucuacuaaaaauacaaaauuagccaggugugguaguacacgccuguaaucccagcuacucgggaggcugaggcaagagaaucguuugaacccaggaggcagagguugcagugagccgagauugcgccauugcacgccagccugggcaaaaagagugaaacuccgucucaaaaaaaaaaaaaagaaagaaaaaagccagguaugguggcacgugccuguagucccagcuacucaggaggcugaagugggaggauuacuugagccgagaaguuugaggcuucagugagcuaugauugucccacaggacuccagccugggugacaacagagugagacccugucucuaaaauaaguaaauguaucaauuuauaaacaacacugcagugaacaucuugcacacacaucuuccaucaucuugggcucucagggcucugcuggcugaaguggggaggcugggccaggaggcuucucugucuccuagagagaauggggacagcagccccuccucaccauggcucacuucuccccuuacccaggcugcccauacuggagacagcauuuccugcuggagaaccucaucccagcccgcuggacuccaucaugagcaaccgcuucccccgcugguucauccuuggccaccuggagacccgccagugugaacuggcuuccaccauguugacggccgccaagggugaggcuggcagcugucccgauuccuuugucuuccuccucugucaucuccuucuuccuucccucuuaacuuuccugccuccucuuauccuuucacaaacuucccccugcauucuuugagcaccuccuauauguaccggacacugucucaggugcuggggauguagcaggugacaaaacugucccagauccccugcccuguggaaugacauucuaguggggagaagagagugaugcaguaaaugagacgguaacaggugccauggaguggaauaaaacaguugaacauuuaagcagagaccugaagaugagguggagccuugcagguaccuggugucuuagcucaggcugcuguaacaaaacaccagagacugcgugacuucaacaacaaaaauuuauuuucucacauuucuguaggcuagaagucuaagaucacuaugucaguauggcuagcuccuggugagggcucucuucucagcuuacagacggccaccuucuugcuuuguugagaguuggggggagugaaguggggaguagagaggaaagugagagagaggaggcugggagagagagagagggagaaaggagagauaguagggggggauagagagagagggagagagaggagucaggugccagagaggagagagagaagaaagagaagagggagagaggagagacagagaggagaaguuaaauuucuccaguguaucuucuucuaaggucacuaacccucucaugaguaccugaacuucaugaccucaucuaaaccuaauuauuggcugggcacgguagcucaugccuguaaucccagcacuuugggaggcugaggcgggcaaaucacuugaggccaggaguucgggaccagcaaaucacuugaggccagaaguucuucaagaccagccuggccaauauggugaaaccccaucucuacuaaaaaugcaaaaauuagccaggcacaguggugcacgccuguaaucccagcgauuugggaggccgaggccgggggaucaccugaggucaggaguucgagaccagccuggccaacauggugaaacucugugucuacuaaaaauaugaaaauuagcugggcguggugaccggcaccuguaaucccagcuacuugggaggcugaggcaggagaaucacuugaacccgggaggcaaagguugcagugagccgagacugcaccguugcacuccagccuggacaacaagaacaaaacuccaucucaaaauaauaauaauaauaauaauaauaauaauaauaauaauaauaaaagcuaacauuugagcagcuccuugccauguuaaggccuugccaaguaugggcccaccaccacccugugagguggguuccauugccugaguguuacccauuuuacagauggggcagccagggcacagagaggugaagugacuugcucagggucacacagcuaguggguggcaggaccaggauuugaacccuggcauucugggugugcaaccaaugcccuugagaugagggagagguccauaggaucccuagguggcuuuucuuuucuuuuuuuuuuuuuugagauggauauuacucuaucaucuaggcuggagugcaguggugccaucucagcugacugcaaccucugccucccggguucaagcgauucucgugccucauccucccaaguagcugggauuacaggcacccgccaccaugcccagcuaauuuuuguagaugggguuucgccauguuggccaggcuggucucaaacucuugaccucgugauccacccaccucagccucccaaagugcugggauuacaggugugagccacugcgcccggccccuagguggcuuucuguaacaggaaagggccagagaggagauaauuggcaagggcuaggggcacugaggucugaaucuucacagaaccauggcccaguacacaucccuccacacucacacaugugccccuggguggaaggaucugugugaacaggucgggugguggucagaggcuggugcugagguguauccgaugguguccucugucccgcccuucacccaggagaccccaaguggcugcacacgguacugggcuccauccagcagaacauccacucuccggcccugcucuuuaagcuggcgcaggacgccugcaagacagccaccccggucagcgccccaccagacaccacgcugcugggcaucgcacuggagcuggggcugcaggugagggcugccagguggaugcgggagggcgaugguggcucggggccaggacugacugugagcugcgccucccggggcaugggcugagugugagccacuucgcugggggcccggcauuugcgugagcuauuccucuguggcuggggacugagcgagaaccacucuuggggcggggacugugagugagacacaccucugggggcguggccugagugugggccacuuccuugggggcguggcaugagugagccacuccccugggaauggggacuggaugaaucgugucucuggggauggggucuucacuugggccacaccucugcagguggggccugagugugaaccucaccuuuaggggcggggccacagaaggccaaggucuguaagucaugggagugugggaaugggguucccaguagggaugaagccuaugaauuauuaauagaauccgucuauggaggagacugaggucuaggggagaguugucacuggagcggagaggcagggccugcaagccagcagauggaucgcaagcggagccuggggguggggccugggagugaugugcuauugguuaaggaucaugggugggugaguuugaagcugagggugaggcagagccuagcaauaaagagcuuccuugggggcagggccugaagaggauugccgccuaaggagagggauucaccacugaagggcuggccuggcggaaggucuugaagaugagaugccaacucuagggguggggucugugguugaaagcccuguaugagcccgggugugguggcucacaucuguaaucccacacuuugggaggccgaggggggcagaucacgaggccaggaguucgagaccagccuggccaacaugaugaaacuccgucucuacuaaaaauacaaaaauuagccaagcgugguggcacgcgccuguaaucccagcuacucgggagguugaggcaagagaaucgcuugaacccaggagggagagguugcagugagccgaaaucacaccacugcauuccagccugaaggacggagcaagacuccgucuuggggaagaaaaaaaaaaguccuguaugcagggccugcaacugagugucugggucauccccaggggcugaacaaagggugguccugcaaggccaaaucuugggugcagcuugcuggaaaggugucauugguagggugugagugccaugggaccuggaggaggguggggucugcaggauagacagguaaggggcggggccucaaaggguggcagaaguucacuaagaagauaaggaauagggccgggcacagugccucacaccuguaauuccagcauuuugggaggccaaggugggaggauugcuuggggccaggaguuugagauuggccuggacaacauagugagacccccaucucuacaaaaaacuuuaaaaauuagccaggugugauggugcaccccuguagucccagcuccucaggaggcugaggcgagaggaucgcuugaggccaggaguuugaggcugcagcagugagcuaugaucgcgccacuguacuccagguaacagagcaagaagaccccaacucuaaaagaaaaaaauagaaaagaaaaaagaaguuggggccaggcccugugguucacaccuguaaucccagcacuuugggaggccgaugcggaucgcuugaggccaggaguucaagaccagccuggccaacacagcaaaaacccgucucucccaaaaaucagccaugcauggugguggacgcguguagucccagcugcucgggaggcugaggcaggagaaucacaugaacccaggagguguagguuacagugagccaagagaccacaacugcacuucagccccggcgacagagugagacccucaaaaaaaaaaaaaaaaaaagaaaagaaaaaaaaagaaacuggggaccuucccagcuagaacaaacaagggccagcagggugcagaaucagcccuggacagccuccugauuggagccguuguaguguggggagcaagacaaggagcuuucagaggcuacucaagagguaggagcuuacagaaggcagggucugcaggacaggaccuguggauggggccucaggggagaggcaaacacgugagcugcugauugguggugggaccuagugaagguggggcuuauacagcagguacuuagaggcaagagagaggagccaacaggaagcauggagguuucaggagcgaagggacagguugguuuguuccggcauaggaucuaugaggugggaucugggguaggaucugugaggacucacuucagaagaacagcaacaacagcagugauauuaagagcugacauuaccugagagcauuuucaagcaauaagcaccuugcagaaagcuucaccuacgcaauuuuguuuacuucucacaacaaucaggcugggugcaguggcucacgccuauaaucccagcacuuugagaggcugaggcgggcggaucacuugaggucaggaguucgagaccagccuggccaacauagugaaaccccaucucuacuaaaaauacaaaaauuagcugagcaugguggcgggcaccuguaaucccagcuacuugggagccugaggcaggagaaugcuugaacucgggaggcggagguuguagugagccaagaucgcaccacugcaugccauucugggugacagagcaagauuccaucucaaaaaaaaacaaaacaaaacaacaacaaaaaagaaaaaacaacaauccuaugagacagauacuauuuuaucuccauuuucuagguaauugaggcccagaaaguugagaucacuuacccggguucauuggaucagcuuuaaccuccaaguguuucugggguccuccaucucccaacgccccuccauaggccagcccaagacucaggcuaacccccuucuccccaccccuaccuugcaggugaugcggaugacucugaacguaaugaccuggcggcggagggagauggugcgcuggcuggucagcugugccacagagauuggugagagccccuaaggggaccugccacccacuucgcuguucugguucugcagagcgcacugagagaaccaggcagacaagaaagagagaaguggcggggugcgguggcucacaccuguaaucccagcacuuugggaggccaaagcgggaggaucacuugagcccaggaguucaagagcagccuggguaacauagugagaccccaucucuacaaaaaauuaaaaauuagcugggcgugguggcaagugccuguaguuccagcugcuugggaggcugaagcaggaggauagauugcuugagcccaggaggucaacgcuacaguuagccaugaucauaccacugcacuccagccugggcaacagaggaaaaccuccucugggaaaaaaaaaagagagagagagagagagaagcaagccaggcaugguggcacacaccuguaguccuauccggagggcugaggugggaaaaucacuugagcccaggagauugagguugcagugagcugugauugugccacugcacuccagccugaguggcagggugagacccugucucuaaaaaauuguuuaacaaaaagaaagagggccaggcgcaguggcucacaccuguaauccuagcacuuugggaggccaaggcauguggaucacuugaggucaggaguucgagaccagccuggccaacauggcaaaaccccaucucuacuaaaaauacaaaaauuagccagaugugguggcaggugccuguaauuccagcuacucgggaggcugaggcaggagaauugcuggaaccugggagacagagguugcagugagccgagaacucacuaccgcacuccagccugggugacagagcaagacuccaucucaaaaugggcagaucacaaggucaggagauugagaccauccuggcuaauacggugaaaccccgucucuacuaaaaauacaaaaaaacuagcugggcgugguggugggccccuguagucccagcuacucaggaggcugaggcaggagaauggcgugaacccaggaggcggagcuugcagugagccgagauggugccacugcccuccagccugggcaacagagcgagacuccaucucaaaaaaaaaaaaggaaagagaaguagagacucuucagagacucuucuccgauuccagccugugcucagggcuuggccgggagggaauggcuggccagcauggagcuggacaaaggccuagaggcuggccaggcuaauguggcugcaggggguugaggggguugcagaaagaggcuccaaagcuuagccuucuacacacgugauucccaccuaguccaggugcgcccugaugauuuggaaaggaaguuucuguucagcaugguguggagguggaaguggagguggcagugucaugguuaacccacgcauacauguacgugugucugcccccgcuccugacggauuucccucccucaccucccaccaggcccgcaagcccugaugaauaucaugcagaacugguauuccuuauucacaccaguggaggcggcuaccaucguggcagugacgggcaccacacacgccacucugcugcgacugcagcuggacacaucgcggagggaggagcucugggccugcgcccgcacccuggccuugcagugcgcgaugaaggacccucagaacugcgccuugccugcccugacccugugcgagaagaaccacucggccuucgaggcggccuaccagaucgugcuggacgcggcggccggcggccugggccacgcccaccucuucacuguggcccgcuauauggagcaccgcgggcugccgcuccgggccuacaagcuggcgacgcuggcccuggcgcagcucagcaucgccuucaaccaggacagccacccugccgucaacgacgugcuuugggccugcucucucagccacucccugggccggcacgagcucucugccaucgucccccucaucauucgcagcauccacugugccccaaugcuguccgauauucugcgccgcuggacucucucggcgcccggucugggccccuuaggggcacgccgggccgccaagccacugggugccgaccgggcgccgcucugccagcuccuggacgcggcagucaccgccuacaucaccaccagccacucgcgccucacgcacaucagcccgcggcacuauggggauuucaucgaauuccugggcaaggcccgggagaccuuccugcuggcgcccgacgggcaccuccaguucucacaguucuuggagaaccucaaacagaccuacaagggcaagaagaaacucaugcuuuuggugcgggagcguuuugguugagggacaguggggugcgugggaguggggaucccccucgccccugcgucccccacccuugcucuccaauuaggcccacguggcauuucaguauuauuaagucagggaaggagcccggcuggagaugggggcagggggagcagcauccugccacgugugugccugggagucugugagcaagugugcaagacuccagaagcagaagccauacugccacccagaagccuggaaggggugugugcuugggcugcugguaugaccccacuuugggcaccccaaaagcaauaggcaaacuccccuuacccagacuggcuugggcuccaggagggaggcugggaggcaggacuuuccagaaaucgacccucuaagucaauguagcacauuuucccccaaccccacccuggguggccaaggguccucccccacccccuacugcucagggccccccauuaugccaccuccaaaguggcugcccagccaggaccauuggcucacccccacugaaggaauugaagaggccucaggccucagccucauaccucacccccuuauccuauccggccaggacccccauuuccuugggcacuagggucccagggugggcucaggguuggggaaguccucgcugcccucucuucucaccugcuagucacuggacguacaacucaggaacugagcgaggcucacacugccccuuccaaccugggguugggggacacagacgcgagagagccggagacccccacccccgaucuggaaaggaaagagaccuguaucuugguguuuuucuggcuuuuucacccuuucgccuccugucuuucugcuucgccccuucaucuuacucuguuuccauuuuucccggcacuuaccugccuuucucucugcaccuaagucccugccgcccucucucuuuggccauccuuccuuucccccaccuugacccagggaggagaagggagaacaucacccccccaagucacccccacaucuuuucccuucuuguauauuaaggacaaaauaccacaucauuuuguaacuuuuuuucuauuuauugaacgguguauuacauguccuuuuccuuuuuuuuuuucaaagauugaacagaaauuuuucuuuuuaauuuuauuuugagacuggggugcaucuccagagccacucacacccucaaccucguuuccuccgc

SEQ ID NO: 191914 - RNA, 9760 nt, Homo sapiens
ccccgcucccaagugcgcgcggaccccuagcucccucugaguugcgcugggcuuggcugcugcaccaugacccuggaggcgauccgcuacucgcggggcucccugcagauccuagaccagcugcugcugcccaagcagagccgcuacgaggcggugggcucggugcaccaggccugggaggccauccgcgccaugaaggugcagcggggcggcggggcggcggggcggcggggcggcggggcggcggggcggcggggcggcggggcggcggggcggcggggcggccggguuggaggugggagugcgcccgcgccugcagcuuccgacgcccaaaucccugccccgcaggugcggggcgccccggccauagcccuggugggcugucucagccucgccguggagcugcaggcgggcgccgggggaccgggacucgccgcgcucguggccuucgugcgcgacaagcugagcuuccucgucaccgcccggcccaccgcugucaacauggcccgcgccgcccgcgaccuggcugauguugcagcccgggaggccgaacgggagggcgcuacggaagaggcgguccgggagagguacggggaucugguaccaggcacggcgcugagcaggaauuauauugacucuuuuuaaguacagugacccacuauacagauggggaaacugaggcacggcgaccuuaagucccuuguccagggccccacagauggggagacugaggcacggcgaccuuaagucccuuguccagggccccacagauggggcccagagucuagccugggcagccuggcccugaaaccuaacuccuuaaucgugccuccccugaauacacgcagccccuuauccgcccuuggaggcccuuuuuaguaucuccguguucucuugguuucugcuuuugaggaacuuuuuuuccuguccugguccccuuccugccaucuuuuuccccccacuuccuuucugcuccagcccucccugcaaugucacuuuaccccaccaagcucgagccugccuuacagccuuugcacgugccauuggugcgggccagguauccauagcgcccuccuccaccauucuauaugauccagcucacccgcugcucucuguugccugauucugccggcuuuuccuucauuuuauuaucucuucaucagcuggcucacucaccccagugucaacuccacaggagcagagauuuuugucuuguuuacugcugggucauaccggaacugcuugguaaacaugucuuugcaugaaugaacggagugacacuucgguggcccuggccgaaggguccaggccccacagcaaugagaggcuuugagcaggagggcuccaggacagcagcguuaggcagagaggaggcguuggccugggccccggguccugguggcuggugcugaaaacuccuugucaccccagagugaucugcugcaccgaggacaugcuggagaaagaccucagagacaaccgaagcauuggggaccuaggagcccgccaccuccuggagcggguggcccccagcgguggcaaggugacugugcugacccacuguaacacuggugcucuggccaccgcuggcuaugguacagcccuaggugagagggccuccucaggggguaggggagggccuucuaggaacuuuuuuagauacaagagaaagaaucccaaacccaaaccacuuuauccacaaaaaaaaugggaagguacuaguucuaguacggaaacacuuauacaguuggcuucagguauggcaagaucaaggggcucaaccaguagcaucaggaccuaucuaucucugugcuucagcucugcccuccuucaucuucagguuccaugggcuggcaggcggcuguuaggguccaaaucaugaggaaaagagccuccuauacuagaaaagucuccuuguaucucaggggguccacuagggcaccugcccaucccagagcagucauucgaugggccccgccugagccauaugccuagagccagggcaggacguggacuccaggaggaacuggggagaagggagugagcagagaaagauuagguagcugugaccaggagacagggggagugggcuguagggggccaaggcagcagauuccacuugacccuaaauucaccaggaaauuucccuaccugccugagucccaccuucaucccugggaacugaggccuuaauggaaagaccucugccuuugauucauucacucacccagcauuuaguaagcaccugcuguggcucagacaccgccauuugcuggggacgcagcagugaacaaaacagacaaaaucucugcucucaggggucccagggaagcagaaggaacagucaacaggcaaaauaaguacagucauccuucaauaucugugggggacugguuccaggaccucccacagauaccaaaauccauggaugcucaagucucugauauaaaaaugccaucauauuugcaugaccuaugcacauccacauauauauauauauauauauauauauauauuuuuuuuuuuuuuuuuuuuuuuuuuuuugagacagagucuugcucugucgcccaggcuggugcaguggcaugaucucagcuuacuacaaccucugcuucccggguucaagagauucucaugccucagccuccugagugucugggauuauaggcgugagccacuacgcccagcuaauuuuuauauuuuuaguagggacgggguuucacgacauuggccaggcuggucucgaacuucugaccuuaggcgguccgccagccucggccucccaaagugcugggauuacagacguaagccacagugcccagcccaccccuauauuuuaaaucgugucuagauugcauaucauagcuagucccauguaaauacuauguaaauuguuguuacuggcuagguguaguggcggugcaggccuguaaucaggaggcuggggugggaggauugcuugaacucagaaguucuagaccagccuuugcaacacagcaagacccugucucuauuuuuaagccuguaaugccagcacuucgggaggccaaggugggcggaucgcuugagcucagggguucaaaaccagccugggcuucauggcaaaaccccaucucuacaaaaaauacuaaaauuagcuggguguagugguaugcaccuguggucccaccuauucgggaggggacugagaugggaggauugcuuuuuauuuauuuauuuauuuuggagacagagucuugcucugucacccaggcuggagugccauggcacgaccuuggcuccuugcaaccucugccuccuggguuccagcgauucuuuucaaguauuuucuuucuuuccuuuuuuuuuuuuuuuuuuuuuuuuugagacagagucuugcacuguugcccaggcuggagugcaguggcgcagucucggcucacugcaagcuccgccucccagguucacgccauucuccugccuccgccucucgaguagcugggacuacaggugcccgccaccacgcccggcuaauuuuuugaacuuuuaguagagaugggguuucaccguguuagccaggauggucucgaucuccugaccucgugauccaucugccuaggccucccaaagugcugggauuacaggcgugagccaccacgcccagcccaaauauuuucaauccacaugguugaguccauggauggagaacccauagaaaaggggggcugccuguacacaugagguguuagaaggugauaaaugcuaaggacagagagcaggaaacugaaaguguggggauugcuaugcaaaacugauauaucagggaaggcuucaccgagaagguguccuuuaaacagacgugaaacggagcuaugcgagcauugggaagagcauaccaggcagagggaacugccacugcgagggccccugggcgggacugugcucgguaagccuuuggcaauccacgcccagacuaggagccugcaccccuaaccaauggaccacccugucuguuugccccuccccggggccuucuccugguggguggggcccccgcaggugugauucgcucacugcacagccugggccgccuggagcaugccuucugcacagagacccggcccuacaaccagggagcccggcugacggccuuugagcuggucuaugagcagauccccgccacccuuaucaccgacagcaugguggcugcugccauggcccauaggggcgugucagguaagcagacgguaagcccugggggcggggcucuggagcauggggccagguaaugacccccaacuucucauacgcccccuccccagcuguggucgugggagcugaccgcgugguugccaacggcgacacagccaacaaggugggcaccuaccagcuggccauugucgccaagcaccauggcauucccuucuacguggcugcccccagcucuucaugugaccuccgucuggagaccggcaaggagaucauuauugaagagcgaccgggccaggagcugaccgauguuaaugggguccggauugcagcaccugguaagcugcccccucagaaaggggacaccccagcuccugggcacuucauggaggcaggugauaugcagguccuugucauccuucuggaacauacacagcuccuacaagccacuuuuucuuuuuucuuuuuuuugagauggagucuugcucugucccucaggcuagagugcaguggcacgaucugggcucccugcaaccuccaccucccgggcucaagcaguucuccugccucagccccccaaguagcugggacuauaggugggugccaccacgccuggcuaauuuuuguauuuuuaguagagaugagguuucaacauguggaccaggcuauuuauuaacuacugaccucaagcaaucagccugccucugccucccaaagcgcuaggauuacaggugugagccacagcacgccuggcccaagccacuucuucuaacaggugcauccuggaggucagauccaauguuggaauuuacaacuaaccgguuauaugaaugaucuugaguaacugucuugcuauucuccacuuagguuuucuuaagaggaaauaagaauaucuggcuggccacguguuuguaaagaaaaaccaagacggccaggcgagguggcucacaccuguaaucccagcacuuugggaggccgaggcgggcagaucacaaggucaggaguucgagaccagccuggucaacauagugaaaccccgucucuacuaaaaauacaaaaauuagccggacaugguggcacccgccuguagucccaacuacucaggaggcugagggaggagaaucacuugaaccugagaggcggagguuguggugagcugagauuacaccauugcacuccagccugggcaacagagugagauucugucucaaaaaaaaaaaagaaaagaaaaagcaagauauuucuacacuuauuuuuauuuguuuauuuucauagagauagggucucgcuauguuccccaggcuggucucaaacuccuggccucaagcgauccuccugccucagccucccaaagcacugagauuacaggugugagcucccaugccuagcugcaagacuuuucuuagcugccuauacuuccuggcugugcaaccguuagcaaguucccuaaauucucuaauucccuaagauccucacugguccuaucuguaaaaugggcuauggcuagaaccugcugcauaaacccaagggcggucagugaauuaacccacaggacauuuagaucaaugacuggcccuuuaaauaguucaugcacucagaugccguggcucacgccuauaaucccaacacuuugggaggcggaggugggcggaucacuugaggucaggcguuccagaccagccuagccaacagagcgaaaccacgucucuacuaaaaaaauauaaaaauuagccaggcgugguggcacaugccuguagucccaucuacuugggaagcugaggcaugagaauugcuugaaccuaggacgcagagguugcaguaaguugagacugcaccacugcacuccagucugggugacagagcgaaacuccaucucaaaaauaaaaaaaaaggccgagcgcuguggcucacgccuguaaucccagcacuuugggaagccgaggcgggcggaucaccugaggucgggaguucaagaccagccugaccaacauggagaaacccugccucuacuaaaaauacaaaauuagccgggcgugguggcacaugccuguaaccccagcuacucaggaggcugaggcaggagaauugcuugaacccgggaggcggagguugcaaugagccaagauagcgccacagcacuccagccugggcaacaagagugaaacuccaucucaaagaaaaaaaagaaaaaacaguucaugaaauauuagcaugaaccaauauuagcauuauggggccagguaaaauggcucacaccugaaaucccaguauuuugggaggcugaggugggaggaucacuugagcucaggaguucaagaccagccugggcaacauugccagaccacaaucucuaaaaaaauuguuuugccagguguggugguucaugauuguaaccccagcacuuugggaggcugaggcgggcggaucaccugaggucagggguucgagaccagccuggccaauguggugaaaccccgucucuacuaaaaauacaaaaaaaaaaaacguuagcugggcgagguggcaggcgccuguaaucccaacuacuugggaggcugaggcaggagaaucgcuugaaccugggaggcacagguugcagugaguugagaucaugucacugcacuccagccuaggugacaagagcaaaacuccaucucaaaaaaacaaaaaaacagcuagacaugauggugcacaucuguggucccagcugcucaggaggcugcagcaggagaaucguuugaauccaagaggcagagguuacacugagccaagaucgcaccacuguacuacagccugggugacacaacgagacucugugucaaaaauaauaauaauaauuaaaaauaaaacuaaaaaaauaagugggaugggccaggugcgguggcucacgccuguaaucccagcacuuugggaggccgaggcgggcagaucaccugaggucgggaguuugagaccagccugaccaacauggaaaaaccucgucucuacuaaaaauacuggcugggcaugguggugcaugccuguaaucccagcuacucgggaggcugaggcaggagaauugcuugaaaccugggagguggagguugcagugaaccaagaucgugccauugcacuccagccugggcaacaagagcaaaacuacaucucacaaaaaauaaaaaaauaaguggcauagauguguauaggacuuugaauuuuucuuggggacugacauucuaggggcaguggcgagucuaaacuuacuauugaguacaauguccaugccugcauguacuuuuggggugagaauccucagguucucaaggacuccccaacuccaagaaccacugugguagaaacagaugacuacaaccugagaacuuucacagaagcaaauucuugccuccuugccuccccucucuccccugcagggauuggaguuuggaauccugccuucgaugucaccccccacgaccucaucacugguggcaucaucacagaacugggggucuuugccccugaggagcuccggacagcccuaaccaccaccaucucuuccagggauggaacccuagauggaccccagauguaaccaacucagcucucccuagccugccucucuagguuuuucaauacauuucuugaauggcuacccaaaagcugaccguccagccccugaccacacuuguuccuagugcagggagcucagacagggccuuccaucuagagcccagcaccuagagccaggcugcccagauucaaauccugacuccgccacuuuucccacuguaugaucuugggcaagucacuucaccucucugugccuugguuuccucauuuauaaaauguggauaacaggccgggcgcaguggcucacaccuguaaucccagcacuuugggaggccgaggcagguggaucacaagaucaggagauugagaccauccuggcuaacauggugaaaccccaucucuacuaaaaauacaaaaaauuagccgggugugguggugggcaccugcagucccagcuacuugggaggcugaggcaggagaauggcgugaaacugggaggcagagcuugcagugagccgagauagcgccacugcacuccagccugggcaacagagcgagacuccgucucaaaaauaaauauaauuaauuaauuauuuaauuaaaaaaauaaaaaauaaauguggauaauacuaguaccucccucuuaaggucagggcuggagcuagggugacaucuccagggcagaauuuuaagaggacaccaaaaaagcucagcaaccaagauaaaaaauauuuuaaagcaauauuuuguuuuggguuuuuuuuuuuugagaucaaguaucacucguuacccaggcuggaauguagaggcgagaucucagcucacugaaaccugugccuccccgguucaagcgauucuccugccacagccuccugaguagcugggauuacaggcaugcgccaccaugcccagcuaauuuuucuauuuuuaguagagacaugauuucaccauguuggccaggcuggucucgaacuccugacucaaaugaucccccugccucagccucccaaagugcugggacuacaggcaugagccacugugccugaccuuacagcaguauuuuuuaaaaaucaaaauuaaugcaaaaauccaugaugaggccaggcuugguggcucaugccuguaauuccagcacuuugggaggaucccuugagcccagguguuugagaccaguuuggguaacauaggaagagcuugucucuacaaacaaaaauuuaaaaacaaugagcugggcauggaacucacaccucuagccccagcuacucaggcugaagugggaggauggcuugagcccaggaguucaaggaugcagugugcuuugauugcacuacugcacuucacccuaagcaacagagugagaccccaucucuuuaaaaaaaaaaaaaaauccaugaugaacaaaacaaguauuuguuugagacggggucucgcucugucgcccaggcuggaguacaguggugccaucucagcucacugcaaccuccgccuucuggguucaagcgacucuccugccucagccucccgaguagcugggauuacaggagccuggcacuaugccuggcuaauuuuuguauuuuuauuggagacaccauguuagucguggcuggucuccaacuccugaccucgggugauccgcgccccgcggccuccgaaagugcugggauuacaagcgugagccaccgugcccggccuaaauaaaauuuugaagaggcuagaaccccgcacuugugccuugagcuuacugaccucaacacccugguuccacuaaaacuuuauuuacaaaauuaugcugccggucugcaggauguaguuuaacaauuugauuauuuuggauauuaaaauauuuuuuaagucuugaaaauauuguuuacuauuaccaaaguuuuugaaccuucuuaaauucuguaccagaggugagugccacacccuaaccuagucugaguuuuuauguguaaagaucauaaaacguuguaaguuuucuaaaacacauaagcucucaauaaacguuagcuuaucauuguca

SEQ ID NO: 191915 - RNA, 300019 nt, Homo sapiens
gaugucccgagcugcuauccccggcucggcccgggcagccgccuucugagcccccgacccgaggcgccgagccgccgccgcccgaugggcugggccguggagcgucuccgcagucguagcuccagccgccgcgcucccagccccggcagccucagcaucagcggcggcggcggcggcggcggcgucuuccgcaucguucgccgcagcguaacccggagcccuuugcucuuugcagaauggcccgcuucggagacgagaugccggcccgcuacgggggaggaggcuccggggcagccgccgggguggucgugggcagcggaggcgggcgaggagccgggggcagccggcagggcgggcagcccggggcgcaaaggauguacaagcagucaauggcgcagagagcgcggaccauggcacucuacaaccccauccccguccgacagaacugccucacgguuaaccggucucucuuccucuucagcgaagacaacguggugagaaaauacgccaaaaagaucaccgaauggccauauccuuuugcccgaaccccagcagcagcugcgccucccccuccucccuccgccuccccucuuccaggcugggagagagacccggggguugaugggagguggggaggaggggggucuuccaggggcugggagagggggcaccgggaggagugugaaagaaucucuccaccccgagcuggguugagcuacccuggaggcuugggaauggguuuguggggggcuggggggugggcagcggagaguggauccuucccaaggaccgacucuagaaugagaucuggggccuggggucgugcaggagccuuggugggggcuuucgagccaaguccggaggguuuggaguucuacggagugagcuuggagcgggcucgggccugggcgcuucuggccagggcaggggaacuaugggggccuugguuggguuuucuuggccgucgcucacuggaguccacgcaggggaagcuggacagccucuccacuacugcuuuccccaagguggggggccgccgcacuuuuagggcagggcgcuugggggcucccagggcuaagagcaagagggaguccauguggccuucacacugagaagccagcacuggccgaagugaguaccccagggugggccgcuguuccuaucuggagaggauagugaugggcuggggggcgcuuauguuucccucaugugugcaggucccauugccuuuaaccgcugauuggggaaccucaucaucuuugggggugucgagaaagagaucccacuugcuuuaucugggccccuggccugggaagaccugaucuggacacuuucaguaagaaagacagggcaacagcaaaugaggugguggguccauuuuagagcaccauguccagcuuuuccuaccccgaguagccgagagggaacaccaggagaaucagcacccauguggacaucuuagguagguaaaugccuuuuaaauuuuuuuuuuuuuaaucaaagauccagaggaaaaaggugaagcccacauuuucuucuguggagaugcuaucaaaaugcagaucuucuguguuucuuuaaaucccugccugcuugaaauaaaccuugaggagggcuuaacaucuaucgagauguaggcaggcaaggguggguaauuagucgggcuuucuagcaguuaucuaagcaugacccagauuccaggaggggggacacacccugcugcccaggcuggcuggccacugugccaugcccagaugugccgcuucuccgcacaguuccaaccagcugcccucuguguaaaaaugaacgggcuggaugggucccuggggcucagcgaugaguccccuaucccuuuuguaugugguuuugcaguuauagacuaaacggggcugggcccuguguggucuccggggguugcuguuugaggagcauggcgggugguagagggacucacuucagggggguucaaaaucgagccuggcgcuuggauccugggugcugggauugcaacagagggcacugagguuuuggagugugugaguggucuacuuugaggguggggaaaauuaagaaguucagcagaggugcuuuugaggggagcauaccucuaacuacgaugccaucuccguuggugcccaaagcaggugccaggucuuugcuuccuaaguuucagacucuuaaagaggcugguucuuaagguuagcaauuccucaccaucccaggcccauugaagugcucagggguggcuugauuacucugccuaucaacagagugaggagugggagugccuugcaggaggacaggguauucaugggugcacacccaguuagcuccaggagugagagggcuuugcucggcugacagguuuccucauugaaaauggcuuuagaucgccuucuggagccuggauuuggagacuucuaagaggaaaggaaggagguggggagcccuucugcuguguccuuagcuuaccucuguccagccugaauccugcagauuggagggcuguugggggagagggggauugcaguggccccucggaagggggaaucgugggagagggaggcaggugaauugcgaguguugcuugccacuucaucuauucucuggccagcucgcccggggcuuucuugcucuuaugaugaguuugugcauuaugcucucugcagacuguuuuuguucucuuugacccgagguaacaaacacauuauacagcccuacucuggaagggaaaacuccccaccucacaaucugucaucgagcugggucauccaggacugagcuuucucuguccuggauggagcggagggcgguggcggggugggugggaggguuggagaugagaggggauggacagagaccuggggagggagguagugaauaaaagaauucaggccaguguaaagagaaagacacguggaaugucagagucacgauaccagggcagaacauucuacuuuuuaaucuaaauauuucugccauuaaaaaaaaauguuucagcauauccugagagugaaaaaaaaaguguguagguacuuaaauaaagucuaauauauguacaggcaaguacauauauucagaugcauagauuuuuacaaaaugaacacacccacguauccagcacccaggucccgaucagugcccuggaagucccccuccccauaccgccuccuaguugcucccccaacaaggguaccgcucaccugacuucuaagguucauuuugccucuuuuaaacauguaaauggagucacacaguacguucuuuugccacuggcuucuuuugcucacaucuguguaugugacucuacuacaaucuauccauucuacuguugaugggcauuugugucauuucuguuugugccacugggaacauucuugugucuucuauuauuuuuuucccacaguucucuuagauaggaguggaaucgccccugcuacuuuuugaugcauguguugugggauguguauuuggaaaugguguugacuaaggguugcaggucgauauggaaagcagguuccucccugucuuguuuaagagaagugagugaaugauccaugaacuugucgguaugcucacagggccuaagagugcuacuuccaaauguaaauucuggcaugguacacuggugaaggaugcagucuugcuuucuccacacucggggcaauuugucacuaugauuucuuccucuuucaucccucagugggucaaacuugaagccaucaaugacaauuaagaauccucauuuauuucauuuuuuccccucuuccuaagugaggaaacccaaauggaagucuuugauguucaaauuuacauugccguguuuuucucaugccaggcagcaagccgucuugaccacacaccuugguuucauguuuucauugacuggaauugugauucaaauagggccaugagggucucugaugauugccgaagagcucagaucugucagcucaaaaaggagcaucugucagccuuccuagaguucccuccccacuuaaugccacucacuccuucuaccaagugccaaggugaaugucaucuuuccagcccucccugugccaccaggucucccacugaacaugauguagaaacucaggccaucggaggaacacuggaagcaggucaguguauuaucacgcacaguugccugaauuacacguagaauuccagcuuuucauccgguuugcagaaaucuuaacaagacaccuaaagucacauugacaucaggugacaucacuuugacaucuguggacauuggcugauuggcacuccucucauuuuuuuuuuuuuuuuuuuuuuuaagaaaagcucucuaaagagaaacuuucugcaugagaagcgcugggagacaugggagcagguuaucagacucuuggccuguccugagagauagaauguucuagaagguacugccguagagggcaggauggugucacuuacgugauccuuguacuagaccggcuuggcugguauuuccagaggagcaaaauucugcgaaguaaaauuuagcacggcuuuuccaaugggaguauuuucaaaaagggugcaauuucuuauccacaauuccccaauccaaaaagcuccaaaaaccaaaagacgagcucauauagagguaaaaccuaaccugaacugacuucaguuugaagucuuaauuuacaguuuucauucauucuacuuggugugcauuugaguauguuuugcagcagaaauguuagaugugcuugaugaugaggugcugcuucagcuccugacuguuaggucugcauuguaguccugucaaacuuucagguguauggaaguugucuuguuaacaggaugguucugguccagcaggauuuggguggggucugggauucugcuuuucuagcuagcuucuagggauuccccaugugguaaguucaugggcuaggguuggaguauccagguuagaucauagagacaucuuguuaucauuuuucuuuuccuuaaaaaucagguuuauaggggccgggucuggugguucacgccuauaaucccagcacuuugggaggcugaggccgguggaucaugaggucaggaguucgagaccagccuggccaacauggugaaaccccgucucuacuaaaaauacaaaaauuagccaggcgugguauugugcgucuauaaucccagcuacucgggaggcuggcaggagaaucauuugaaccugggaggcagagguugcagugagccgagauugcaccacuguacuuuuuuuugagacucugucucaaaaaaaaaauagauuuauugauguauaauuuauuuguagcaaaauucacccuuuugacauacuggucugcaagcuuugacaaauggauguaguuguggccaccacccaaaucaagauaugggacaguuucaucaacccuaaaauacccccacagugccccucuugagucagcaccccacuucuccagccccuucaaccacugaucuguucuccaucccuacagcuuugccuuuugccgaaggucauauaaauguaauuucacaguauauagccuuuugaauguggauucuuuuacucagacuuugagauucauucaugcuguugccugugacaguagcgccuuccuuuuugguguugagcaggauuccaugauauggauggaccagaguuugcuucccagccgaaggacauugggaugcuuccaguuucaaugauuaugaauagagcugcuauaaacauuggcuuauggguuuuagugggaacauuucauuucauacauuucauuucucuuggguaaauuaacccaggagugagauugcugaguugugugguagguguauguuuaauuuuauaagaggcucucaaacuguuuuccuaagugguuguaccauuuuacauucccaucuuugcaaugcgucuaaaagcccugaguucugaauuccaaagcacgucuggccucgauggcuuaggauuaaggauguggaucuauggaaaggaguggaaguaauaguguuaaaucccggucagagaaauaagaaagauuaaggaugucauucaaagcuaugugccugcacuagagagagagaaagaagggguucucuugggugggguuccaccccucccugguaguucuaccauuccccaggaaaaagucaagcucugaggcugugagacccaugaucuuuacccuguucuucaccacugcaaccccagugugugggacaaagcaggcguccuauaaacguuugcugagcaaaugagaaaagguaccugucuucacccauuaacuaaauuguauaacaucuaucugaucuacccuugugccaacguuuuaggauuuugauggguuuuaguugcaggggguugagagacuguccaugagauuaucagaccaaugaaaguuucugaaauguuagugcuugaguagauuggaugcagcggccccuugagaaugaagucuuucuucagggacuuggagugggaggcaucuguugggugcguagggcuuaugcuucccccucccuguuucccccccaguagcaagcacacauauacacuuucucagcaauaaaaagcaccgccgggaagguggacuccauccagaaaugaucagagccuaagagccgugcaguaacgcauuuccgagaaugccagcucagcuccugagaaaagggccggaugggauggugccugcucugaaagagggcagagaggagagggaaaacacuccggacucugggucagacuggcccagguucacauuauucaccagccauguuaucuugggcaccagagccuauuucuugacaugcaugaugaggauauuccuucuaguagcaucucccuuggagggcucucaggagauuaaauggggucgugcgugaaaaauggccagcacagucuccagcacagagaaaaaccccaaaacgccagagccguaauacuauggagucauuuagguuccaguguucuuuuuuuggaaaccggccagaaaagaggcuuucugggugggaaugggagcgaagugcccccccccaccacccccugcgacuggucaguguggauugauuaaccugaucguggcgcucuuuaaagccaccuuuggacauuuugcauucuccguucucucuggaagcuuucaggggaaaaaaaauucguggccacuugacccauuuuucuauucccuugagucuaagguaaaaauuaauucucuuuccuccuuuggucccucccucucucugugggugacaaggugagggaguuuuaaaguauauaauuagcuucccucuuccccuuuugcacucccugucucuuccuuuggggccggucgagagugcagcccaggauggccaccccagguguccacugcaaacuccacagaaaaacuuugcucaacuuuugguuuagaauuuagguaccccccuccccuuccaaacuuuggucuucuuucuccucacucccuaaaaaaauaggaaaaacaaggaacauuccuggcgagggaaccaugagugggcacagcaacuuagguuucaaaaaccacugggccucaguucuuaucugaguagggugacccuucagccaggguugccugggacuauccuggguuuagcaucucuggaaacucacaguccugggcaaacugggacgcuggucacccuaauggugaguucuuaacaccugagagagaagaauggugcaagagauggugccguugaccaagaaagggggagagucaguuacuuauucccucugaaaagccaagacuuuuuauuggaaugaaugcagcuuuuagaagccgucuuuaaggcagcuaauacaagagagauuccagcuaugaagggaaaugccugaguuaaguccggaucaaguuuugacaucucgcuucggucagacacggcuuuaucugccguucagacugggagcagccgugagucuuccuuaaaggugccuguugcucaggcggcaccugcaguuagaaauuagcagccucccacccccagcccccaaauaacaggauucaagaguccccucucugaagccaugagggaaacccaacuuagucacccacuugccaguaaauaauauucaugcuguuaaguucuguucucauuuuaggccuauguguaaaaaauauauguaauuuuaaacugauuuuuaaaguauuuucauacgaacagcauuugcaggagggcgaagucuggauguuaccuuuuuguaaaaguggauggauuugucuucaaugagacucuggggcagacuuaaaacuuggcccgcagugguguuacauggauucugaucuuccagagucugucacguucuuuuaucuccaugaucuuuauuaucuucuuuauugagaaugaugggcauggugugugugggugggagggcuaugcugaccaucacugcagugaaauguguucguggcauguuguggcgucugcauaggaaugugucuguuugauuaacagcacaagcaguggaggcuguaaggaggaaaagaggagggaaggugauauuggauggaggggagacauauagagcuugggaacaguccacccuggcugcaaaucucagcuccagcucacaguuguggagccucagucuucuccucuguaaaacggggacaguaguccuauguccgaggaauuguaagaagguuaaaagauacuguacccagaaagcacauggcauauauaaucauccugugaaguagccaacucaaugaauuuuauuuuauuuauuuugagucagagucucacucugucacccaggcuggagugcaguggcaugaucauggcucacuauagccucgaccuccuaggcucaagcgauccuccugccuuagccucccgagaagcugggacuauaggcaugcaccaccguacccagcuuuaacaacauaaauuuauauauauauauauauauauauauauauauauauauauauauauauauauauauauauuuuuuuuuuuuuuuuuuuuuuuuuuuuuuuuuugagauggaguuucauucuuguugcccaggcuggagugcaauggcgcgaucucggcucacugcaaccuccgccucccggguucaagcaggacgaugggcauuugggauguuucuaguuuggggugggggauuguuuguuuguuugcuguuaugaacaaugcugcuguaaggaaucaauaauuuugaaugaaugaauucgagguguuaauuuuagucuguguacuuggaaaucuagcuucaccuagaaucagcugagauucaucagcauuuauggcaggagcuaagacauuucacagcuuacucaucauuuucucuaagaggcugggucaaccgguuagcucuugguccugcuuguauucugagagucagaaccugugguuuagacacuggcaauugauaugguuguagagaagcagcaugguugaguugagagcauggauucuggagcuagguggcugggguucaaaucccagcucuacuagucacuggcugcgugaucuugggcaagucacuuaaguguucugugcuucaguuucccagucugucccaguggugauucuaauagcuccauggggauccuaauagcuccuaucugggaggauuaaaugaguuaauacaucugauguuuagaguggugccugacacuuaggaagcacuauauguguuuauacauggaagaguggauagauggauggacuuauguggguggccauauuugggcuucucugauccacugcugagaauaguguguggcacacaguaggugcugcauaaguguuaauauucugcucuuucuugccaagucucucaacucccuugaucucuguuauuuuuggcgucuguguuguuaacccauucuucugaaugaucagcugaaucacuguugcuccaauauauaagccaaggagaacacaaucacaaggucucauugauuguccauacuagaauuccaugauuccuaggcccaaguaggauuuuccccacgucucagcaauccuucuuccauguuucuaaucuuuuucucucauuuguuaugccccauugccagacucuccaaucuccccacagcuuccccuuccucuaacuauacugucucuagucuuaccuucucccuaagggcaccgucuuugaagacaucaaauacuucagagcaccaaauauagguuagcuucucugagggccuuacaaggacauggaguguuugggucuuacacaaauuggaauggucagaaauguuuagagacuugaguugucuuugaaagaguugucagaaugcaaauuuuugacuuguggccuguuucugaucacaacgcagucuuuuaaguuauggaucauagcuggauguuugugguuuagaggggauggaggcauccucugcaguuaguguuggaugucuggguggauggauggauggauggauggauggauggauggauggauggaugguugaacagaugcauggaugaguggauggauggauggaugggaugaaggaaggaaggaaggaugggugauuggaggguagguggguggauaaguagauugguagaugacucgauggguggguggacaaauggaugggugaauggaugacuggauggaugacuggauggauugguguaugagugaauauauggcuggaugaauaaauaggcagaugacuagacuggauugagggguaaaaauauggaugacuggauggguggaugaguggaugauagaugguugaauggguggguggauggguggauguuggauauaaggguguaugguaggguagcugucuaugugugggucucccugauauuugguguucuguuugacuugggaaugaccaagucucuccgcuuaccaccuuauuuguaccuuuuccaguaucaagugaauuuugcacacuuuuguaaaaaucaauaagauuguauguuuaggacuuugggaggccgaggcaggcagaucacaaggucaggagauagagaccauccuggcuaacagggugaagccccaucucuacuaaaaauacaaaaaauuagccaggcgugguggcgggcaccuguagucccagcuaccugggaggcugaggcaggagaauggcaugaacccgggagguggagcuugcagugagccaagaucaugccacugcacuccagcuugggcgacagaacgagacuccaucucaaaauaaauaaauaaauaaauauuauaugcuuagguuuuaccuauguaauuagaaagcuccuugaggguaggggacagugauuugccuuccucacauccccccaaaguuccugcacuauaucaugcauaaguauuuaauugaguaauggugaggaaaguaaacaguguuauugaacaaagauuauuaaaauucuggaaacaccugguuuuguuucagcacugggacugaaaguggaauuccuuggauuuugcuccauugguggauaggauagcauguggugguggacugguagacucuuucucuuccaagcagauuggguaaaugccccagauucuuacccacuagucagagauuacagauuacugauugauaugguuuuucucuguguccccacccaaaucucaucucaaauuguaauacccacaugucaugggagggaccuggugaaggugacuggaucaugggggugauuucccccaugcuguucuugugauagugaguucucaugagaucugaugguuuuaaacuugugugggccucuuuccucucucuccucuccugcugccauguaagacgugccuugcuuucccuuugccuucugccaugauuuguaaguuuccugaggcguccccagccaugcagaacugugagucaauugaaccucuuuucuuuauaaauuacuuuuauagcagugugaaaacggacuaacacacugauguagcaagguccuuuaaggccccaugugaucuggucccuguuuugucuuugaucucaucucuuucauugucuaccuuccuuucauugucuauucugucucagcccugcugaccauuuuacucacacccaugucauuugcauuacaugacauuccuucuguucagcauaagcuauuuccucugccugcaucacuguuucuccaggucuccccauggcuaacuccuucucuucauuuaggucucagcccaaaaguuaccuccuccaagaggccuauccuuuucauuuacugaacaucucauguacaaaaaagaauauaaaauauauguauacucucucauccacaaaaaaaucucugaagacauuuuaauguauuucaucccauaccuuuuuaugcauguaaacuuuuaggaacacauuuccaugccacuagguauccuugaaaaaauaagggccaccauguauaguugcacagguugugcacugcacaaagauagcaugucacauaucuuaaguaucauggagcuuguaugucuacuauuucaguaccccagcugauaaaagcuuaaguaucuuguucuagcaagaugaagcuauuaugacaauuuuugacagagaaagggguguuuuguuuaaguucacaaucagagaaaugggugucuuguuuaauuucacaaccagagaaaggggugucuuguuuaaauucauacaguggugcuguauggguugguggcaaccccagaaaagacuguuguuaauaucugauaauguuccacuuuauacguguauuauauucauguaacaaucucuggcuguuuguuuugccauuauaaauaacagugcaguaaacaucuuugugugugaaucucuguccaagguucugauaguuuucugaaugaaauuccugucuauauauggcacuccaagcccauaauugaaacucugcuguuaccacuuucuuugaaucuguagaaggaauuuugagaacaggugacugguauauucaggauguugaugacaaggaacagagaaagaacaguuaaaugguuuggaauuuuuccugggcugcauguaaagcagugcuuuugaacugggagcaauuuuucccccaaggggacuuuuggcaaugucuggagacguuuuugguugucacgaauguagggggagggggcaagaugcuacuggcaucuggcugguagaaaccagggaugcaguucagcaucuuaaaaugcacaggacagccuuucucaguaaagaauuauccagcuccaaaugucaguaauaccaagguugagaaaucuugauguaaucgaugucauggguuucuucaagaggaguggguggauuuaggguuuuugggugacuuaaauuuaauuuacaguuugucuuccuagcugggugucuaagccagcuuucugugaacuuuagaucccacacaagaagcaacaggcuugcuaccgacagauucguugauguaaauauagaugaguguauagaaggaaaucucacccagagcuggaaaauguuggaaugaaaacugcggcggccuccccuucucucuccuuccccuucuguugcccuguuugaaaaucgugccuuacuuucuuuggucuccuggcauggugaaugcugcugguauggacuguguuucuauauccccuugauccccacacccuuaggaacguacaggagagagacccuggagcauaucagcuuagagauggaggggaaugggaaggagugcguucauucauucauaaauguugacugagcaccuacuguaugcuaggugaaugggaggacgugagggcagggaggugacaagguuggcuuauucugggcuuugugaacuauggugaggauuuuguuuuuuuccaaaggaaauggaauaaccacuccuuuuuuccccccgauauaccuaaacuuuuugauuuucauaacaaaaaugggcuuccuuuuguauauuuguuuugagaccagccguuuuuccaccaacacugaucacacugcagugagcauccugguagagaagucuuugcacacuucugucacuguuucccuaggacagauuccuggaaaugguauggcaagguuguaugucaggcuuuugggccagguugcaagaaacaggaagucugugcccuuucaaauuccaagguccccuuucccugacgacguggcccaaucaggcuugcccucccuugauuuuacaucuucaccaaucagauaagugaaagugaaauccuguugugguauccugugcauuucuuuggugacuuaagacauagagcauuuuccagaucucugugggcuguuuggauauccuuuccucuguuuucucaggcacauucuuuaccgaugucuuugagggauugagcaaguuucuguugaaauugaggcaugucauggcucuguguggggcuugaggcaguccaguguaguggagggagggaggcuguggagccuggcugccuagguucaaauaccaacucugcuuauuuccauucauaucauuuuaggcaaaucacuuagcccccugggccugccuuuccucaucaguaaaagugguauaacauuagugccugcauuguggggugguugugaggaaagcagcacucaaaacaguaccugacacacagugggugccaaauaagagucugauguauuaguguuauagguaucggccuccucccuccccagugcaauagugugugugcgccucuguguaccucuguuggugcugacaagcccuuuuuaaaauuuagaggugaggucucacucuguccccuaggcuggagcacaguggugcaaucauggcucacugcagccucaaccgccugggcucaagcaauccucccagcuuagccuccugaguaguugggacuaucggugugcaccaccacaccuggcccuuagacagccccuuuauuucaaagcgaaauggcagccacaagauuuagugcaagcucuccaagcuuuaggaccagcugcaacuccucuaacugaccaaacaggaucccccauguccccaacccccaaaaccugaugaaaagcaaacagaccauuuuccacauucaugacggaaaggcccuuuucuuggcuccugcccuugcucaugucaggauuucacuccaucccugauaaagaggaagcaccaugucccaggaggacauggaaacucucugcuuuguggugaauaguuacaguaacaguagcuccucucuguggggagcuuaugagccccuaagcuuuauagaacugcccuggcaguuuaugagaacuucaucccagcccccagagcucauggcacuuauuuuugcccccaguuugcagaugugcacacugagacucagagagcuaacacugcuugccaaggucacacaucuagcaaauggagaaacuuuaugagacaggugaaggcacagcaaggauaaaaacccagagggaaaaauacucaaguuuucuccgggaaaccauuugcauuccagagagguuggugugcgagugggcaagagaugucgcgggacgaugguuaagggacagagucugagcucaacuaggacuagguuucuuccuuuccuuccuuccuuccuuucuuccuuccuucuuccuuuccuuugucuuucucucccucccuuccuucuuccuuuccuuccuuuccuuucucuuucccucccucccucccuuccuucuuccuuccuuacuccuuuccuuccuuccuccuuuccuuccuuuccuuucucuuucccuccuucccucccucccuucuuccuuccuuucuuuccuuccuuccuuuuuccuuucucuuuccuuucuuuccuuuccuuccuuccucucuucuuccuucuuuucuuucuuucuuuucucuuucuuucuuucuuucuuucuuucuuucuuucuuucuuuccuuucuuucucucucucucucuuucuuuccuucuuucuccuuccuuccuuccuucuuuucuuuucuuuuccuuucuuuucuuuuguuuuuugagauggagucucgcucuguugcccaggcuggagugcaauggcacaaucucagcucacugcaaccucugccucccgguucaagcaauuuuccugccuuggccucccaaguggcugggacuacaggcacgcgccaccacacccagcuaauuuuugcauuuuuaguagagauggaguuucaccauguuggccaagcuggucucgaccucuugaccucgugauccuccugccucagccucccaaagugcuggcauuacaggcgugagcuaccacgccugggcuaggacuagguuucuaucggugguguggcuuuugggaagcuaccuaaucuuaaccacucuguuucgucaucuauaagauaagcaguguagcauuuucuugcaggaauguugcaaggauuaaguggauggugacuguaaaacaucaugcguggcacauaguaaauucucagcagguagucauugcuggucauuuacuuuucucuaaugaccagcaagcucuuaauuuccuccuuggcaugggcacugggacguagauggacaaaacacagagagaaauaaacacacggacaaaaauccccgcccugguguggcugauauucuggguggggagagagagggaguccaaggaccagauaaacagguaaaggauaguuugagugugguaaguacuaaggcucaaaaauaaagaucucccaggugaucuuagcugcauuuggaggugacaggagauacaacugagaaacugagauaggaggaaacccaaggggagaugugggcuugauuuagggugaucugaggaguaggagaagucaggggcugguguggggaggcucugaugguucucucuggggagugaagcagggauucguuggggagacccaaggggacaggugaaggccccugaacagguggccagugcugagaaaggaaagguggaggacccaagugaguuccuaauuucuucauugcuccccuaagguguuugucucacccuuggccauagucuuggaucacuuacagaugcagaccaggcugggcucaauggcuugugccuguaaucccagcacuuugagaggcugaacccaggaguuugagagcaggcugggcaacauggugaaaccccgucucuacaaaaaaauacaaaaauuggccgaggguguuggcacaugccuguagucccagcuacuugggaggcugagguaggaggaucucuugagcccgggagaccuaugcugccaaauaagguaggcaguagccacacauggcuauugcaauuuuagaaauuaauuacaggccacaugugguggcucacaccuguaaucccaacacuuugggaggccgaggcgggcagaucaugaggucaggagaucgagaucauccuggccaacauggugaaaccccaucucuacuaaaaauacaaaaauuagcugggcaugguggugcacacccgcagucccagcuacucgggagacugaggcaggagaauugcuugaacccaggaggcagaggcugcagugagcugagauugcaccacugcacuccagccugggcaacagagagagacuccgucucaaaaaaaaaaaaaaaaaaaaaaaaaagaaaagaaaagaaauuaauuacaauaaaaacagucccugaguuucacuggccacauuugaagugcccgaugacccuguguggcuuagugaccacugugcugaauagugcagaucuagagcauccuacuggacauguugccagggucccugaaccaacagaauuagcaucuccugggagcuuguuggaaaugcagaaucucauccccuaccccagaccugcucaaucccaaucugcucuucagugagauuccucaggugaucuugacugcaccuucuaaucacuuggaagcuuuaaaaaugcugaggcugggcacgguggcucacguguguaaucccagcacuuuaagaggccaaggcggguggaucaccugaggucagaaguuugagaccagccuggccaacauggugaaacuccaucucuacuaaaaauuacaaaaauuacccaggugugguggcacacaccuguagucccagcuacuugggaggcugaggcaggagaacugcuugaaccugggagguggagguugcaguaagcugagauggcacugcugcacuccagccugggugacagagugggacucugucucaaaaaaaaaaaaaaaaaaaaaaaaaagaaaagaaaaaggaaaaugcugaugccccaagcuccacccccacagaugcuggagagauuuguccagggcuuccccuggaguggggaauguuugaaaacuccccaaggguuucuaaaguucagccagaguuagcagaaagcccauuagguggcuaagcagguagacugaaguuggagcugugugaccuugggcaagccacuuacccucucugaaccacaagcucccuucucucuaaaacuagagaccugcuggcaccucccucccagggcugugagaaguaaaugaugggaugauucaaagugcugaguagggucagaugcaguggcucacaccuauaauccuagcacuuugggacgcugaaaugggaggauugcuugaagccaggaguuugagaccagccugggcaacauuuaaacauuacccagguguaguggugcaugccuguaguccuagcugcuugggaggccgagguggggggaucccuugagcccaggaguucaaggcugcagugaacaaugauggugccacugcacuccagccugggggacaagagugagacccuauuucuaaaaaagaaagaaacccaaaaugcugagcgagugccuuggauugauaguaagcagugccuguguaauaagcaugaauuuuaaaaaaugaggucagcagccuuagagcuaaugguuaauggguuugggugugggauuuuuuuuuuuuuaauuuuuaaaacauugagauaaaauucccauaacauaaaauugaccauuaaccauuuuaaaguguacaguuugguggcauuuaauacacucaguguugugcaaccaucaccucucuguaguucaaagaccccaaaaaggagaccccguacucacugagcgcucacucccugucucuccccgcucccccagccccuggcaacuacuaaucuucugucuguauagauugaccuauucugauuuuggggguuuuugaacucgccuucccuggcugacaaccucucgccauccaggugagacugugugaaagcccagcucccugcauuucugggucuuccucuccccacugggggcugcccccaccuguuucccccucugggcacccugguucuacucaucagccuggcuuaaucccagcagcagguccauguucugcucuccuguggcugccacaaaugagagguuucaucucagcuggguuucuccuaguuaaauauuuaauaaauaagaccuacaacuugugaugcugggaguguuugauagugaaauuaaugauggggagagaguggcaggcggcccacagguccaugcuggagcugggaugaggcgcccugggcaggcguccgugccacugaugcuugggaaccacggugggccaugccaucccauuucccccagccagggccucuuuuuuagcacuguguccagcacaggguagccaccugauaaauaaguguuaaaagaaagagaggcugcguguguagggaagaaggaagagacagaggagacaaagaggagacacagagagagagagagagaugagagagaaagaaaaguggaaggugagaaagagacagagauggaaggggagagaaggaccuggauggaggaagugcaaggaaggcaauggugagggaaaagagagagagacaaagauggaagggaugaaggagagggagagauauggagguagagaaagagagacagaaagaagagagagaauauugcuucuuguaucuuccccuucuccuguuauccuugaccaucuuauuauuuuuuucuuuuuucugucucuccaguucucauuuccuuacccucgccgucuugccaacucgucaucucuuuucauuuccugugucuauguuaucuuuuaauuuucugucuggguauuuuccccuuuucucuuucucagcauaaacuguugguugguguaugugucuucuuucuuuuuuagucuuuaacugacguguguguguaugugugugugugagagagagagagacagacagacagagagagagagagagagacagaacaaaccuagagagcaguguaggaacauagaugaacauuuuaaagaccaaaccaugaagcguacacccauuuuacccaggucaagagccacagggccaccaucagauucucccucaugcucauccucaaucacagccacuccuucccuccuggaggaaccacuauuggagauuguaugggaaccauucgcuugcuuucuugugugguuguaccaccuaaguacgcauccugaagcaauauagucagauauuaugugguuuugaguuuuauaugaauaaaaucaugugagaggaguuguuuuguauuuugcuucauugguuugcaguuaccuuugugagauuucauccucauuguggucacugcagcuccuucaugaucuuguuuauucauugaugaugagcaugugacuuuguucucuuuugggcacuggcauaagcagcuuuguugguuguuuauggauucugcugcucgcuugcaggggucucucuggagcacaucgcucugugugaaauuguuggauacuaagauuuguacauuuucaccuugacuaaacacugccaaacaauuuuccaaagugcuugugcuaauuuacacuccugccgguggugggugagcauucaagaugcuucacaaccuugccaacacuugguauugucagguuuuuaaguuauagccuuucucauggugauuucucauugugauuuuaguuugcaucccccgauugcaaauuagagugaacauaguuuaaaauauuuauugacuauucaagcuugcuuuuuugugaagugccucuacaugcucuguccauuuuugauuaggucacuuuuaaaaaaaaaauauugauuugugggugauccuuacauagccuggaaacugauucuucaucauuauauguugugcaauauuuucucuuggcuuggcuuuugaucuuuuuuauaaugucuuuugaucaccaacaguucuuaauuuugaugugguugauuuuagaaaucuuuuccuuuauaguuugugggcuuuguaucuuauuuaagaaaaucauuucuacccugaggccauggauauauuuuauguuauuucugaaaguuuuacaguuguguucacuguaugucuuuaaucagcuugggauugauuuuuauauguggugguagguagggguccaauuuccuuuuuauuccauaagaauugucccagcaucauuuauuaaaaagcccauucuugccccaaugaucugcaagacaaccucuugacuguuuaacuuuuaccuucuuucaucuggucuguuuuuauacucaaccuuugaagccacaaauauuuauugagugccaacugugugccaggcacugaguuacagugacggauaugacagaugcaaucauggcuuucauggaguuuacagucuggcaaggaugacauguaaauaguuauuacuacuuauaauuuaaaauguuauaggccuugcaaaaagggacaagucuggcuugcucuaaaagaaacaugugaaacaacaucuuccagggaagugcugauaaacugagucuuuagugggccucugcuauuguaggggugggaaugguggaaaagauguuuuggccacagggaacagcaugugcaaagguccuguggaaggugcuuaggaguuugauauuuauccuaaaggcacugucaggcuacugaagcaguaauacaaugauuuuaugucugugaauaguuccacugguugcugcauggagaauguauuggaauacagcaagaauaaaaagccaugagaccaauuaggaaaugauuucacucauucagggaagugugccuugggcuggcaugguggcuguggagauggaaaucauugaucagauuaaaagaaauuuugagcuggcaugauuuuuccccucucuccccucucucuaucucuguuucuuuucugguuguguuuucugggugagaaaagcaguuugugauccugccaaggguaugugcucuggaggauguauuugccacagauggucuuuggaauucuggccaagagagucacuggacagccccuggcccccaggguuucuggagccaauucaacaaugacuguuuauuaacaacagcaaggaugaguugcuagccuuuccuucagagcaccuuuuaacuguuaccuuacuuuguuacccaaaccgacacuauggaauuggugggggagaaguggaaggguuuuuaucuccauuuuuuauagaacgggggaaguuaauuggcacucuugaaaucauacaaaagauguugguuucaggauugguuucuggacuuucagcccaaucccaauuacucaagcucacacacccaauccccaaacauacucuuuugcaaauaauuucccuacugaggugcuccuggccaauuuaaaagguccccauuuccuugccuauaaaaugggaauuaaaguaaaaauaucuaccuguugacuugcugugaggucagugggccugacacaugguguggacucauuauauuuaccuaugugaaucccuuaguucccuuuacuuggaagagguggaaaacucaaaggggcuuaaacaagaaguggggauuguauuggcucaugagacugaagagucucaggaguguccagcuucaggcuuguuuggaucuagggaucagauaacaccauuaggccucuguuucuguuucuuggcucuacuuuuugcagcuggcuccauuauccaugacuuagcugcacuuccagcccuccagucugcccaagaccauauucagagagagauucuucucucuuuuucagcuaucuucccggaauuuucagcaaaugcuuucuugcuuuugauuggcuguugcugaggucgugugcucaugccagaaccaaucacuguggggaaaugggagguggagaacggggugcucugauuggcuuaggcuugggucacaugacuuuauggaguugggguggagccaacuucuccaaguggggaagagcagucuucuuaaagguguauuaggauaugcuugcugcuguaacaagcaacccccaagucugcaguagcuuaaggcaauacgaauguacuucucacucacccuaaauccaaucagauaaucagcaaguggcauuccauguggugauuucaggacccggcucuuuccaucuguggcuccaccauccccuaagaucagaaaguccuucacuuccggccuguaggaaaagaguaugaaggcucacacaggaaguuuugggaggccacauauagaaguagugaaccuuacuucugccugcauucuguggacuggaauuucaucccaugguguaugagagagggucccaguaggaaacggaagacacagaccaagaaucaaauuaagagauagcuuaagaaucaaauuaagagauagcuuacaaaggugugggcccuuacugaaauagagaaggaggaagagaggaaggaggcagagacagagagagacugagacucacaaagacacacacacacacacacacacacacacacacacacacacacacacaaguugagagaaagaaggggggagagaaagagagagagggagcauuuccuaacaggaagcuggcagaauaaaugucccccauuguccaaagccagagggcugggagcccagugagcccauccacacaggucagccccccaugugacaguccuagaaggguaaagaaggaaggagaguggauuugggguaauggaagacagccaauacccaugguccaucugacugcagggggaacugagaaauucaguccauggagaagaagguuuaguggacacgucacuuugucuuuuucacaaagugaaacuagguucucagguggaaaaaagaaaaagaagguuugccuugcugcuauucuuuuuuuuuuuuugagacggagucucacucugucacccaagcgggagugcaguggcacgaucucggcucacuggaagcucugccuccuggguucacgccauucuccugccucagccucccgaguagcugggacuacaggcacccaccaccacgcccggcuaguuuuuuuguauuuuaguagagacgggguuucacugcuagccaggauggucucgaucuccugaccucgugauccgcccgccucagccucccaaaaugcugggauuacagacgugagccaccgcacccggccuccuuacugcuauucuuauuauuggugguagcagugguggugaugguuauugguucuuaguucccucuacaugccaguaucugcucucuucuuuuuuucucccuuacuucuuuccuuguucugcaaauucuuucccuuuaagugaaaaucuuuccguguucuccaagggagauaaauucuaugccaagcuugagugugggguccucugcuuggauagcugucuucuccaggagaugagguagaacugagauagugggggucucugcaggcagucugugccccuggcaagccccucaccuuaaccugaggcuggguggggaaagaugccuugauggagucagaacagaaagcaagugaucgcugccugaaccaagcagucacuuuccuggaggugaaaccuagaaacggucccucaggcuggguccagggagguggacuugggucccaggggcaggaagcaaccugccccucaccugcuccuaccucuuuguagccuaucuuggcaaccagaaguagguauacaagugacguugaagcugggcauguuaacaauggugugagcccgccugacuccaaucugguccagcuguacuggccgugcauccucaucuccagcccccagggucagcccagcggcuguaacaauggucuguccccuccccgccccacccacuucuuugaacuccuccaaggaucugugaugauagggcugucacugucuuagcuuccaccauucaagcuuaaccggccuucuuccccuccauggagaacggaagagcaaccccucauugccucuggcagcugaccagcaggucccugccuucugcccacucccaggucuaggacaaugaggugagagguagacaggaccaaguuccccagugcugucuucuagguccaccuaucaugagagccgugauuccuaguuuuuaucacccucuccccaacuuugccagcucuccacuucuggcagugguggcugcccaugacuucaccuucccgugccucaguuuccucaucuguaaaauaaggacagccaugguaaugagaguucuggucaauaugccaggcaccucgcuugcaucaauuuagcucauccuuucagugcccugagggguggguacuguuaucaucccguguaacaaaaagagaaaaccgaaacagagagagagacucacuaucugaggucuugcaccccucaagcaacaaaagugggauuucagccuaggcuaucuagauucggaguccacggucucaaugaauaauaacaacaauaauaauauuguccuaaucugaugaguuuuugaucagauucaauacaagagcauaggcagaaaagcuuagcccagugcccagcacaugguaagaacucagcauguuauuuauaauaguaauaaaccauuuuauguuauguaauuauauauucauagauaaauauaguugacucuugaacaacauagggguuggggcaaugaccuccugugcagucaaaaauguguguguaacuuuuuuucucuauuuuuuagaaauuuuaaaauuagagacaaggucucgcuuuuguugcucagguugaucucgaacuccugggcucaagugauccuccugccucagccucucaaagugcuaggauuacaggugugagcccccgcacccagccuguguauaacuucugacucccccaaagcuuaacuacuaacagucuauucuugaccagaagccuuaccaguaacauaaacagucgaugaagacagauuuuauauguuauaugcauuauauacuguauucuuacaauaaaguaagcuagggaggagaaaguauuauuuuaagaaaaucauaaggaagagaaaauauauuuacuauucauuaauuggaaagggaucauuauaaaggucuucauccucauugucuucacauuaaguaggcugaagaagaggaggaguuggucuuguugucucagggguggcagagguggagguggaaggggaggccagaaagacaagcacgcuugguguaacuguuauuggaaacaaaucuacauaaguggacccauaaaauucaaaccugaguuguucaggggucaacuauauaugcuacaaauacguaauaugcuaauauaguuguauguuauuguuauaguacggggaucagaaaauguuuucugcaaaggauuagcuagaaaaugucuaguaaauacugucucuuugggaccacucuacucugccauuauagcaaaggcagcuacaggcaauacguaaaugaaugggcauggccauuugccaauaaaacuuuguuuacacaaacaagccaugggccagaguuugucaacggcugguauaguauauguuauuauauauuagcuuuacuuuuucuguugcuuuguuuauguucuucuuugcccuuccuuucuuaaaggccagccuuucuuucucucuguuggucugucuuuuaggacagcauggcaggccacugggacaugggcucuccugacuccaggcuuguuugucugauaagacaugaagagugaagguggcaggacucugagcucaggccuguccuccuccucuucccucucuucguuuuuucuuuccucuuuccucuuuucuucccaagcuccagaaguugccauuuuccuuucccauugcugauuuucucugccuugggagaaagcccgagaagaucacuuggaaaagcccacgagcaucucuggccucacucacccagcuccugccauugucuuuacucuuccucagacacaccaggcacaguccuaccucagggccuuugcacuggcuguuuccucugucugcauuguucuucucucaggugaccucauggcuucucccuccucuccuucaggacuucacucaaaggccaccuucucagcauuugccucccgcccuucugccuuauuuuccccuuuggaacuuuucaccuucuuacuuacucaucugucugcuaucugucacccuacaucacuaugaucuccacaagggaaggugauuuuauucguuuuuuguucuguuuuguugaagaugagguuuugcucuuguuacccaggcuggagugugguggcacgaucugggcucacugcaaccuccaccucccggauucaagugagucuccugccucagccuccugaguagcugggauuacaggcacccaccaccaugccuggcuaauuuuuguauuuuuaguacagaugggguuucaccauguuggccaggcugaucucaaacuccugaccucaggugauccacccaccucagccuuccaaagugcugggauuacugugagccaccacaccugaucuuuugguuuuacccaccaauguggacuagaacagccuagaucagcagguggcaugcaguaagcaguugauaaauauguguuggaugagugagcacuguggcuucugucauucuguugcucaauagcauucaucuggaaauaaccacaguuuguuuauccauuuaccuguugauuggcauuucuguugauucucguuugggccauuaugaacaaagcugcugugaaauacuuauaccuuugcccaauucuucacuuggugaacccuuauaaauccuuuaggccaggugugguagcucacgcuuguaaccccagcacuuugggaagccgagguaggaggaucgcuggaggccaggaguucaaaaccagccuggguaacauagcaagacccgucucuacaaaaaaauaaaaaauuggcuggacguggcaaugcaugccuguaguuccagcuacuuaggaggcugaggugggaagagugccugagcccaggaguucaagaccgcagugagugaucgcguccugcacuccaggcugggcgauagagugagacccugucuguaaaaaugacagcaacaacaacaauaauaaaaccuuuagguuuccucuuaaaaggaacauccuuagagcuuuuccugacccagcaacucaccccaagucugaauuagacuucaccccauuucuuucauaacauuuaucacaaugacauguuuauuuugugggggcggguggcauucuggccagaacugucgacuuccagagugaaaauacggaagaaccaaauaaaacacaacacacacauuugcacagcagcucgagggaggugcuuaguucuuugaguuuccaagaacagagagacgaagauuugucuggggaggaaaaaucagggacugcuucuuggaggagguggacuguugcugccccauccacccacacauuugcagauguggugaugagaagaugacugucacgaggucucugagcccagggggcccaugguugagugcaaagauagugggguugacaaauaaucgucguauaacaaaagaaaagccaccacaguugcauaauggaaaggcggcuucuauagaacauucagaucauaguugaaggcaugucacacuguguuacucagaggccacugucagagccaaaagugagaguggaugagaguuugggcaggaaacaacugaaccagauacagcaucaccuccaugagggcucagcuuuaucuauuuugucuucuguugcauccccagcccuuagaacacugccugguccaucuuugcugugugaauaauaauaaggaacgaucgcuguguugaguuugggcugugaauucagacaguuugcugcugcauaccugauuaugagucucaguuuuccuccuccauaaaaugggcaaaacaguccuugccucauggggcugugcauuuguuuagcaaacacugaaggaguauacaugguggccaaggcacucuucaagacacaggaagcagacaaaagucccugcccucugggagcuuacaugcucauggggagagauguaugauaagaaacaaaaauaguagguaaguugcauaguacuuuagaagauuauaaggguaaugggaagagaacagcagagaaagggcuggggaggcaguugcuguauuagauagagcuuuaucgaggcgauggcauuggagccaagacuugaggaagcugugaggaugucuagagaaagaaggaacagcuggugcaaaggcccugagguagggguauaugugacaugugugacagugaggaggcagauguggcugaagccagugagcaagagagagggaaggugcaaggauaaggacagagaggugacgggacagguuuuggagggccuuaugggcugcggggaggacuuuggcuuuugcucugagggagcugggagccacggagggcuuuugagcagaggagggacgugaccugacucagauauucauaggcuccucuggcugcugugaaaagaacagacuuugaagguugggggcaggcagggcagaagcuggggaauuaggaaggaggugacaguguugguccuggcagguaauaguggggguggaaccagguuguugucuguggagauaauaaugaguggcuggauucugguuauaauuuuuaaguuuuuuuauugugauaaaaugaauuuuuuuauugugauaaaaugaaauuuaccacuuugaggugugcaauuccacagcacuuacuacagucacccuguuaugcaacagucaccucuauuuaaucucagaacauuucauccccccuaaaggaaacccugcacccauuaguaguuacuuccaguuucucccuucccccagcuucuggaaacuacuaauucuggauauaaguugaaaguugaccaguaggauuucuaggcagacagguggugagggcucaaugcauucaugcacagaaaguacucagguggcauaucauaggugcucaaaacugaaauggugaugaugaguuggcaaugauggugaguccuuccagaaucccugcucuagugcuaaacugaccuaccuggcuguguagaauucucaccugcuggccgggaggguggcagaaccaggaucccuucuuacuuccagucuggcuuggguuagggauaggggaggaaugaucagaagaaccaagcuagcaccaucuguucuggaacaucauccaacucuuguccagauuucccagaacugagcaggaaaauguccagggaggaacagugcagcugauggaaguccugguaagcccuggccccagcuuccugagcugcuguugcaccaacuagcauuuguuggaccuucagucugagccaagauggcagcuucagaggaagaacaagaaguguacaaguuucuuucaugguuguguccccgccuccuuauauagccucauauaaaccccugcacuaucccguuacuguuugccucucccugaaaagaguguaaaacucccccacuuuuucccuacuuuucacaauguguuuugguuucuaaagaugaaacuccuuuaauuauguucugguuguaauuuucuggcuccuuuuauuucucccuuacuugauguauuauuuucccuuguuccuucugcccccugccuccauugauguuucucuucacugcuaucuagauuuaauucucaacuccugccaaguucagggugauagugcaaaaagacauggaccauuuagucuugaauucaggucccacuucugacaccuucaaagcugcuuuacuuugggcaagucauaugaucuuccugaggggguauccuuuaccuuguucagcuaacauuucuuguuuuucucugggcacagaguagagugucauuuuccccaccucccugaaguuagguauggcugugugauuugguuucaucaaugaaaugugaggggaagugacgugaguccuuccggacagaagccuuaagggugagcaugggauucaccauguuuccuuuuuccugccuccacugucauggaugcacaaagauggacccucucucaaaguaagugcuggagagaggaugacauagaucaguccccaucccacuucauagcaugaguagaaaaauagaccugggguguguucaaccacugagaucuggggauuguuuguuacugcagcaggacauagacuaggcugacuguauaccucauuaucugcauuuuggggcugauaucuaaucacagugucuccaggaagauuauguugauguauguuuuagggauggauauucauauuuuccuauaagggcucaauagguuuggaaaugucacaugcauguaaacuucugauuaacaaauauuucuugcuuuccaauuucuuccuauagugcuucuaauuuuccuguuuuucaaucuugaauaaaaugugagaaguguuugacuucuccuucgaggagauuaaugguuucuaaagccuggggcauugauuuagucauucucaaccuccuuguuucuaugaccuuuuuuucuccuucucuggucacuuagugucugcuaaggggugaaggaaugucuguuuuaacucauugcauuuuuuuuuuuuuugagacggagucucccucuguugcccaggcuggagugcaguggugugauguuggcucacugcaaccucugccuccuggguucaagugauucuccugccucagcaucccaaguagcugggacuacaggugucugccaccacucccggcuaauuuuuguauuuuuaguagagacgggguuucaccauauuggccaggcuggucucgaacuccugaccuugugauccgcccgccuuggccucccaaagugcugggauuacaggcguaagccaccacaccuggcaaacucuuugcauuuuuaacucuugacaucuucaucuucuuuuucccaccuccccuuugccuguuccuccccugcucaccccaccagggaguuuauaaucagguucuagaaccugcaauguuuuucuguuguugucuuccaucuuccuugagucuuaugggaaucggccauagucgcaaauuaacaaauagcucugaagcgccucaagcuuggaggcauuuccuuuugcucaccuaagcaagauccuggagcuguugcaaauauccugcccccuacuguaaaucugucuucaugguuguaagagauucagucggggucagugaagacccgagcaggagaucuuggccgaggcuccuugauguucugucugcgcuggguguugucauauugauuaagcuccugggacugcugccagcagccucuaggauuaaaucaauagaguuugcaaaaguaaaagcuucuuuuggagacacagaauauguggguuuauuuuuuaaugauaaagcuucaaggagaaucuucauggauggcagaaccagugauggaaaaggcgaggcagacccaaauauuuggggaagugcaguggggagcaagugagggagguuucauugggaggccggggcuuuccagaaaaucuguuuaacuggaguugcuaaugcaacagcucagaguuagaagugaagguggaagaugcaagaaggacugccgcugagauguaaagagaaaugaaggagagguggauccauuugcucauucaauaaacauuuugggaggcaggggggugggggggagccugccaugugccuggaacugggauguacaugguggggacaugacagugggcaggacagaugugguuccuccuggcccuccuggaacuuguaacaggaaaagaaggcauaaaauaaggaauaggcaaauacagacauaauuacuaauugugguaaguguuugggagaaaaccagcaggguccuguguuuguuuccuagggcugccaggacaaauugccaugaacuauauggcuuaaaacaacauaaauauauugucacccaguucugaaggcuggaagaccaaaaucaaggcaucagcagugcugagcucccuuggacggcucuagagaagaaugcuuccuugauucuuccaguuucugguaguuguuagcauacauuggcuugauuggcuuguggcugcaucacugcagucucugccucugucuucacauggccuucuccuucaugucagugucuucucuuccucuucucucucucucuuuuuuuuuuuuuugucagggccucacucugucacccuguacaagaguacagcagugcaauuauagcucacugcaacugcugcuucccagcaucaaacaauccucccaccucagccuccugagcagcugggacuuacaggcgugcaccaccauacucagcuaauuuuuaaauuuuugauagagaugggaucucacuauauugcccagacuggucuugaacuucugggcucaagugauccucccuccucagccucccgaagugcugggauuacaggugugagccacugcaccuggccucuucugucucuuauaaggaucuuugucgauggauuuugagcccgucagauaauccaggacaaucucaucuugagaucucuaauuuaauuauacuugcagaggccguuuuacuaaauaaggucauggccagaggcuccagaggcuaaagcauggguaugauugcaccacugcacuuuaggcugggugacagagcaaggccccaucucugaaaaauaaaauaaaauaaguaaccuacuacaggcccuuugcguagaggauaauuagaaguacagggguaccacguaagugaagaccugaagguuguuaagcacagagcagagugugaacagaaugagacagagggaggaagagaaucccaggcagagggaacagcaugugcaaaggcccuggggaaggaacaaguucaucauguuaaaaaugagccaguguagcuagagucugaugagcaaagggacucacaggugggaagacacccaagaaguuggcagagacaggucacacaagaccuucuaggucaaguuccggaggugaacuuuauucuacaugcaaugagaaguccucagagaagcuuaagugggaugggacagaacugcuuuacuuuaaauauauauacauauauacaaacauauaauauuacauauauaaagcauauauauguauacauauauacauaucuaucuaccugucuauauauuuuuuagcugggcaugguggcucacaccugugauccuagcacuuugggaggcugaggugggaggaucacuugagcccaggaguucaagaccagccugggcaacauagggagaccccaucacuacaaauaaaaauaaaaauuaaaaauuagcugggugugauagugugcaccuguagucccagcuacccgggaggcugagguaggaggauugcuggagccccaaagguugaggcuccaguaagccgugauugugccccugcacucuagcuugagcaacagagugagauccugucucaauaaaauaauuuuuguauugaggugaaauucaugcaacauaaguuaaccauuuuaaaaugagcaauucaguggcauucagcgcauucacaauauuguacaaccuccaccucuuucuagugcugaaauauuuucaucaccaccccuccagaaaacccuguauccaugaggcaguugcuccucauccuccccucccgguauccccccaacccccaccacuccugguaacuacaaauuuguuuucuguuucuauggauuuaccuauacuggcucuuucauauaaaugaauucaggcacugugugaccuuucgugucuggcuucuuucacuuagcauaaugcccuggcuucucucuggagaaugaaauggauagaccacuuuggagucuacugagauuauagauauuucugugggaagggacaguggcuugaccuuggguggugcugaagaggcaaugcugagcaggaggauucaaagucuaauuucggaaguagaauugguggggucugaugauacaucagcuguagggggaggaagauguaggaacugggaaggucucuuaggguaaccuuaccugauugagcuccuuacuaggcagcuggugguacaauucauaacaaagguuaauagagaaagagacaugggauuagggagggaauggaagaguuugggccuuggacacuguagugguuugaauccuguccaccaaaaauucagaugcauuuggaacuucagaaccugagaccucauuugaaaguaggaucuuugcagaugucauugagucagggauugagaugaggucauccuggauuacaguggacucgagauuccaugguaagugcuuuuauaugagaagguacaggggagaaagucauguggcaauagaagcagagaauggagugcugcagccacaagccaaaagacauguagaggcaccaaaagcgggaagaggcaaggaaggauccuccccuagagccuuugaagggaaacccccuaauuucagaaccuugccuccaggaugacgagagaauaaauuucuguuguuuuaagccacccaaucuguggcaauuugucaugacugcccuaggagacuaauauagacacuccuaugagaugcucuaagaagacacagagugguauagcuauugcuaagaccacacacuguagcagggaggaaaucaaauggagaaaugccccaacucccccuccucucugaucucuugcuggugccucccguuggccaagccaacccagaaggcagaagaugugguggagggcagcguugcagggcuuggaugaugcagucacagaagucagcccugccucuaccaggaugccaaacagggcaaugaguggauauuuuagggagaaagggcaacaagagaauggcaaaauacaucgaaaugcaugcaagcucuagaaagaggauagagauagauaaagggugauuaccuaggauuaagccccagggaagaccaacauuuagagauuggauagaaaaagaggagcaaaaagggaagauugagaaguagagaccaggaggauaggaggaaaacuagaacaacauuaagaagggcauggucaaguaaucugggcacagaaaaauggcccugggauuuggcagccugggggucuuuggugauccucuuuggaagaguuuugguugagugaugggggcuagaaaccagccuggggaggguaggagaagaaugugcagugaggaaguggcaggaacacgugaaggcaacucuucaugaaggggaguagagaaauugguugguggcugaaggaaaauuuucagucaaggguggagguuuuaaugauggaagaauauugauuucuguaaauugggucauucccauccauuauaccaauaugcacgggugucuucucugauauaggaugcugggauucucaaaugcccauuugaguuuagcaucaugaauuuaaugucaccagcccagauaguugaucucauucaggaaugcuccacugcccagguauggggaaggcaacuaguugaguucaugcagggauggauuuuuuccaggagagaaacaggaggcaagaaagugcgauauaaucaaccuauguaagguugacaaggcaggagaggguccugagaaauggcggggucaguggguugcagggcucgaugggauggacguugguuugcauuuaagggaguuagugagcugggaggugguuaaagaggaggugguucagccgggcgcgguggcccacaccuguaaucgcagcacuuuggggagccgaggcgggcggaucacaaggucaggcgaucgagaccauccuggcuaacacggugaaacccugucucuacuaaaaauacaaaaaaaaaaaaaaaaauuagccaggcgugguggcgggcgccuguagucccagcuacucaggagccugaggcaggagaauggcgugaacccgggaggcggagcugcuguacuccagccugggcgacagggcgagacuccgucucaaaaaaaaaaaaaaaaaaaaaaaaaaaagaggugguucaagacaaggaugcuggaaacagguguuuuggagguggcugguguagcuucugagcaugcauagcuggaguggcuuggaggagacauugguuauugaugaagagguagggacauccuccagugaucaaggaagcaggggaccagcauggacaauggucucuccacagggaaauuggaggucaucaaauguuaacagguuccgucggagucuuagcucccagcuucuguuuuccuguggaucucaggaucuuggcugcuggugcuaccucugacuuuggacuucccauugagcccagcagcacugggagggaccuucauggcauuggcugguuuaaggaagacuuccuuggcuuugcugacuuucuugggggccuucuuggcuacaccugcuuuugagggagcccuccucaccucaccugacuucuugggggcaccuuuuccaccuuaucugaguugggaaggucuuucuuugauucucuugcuuucuuggggcccuucucacugguuuuucugggggccaugaugguggacauauuccagagcugagcuuuccuuuuguucuuaggaacuaauuugaggcugccaguggccccaccuuggucuuagaguugauggucugcagggaauuuccagguuaaagguuuuuuauuuguuuguuuaauuuugagacagagucuugcucugucacccagguuggagugcagcggcacgaucuuggcucacugcagccuccgccuccuggguucaaacaguuuuccugccucagccuccuaaguagcugggauuacaagcacgcaccaccaugcccagcuaacuuuuguauuuuuaguggagacaggguuucaccauguugaccaagcuggucucaaacuccugaucugaagugauccggccaccuuggccucccaaagugcugggauuacaggugugagccacugcgccugaccuccagguuuaaguuuaaaccaugaaguagauggacuguguagagagagaccagggaaauggaggauuuuacugaccacugaacagggaugucacuauugccagagaggaaaaggauucccccuugguagagugaacauauaagggaaagugguugaaaauugaaucaggagacagagaccucacaccacucagaggucccuagagaacuuuacugaccuagaaaaaaagauaaacagggagaaggucuucaguucuuguuuggaaucugacacugaagcauccucacuccucacucucuucccgaccccgagagucugaaauugauuaauacuuuuuguuuaaaacuuggcuuguuguuuuguuuuuucuuucuguuuucaucaagggaucuuuauuuuacuuuuguguauuuguguguuuuccaugagucauguuaauucuuccauguuuaaacuuuuuggcccagaggaauuuauacauuuaaauuauggauuuaauuucagaagguacauacacacacacacacacacacucacucaucucacuuuuuaaaaacuguaaaauauagcccuguaaauauccagaaaauaucuaaugugggccggguaugguggcucaugccuguaaucucagcacuuugggaggccgagguggguggaucaccugaggucaggaguucgagacuagccuggccaacguggugaaacccuauccucacuaaaaauaaaaaaauuagcugggcaugguggcaggugccuguaaucccagcuacucgggaggaugagacaggagaaucacuugaacccaggaggcagaggcugcagugagccgagaucaccccacugcgccccagccugggcgacagacugagacucugucucacaaaaaaaaaaaaagaaaagaaaaagucagugugcauccccucugacauccagcaacuucacaucuuggaauuuaugcugcaggaaaauuaucacaagugcacaaggauguauggugagauaguuauuauuaucauuuuaaaagauagggucucacugugucacccaggcuggagugcagugaagugaucacagcucacugcagccuugaccuucugggcucgagugauccucgugccucagccuccccaguagcugggauuacaggugugagccaccaugccuggcaucccccuuuuuuuaaaaaaagguuuuaauuaugaaaagaauaugggcuuguuguuuugugugguuuuuuaaaagcuuaaaaaauguguagugugucauuuagaaggugaaaagcccuuaccccaucccaccucccagagauaaccucugcuagcaauuucguguuugucuuucaaauuuuuucccacacacauucuuuguacuggcugcuuccccuccuggguuacucuucucccagacagaaacagggcucauucccuugccuccuccagcuuuuauuaaaacauuaacuucccuguagcuggaugcaguggcucacgccuguaaucccaguguuuugggagguggggaggcaggaggauagcuugagcccaggaguuugagacuagccugggcaacauagcgagacccaucucuacaaauaaauaaauaaauaaauaaauaaauaaauaaauaauggaaauuuaaaagagagagggaaggacucuugaaaaccguccauaucaugcuucucuaaaugguugagggcucagaggaaaaaaaaucagcaauuucacaucacggaauuuauucugcagaaaaauucucacaagugcacaaggaugcguggucagaugaugaugaugaugauuauuauuauuauuauugaagaaaguagcagcagcagcagcaguauuuuaaaagacagagucucggaugggcaugguggcucacgccuguaaucccagcacuuugggagguugaggugggcagaucacuugaggucaggaguucgagaccagucuggccaacauggugaaaccccaacucuacuaaaaaugcaaaaauuagccagguaugguggugggugccugcagucccagcuaccagggaggcugaggcacgagaauagcuugaacccaggaaauggaggcugcagugagccaagaucgugccacugcacuccaugcacuccagccugggugcugacccagguuaggugcaagacuccgucuuaaaaaaaaagaaaaggaaaaaaaaaaaaaaaggacagagccucacugugucgcccaggguaaagugcaaugaguaaaggcccaugaugggaacccugaggagagagucaaggggaaagaaaaaaaaaaaagcaaaaccaaaauggaauuuaaaaaaaaucaggugcaauuugcauaacagaaaauuaaccauuuuaaagugaacggcucuguggcauuuacugcacuccaacuguuauguaacuaccaccucugucuagcuccagaacauuuucaccaccccuaaaggagaccuuguacccauuaagcagucucucuccuucuccccuccccaccaccuuccuccagccucuggcaaccacccaucugcauucugucucuauggauuuaccuauucuagguagucaacaggaugagauaucccaaaaguccauccauggaugaacagauaaaccaagugugauaugccuuccucagauauuagucugccuuaaaaaggaaugaaauacuaaucuuugcuacaacauagaugaaccucaaaaauaugauguggcuggacacaguggcuuacaccuguaaucccagaacuuugggaggcugaggugggcggaucgcuugagcccagguguucaagaccacccuggguaacauagcaaaacuccaucucuacaaaacaauuuacaaaaaacuagccagguguggugacaugugccuguagucccagcuauucaggagacugaggcgagaggaucgauugagcccaggaggccgaggcugcagugagccaugaucauaccacugcacuccagccuaggcaacagagugagacccuaucucaaaaaacaaaacaaaacaaaacaaaaaaguugaugcugagugaaagaagccagacacaaaaggcaacaucguguuuaauuccauuuacaugaaauguccaaugaagauuuuuuuuggcaacauuuauuuugaguauaauauucagugaguggaccacacauaugcaugcacugcaguauguucuuggaaacauuucagauuugagaggucuguucagcuaugaugacgguagguauugucccuucccucccuccuugaagaaaaggaacuaaggcuggacgcgguggcucaugccuguaaucccaguacuuugggaggcugaggugggcagaucacuugaggucaggaguucaagacuagccuggccaacauggugaaaccaugucucuacuaaaaaauacaaaaaauuagccagguauggugcugcacgccuguagucccagcuacucgggaggcugaggcaggagaauugcucgcacccaggagguggaggcugcagucaaccgagauugcaccauugcacuccagccuggguggcagagcaagacucugucucaaaaagaaaagagaagagaagagaaaagaaaagaaaccaaaagaaaaggaaagaaaagaaaaggaaccaagaccuagaagggcaaaaauaggaaaaguuggccgggcgcaguggcucacgccuguaaucccagcacuuugggaggccaaggugggcagaucacaaggucaggagaucgagaccacccuggcuaacacggugaaaccccgucucuacuaaaaauacuaaaaauuagccgggcgcgguggcaggcgccuguaaucccagcuacucgggaggcugaggcaggagaauggcgugaaccugggaggcggagcuugcagugagccgagauagcaccacugcagucuggccugggcgaaagagcaagacucggucucuaaaaaaaaaaaaaaaaaaaaaauuggaaaaguuauuuacuauuagcagcaauugucauaaaguaaugaacauuuauugcaugauuacaaugagauaaauuguauccuguuuuuauaagcauauuaaguuuucuuuuuuaaaaaaauguauguauuuauuuauuuuaagagauagggucuugcucuguugcccagacuggagugccaugguaugaucauagcucaaugcagccucaaauucccagguucaagcaaucuucuugccucagucucucgaguagcuaggacuacaggcaugugccaacaugccuggcuaguuuucuuauuuuuaaauguauuuuuguagagacaggaucuugcugugucgcccaggcuguccucaaacuccuggccucaagcgauccucugccuuggccucccaaagggcugagaugauaggcaucuaccucugcauuuggcccacauuaaauuuucuagucaucaugggaaccaaaauaaacaauauaaaacacucacauuccuugagcacuuacuauaugcagggcccuguaauagauuauuguguguaucagcucauuccauucucacacaaccuaugagguugaugcuauuuucuaccuuuuauauaugaggaaacugaggcucagagaaggaaacugccuugcccaaggucaaggccacgucugauccccaaauccuuucaacuccucugcacuacuauuuuuuagugcagauauugccaguuuucuaagcagaagcaugauuuagcagcccugaguagacuucucauuucagaaccaaaguguuggacauuguuggauaauaugaaaaacaaaugacacacaaaccuauuugauacuguuuuuaauuuucucuucauuugauuuuccugaugacaugauuaaucuuuuuugccucuacccuguaugugaaauguaggucuuugcagaugucucagagaguguuaauaguugcugcugguuuuguuuucucuccccggggauucccaucccugggugcaagugaaauuaaacuugugccucuuugccgcuggccguggugcugaaaacaucccgggcagcgcuaggguugcccuuguuagcaugccaucccugcuaagagucuuaggcugaucagcgaguggagagaucuuuuccaggcuucauuuugguuagaacuguguguugaagauuuuaaagcccaugucugggaacuggagacuguuuggauuguuugaaguugaaauagucaugaauaauuccuacuugagaugggcuuaugagggcguggacuagcaugcaaugguuggccuuuacuaaacuguggccauugguugggacuugggugagguguaacccauuuggucuaauccauaugguuagggccccaagugcaccugcauucuauuuuuuuuuuuuuuuaaauaaaggcaaacccaucuaucuucuaaccaggauagcuccugaguggucuuuggggaccaccagcuuaaaagcauagacugugggcugggcacaguggcucauaccuguaaucccagcacuuugaaaggccaaggugagaggaucgcuugagcccaggaguucaagaccagccuaggcaacauggugagacccucaucucuacaaaaauguuaaaaguuagccagguguguuggcaugcaccuauagucccagcuacucaggaggcugaaguggguggaucgcuugagccugggaggucaaggcuacagugagcugugaucgugccacuguauuucacccugggcaacagagcaagacccuaacucaaacaaacaaacaaaaaaaggcauagacuguggaguugggcagaccugggugugagccccagcucugccaguaccuccuaugugaccuugaaaauuuguuuaaucucucugagccuggauuuucuuguguggaaaaugaggcuuaccacagaacccaccuuguagaaauguugcaaggaauuaacugaaacaaagugcuuaccacgguaucugcccaaagaagcaguuggaaacaaggcagcuguaauuauggucgcugugcuuguuaauggccccauaauaguugaucauauugcagagugaaauugggguauguguuuaauggaccaaggaauaugucuuaaacccauauaucuaggguucugguacccucuacucuuuuuccuggugauugugaugagcauggaacuuacaugaaaaugaggucuguuuggcuucuucacacaagcucaaugaccuggcuaacugcuacaaguaucuguuuccuuagaacccacccaucagcaguccccauaguggagacaaggucacaaagaguugacaaaccugauuugauuuccgcaccaaccacaggaggcuugaaaugagaugagggugaagggcaccacagagggaugcaaggauuacuuggacacugcaaggucuugcuaagggaugggaaccaucagccacgcccacuuugagaauuuuccuucauguucugaaucugaagagcaagguccuguucucagaugcaagcccuccuucuucccuacgcagagucaaacuuggucuuuuccagggucacauacagccucucucuggggccucugcagguccugaucaauuucauuguguauagagcucugugucuccucaccugccugcagggcugucugcuauccugacuuccgagagccauuucggaagccagcuuuuccucccaucagggaugcuucucuucuuucagcccccgccccgcuuuggccuccuaggauggcugauuuuucuggaucccgcugacacaggugcuuucucuccgagccaaucagggagcagaaaggcucagcucagcuaacagaggcauugcucaccgcagcugugaguuagaacucaggcuuucuaaaucgggaggaucaggcaugacuugagguugggcugagaaagccucgccugccccccagcucgacuacccagugaaaccuuuggcuucugccucgggcgaggcaucucuuaccaugccaagaacucagcagcccaucuuucuuucaucugggcaccaaguacaucauugcauauuucaggggguuucauuguguccuuaacaugcucauggagacuuggcuugagaugaagucgggguuucuaggcagcaggacccauguccccuuccuucauuuccuccaccggugauuuuuguuuuguuuuguuuuguuuuguuuuguuuuguuuuguuuuugagacggagucucguucuguuguccaggcuggagugcaguggcguuaucucggcucacugcaaacucugcuucccggguucaggugauucuccugccucagccucccaaguagcugagauuacaggcgucugccacuaugcccagcuaauuuuuguauuuuuaguagagacgggguuucaccauguuggccaggcuggucucgaacuccugaccucuggugauccacccgccucggccucccaaagugcugggauuacaggugugagccaccgcaccaggcccuuccacugguguuuuuugagcaucuacuauauagagaaugcucuccugggcacagaggaugaagcagugaacaaaguagacaaaaaauccccacgugcauagagugugcagucucgugggagagacagggaacaagauaaagaaggaaaaaaauagcagaugcuugacuggggacggggacuaaagaaagaaaaaaauaagcaggcuaaggggguugauggaugugaccuuugaguaaaggccuaaaggaagugagggagggagucauguggaugucuggggaaagacuauuccaggagaaugaacagcagguacaaaggccccuggguacaaaugugccuggggaguuuggggaauaaaagggaggccggcguugcuguagcugagugacuaagggagagaauagaggagaugaggggagggagguaaugggagcaggucaugcaccuugcuggugcuggaaggacuuuguuuuugcuuuugagugagaugggauccaugggaaggcuuugaauacuuccacaugcauuaggcugaaauuuucuuuucugcuuuugucgcauuccaacauugcuuuuauuucaucaaaaucuucgguuucuucucaggcucuuuacccaagugggagcagaaggcugguacccagggcuguucaguucucccccuggggucagaacguggaggagaaagcuuggaggagaaacaggaacccccaccucuuucuggaugacucaaaaccgcaauuaccugagcuccuccuccuaucccugaaauagaggcacuuagcacuuccuaaacuucccggugcacacaaauccccuggcgaucuuuuuaaaugcagguucugacucagcagguggaugcaaggucuaaggcugcauuccuaaccggugcugguucugggaccacacuuugaguagcaagggucugaggucauuguugcagauguccaucuggggcaugucuguggacacuugcgggggugcgggugagcagagggaggggggaugauguuggaaaagcagugugaguaucuguguuugauaagaaguaagaaaaugaagcaaggugggagaguagaaccucuuuauuuuugccuacgugcuaagguuuuauugccauacccagagagcccugggucugaaauccaggcaacacuggccaguugaaacccugauauugcagcccauaaaagugcugcaugcugcaugguggacuucugggacucuuccuggaaccuucagugccagagccgguccaaaggaagucacaucccugccauugaggggcaggagaccagggaaccggaggagugggauggcagaagcgcguguaaggaggcugaguuggcagggagagaaagcgaagucagcuucaaaucauagcgagaggagaccagggaagggcuuggcguugcugcucuguguacaaauauugucucuuauuuuccaggcugcagggugaggcagaguggaguauuugugcaacacagcccagcuuuguucucugggcuccuaaugccugucagcucagaggcagaaagccaaucagagaugaucgucggcaaggccggcuuuuguuggcuccccaaauugcccugagucucggauuuugcuuuucagagugugcuuucagcuggaggcaaaggcugaagcuggugacaaaaggaagccugguuuuccuggcuuuccgagacuuuuacugaggggguuucuauuucagacuccguuuucccaccuggaaagcagguuccacucucccuccggccuggaagggaugguuuuauggugcuuccaaaaugccaaaccuaacuccagggcagaagaggagacugaaaccaauuaauuuuccaaagguuagagcuacgaggaggggagagguuuagcauggucaaguuccccaagacauacuaauugaucucucuacagaaugcgggauuucagugcccccaggggacacucagcaauguuuagagaccacuugagguugucaucacuggacaggaggggcugcuacuggcaucuagcacacacaggccagggauacuguugaacaugcugcagugcccagacagccccaccaaggagaaugauccaccccuaaaccuagugcugagguugggaaauccugcuccggaguaaccaacacccuauggcuuuuucacucaagcagccgcuucuccagcgcuuacaccuccucagagauugccagauccauaugcagagccuguuggcgugggacacuucugagggguguggcagggagacagcggacauucccauuuaccagcugaucagcagguuaggagcuaauaugaaaugaacaagauagacccuccccaccugcccugcagauccucuggugggacacuagggagggaggccuccuaaacccaaaugacaguucccaggaugcagggaggaguuuaccuaugcaaacuggagagaaugcaaauggggcaucuagagauacuuacuggacgaccccuccccugccucgggucuuggaagaacagauucucagaggucugcccugaucacuguaauuuuuuuuuuauugagguaaaauuaauauaacacaauuaaccauuuuaaagugacauuuagggcugggcacaguggcucaugccuguaauccccgcacuuugggaggcugaggaagaaaggucgcccaggaguucaagaccacccugggcaacaaaguaagacucugucucuuacaaaaaaaaaauuaggcacacaugguguugugcaccuguagucccagcuacucaggaggcugaggcaggaggaucguuugagccuaggaauucaaggcugcggugagcuaugaucaugccacugcacuccagccugggugacagagcaaaauuguguuucuuuaaaaaaauaaaaguaaaaauaaauaagaaaagaaaggagaggggaggggagaggcguuuaguacacucacaauguuguguaacugucaccuucaucuaguucuaaaacauuaagcagccacucccauuucccuugccauuccccaggaacaacaaaucugcugucugucucuggauuugccuguucgggauauuucauauacauggaaucauacaauaugggguauuuuaugucugcuucuuucgcuuggcauaauguuuucaagguucauuccuguucuaucauguaucaguacuucauuccuuuuuuuuuuuuuuuuuugaaacggaguuuugcuuuuguugcccaggcuggagugcaauggcacaaucuuggcucacugcaaccuccgccucccggguucaagcaauccuccugccucagccuccugaguagcugggauuacaggcaugcgccaccacacccagcuaauuuuguacuuuuuuuaguagagaugggguuucuccauguuggucaugcuggucuugaacucccaaccucaggugaucugccugccucggccuuccaaagugcugggauuacaggcgugagccacugcacccggccuacuucauuccuuuuuauggcugaauacuauuccauucuaugaguagaccacauuuuguuuauccauucacccacuggugaaauuuagguuguuuccaucuuuuggcuguugugaauagugcugcugugaauauuuguguaugaguguucguuggaauaccugucuuacgauccuuuuguguuuauaccuuggaguggaguuacugugugucacaugguaacucugugauuaacuuuuugaggaaccaaggaaugguuuucuauggcaguugcacugguguuuuuuuguuguuguuguuuuuguuguuguuguuuugagacagggucucacucccauugcccaggcuggagugcaguggugcagucaugguucacugcagccucaaccuccuggggcucaagcaauccucucuccucagccucccaaguagcuggcacuacaggccugcgccacuaugcccggcuaauuuuucauauuuuuuguagagauagagucucaguuuguugccuaggcuggucucggacuccugugcucaaguaauccuccuaccucggccucccaaagugcugggauuacaggcaugagccaccgcaucuggccagcuacaccauuuuauauucccaccagcaugaggguuucaauuucuucacaucuucaccaacacuuguuuucuguuuguuuguuuguuuuuaauagcuauccuaguggaugugaagcaguaucccguugggguuugauuugcacuucccugaucacuaauacccucauguacauauuggccauuugacugucuucuuuggagaaaugucuauuccagccuccuguccauuuuucaauuggauuaucuuuuuguuguuguguuguaaauguucucucuuuauuuuuuauuuuuuugagacagagucucgcucugucgcccaggcuggagugcaguggcacgaucuuggcucacugcaagcuccgccucccagguucacgccauucuccugccucagccucccgaguagcugggacuacagaugcccgcuaccacgcccggcuaauuuuuuguauuuuuuuaguagagauaggguuucaccguguuagccaggauggucucgaucuccugaccucaugauccacccgccuuggccucccaaaguucugggauuacaggcgugagccaccacaccuggccguaaauguucuuuauauaguacuagacccuuaucagauacaugauuugcaaauagcuucuccuauucuguuacuugccuuuuaacuuucuugauaacguccuuugaugcacaaaagguuuaaauuuugauaaagcccagcauaucuguuuuuucuucuguggaucaugcauuaggugucaaaucugaucauaauguuuuauuuauuuauuuacuuauuuauuuauuauuuuauuuauuuuugagauggagucuugcucuguugcccaggcuagagugcaguggcaugaucucggcucacugcaaccuccaccucccagguucaagcgauucuccugccccggccucccaaguagcugggacuacagguguguaccaccacgccuggcuaauuuuuguauuuuuaguagagacaggguuucaccauguuggccaggcuggucucaaaguccugaccgcaagugauccacccaccgcagccucuaucuauuuuuaauuuaucucuuuuuuuuuuuuuuuuuuugagacagggccuccuucugucacccaggcuggagugcagugguauagucauuguacacugcagccucuaccuccucggcucaagcaauucucucgccucagccucccaaguaccugggaccacaggugccugccaucaugcuggcccugccaccauauuugaaauugcagcccugaccccuuccacugucuauagucuucaccaucuuacuacauaacauagcauauaugauguacuguauaacaugguauaugcaguguacuguauagcauaguauacaugauguagucaucucauuuauuugcuucuccucugggaagcaggaggaagcuucuccucuugucugcuuugcucucaacugugucccuagcccagaacagagucuggcacacagcagguacugaaugaauauguguucagugaauauugugggugagauagaaggugaauauccacauuucccuuuagaagucaccugaucuggguuugagaucugcagggaucuacuccagacaggagaacgaauaauuccaccugugcugaugaguuggaaggaucuagagggcuugagaucuuuccacuggggucagugggggugggugcaccuccaacacccuucuuuucuuugaacaagauuuuuccuuaauuccccaauacucccuuugaauauaugauuuuagccaccaucauagcgaauugcaucguccucgcacuggagcagcaucugccugaugaugacaagaccccgaugucugaacggcuggugagugaugucuuuucucagggucuucuccuuggcuuuagcaggacauuaauuuuugggggaguggagcagggcacagaggaggcucucaguccuggagcccagagccagaucaugggaagccuaaauuuccuuuucauuuuuucuugaaccagagucucgcucugucacccaggcuggagugcagugguucagucauagcucacugcagccuccaccuccugggcucaagccauccucccacugcagccuccugaguagcagggacuacaggugccaccaugcccaguuaauuuucuuauuuuuaucuuuuuuuguagagauggggaucucacuagguugcuuaggcuggucucaaacugcccacuuuggcaucugacauaauuucaggcaguauacucaaaugaacauuguuaauguuaauaauuaugucuuggccagacacuguagcucaugccuguaaucccagcaguuugggaggccaaggcagguagaucacuugaggucaagaguucgagaccauccugaccaacauggugaaagcccgucucuacuaaaaaaauacaaaauuagcuggauaugguggugcacaccuguaaucccagcuacuugggaggcugaggcaggagaaucgcuugaacccgggaggcagagguugcaguaagccaagaucgcaccauugcacuccagucugggcaacaggagugaaacuccaucuuggugggggggaggcgaaaaaaaagaaacaagaauauuacaaaggauacagaugaagagaugcaaagggugagauauaggagaaggguguggcuggcagcuucuagguagcuucaggagggggacuggucaccagaaagaccaaggcaugauucgaggguugcgacuuucagccccaccccccaaccucugggagggcagaggggcugaaaaucaaguugaucaccaacggucaaugauuuaaauccaaaccucuaaucaugccuugguuuucccggugaccaacccccauccugaagcuaccuagaagcugccagccaucagucaauccuuagccugcaaaaagacaucccuuuggagaucccaaggguuuuaggagcuguacaccaggaaacagugucaaagaccaaacauacauuucacaaugucacagucuucuaaaaacuauaacuagccuagcaaaccuaugauuucuagaucuuugcauuuucacuuaaaauaaagcuaaauaaaaagcguccauugaaagacugguaagcaaguagaaguaccaguggcaagcuaauguggaaaaaaaaaaucauucaggcagagugaaaaugauuguagcucgagaaacguugcuguaacagaugggaaaacauucacauuggggcucugauggagaagagcuuguagcuuaauuucaaauaugauagauuagcagcuggaagccagaaccagccggagguucugcagaggaacuggaggugaggauacuggccacuuaucagccaguacagaaguccuauuccaaaccuuuaacaaucuacaugccagcugagaaccauccuaaggggucagauuuaggagugaggucaaugcacaagcucuagccucaaauaccuugaacgcugcaugugacaaguaaauucucuaaaccaaugcuuuccauuagaacuuucugcagucacagaaaugaucuccaucugcccuguccaauaggauugucacuugaaauguagccagugugacugcagaacuguguuuuuuauuuuauugcauuuaaauuaauuuuaauugaaauagccacauguggccugugacugucguauugaauaagacaggugcaaacaaauaauucuguuuagcugagugauaugugagguuggcccaaaaggaaugaaggaggaaggugccuucucuaggcauuggcuuugcucgcaaaaggcuuuggacaagagaacucugcaagaggcagugagggguggugagugcaggagggucaggggaagugagagggugauagguacugauuucuaggugggcugguucccugaucuugucaacaucugcccagcccaagacgcugaccuugccuucucucccuuccaggaugacacagaaccauacuucauuggaauuuuuuguuucgaggcuggaauuaaaaucauugcccuuggguuugccuuccacaaaggcuccuacuugaggaauggcuggaaugucauggacuuugugguggugcuaacgggguaaguggcgcgugcuauacgcuuuggauuuaacuagcugaaggauuacgaggcuuuugguuggugugguccgggccaggcucaggaaggcugagcccuuguguucucccuccccuuguuaugcgccugccuccuuucugccaacaccccaccuccaugucucagcuguauauuacagcagaugcuuucuguuacaauuaaaauaauagcucauuauuguuggcugcuuccagagugcuuuaugcccauucucuaauuuaauccuugcaacaacccacugaauuaggaaauauuaauauucccaucugaccacugaggaaucagaaacucagaguguaacuugcuuaaggccacccagcaaguaagugauggaacugggagaugaacagaagauuaugcauuccagaacucaagguuuuaaguguuguacgugcaugggucucuugauuugcuugaggauaucuugcuuuuauuucaacuuggugaauguuuuuugagaaugucugggugcaagggauugugauuaugacaaaggagaaaagcaagcuaaauaagguacaguuacugucuucaaggaguuuucagauccauauaugaugaacugugguugaaauguguauaugcuuuccucuaagcacccuguaugagguagcacuugcugguauaacaaaagauccaaagcuaggaaaugacuuaaacacggcagaaguuuauuugucacucauagaaaauucaaaauugagcugggugugguggugcaugccuguaaucucagcacuuugggaggcugaggugggaggaucacuugagcucaggaguucaagaccagcuugggcaacacagugagaccacccccccaucuguaaaacauaaaauaaaauaaaaauuaaccaggcauggugguacaugccugggagaauugcuugagcucaggaguuggagggcacagugagcuaugaucauccaaccgugcuccagccugggcaacagagcaagaccccaucucgaaaaaaaaaaguccaaaauaauuguuccuaguugacaggcucaucuccuccaaugacugacggacccugacccuugccauauuguggcucuucauugucagcccacaucauccaauaacuccaugcuugucuguaucaaaccaggaaggagaagugagcauagaaggugauacuuggaaagguuuaugaguuuggaaggggugugacccauaccuguuccauucauauccuauuggcuagaacucggucacaugaccacacaucacugcaagggaagcugggaaguaucagauugugcuuagaagaaaagggaaauggauuuggagaaugaccuacuagucugucagggaccuuaaaaacuuuuauuagauuccaguagggacauuaguaucugguaccaauggcugguuccuccucuucccacucucuacucuccucucagcuaagucugggcucuucuauucuaagacccuucuucacuggacaccuuuuucauaguaaucauuuacaggaucauagcuuuccauguuuuguugcugcuccagguucugucucucuuggcggaugugauggguugcagcacccacacugugcuggccgggcucucacaaugcagauuuguuucagagcaauguugccucucacagaaggagcuguggccuauugggcuguuucuguagaggccuucagaugucagcagucuguuguaaggacucugggcuagcucucaugggcuuggguguucacagagggaucuuuguuggcugugcucacaguucgguggcuugggaccuugguggguuccaagggcauauuaugguacugggcacuuuucucuuagucuacuaggaaacucaucuagaaacagccuaguggcuaacuuuuuuauuguuuaaaaaauguaaagcugggcaggguggcucaugccuguaucccagcacauugggaggccaaggugggaggauugcuugggcccaggaguuugagacgagccugagcaacauagcaagaccacaucuccacaaaauaaaaauuaaaaguguauaaagcuggguacaguggcacaugccuguaaccccaauuacucaggaggcuggagagagaggauugcuugagccuaacuaguuugagaccagcuuggguaaccuagcaagaucccaugcaaaacuaaguagagaauaauagagcaaacaccuguguauacauucauuuauucaaugacuauuuauugaacacuucugugugccagguccuguucuaggcucugggacacagcaguaaacaaaauagaaaaauccccuguccucauggagcugagagucuacugauggagauggacacaauugaugaaugaaucuagugugucagauggcggugagggguacagaggaaaaauaaagcaggggagggaugggauguguggcaggcaggggugaggggugcuggaagccagggaagacuucacugggcaugugacaucugaaugaaaaccuaagggaggugagugagugagccaugaggagagcuggaacagagugucaggcaaagggaacagccagugcaaaggcucugaggcuggacuguaucugacauguuugaucaacaguaagaagacccacauggcuagagaaggugaccagaagaauggggagaauuggggauagagaaguaauggaguaaccugcuaucaaaacacaaccuuucucuuuuuuuuuuuuuuuuuuuuuuugacaagagucucccucugucacccaggcuggagugcagugguacaaucucagcucacugcagccucugccucccaguuucaagugauucuccugccucagccucccaaguagcuuggauuacaggcguguaccacaacaucuagcuaauuuuuguauuuuuaguagagacggguuuacgccauguuggccaggcuggucuugaacuccugaccucaagugauccaccuggcauggccucccaaagugcugggauuacaggcguaagccacugugcccagcaaaacaaaaccuuucuaaccuuucuaaucccuguuuucucccucccuagacccauuccuuucucucccccauccaggggcacuuuccugaauuuuauguuuauuauuugcauuuauguauucacacuuuggcugccuaaguauauaagaaauauaugcuaccuauuuuuacacuucaaaauauuuuuuaaauagcaucagagugagaauaguuuacacuuugacuacaugcauagauaagaaauaugugggcugggaaugguggcucacaccuguaauccuagcaauuuuggaggcaaagauggaaggauuacuuuaggccagaaguuugagaccagccuggccaauguagugaaacccugucucuacaaaaugaaauaaaauguaauaaaauauucagcugggcaugguggugugcuccuguggucccagcuacucaggaggccaaggcgggaggaucacuuaagcccauaaggucgacgcuguagugagcuaugacugcacuccagcuugggcaacagagcaagacccugucccuaaaaaauguuuuuuguuguuguuguuguuuuuuguuuuuuuguuuuuuuaauaaaggccaggugugauggcucacacuuguaagccuagcacuuugagaggccagggcaggaagacugcuugaguccaggaguuuaagaccagccugggcaacauggugaaaccccaucuauaaaaaaaaugcaaaaaauuagccaggcaugaugacgcacgccuguagucccagcuacucaggaggcugaggugggaggaucacgugagcccaggaggucgaggcugcagugauccgugauugcaccacugcacuccaggcugggcaacaaaguaagaccuugucucaaaaaaauaaaauaaaauaaaaaauaaaaaaaagaaaagagaaagaaaaaaagagauaugugguacuguuuuucaaacuucacauuucucuaaccugacuuuuguguucaacaugagauaaaucugauuaauaaaaauaguuuccaugcauccauuuucaugacugcauaguauucugugguaggaguaugcugccguguauuuaucuauuuggauuguuuccagcuuugggcuauuuugacccaaagugucccugcuuucucccaagugaguuucucuagggcacguacccaggaguggaacugcugaguuguauacugugugcauccucagccccacuagguauugccaaauugcucugcaaagugguugugccaauucaugcucccugggggcuggcuucugcuggcugaggcuggcuugaccuugcuggcaggaaggagccuuaaaaaucccugugugguuuuuuuuguuuuacuuuuauuuuaaguuuagggguacaagugcagaucuauuacauggguaaacuugugucuuggggguuuguuguacagguuauuucaucacccacguauuaagccuaguacccauuaguuauuuuucuugaucaucuuccuccucccgcccuccacccuccaaaaggccccagugcguguuguucaccucuguauguccauguguuaucaucauuuagcccccacuuagaacacgcaguauuugguuuucuguuucugcauuaguuugcuaaggauaauggccuccagcuccguccguguuccugcaaaggacaugaucuuguucuuuuucuuggcugcauaguauuccaugguguauauguaccacauuuucuuuauccagucuaucauugaugggcuuuugcagcccuguuuuuuuuuuuuuuucauaauaacacgguuaugggaacacuuagggaagcucauauauuauugagcagugugaugguuaauauugagcaucaacuugaucagcuugaaggaugcaaagucuuguuccugggugugucugugaggguguugccaaaggagauuaacauuugagccggugaacuaggagaggcagacucacccccaaucugugugggcaccaucuaaucagcugccaguguggccagaauaaaagcaggcagaagaaguuggaaagaguagacuugcugagucuucuggccuucaucuuuguccugugcugaaugcuuccugcccucuaaaaucagauuccaaguucuucagcuuuuggacucauggacuuacaccaaugguuagccaggagcucucaggccuuuggccacagacugaaggcugcacugucagcuucccuacuuuugagguuugaggacucugacggauccaccacuggcuuccuugcucuucauccuucagaugggcuaucgugggacuuuaccuugugauugugugagucaauucuccuuauaaacucccuuucauauauacaucuauccuguuaguuuugucccucugaagaaccuugacuaauacagacaccuagugggucccaauaagugaucauuaaacugaaggcagucauucaguaggucaguuugucacuuguguuuguaucucccugcuuacaacaagguggccuuucuucuaguuuccugucaucugauggaagagauucuagacucauuccucuagaggagaaauacuucaucuagaacagauagguccuaagggugagagcucaucguugggaugaaugaacccacugaaauuuuaugcaagaagaaaauuguguauauguauauuuuuuuuucuggucuguaguuuuuauuagauucucagggaauccugauccuaucaugaagaccuucuauucuagauuggguuccuuucacauccccuucuccuuucuuguugaauucuccaugcauuucuuucacuugcuuuucuugcucuuauuucucugguagucaguuauccuuuuugucuggugguucuaucuccuucaaaugaggcacauugcucaaauuuuauuacuccaaauuccaaggugcuguuuaguguccuguuggguuguaagcuaggaacagggaggggaaaguaaaacauucugcaugagcugggugcagcgggcaagcaccuggaauuccagcuacuggaagcugaggugggaggauucccugagcccaaggguuuaaggccagccugggcaacaaagugagauuuugucuuaaaaaaaaaaaaaaucccagcugggcucuguggcucauaccuguaaucccagcacuuugggaggcagaggcgggcagaucgcuugaagucaggaguuccagaccagccuggccaacguggugaaaccccaucuguacuaaaaauacaaaaaaaaaaaaaaaaaagccuggcauggugguguggugugcacugguaaucccaguuauuugggaggcugaggcagcagaaucacuugaauccaggaggcagagguugcagugagcugagauugugccacugcacuccauccuggaugacagagugagacucugucucaaaaaaaaaaaaaaaaagaaagaaaaaacacgcgcgcacacacacacacaucaugcagaccuagccuucugccaaugucaaugguagagaaacacaguagacacuuaauucuauguuucagagaggaggggacucaaauauauuaauuugacauugagacagugaugacuuuaaugaguacuuucuuuccuuuuuuuuuuuuuuuuuuucgggacagagugcaguggugggauuuuggcucacuguagccuccaccuccuggguuccagcaguucuccugccucagccuccugaguagcugggacuacaggcaugcacugcugugccuggcuaauuuuuguauuuuuaguagagacgggguuucacacuaucagccagacuggucucgaacuccggaccucaggugaucugcccaccucggccucccaaagugcugggauuacaggcaugagccaccgugcccggccuaaugaguacuuucugauuaaccuguugcccucucagauuccugaagcaaaccacagcguuaaaacgugauucauuuuguguggaccaccacgguguuuaccuucuucuugggugaaguuugguggaaaagaucuuaccccggacaucuguuuguucuuuguaacucagagccucagagaaauccuaacuuuauaauguugucaaacccuuguaaggcauguuuuuauuguauuuguguucugaucaugaaacugaaaauguguaagaggaagauuucagaagcuuggcuguaugucugagaugacaguucuuuuacugucauucucaaauauauauaaauauugaagagaucaaauaacacaaaucgugcauguuaagaaaagagacugugaaccucaccagagaggggugagcacaauuuuuuuucuuuuuuauucacaggguuagcacugucccuuucacauaauaaaugcucaguaaaauaaaugguuguuaagccggaaaaggguaacacuucugauaaugaguguccugggaaauuuacuaagcuguuuagaagaugggaccaacacacugauagaaauagucagauaguccagaagucuauggcagaugcccugaacaucagaugagauauaagacagagaagcucugggucuuugccagcucugacauuuuaugacucuaugaaacggaagguuccuuuuuagaagggucuauaaacugucucaggcuuugggccauuuuguugaagaucagaggcaaggaaaagacacaacuacacaggaaccaucagggaaagauguuguuuuuuggucuugaagcaucauugaauuuuuuuuuuuuuuuuugagacggaguuuuucucuuguugcccaggcuagagugcaauggcaugaucucggcucacugcaaccuccgccucccagguucaagugauucuccugccucagccuucugaguagcugggauuacaggcauguaccaccaagcccggguaauuuuuuuguauguuuaguagagacgagguuucuccauguuggucaggcuagucuccaaguccugcccucaggugguccgcccaccucugucucccaaagugcugagauuacaagcgugagccaccgcaccgggccgcaucauuggauuuuaaggcuccauggauucuggcagguccagcccuucuguuuuacucacaaacaagugguuuguccaaagucacacagagaugguggcaagagaucuagaauaagaaggugucuucaagucauggagccaggaacccuggcuuuuugggcaauggaagugguauaaauguuuaauaucaccccucagguucugccacuagagcccagcucucucuuccuuccucuugcccccugacuagccuauggccucuuuccagagaauaagaaagggauccucagagaauaaucccaguuccucgcuuuuuauuauauaguugaggaaaccaagucucagaggggucagugucuugaccauacaccucucauguccucucuccuuuuugauuaauugaauaaauacauguaguugcuucuuaccuccuuucuuucuucaccccugccccaugcaccugcucuuaguugccuucacauguaaacagcauuccaacaacaacaacaaaacacaaccagcauucuaacucaugagaccagcaacaguuccuauaaauaccagcagcauuuuauuuuaaugucucucugcaguaguuucuccccuccauggaucagucauccuugguaccaaaaggauuccccacugugacacaaaugcuuuuugucauucucagugaguuauaccauugagagagcaucgaucuuuuuauuguucaaagcuuuugguugucaugauauuugcuggaccauguuucaccaggaaccacaucacuuccuagcagcaggagcuauuuucuuccaucuucuaacaacaccagcagugacagugauaauaaugauguuagcugccauggucguuauucuuaucauuuauugaguacuuacuaugugccagggacuacauuaagaguuuuauguguauuaucacauugagccucgcuagccuuuguacagaugaaucugaggcucagagagguuaagcugcucacaagggagucacacagcugguaagggguggaucaggaucucagccucucugcuaggacacuucucuaaaccuagaauaauacugggccuguguuaaguucagcaaagagcuguauucaacccaguguccuuaggaauguaaugccuguuauuaacaacaguggcaacauugauaagcugaaacuuaugaggugcuuacaauaugauauacuauauauuauauacauacauaggcacccaccuauaaucucagcacuuuaggaggccaagucaggaggaucacuugagcccaggaguucgagaccagccugagcagcauagcaagauccugucucuguaaaaaguuuauuuuuucaguuggccagguauguugguacaugccuauagucccagcuaaugaggaggcugaggcaggaggauugcuugagcccaggaauuugaggcugcagugaacuaugaucacaccacugcacuccagccugggugacagagcaagacugucucuaaaaauaaaaauaaaaauaaaauuauuucaacucucaagguuaaauaaauacuauuauuauucccauuuacagauggagcaacugaggcucaaagacauuaaaugcuuacugucuuagucuguuuucuguugcuuauagcagaacaccugaaacugaguaauuuauaaagaaaaagcaauuuauuucuuacaguuauggagacuggaaaguuuaagaucaaggcugcaugagcuauaaugcacacacacuauugcacuccaggcugggugacagggugagaccccgugucaauaaauaauaauauaaaauaaauaaaacaaauuucaacaugaguuuuggaagguuugaaauauucaagccagagcaucugucucauaagugguggacccaggauuugaacuaaggcagaucuggaucuagaacccauuuucuugaauccuacgcuauuucucuaaggucaaguuugccaaggaaaauaaacuugagaauuugaauagagcucucugacaugggaagucagggugauccuuccuuccccucccugaucuuggguuccacuauggcugggggaaaacaggagcagaagagauuucaagaaaugagagauuggccuagcgccaugguuaagaccuggacuucagagucagaggaagcuccucccucuaugacagugagaauguggguugaacucacugaaccucaguuuucucaccuggaaaaagggaguaaaacuagugccuagcuccuaggguuugcaucacacacgaaaguuggugaacugaaggaaaaaaacuuaaauucuugugggggagcaugugauagaugcuacaaauucuccaugccuuauuuaccuagcuuacgucuaaguucaccugcagcuuccucuugguacacucccaucucucuacaucucuguuggagggcagucucuggcaucacagaguuugcugagccagaugcuuaacaaccucgguagcaucccucaaccagugagcuagggagucaguguauaaauacccuggcuuccccauugcucagugggaaaacacugaaauauguuauacagcaucauagaggugccucaguaaaauugaauccuaguuguucacauaaaacccauucacuaguguacccuuuaccaaucucucucuuccucauuccucacuuguaauuccuugcauuaccucccaaauuaaccauuggacccuaguuuuugccuuggggucuacucggcgcuaacucaaggagcggaaguuggaagcuuagcggguuacagguuucagcacccuggacagcucccagcacaccguauugugcuaaaauguucucuucccucccucugccuccagcugggguggagagggacugaguaaaggccagauggccaggugaccuuguuccauacugagcuucuuggccauuuucccuguggggcuggagaagaccuugccauccaucucuccgcagguuugggggccgacugaggucuuguuuucucgaauugcuaugacaaaugccagccugccuccaaggggcaucugucccacugccucuacaguuugcaugccuaaugacuccucuccucucaccagggcagggagguggcugccuggugggccgcuugaagccgggagaccaagaucaugccacuggacucgcaacaaaccgagacucuuuuuuuuuuuuuuuuuuccucgagacagggucuugcucuguugcccaggcuggagugcaguggcgcgaucuuggcucacugcagccuccgccucccagguucaagcacucccaccucagccucccaaguagcugggauuacaggcgcacaccaccaugccuggcuaauuuuugcauuuuuaguagagaggggguuucaccauguuggccaggcugaucucgaacuucuccccucaggugauccacucgccuuggccucucaaagugcugggauugcagcugugagccaccaugccuggccaacagaauaggacucugucucaaaaaauaauuuuuuuuaaacauugcuuugcaacccagcugcuucuugugcaggcaucucuaaaugaggacagccagucuacauagacacguaaggaagcauagugguuaagaccuggucuuugggguuagaguggauucccaaccugacuccacuguuuccaagcugugugaccuugggcaaguuacuguaccucccugaaucuuccauuucuucaucuggaaaaugagaguaguagcauccccugacuugguggggcaugguggcugaugcuuguaauccaaacacuuugggaagccaaggugggugaaucgcuuaaacuugggaguucaaggccauucugggcaacauggugaaacuccaucucuacaaaaacaaaacaaagcaaaaauuaucugggugugauagugugugccuguaauuccagcuacucaggaggcugaggugggagaaucacuugagcccaggaggucaagucugcagugagccgugcuugcaccacugcaguccaacagagcgagaccuugucucaaacaaacaaaacaaaacacaaaacaacaacaaaauacuaccaccuuauggaguuguuuucaagguucaaugaguuaaugucugacccaugcugggcuggguuuauggauguuacuugcccagggacagucugaagaaagagaaagugauauaguccauugggccucagcuuccucaucuguggaaugggaauaauaauugcaccuaccucaaaagguaaaagucagugagauacauauaaggcauucagaacaaaaacuggcacagaauaagugcucaauuauauuagcuauuguaagacuaauaacuaucauuauaaugaugauaauaauuauuacuacuuccccaggcccaguuccauagaccaguuaguuaacuguagggaacguuugcuauuauuaguuggguucccaauaucugaccucccuuuccaauuuagggagaauccuccccuuucuauaaaguacugcuggucuaugggaucccacccucacuaauaaguugaaggugaaagggauucauugucaccccaucaccugguagucagggcaugugauuuaaacaaccagggccaggcgcaguggcucacgccuguaaucccagcacuuugggacgccaaggcaggaggauagcuugagccaagcccaggaguuugagaccagacugggcaacauagugagaccccuaucucuuaaaaauuuuuuaauuagcugggggugguagcacaggcuuguaguccccgcuacucaggaggcugaggcaggaggauugcuugagcccaggaggucaaggcugcagugagccgugauagugccacuacacuccagcccagccugggcaacagggcaagauccugucucaaaaaacaaacuaauaaaaaacucaaccagucacguuuuccuacccaggaauuugaaaauggaccaagugauccaaacaugaugguuuggacucuuucauggccuccugcuacaggagaaggucaggcuggcuacauuguuccugcugauuucccaaauccccucuucuggcccccuguugauuaucugaguuuccuaaaaaucccuuuuaugccuaagauagccggucaguguuugguuuugcaaucaagaacccagacugggccaggcacgguggcccacgccuguaaucccagcacuuugggaggccgaggcgggcagaucaugagaucaggagaucgagaccauccuggcuaacguggugaaaccccgucucuacuaaaaauacaaaacaaaaaaaaaaaaauuagccaggcaugauggcggucaccuguagucccagcuacuggggaggcugaggcaggagaauggcgugaacccgggaggcggagcuugcagugagcugagauggcaccacugcacuccagccugggcgacagaacgagacuccgucaaaaaaaaaaaaagaaaaaagaagaacccagaacccagacugauccugagacaaagauuugagggcaacgaaucacgaggucaggaaaucgagaccauccuggcuaacauggugaaaccccgucuuuauuaaaaauacaacaaauuagcugagcgugguggugggcgccuguagucccagcuacucgggaggcugaggaaggagaauggcgugaaccugggaggcggagcuugcaauaagccaagaucgcaccacugcacuccagccugggugacagagcaagacuccaucucaaaaaaaaaaaaaaaaaauuugaggacaagugguuuguuuggcaauaccaggaaacaggggaacaggauagucagaaaagaaagagaaagcugggcaugguggcucacuccuguaaucucagcacuuugggaggccaaggcagguggaucaccugaggucaggaguuugagaccagccuggccaacauggugaaaucccgucucugcuaaaaauauaaaaauuagucgggugugguggcgugcaccuauaaucaaaauaaaauaaaaucaggauauuuuauuuuaaaacucugucuuaguguaacucauauuuaccucuucuguaugcuccuuugcaucaguuauauauugccauaauacggcuguguaacaaacaauccccaagacccaguggcuuauaaugacaagcauuuauuuagcucaugauucugaaggguggcaguuuaggcugggcccaguugggugcuuuaucuggucucaguugagcucauucaugcaucuuuggucagcugcgggucagcuggguggcucuucuguuuggcuguuagcuggcugcagacugguccaggaugaccucggcuggaaugacugugcuccacucccuauggucuuucacccuccagcaggcuagccugagcuaguucacauggcagcuuuucauccuccagcaggcuagccugagcuaguucacguggcagcaaugggauucuaagagaaagaggaaguguucagccuucuuaagggcuagucccaggaauggcacaacaucguguuggccacuguuguccaaagcaagcaaugaagcugguccagauucaaggaauggggcaacagagcccaucugguauuuaccuggggccacuggggccccauuccuguucccuggggccuuuugcccugacuucugugggcccucagagcauauuuucagauuccuuuccaucccugacccucagcaaucaauguagaugacgugucauuacugugucacuugcacagagaaaaggaggaaaaaaugucagcaaaaacucugcugagagcagagggcccaucauacagcaagcuggaaagaaaagugggaaugauuacacagccuccucagaugcuuccagcuuuuaucaaaucucacugugauaucugaguucugaacccucacaggugguuggcgugcaagggaagagauuucuugucugccaugcugacaugcacagacacgcaaccuggcucccucuguccacuggggcuuuggauuuuguuuguugaaauguuacccacuccugaucagagcuggauggaaaccuggcucugauuccauuggcucaggggcucaggugggggcagaggccaggcugguugggugucuauguggagaccuuaacucuucucccucccgccccaacucuuuuuguuucuuuuuuuuuuuuuuuuuuuuuuugagaugggguuucacucuuguugcccaggcuggagugcaguggcgugaucuuggcucacugcaacuucugccuccuggguucaagcaauucucccaccucagccuccugaguagcugggauuacaggagcacgccaccauaccuggcuaauuuuuguauuuuuaguagagacaggguuucgccauguuggccaggcuggucuugaacuccugaccucaggugauccacccuccucagccucccaaaaugcugggauuagaggcgugagccaccacaccuggcccuuuucuuuucuuagcugccuccaccucucuucccuucugcaguguuagguuuauggaaaccgaggccggcguagagaucaacuucagagagcaugaacugagcaucugcugggucuuagauccuuuacauagcuuaucaucuucaaaccuucucacaguucuguguggcuagagccaggauuuggacacagcucugccccacuguagaaccaggcuuccuucuguccacugucaaauuuuagagggagaaaauagggaaagggacaccagccuucuccacgagcagcuucugcccacucaccccagggacuuugcacaugcugugugccugugucugagauaugcucccuccucuguaucugcuuaauucuuacccagacaugauacauaaaguauuuaacauccagguggcagggacaccagcuaaccugaaaagagguuccccuguugugccacauguguacucauuguuugcugcauugugggggcaguccaggggccuugaagaggggccaaggugccaaaggggcacucucaggccucaaggaaguacauguuuacugauaugauacugucucuuccuccaggaaggaagccuucccugaucuccccacugcaugcccacuaugauaccaguuuagguccccucuuuauggccaucuguggcaucagugugaauccucuuaauguugucuauuugguuaaucaucugucuccuuccucugggggguaaagacagaaccacagagccucguguagaacuugagaaugggguucaguaaaaaucuguugaaugcauaaaugggugauugagugaaugaaugaaugagugaaugaaugagugaguggaugaaugaaugagugaaugaaugagugagugaaugaaugaaugagugaauuaaugaaugaauucauagcugauaauacaggcuucauggcuuuuguuaggcuugcccagacauugcuaggggauggacagaaggaagaagagcuauacuuaauuccaguccuguuguucuguagcaggaggagaaaaacagggacugcccagccugcucuggguggauucaggagcagcugagguuccucucuuauuugcaaacagggaauucaaaaagccccaaccucagaaucacacucgccucagcagcuguaccagccaaggggacaaugugggaagccuugggcaccaggaaugcugagugcuucgaaaaagcgaaggcucagggaacaaucccugauuuuucauucccuuguccuuucugaagaaacaggcaaaggcaggccaggcacgguggcucacaccuguaaucccaacacuuuaggaggccgaggcuggugaaucacuugaggucaggaguucaagaccagcguagccaacaucaugaaaucccaucucuacuaaaaauacaaaaauuagcuggguuugguggugcaucccuguaaucucagcuacucgggaggcugaggcaugagaaucaccugaacuggggagguggagguugcagugagcugagucugcgccacugcacuccagccuggaugacagagugagacuccaucuuaaaacaaaacaaaacaaaaacaaguaaagccuuguguguuuuuaaauuguagguucagcagcaaagcucuguaauaaggagcuggacccugcagucagacagucaugggcuucuccagugcccagccgagugacccgagggaguuaugauaaacaccaacauucauccacaauuuguaccuagugcuauucucaauaucuugaguaaauuaucucauuuaauccuccaggcacaucuuucuugguaggugccgucauuguccccaguguacaucugggaaaaugaggacaggcuggcagagcacccuuccugcucaccucugcugcucugcugaccucuggcaagacuguugucucucugagccucaguuuccccaucugaaaauuggggccuguauuagcccguucucacauugcuauaacgagaugcuuggcuggggcugggcgugauggcuuaugcuuguaaucccagcacuuugggaggcugaguugggcagauugggagugugagaccagcuugggcaauauagcaagaccccaucucuucuaaaaaaaaaaaaaaauuagccaggcauggugauaugcaccuguaauuccagcuacccaggaggcugaggcaggagaauugcuugaacccaggaggcagagguugcagugagccaagauugcgccacugcacuccagccugggagacagagugagacuccaucucaaaaaacaaauuauuuuuaaaaaauuaaaaaaaaaaaugccuggcugggcacaguggcucacacccauaaucccaguacuuugggaggccaaggugggaagauugcuugagcccaggaguuccagaccagccugggcaacacagugaaauccugucucuacuaaaaguacaaaaauuagccaggugugguggcacgcgccuguggucccagcuacucaggagggugaggugggaggauugcuuaagccugggaggucaaggcugcagugagcaaugauuaugccacugcacuccagccugggcgacagagugagaccuuguaaaaauaauaauaauaauaauaaauaaauaaaaacccugagacugggguaauuuauaaagaaaagagguuuaauugacucacgauucugcaggcucuacagaaagcauggcagcaucugcucagcuucugggaaggccucaggaaacuuacaaucauggcagaagguaaagcuggagcagguguccucacauggccagaacaggaggaagagagagaguggggagaugcuacacaccuuuaaauguccaaucucacaagaacucacucacgaucucgagaauagcaccaaggcggaaaucugcccccaugauccaauuaccuuccaccaggccccaccuccaacauuggggauuacaauucgccauaagauuugguugcggacagacacagauccaaaguacauuaaaaguaauggcaaaaaccacaauuacuuuugcaccaaccuaauaucucaggggcucauuguaccuauuucacaggacaaaugaagguaucaguaauaacaguagccuguagucccagcuauucaggaggccgagacaggaggaucacuugaacccaggaggucgaggcugcagugagcuaugaucacgccacugcacugcacccugggugacagggcgaaaacuuaucucuaaaaauaauaauaacaacaacaauagugaacacagauauaacauguguguggccaggcugugcccuuagggcuuugcagggauuauuucauucacucucaaucuccccauuuuacagaugagaaaacugacguucagaaaagcuagaggacuugccccaagccacacggcuaggaagugguggaauugggguuuaaaugaggaagcuugacuucagugucgaagcucuuaacugccacacucaauacauggaguagagguugcugauucugugauuaucugauucuggaaaguaaagacccuguuuccagacguuugcugcuugacuuaguucccaggggauggccacuggaugaugcaguguugcccaggagagguuagcuagacacacugcaaccauuccauugcuaauacuuauacuugcucuuguucugcugggugcuaugcagggaagggcugucugagcccuuugcaagaauucucccauuggugccucccagagauucugagguuggggcuuuuugcaucccuuauuagcagaugagacaccaaagcccaggucaauaaucugaccugcaucccccgccuaccagccagaccaaggucacuuccccacaaugcaggcccugauccaaggcucugggugcaaaccaguuuccaugucccuggggguccaucuucuucagcugacuuuuuuuuuuuuuuuuuuuuuuugagacagcgucuugcuuuguugccgaggcuggagugcaguggugugaucauggcuuauugcagccuugaccucccaggcucaagcaauccucccacgucagccuccugaguagcuaggacuaugggcacacgccaugaugccuggguaauuuuuuuuuuuuuuuuuuugagacagagucucgcacuguagcccaggcuggagugcaguggcgcaaucucggcucacugcaagccccaucucccagguucaugccauucuccugccucagccucucgaguagcugggauuacaggugccugcuaccucgccuggcuaauuuuuuguauuuuuaguagagacgggguuucaccguguuagccaggauggucuccaucuccugacuucgugauccgcccaccucagccucccaaagcgcugggauuacaggcaugagccagaugccuggcuaauuuuuaaguuuuuuuauaaaggcggggucuugcuauguugcccaagcuggucucaaacuccuggccucaaaaagucuuccugccucagccucccaaagugcuaggauuacagacaugagccacugcacccagccugacuuuuuuucuaacugaaaaauuaauuauauauauucauggaguacaaugggauguucugauauauguuuacauuuuugaaugauuaaaucaagccaauuaacauauccacuacaucgcauacuuauuuuuuguggugagaacgcuuaaaaucuacucuuuuagcaauuuugaaauauacaauaccuuauguuguauauuacauuauguuguauaguacguugaaacauacacuacaauacguuaucauuaauuguggucaccaugcugugcaaaagaucucuaaaacguauuccuccugucugacugaaacuuuguauccuuugccuaauaucuccccaaucccuccaccaccagccccugguaaccaccauucucucugcuuccauggguucaaauuuuuuauuuuuugaaauuuuuaauuuuuauuuauuuauuuauuuauuuauuuauuuauuuuugagauggagucucgcucugucacccagucuggagugcaauggugccaucuuggcucacugcaaccuccgccuccuggguucaagcgauucuccagccucagccucccgaguagcugggguuacaggugcuugccaccaggcccggcuaauuuuuguauuuuuaguagagacgggguuucaccauguuggcuaggcuggucuggaacuccugaccuccagugauccacccaccucggccucccaaagugcugagauuacaagcguugagccacugcaccuggccuaaaauuuuuuuuuuuuuuuuuuuuuuugagacggagucucacucucuugcuaggcuggagugcaguggcaugaucucagcccacugcaaccucagccucccggguucaagcgauucuccugccucagccuccugaguagcugggacuagaggugugcaccaccacgcccagcuaauuuuuguauuuuuaguagggacaggguuucaccauguuggccaggauggugucaaucucuugaucucgugaucugccugccucgggcuuccaaagugaugggauuaugggccaccacgcccggccucaaauuuuuuagagcucacauauaagcgagauuguguacuauuugcguuucugugucuggcuuguuucaucuuaguauaauguccuccagguucaugcacguugucgcaaaagauggaauuugcuccuuuuuaaagacugaauaguacuucauuguguacauauacacgccauauuuucuucauccauuccuuuacugauggacauuuggguuguaccugcaucuuggcuauugugaagagugcugucaugaacaugggugugcagcugacucugagguguuagagggauuacagcuccuccaaaagaccaccgucacccaaaccugcuccuccugcccuauuuucuguuuagguaaaggcggcuuuaacccccugcagugcucuggccucagaccuccagaucuuccucuaugccucuaugccucuuuuucuccacccccugcauccaaucuguuagcacaucuuauuggcucuaccuucagaaucuacccagaauccaccacccaccucucaccaccuucacagccccaccccgguccagcccccaucuuugcuggccuggacuaaaccaguugccccuccaccccaaucuggucucuuaacuucaguccuugccccacccccaggacuguuccccacacagcagccagagggcaccugugagccacugagucaggaccuggcuccucuuugcucacaaccucacuuggagaaaaagcccaaauucuccucacagggacccacaaacucugccccugugaucccccaucccccucuauucccacucuccucuccacucacucggcuucagcuacacaaguucccugcugucccuuacacaccaagcacuccccagccucagggccuuugcacaggcuguucccucugccuggaacacucuucccccagauaucugcuuggcuccccccucacuuccuuugggucuuugcucaaguguccuucuaacauguaacugccucaccugcacugugccaccccacuccccgccucuaggcuuaauuucccucuacaccccugaagagcaucugccaagcuauauuuacuuguuuauugguuauugccaauccccugcccccacuagaaugccagcuccaugagggcagggacuucugucuguuuuguucacugcuauucccccagagccuagaacacagccuggcacauaguaaguauucacuaaauaauuuguaauaugaauugugccaguaaaaucuuccaggggcaucaagccccugccaugacuaggugguaacauccucacccccuguccaugugcuaucuccuccugaccugcuugucucauuguucuaaugguggcucacgccuguaaucccagcacuuggggaggccgaggcgggcagauaccugaguucaggaguuugagaccagccuggccaacaugaugaaacccugucucuacuaaaaauacaaaaauuagcugggcguggcauugcacgccuguaguccuagcuacucgagaggcugaggcaggagaaucgcuugaacccgggagguggagguugcagugagcugagaucaugccauugcaauccagccugggccacaagagcgaaacucugucucaaaaaauauauauauauauuucauugugguaacauaugcauaacauaaaauguaccauuuuuuaaguguuuaguugagcggcguuaaguacauucauauuguugugcaaccaggaccgccauccaucuccagaacuuuugcaucuugcaaaacugaagcucugcccccaggaaacucucacuccccgcucccccuuccccucuccccgacucccccuuccccccuccccacuccccccacccuacuccacacuccccacucccccagccccuggcacccgccguucuaguuucuaucucugugaauuuggcuacuuuggguccccccugugaguagaaucauacaguauuugucuuuuugugacugguuuguuucguggagcauaauguccuccagucucauccauauuguagcaugagucagaauuuccuucuuuuccaggccgaaucguauuccauuguguggauggaccacacuuugcuuaucuguucauccagaugggcacuuggcuuccaccuuuuggcuauuguaaauaaugcugcuguaaaccuguguguacaaauagcugagucccugcuuucaauucuuuuggauauagacccagaaguggaauuuuuuuuaaaucaagauuugacccacuggggcccuuagaggucucauuggcucugaagcuuuuuuuuuuuuuuuuuuuuggacgcuuugaaacuaaaaauaggagugaggggcacagugaggggggcacacaucucucgugucagcguuuuuuaaaaacaccccgggaggaagaugugugaaaucccucccuuccccccgcucccacccccuccaagaucucaaaauaccucuuguuuuaggaagcggcugugacaucaggcaggcagcguguggcaucugagacacaauaucgcaaguggcugggagcccagagaaaccaggacaggcgugcuggggauguggacuagagauggagcuaauuuuaguggcugaagaggcugcaagaagagagagaaagagggguguguguguguguguguguguguguguguguguguguguacgcacagugauagaggcuggagggggagaaaugacagauaaaucagcuugggcaaagaaagcuaaugggcagaggagcgagacccagcucagaagguggucagcaaaucuaaagaugugugcccgagggucaaggugguggggggauucauaggcaagugguagagaggcuauuccauuugcagaggcucucucuguuugaggcgugauucaccugugccguccucaaggccauucugagaacaccacuguuguuuuccuccuuuuaugaguagggaaacugaggcauugaacugcuucuauucuucaguaagaagcagggggaacauaugguagaagcaaagaaauacaaacaugagggcucucggggucuacgugauuggcugugacauccaugagagcggaucgcagguugaaggaaacacugguggcagaaaguagcugaacauuuggauuugggaaucccaguggacguggcgaaaauucuggcuuuucccuucacaggcugcggggccacucugaccugcgguuuccuuaucugugaaauggaacgaugccaccugucucagcguuguuuugaggaugcgaggagaugauccguguaauaugcccacuagggggccugcuccaggguagauucucagcaaaugguagucaugguuuuuguuacauuuggggauauuggcagguaaaaaggaaauacuucauucauuccaaaauugcucacugagguucuacuaugugcuaggcccugaugacacaucggucaacaagacaggccugcuuucugcccuuguaaaacuucaguucaacugcauugcacucaucagccuaauaauccagguaaauugugaugagaauaacaacuagcauuuacuaugagcccuuuacaaauauuaacccauuuaaucuucuaaagagccuauaagauaagagcucuugcccugcgcaguggcucacgccuauaaucccagcacgucgugaggccaaggcagguggaucaccugaggucaggaguucaagaauagccugaccaacagggugaaacccugucucugcuaauaauacaaaaauuagccaggcaugguggcaggugccuguaaucccagcuacuuggcugagguaggagaaucgcuugaacccaggaggcggagguugcagugagucgagaucacuccacugcacuccaagagugaaacucugucacacacacaaaaaaaaacaaccuguuauuauccacauuuuaccuaugaggaaaccgaugcccagagagguuaaguaacuguccaaaggucacacagcuacggagugguagagcugggauucagacccaggagugugaucccagaguguguguguauguuuguuuguuuguuuguuuguuuguuuguuuuuaccacuguguuuuccugcuucugcaauagaaguaaucaccaguaacacugagcaguuguuaugugccaugcccuuaacacacaucuccuuggaucuuuggaaagaauccuaaaaggguuguuuuucaugauccacauuuuauggagagagagagaucaaagcauagagagaggaaguaacuugcccaagauccugcagcugaagacucuaggguugcaaauuugggacggcccuggacccugcauuccagcuucuagcagcucauagggggaacucuuuauuuauuuauuuauuuauuuauuuauuuauuuauuuauuuugagauggaguuucgcucuucuugcccagccuggaaugcaauggcaugaucucggcucacugcaaccuccgccuccuggguucaagugauucuccugccucagccuccugaguagcugagauuacaggcauaugccaccacgccuggcuaauuuaauuuuuuuuaguagagacgggguuucuccauguuggucaggcuggucucgaacuccugaccucaggugauccgcccaucucggccccccaaagugcuaggaauacaggccugagccaccacgcaugcccugggggggaccacuuuuaucggugcauuucuuccauuuucccugugucuguguaaagauaaacacccccaagccccuugacuaugaacugugggccauaauuaguuaauggaagguaaauguuuuagagacggaaauugcugugccauuuuuccccgcuaggcauuguugccugcaugcuaaugcaacacaaugugccuuucuucugucaggcauuuuuagacaaauucuauuuucccuaaaauauuuugccaaagaaaauagcaaauggggaagacauucagaggcucaggcagagagaggacaccauucccuuggguuuaaacagaauggcagaguggauaacagcacagaucuugaguuagguggaugccaauuugugauuuauuucccagcaaaccaagaugcuggcucucugugugccucaguuuacuuauuugucaaaugaggagaauaaugguaccugucucucaccagcuuaccaguugccucuuuagcuaugucuaaucugcuauuaaccacgcccacuaugucuuuaauuccaaguauuagaauuguuuucuuccuacaagcugucugaucuuuuuuaauccugcuucaucuuuugcaguauuguuuuccuacagcaggauuucucaaccuuggcacaauugacauuuugggcuagguaauucuuggccgugagcuaccacccugugcuaagauacuuagagcaucccuggccucucacccuacuaaaugccaguagcagccccuccccaguuguggcagccaaaaauggcucagacauugccaaacgaaaugucccauggaggguagaaacgcccccacuugagaauuguucuauagguauuuucaagcaugucuuacauuucuuuaaguauaauaugcaaaagaaaaggcuaaaucuaaaaaaagcccauaauaugcgaagaauuuuuauaaucaguguccaauaacuuaaguaucuaaaauuguuauggcuuuuuuucugcugucucuuguuuccugugauuccucauucuggugccuuguuuucuugaaugucuuguuaucuuugguugugugaagcucauuuuccaugggacacuauuuuuuguuuuguuuuguuuugagacagagucucgcuugguugcccaggcuggagugcaguggugcaauaucaguucacuacaaccucagccucccaggcccaaaugauucuccugccucagccuccugaguagcugggauuacaggcgugugccaccacacccagcuaauuuuuuuguauuuuuaguagaggcaggguuucaccacguuggccaggcugguuuugaacuccugaccucaagugaucaacccgccucggccccccaaagugcugggauuacaggugugagccaccgugcccggcauccaugggacacuguugaagggaguucauugaggccugcgaugaaggcgaacccuccauggacaauuugcauuuacuuuuuccaggugucugggaaacucccagucuaggaccaucuuagacuuuuagaccaacaauguguugagaauuuaggucaccagugucugcaaaagccagcuugugguuauaauuucucaaaaacuuuuguuuuucuccuuuucugcaaagugccaaaguaacuuccucaaaaaucucugggaauggaaagacgggaguaaauuaacuucagguuucuuaccugaaagugauagccuauuggggccccauccuacuuggggaguggugugucuccuuugagacuuucuaacacguguguacccuggacuuugccccaccccugcucccuaggaggccauaaaacuugaagcagcaguuccauggguuagacagaugcccuuggggcaaaagugguuuuaaugcucugguagaugcucagguuaccucugggaaauucuugacuucacuuauuuauuuggggcugauaacuacuaauugucaggccuuucuuguuucaacaacauggacuucagauuuuaugcaggauuugucaucguuuucagcaagagagucagucuuauuacccagcuuacugcauuagaaauagaugucugggccaggcgcaguggcucacaccuguaaucccagcuguuugggaggcuaaggugggcggaucaugaggucaggaguucgagaccagccuggccaacaugguaaaaccccaucuauacuaaagauagaaaaaauuagcugggugugguggugcgugccuguaaucccagcuacuugggaggcugaggcaggagaauugcuugaacccgggaggcagagguugcagugagccaagaucgcaccacugcacuccagccugggugacaggacgagacucugucucaaaaaaagaaauagaugucuguuguguggauuauuuaaaagaguagauggccaagaacuaugacuuaugccugucaucucagcacuuugagaggcuaagguggagggaucacuugaggccaugaguuagagaccagccugggaaacauagcaagacccccaucucugcaaaaguaaaauaaaauaaguuagugugcaugauggugcaggcauaccucuaguccuagcuacucaggaggcugaggcaggaggaucacuugagccuaggaguuugaggcuacagugaucuaugaucaugccacugcacuccagccugggugacagaucaagacccugccucuaaaacauaaaaauaaauacaaauuaaguuaaaaaauaaaauaaauaaguaauagaacauccagcacaguucuuggcaugcauugacuguuguuguuuguuuguuuguuuguuugugacggagucucacucuuguugcccaggcuggagugcaauggcaugaucuuggcucaucauaacuuccaccucccagguucaggugauucuccuacuucagccuccugaguagcugggauuacaggcacgugccaccacuccuagcuguuuuguuuuguuuguuuguuuguuuuguauuuuuaguagagaugggguuucuccaaguuggucaggcuggucucaaacuccugaccucaggcgaucugccagccucggccucccaaagugcugagauuacagacguaagccaccacgccuggccagcuguuuugauuguuaaaugaaggugguaugaaagggaaggaagaacagugacauuugcaagggacacucccuggagggcagggcaagggggcuguggaggggagaagucagagaguaugauacagguugccuugggugauguuuuagauuuuagccaacauuggcaaagagccucauuuaucucucagaguagcucuggcuacuggaaaugcugcacaacuucaggcggacuuucuagaagaaaacucuuggccaggugcagugacucacaccuguaaucccaacacuuugggaggcugaggcagguggaucacuugagcucaagaguuugagaccagacugggcaacguggcaaaaccucaucucuacaaaaaaaaauacaaaaauuaaccaggcgugguggugcaugccuguaucccagcuacuugggaggcugaggugggaggauugcuugagccuggggagguggaggugguagugagccaagauugcaccacugcacucccauuugagugacagagcaagaccuugucucaaaaaagaaaaaaagaaaagaaaagaaaagaaaauucucucugggauucaauccuggcccacacagcauuggcuucacuucaccuccuucuccccugagauacacagcaccauucccccaagcuucaucaacuuaaucucugaucugggugcugugacuuguccccauuccuggccagaauuuaagguagggaugaacccacuagcccuccaucacgcacucugccauaaaagcacaccacgugcugauugcugucuuuggucuccuuucugccuugcccucuagacucugagcugcuuggagacagaggccaguuuuguccaucuccaaauccccuaaaguccuguggccagcaagcagguaggacaucugaaaguucgucagagagggaauugcuuuucucuugagaugcaacuagaacaagaaucuuauugaccuggaguagcuucaagguuguaagaguaugugucaggguucuccaagaccacucucagguuugaagguuugcuaaaagggcucacgggacccagaaaagcugugaaauucaguuaugguuuauuacaguggaagaauacagauaauacagauuaaaaucugcaaagcaaaagaugcacaaggcaauguccaggggagaucaggcaugagcuuccagcuguucacucccaguggaguuaugcaaacagugcucaauucucccagcaauggugugugacaauguacaguguaccgccaaccagagaagcucaccugagccuugguguccaggguuuuuauuggggcucaguuacauugacauggagcacccaugugacugacuuuaacugcugggucuccagcacacuccaagaucaaacugauaccgugugucccagggccccagcugaacacaaacaggcagucaccauagaucccauugugagcauaagcuaccaggcauggcccaaagcccuagauauacagauauucuuuccaggagccagccaagggccaguccuuccuuuggaauaugcagaguuugaacuccccaaccccaaggaguuaacucuuuacuacacagaauauaaaucucaccaagucuuucuucuugucaaguccucucaaggugacccauugcuuuuagcagugucuuugagacccugcgucaucuggccuugacccauaucaccuguguuaucucuccacucuagcuacauugaacuuuucuuuuuugagauguggucucacuccaucacccaggcugaagugcagugguacagucacagcucacugcagccucaaacuccugggcucaagugauccucccaccucagccuccugaguagcugagcccacaggugcaugccauuacacccagcuaauauuuuuauuuuuaguaaagauggguucucacuauguuucccagguuggucucaaacuccugggcucaagcaguccucccaucuuggccucccaaaguauuggcauuacagggguuagccaccacauccagcccauugaacuuuuuaaggauccccuagcauccuauacuuucugucacuggauagccuuggaauuauuuuuccuucuuuuugaaauacucuucuucuuuccacccuuugcugucaagucucagaauaggcauuauuuccuccaaaaacccucuccugacccuccaaaucuggaugaggacacuuccuuugcccagagagcaccuguuuuaauccucucagguggcuauaauaaaauaccuuaaacuggguggcuuauacaccucagaaauuuauuuuccacaguucuggaggcugggaagaucaaggcacugacagauuuggugucugaugaggggccauuucuuguuucguagaaggggucuuccuacugcaucuuuccauggugaaaagaguugaggcagcucucugaaaccucuuucaugagagcaugaaucccucugucuucaugaucuaaucaccucccaaaggccccacuuccuaauaucuucacauuggugacuagguuucaacauaugaauuugagaaagacacagacauucagaccauagcagugcucuuccaccagguuuuuuaucccccuguauuauaauugagguuuaaauuaucugcuuuccuucccuuagauuguaagcuccaugagagcagggcccuacccauccagucauuguccuaucccccaugacuacaacuuccuggguacauaauuaauauuuauuauauuauguagcaaagguaugcugccauacuaagagacccaaaaggccaccggauuaaaaccuuaaagaaaaaaaaauaauuucucuccuauaauagcugcaagguuagccaugcagguuggcagggaagcucacuuccacaaagucacucagggauucaggcuccuguugcccucuucuuuucuaccaccaaaugaucuucagcaccauuugcacaaucaaaacuuaacuggucuugaauaggcagaccuugaauuucugaagucucagacccaaaaguggcagcugucacuuccacugacauaucacugauggaaacuuaaucaugugaucauaccaaacugcuagggaugcugggaaauguaguuuuguugggaacuccaugacuuggcuaaaauuccauuacuguagaagauggugggggaugggggagugguggacauccagugguugcuaccauauuuauugaaucaaauugucaaacaggaccuaucugauaagggguucuuuuccagaauuaacugaaguauuaaaucaggggcaaaggcaugucaccucaucuuucucucccuauauuggcuuucuagggcuguuauaacagaguaacaugaacuuggcggcuuaaaacaacagaaauuuauuuucucuuaguucuggaggcuagaagccuaaaaucaaggugucagcagagccaccuugacaacugcucuaggaaagaauucuuccuugccucuucugguggcuccuggcaacccuugguauucuuugucuggcauccacuucaaucucugccuccaucuucauuugccuuuuuucucugugugucuauguccuuuccucuucuuagaaggauaccagucauugaauuuagggcuuacucuaaauccaggaugaucucaccucaagauccuuaauuaguuacaucugcaaagagcuuauuucaaaacaagauugcauucugagguuucgguaaacacgaauuugggggaaauaguauucaacucaauucacugcuuuacuuaagaaaagagaccaugaagugagccuccuucugcuugagagagagagcgagccuuucugugcaauaggucaaugaauggaugcagcugaauuccacauaacuuuauaaaaauagauggccagcccaugggguuugcugaccccugcccaaaaauuccaaagucaacagcagucucuuuuuuaaucauuucucuauuuuuuaauuuauuuuuauuuuuauguugagauagagucccgcucugucgcccaggcuggaguguaguagucucggcucacugcaaccucuaccuuccagauacaagugauucuccugccucagucuccugaguggcuaggaguacagguguccgccaccauacccagcuaauuuuuguauuuuuaauagaaacaggguuucaccauguuggccaggcuggucucgaacuccugaccucaagugguccacccaccucggccucccaaagugcugggauuacaggcaugagccaccaugcccggccaggauuuucuucauuuuaacagcauucuuacuugucccacauccauucuauccugggucuaauuagauaacaaaaucuacagaucuuguuuaacugacauuguccugggggauacuuuuuaucuuuugagacaaggucucacucuguuacccaggcuggagugcaguggccugauaacagcucacugcagccucgaccaccuggguucaagcgauccucccaccucagccuccagaguagcuggaaccacagaugcaugccaccacaccuggcuaauuuuuaaauuucuuguagagguggggucucccuauguuaccaaaggcuggucucaaacuccugggcucaaaagagccucccaccuuaaccucccaaagugcugggauuacagauaugagccacuguuuccagccuuggaaauauagucuaagaacugagucaauaggcgauuuugucauuguguggacaucauguagagaacuuaacacaaaccuagaugguauaaacuacugcacaccucaguuauggggcauacccuauugcaccuaggcugcaaaccugcacagcagguuacugucuugaauacuguaggcaguuguaacacaaugguaaguauuuguguaucuaaacauaucuaggccgggcacgguggcucacgccuguaauuccagaucaccugaggucaggaguucgagcccagccuggccaacauggcgaaacuccuucuuuacugaaaaaugcaaaaauuagccaggugugguggcaggcaccuguaaucccagcuauucgggaggcugaggcaggagaaucgcuugaaccugggagguggagguugcagugagcugagaucaugccacugcacuccagccugggugacagagcaaaacuccaucucaaaaaaauaaaaaauaaaaaacauaucuaaacagaaaagguacaguaaaaauacaguuauaaccauaugggaccaccauuguauaggcaguccgcuguugaucaaaacauaucaaaacaucguuauguagcacaugacuguaccauaaaccacacggcuucaaacaagggaaauguauucucucacuguuuuggaggccauaggucugaaaucgaggugucaccagggucccuccaaaggauccgggggaggauccuuccauuggauuuggaguugcuucacuccagucucugccucaguggugacagggcguucuccucuucccucucaaaguucccucuucugcugugucauaaggauacauaugacugcauuuaggccccacucagaaaauccaggaauaaacucuugcccucauauucuuaacuaaaucguaccugcauaccuuauuuuuucuaaauaagguagcauuccagggauuaggacaucaacauaacuucuggaggguucacuguucaacccacuacagccagaaugcgcuuugaauucagguucugacaucugggacugccucccacguacacacaccacuaccuuguacugaaugccugaaggguucugcccccaccuccacucccccaaauauuugcuguggaccugagaaagcugacuucauggaagcuucauuccauuguucuaaggacuuuucauacauuaacaaaugucuucucucuauggggaaaaccacagagaaaucaagacagagugggguuaaguaacucaccugaggaggaacaguaaguggcagagccaggauucaaaccaacaugguuuugcacaguuuugacaucauuugcaacacaaauauugucacagauaccuuuuugagcaucuacugugcuaaccgccaggaaggaaaagaacauggggccgggagagcucuugacaggggacagggcuggccauggaggucugugucuugguggaagaugcuaugguucucuuuuuuuuuuuuuuuuuuugagauggagucuugcucugucacccaggcuggagugcaguagugcaaucuuagcucacagcaaccuccaccucccggguucaagcgauucuccugccucagccucccaaauaucugggauuauaggcacacaccaccacgcccagcuaauuuuuguauuuuuaguagagaugggguuucaccaugugggccaggcuggucucgaucuccugaccuuguugugauccacccgccucggucucccaaagugcugggauuacaggcaugagccaccacacugggcaacuaugguucucuuuuaacuccuugugcugaaauuauugcagaagcccaggccaguucauccccagaaagugaggcauaaacaggcagagcucuacagaaacagagaauccacgacugguuugauggaggcugccucacuaccuacagaaugggcucuggguggauuguucuaucuggggagccagcccacccaccagucucagcccuuggcgacucuuuccugcugucacagcagcuggacauucagaaaccgaaacaugacagccuucccucccuguuccugcccaguggaguggaaaccccucgggacccacauaccgagcgugcacagcagcacagaguugcacaguuaacacagcgcuucuucuccagcccuccggaugcaagcugacagauuggcagcuggcugacuuccaagguccagugaguucuuggcagucgcuuucugaccuggacgaguggcugccaccuccuggaacaucaggcugcccccuuggggagagggugacggucucucuggaaagacugugagcuuugagguggucaucaaaagccauucuuggaaacauucuuugagcuguaccgugcaauucggucaccaauugcacguauuuggauauuaauauccguauguggauauuaaauugguuuuggguuuuguuuuguuuugauuguggcaaaauauacacaacaauccuccugccucagccucccaaguagcuacaggcaugcaccaccauacccagcuaauuuuuggauuuuuuaaauuuguuuguuuguuuuuguuuuuugagauggaguguagcacuguugccugggcuggagugcaguggcgcgaucucagcucacugccaccuccgccuccuggauucaagugauucucuugccucagccuccugaguagcugggauuacaggcgcccgccaacacgcccagcuaauuuuuuguauuuuuaguagagaugagguuuuaccaugucggccaggcuugucucgaacuccugaccuugugauccacccgccucagccucccaaagugcugggauuacaggugugagccaccgcgcccggccgauuuuuguaguuuuaguagagacaggguuucaccauguuggcuaggcuggucccgaauuccugaucucaggugauccaccgccucggccucccgaagugcuaggauuacaggcaugagccaccgcacacagccuaaaugcugugccucacgccuguaaucccaacacuuugguaagcugaggccagaggauugcuugagcccaggaguuugagaccagccugggcaacauaggaagaccccaucucuauaaaaaauaaaaauaaauuagccaggcgugguggugcaggccuguggucccagcuacucgggaggaugaggcaggaggaucgcuugagcccaagaggucaaggcugcagugagcugugauugugccacugcacuccagcaugggugaaagagcaagaccuugucucaaaaaaaauuaagcgaaauuuaaaauucuguuucucacucacacaggcugcacuucaagugcuuaaucaucccuugugggugguggcuaucauauuggacagcauggauagagaauauuuuuaucagcguaggaagcuucaucagagaggaccgcucagaggccuguggggaccagcacagugcaguagaagacacaggccagcuggugagagacuggucuucugaucccagaucugucccucacuugcuaggugaccuuggacagcucccucagucccucuggaguuuucucuucauuguuaaaucaggaaauuggccucagugaauucugaggccccaucuacuuuuuuuuuuuuuuuuuuuuuuuuuuuuuuaauugagacagagucucgcucuguugaccaggcuggagugcaguggcaugaucuuggcucacuguaaccuccgccucccagguucaagcaauucucugccucauccuccccaguagcugggacuacaggcgugcaccaccaugccuggguaauuuuuguguuuucaguagagaccggguuuugccauguuggccaggcuggucucaaacucccaaccuugagugauccucccgccucggccucccaaagugcugggauuacaggugugagccaccacgccuggccucaucuaguucuaaauguuaugacccacucagcucugaagacaagggaggaacauccucucagucuagcucugacaugcagaagccucucacccugucccccaggucauaaaggcaggcguguugugaagagcacagaaugggcugagaaaaauaugcagggauugcgucuaucucccuuccuuccgcacguuuccuugucggcaccaccugccucuauuccgcgccgcacacacacccgccuucucucugucucggaggaagacaggaucuuccaucccccaaauccugcccugauuccuacucugaagccucugcccugacuccuuuaagcucccugggaauacagcccaucuccuaugcccuccucaucccaguaguuccuaccuuccccaaaaucgcuuugggaaagucccccaaugaguaaccagcuguccuacaugggcaucucagaacuucucuucuguuguuguuguuguuuguuuugcuuuuguuuugagacaggaucucucuuuuucacccaggcucgagugcagaggugugaucucagcucacuguagccuugaccucccaggcucaggcgauccuccccccucagccucuggaauagcugggacuacaggcacacgccaccacacccgggcaaauuuuuuuuaggacuuuugguagaaauggaguuucgccguguugcccaggcuggucucuaacuccugggcucaagcgauccgcccacuuuggucucucaaagugcugggacuacagacaugagccaccacacccggcagagcuucuauuucuugaguguguucucagccaugcuaagacauuuucucuucucagccugaugaugcuuuuggcuuguguuucuuuguuuuuaauuaccccuucccagucgcugucaugggaucaugagggucuucuguccaucuagaugacaccuuucuugugccacgugucuccaacauucccugguuuuuaaacccuuauugcuuucaagauacuauccaagcuccuuaauguggcacauuguccuucgcugcuaucugccugcuuuuuuuuugagacagagccucgcucuauugccuaggcuggagugcaguggcgcaaucacagcuuacucugcagccucgacuucuugggcucaagcaauccuccugccucagccuucugaguagcugggaccacaggcaugcaccaucaugcuuggcuaauuuauuuuuauuuauuuuuauagagaaggagucucccuauguugcccaggcuggucucaaacucccggacucaaaguucauugcaguuucaauuuuuuccuuggcucaaggauccucccacuucagccuccugaguagcugggacuacagacgggcaccaacacaccuggcuaauuuuuguauuuuuuguagagauggggucccacuauguugcccaggcuucuaucugcuuuuaucucaccuuccacucuuccauccuuccuuucuuuucuuuuauuuccuuucccuucccuugccuuccuuuucuuucuuucuuucuuucuuucuuucuuucuuucuuucuuucuuucuuuuucuuucuuucuuucuugacagagucuggcucugucacccagacugaagugcaauggcaagaucuuagcucacugcaaccuccaccuccuggguucaagcaauucuccugucucagccucccgaguagcugagauuacagguaccuggcaccacacccggcaauuuuuuuuuuuuuuuuaguagagacgggguuucgcuauguuggccgggcuggucuugaacuccugaccucaggugauccucccaccucagccucccaaaguguugggauuaacaggugugagccacugugccuggccuuuuuuuuuuuuuuuuuuuuuuuuaagacaggaccuugcucugucacucaggccagagugcaguggcacuauaaucacuuucugcagccgugaccuccugggcucaagggauccucuugccuuggccucccuaguagcugggacuacaggcaugugccaccacacuggcuaauuuuuaaaacuuuuuguaggccgggcacgguggcucacaccuguaaucccagcacuuugggaggccaaggcgggcggaucacgaggucaggagauugagaccauccuggcuaacacagugaaaccccaucucuacugaaaauacaaaaaauuagccagguaugguggcgggcgccuguagucccagcuacucgggaggcugaggcaggagaauggugugaaccugggaggcggagcuugcagugagcugagaucacgccacugcacuccagccugggcgacagagcgcgagacaccaucuaaaaaaaaaacaaaaaaaaaaaacaaaaaacuuuuuguagagauggauucuugcuagguugcccaggcuggucucaagcuucuaggcucaagcaguccucuugccugugccucccaaagccuugggauuacaggcgugagcccccacaccugguccuaacccacuuucugaacuuccaaccacaccauuuuguccuaauauuuaagucacaccauaacaugucccacuucagaaaugccuaccaaaguagucuucaaaucuuuuuaaaucaguggacccuuucuaccaaacaaauguuauuuuuuaaauauuuauuuuagaguaauuuagacuuuuagaaagguuguagcugggcgcaguggcuaacgccuguaaucccagcacuuugggaggccgagacagguagaucaccugagguugggcguuugagaccagccugggcaacauggugaaaccccgucucuacugaaaauacgaaauuagucagguaugguggcacgcgccuguagucucagcuacucgggaggcugaggcaggagaauugcuugaacccaggaggcggagguugcagugagcugagaucgcgccacugcacuccagccugggugacagagugagacuccaucucaaaaaaaaaaaagaaaagaaaaaaaagaaagguuauaaauauauuauaaagaguucccacauacccuucacccaguuucuccuguuguuuguaucuuauauuaucaccauaugcuugucaaugcuaaggaauugcugggugcagaguggcacauggcugcagucccagauacucaggaggccaaggcaggaggauaucgcuugagcccaggaguucaagucuagccugggcaacacagugagaccucuuuucugcaaaagaaaacaaauaaaacaucuaaaaaagaauacacuggaggcggcguggaaacaaggaucucauuugggaguugucugcaauguucugagcaagcaguaacggaggccucaagucagggcuguggucauggagguggggaggggugguugguuucacuaucuguguugacuuaauuuuagauuugcagacucaacugaguaugaacuuuaagagaaagagagaggccaggcacggugggucacaccuguaaucccagcacuuuaggaggccaaguggggaaggccgcuugagcccaggaguuugacaccagccugggcaacauagugagaccccugucucuacaaaaaaaaauuuuuaaauuagccaggcagggugaugugucccuguaaucccagcuacucaggacagugaagcaggaggaucauuugagcccagaaaguugaggcuguagugagcuguaguugcaccauugugcuucagccugggagacaaagugagacccugucucaaaaaggagaauggggagagagagagagagagagaaggagaaagagagagaaagagagagagggaagucaaggagaaccccacauuuuuugacaugguguauuagucucuucucacacugcuaauaaagacauaccugagacuggguaauuuauaaaggaaagagguuuaaugcacucacaguuccacauggcuggggaggccucacaaccauggcagaaggcaaaggagaaguaaaggcaugucuuacauggcagcaggcaagagagcuugugccauuuauaaaaccaucagaucucaugagacuuauucacuaccacaagaacaguaugggggaaacugcccccaugauucaguuaucuccaccuggcgccgcccuugacacguggggauuauuacaauucaaguugagauuugggugggaacacagccaaacccuaucacaugggcaagugaaaggauggguuugccaucaaauaaaauggggaaggagacugacuaggugggcagauuaggaacucagcuuucuaugaagugccuacugauggauagagauauuguguuggccaucuauuagguuggugcaaaaguaauugcgguuuugccauuaaaaguaauggcaaaggaaauaaccuuugcaccagccuaauaggaauuggagucuaaaauucaaaaaagguaagucagagcuggagauccaaaggcaggagucagccuccuguggaggcuauuuaaggaacugaauaagggcauagaugcaggagagcacccaggacugagcccagggcuuacucuccaucauuaaagagguuggggaagaugaggaggagccagcagagaagacugaauuggagcaaaucagaagaaugugggugcuggcugucaugcaaggaaagugcuaagccauuucaaguaugagggaaugaucaaugauguccacugaugcugauguguugacucaaaugaaaaaugagaaucaaccauuggauguaguggcauggagaucuuucgugaccugagccagagcugcuuaggugaagaggugaaggcaagaggcuacuggaaggauuacuacuagcucuuuuaaagaguucugcugugaaggguagaggaagagagauggggcauguguuagcuggugggggaaguggauuucagagguuuguuucccuuaaaaaaaaaaaaaaaaagaaaaaagaauaaagaaaaaaaaaaggccaggcacaaugacucacaccuguaaucccagcauuuugggaggcugagaccucgggaauuugagacuagccuggacaacauagugagaccccaucucuacaaaaaaaauuuuuuuuuaauuagcugggcaugguggugcaugccugugguccuagcuacuugggaggcugaggugagaggaucucuugagccugggaggucgaggcugcagugagcuaugaucacaccacugcacuccaggcuggacaacagagcaagacccugucucaaaaaaaaaagaugggagaccuaacagcagauuuuaugcugauaggaauaaccuauuaggggagaaaaacaugaggaugcuggaggaagaagagugucaggaggacaucucuugguggacgagaggggauggcauuugguguacagguggaagguuucacuuuagaugacagcacacacaguuaucuauagaaacaggagaaaaugcacuauaugggcauacaugcugggagguagagaguaaauaauaguggugguugcuuguggaaauucucuucuaauguuuuuauauuuuuaugguuuaucaaggacaauuuauauuuuuacaguuuacugcaaacaacaaguucuaauuuauucaauaauuauuuguggguagaccgagugcaguggugcaugccuguaauccuagcacuuugggaagccaaggugggaggauugcuugaacuccugauucacuucugagcuugaaucaggaguucgagaucagccuaagcaacauggcaaaacacugucucuacacaaaauacaaaaacuagccagguauaguggcaugcacguagucccagcuauucgggaggcuaaaacgggaggaucauuugagcccugaagguggagguugcagugagccaagagcgagccacugcacuccagccugggugauagaauaagacccugccucaaaaagaaauucuuauucuucuucuucuuauuauuauuugaggagacauuuacuuuguaccaggcgcugugcuagaugcuggagauacagacaucaacaaugacaaggcuaagugccuggcguauuuguacuuugagucuaauaaaagacaucacacagacacacaacacacacacacacacacacaggauugucaaaggaucaaccauuucacaugucaagaucaggaaugauauuggucuacuacugccuuaccauaucuccuaccaugaccucaucuuccucuugccagauuuuaagucuuuauaccucaacucccagaacucucuucgccucacacccuaucacaaugucauccguaccccacggccaauacuccaucauucgggaaagcaaaguuccaaagcgucaagauuguaucaauggaccugucucuauggcaacaguccugaaugagccaagcaagguaacccuggagauggcgugaaugagaaaguggccuguugccacggagacgugcugaaugggaaggcccccacgagccaggcuaugucacgaagccgaaacagucagcaugaagucgguaugucuauuuucaacucggaauuacaaaaauacauuuuaauagagcucaugacccaucuccuuccucgucccugccucccaccccacucuucagccuucauccuacaacacaaucgagccucaccaggaacccuucaaaccccucaaggacaccuuacuguuccuucaguacacaguccccuuccugggcugaggugguauuccuuugaccaacuacugucuccccuuugggaccaacaguauucucaaaagccaugagcuuaugggaagaacauuaacuacauucuuuggggcaagaacaguugcucaccugugaaccagcucagcuugcaucugugagaaugauugcaauggguagaccaguucuccaucaaagaauggcccuagcaccccacacacagugguauaaucugaucaugcugguguauugaacauauaauguuagugccacaugaaaggaauuuguaaaaggacuuagugccuagaaagguaccuuugaagaucuuggaaucucugaaacuuacccagguuccuuauacccugcucaaaguauuccuccauuuauuucuucauucauuaguucuuuuguuucaccacauauauauuuuugaaacggggucucacucuguugcccaggcuagagugcaguggcaagaucguggcucacugcagccucaaccuccccaucucaagcaguccucccaccucagcuuccugaguagcugggacaccacagguacaagccaccacgccaggcuaauucuuguaauuuuuguagagacgggguuuugccauguugcccaguguauucguuuguucucacauugcuauaaagaacuaccugagacugaguaguuuauaaagaaaagagguuuaauugacucacggcuccacaggcugugcggaaggcauggcugaggaggccacaggaaacuugcaaucauggcggaaaaugaaggggaaacaagcacaucuucacaugguggcaggagagagagagugagggggggagugcuacaaaaccaggucucacgagaacucacucacugucaugagaaaagcaagggggaaaucugcucccaggauccaaucaccuccuaccaggucccucccccaacauuggggauuacaauucaacaugagaucuggguggggacacagagccaaaccauaucacccaggcuggucucuaacuccugagcucaagcaaucugccugccuuggccucccaaagugcuaggauuacagacgugaaccauauuuauuaagcauuguuacagcaaagagaagcauuguugcagcauaacaauuggaagacuccauugauggacgucuccaucaacaagaacugucggauaaacuaugguacacccaucccuuagcguguuaugaagucauuacaaaaagaagaagcagaucucugagugucaauaagagcuaguacuuauagggugucuacuguauacaagugcuguuagaaagugaguauuaacucauuuaauucuuguaacaagccugugagguggauucuuucauauccccauuuuacagagaaggaaauaggaaucucuauauccaagauauguuaucaggugacaaaagcaguuuuugaauggugccgccauuuucucguaagagcaaaucuggaagauuccaugagaaauuaauaauuguguuugccucuguagcggcacccugaaagauuuggaaguagguguggaaaggaaacuuacuuucuugugucuuucugaauuuuguacugucuacgcguuuugucuuucacaaaaccaaacagaaaaugaccauuuggugcauuuugugugucaggcauucuucuagucuagagaagcacaggagagcaaaauauuuuacugacgagaaaaaugaggcauggagaaguuaagugacuugcccagguagcagagcugggauuccacaucauaggguuuauacaggaaacagguaaacagagcugugcuuguguguggguauguguguacacaugcauacaugugugcauguguguguguguuugugugugugugaaugugcuuguguguugggagagggaaauggcaagagaagaaccuacagaaggucagcaggaaccaacccauguuuugaggaguuuggacuuuauccugaaggcacaagggagccauggaaggauuuagacaaggggugguugugcuuagcuuuuuauuuagaaggaugacucuggcugaagggugauggcccagaauacagguauaugugaaggacuccuccugcccuaguaggaggaugcccacccacccucucugcccagugcaguaucaaagggcaaauuggguacagagaauucucaccaagcuggguagaauccacucugaugcuggggaguggacacugaaugcaccagccucuccuccugcucaaucccugaauugaagcuguuccacuaauguuagggaucagauucccuucauauauauauauauauauauauauauauauauauauauauauauauaauuuuuuuuuugagacagagucucccucugucacccaggcugaagcccauugucgcgaucuuggcucacugcaaccuccaccucccagguucaagcaacucuuguuccucagacucccaaguagcugcgauuacaggcacccgccaccacaccuggcuaauucuauauuuuuaguagagacagggauucaccuauguuggccaggcuggucuugagcuccugggcucaagugaucagucugccucagccucccaaagugcuaguauuacaggcaugagccaccaugcccguccuuuuuauauuaccuuuuuuuauagagaugugguuucacuauguugaccaggcaggucuuaaacuccuggccucaagcgauccucccuccucagccucccaaaaugcuaggauuacaggugugagccacugcaucuguccagacucuguucuccauaaagcuggcauauggaaagagggaagaccauccaggcaauaucgaagucccauuggugcugauguggcugcugagaccacaugaauggaugcauucugacucugccaccucucagcuaugugacccugggccagucagcaagucccucuauaacucaguuuucucaucuguaaaauggcgucaacaguagccaaccccagcaaauacugugaaauauacagaacaucauuauaauggugaggaugauagagaugcuauguuaucagaauaccugggcuugaaccagcuccccuucuugcaagcugugugacuuggagcugaugcccaaaccucugugggccucauuuguuucaucuguucaauggggauaauaacacucuuacuucauacaguuauggaggauuuauugaaauaauugacauacagcucuuagaacaguauccggcuccuuguaagcgcucaagaaauauuacagacuguugauaauaaugcaauacuacuaccaauaauauggccaggagcaauggcucacaccuguaaucccagcacuuuaggaggcagaagcaggcugauugcuugagcacgggaguucgaggccagccuggguaacauagggagacucugucuuuacaaaaaauaaaaauaaaaauacaaauaauuagccagguaugguggugcauaccuguaguuccagcuacuugggaggcugaggugggaggauugcuugagcccaggaaguugaggcuacagugagcugugaucacaccacugcacuccagccagggcaacagagugagacccuaucucaaaaauaauaauaauggccgggcgcgcuggcucauaccuguaaucccagcacuuugggaggccaaggcgggcagaucacuugaggucaggaguuugagaccagccuggccaacauggugaaaccccaucuacuaaaaacacaaaaauuagccgggugugguggcggggugccuguaaucccagccacucaggaggcugaggcaggagaaucgcuugaacccgggagguggaaguugcagugagccgagaucacaccacugcacuccagccuaggugacacagugagacuccaucucaaauaauaauaugaguaauaauaauaauaucauuuuuaucaucauucuuacuaacagucucucacuccuugcccugcaguuuugccuguuuucuuggaauaacacucuuccacaccuuuccccucagggaugguucacguuuagcaucaugacccaccccuggggauuaguuagcucauuucuggaaagcacuuuggagcuguaggugcuuugcaggcuggaaacaucacgggacuuguaccauauuuaagcaaugccagauuauucugccuggcagggggaggacacagaggauacggcccugguaucuuuucucccugccuaccucagcuuugcucugaaccauuuucuguccuguucagggcagccugggccacuugccacuuccagcuuucucgggagaggaugccuuccugauggcacgccucuuaacacacaccuggugcuguuguugaaaaagcaacaauugacuccagcgccagcacugagaggcuuguccuuaaaauuagcaggagcuguuggaaggucgcuguuagcucuuuugacuggaacacacuguuccccagguggcaugaggcugaauacagugcagggauuggcucugcucucagguggccugcuccacgcuccugagcuccggguggaagcugugaccauuauuuccuuaacagaaacauauauagcagcauuaacuaugaaccuuauuacuguguguguguguguguauauguguauauauauauaugcacauaugugcauaugugugccuaugaaccuguucugagcacuuuacaaaugucaauguauuuuauccucccaacaacccauuuuauaaauaagacuugaggcacagagagguuacguuacugccccaagaucacacagcuggagaguggugaggccaagauuugaacauauguaccauuguaccauauguaccaacuuuuuuuuucuuuuugggaugcauucuugcucugucacccaggcuggagagcaguggcaugaccacggcucauuacaaccucaaccuccagguucaagcuauccucccaccucagccucucaaguagcuaggaccacaggugcauaccaccaugcccagcuaauuuaaaguuuuuuuuuguuuguuuguuuguuuguuugcagagauggggucuccuuauauuacccaggcuggucuagaacuccuagguucaagcaauccccccaccucggccuuccaacaugcugggauuacaggcaugagccacugcacccagguccucccuccuuauaaaggucgccaagcacaaucuugugagccuggcccuauccacacccauacgcaacaugguguguauuuuucaaacaaaaacugaaugaacaccucugguuuggguuccccucacacuugucccggguuuguugacucuguguugugggccuagacaaagcagugucuggagcuccuagacccagggaccagacagucuggguucaaauccuggcucuuccacuucugccugagugcucucucugaaccugucuuucuuuaucuauaaaauggagauaauuuuuuuaaacucaucacuuggucaaacugcuuugagcaugcaaaugaguucauauguauaaaccucuuagaaugucccaggcaaagaacaacacuucacucagaucaacauuuauuuagcaucuacuguguacccaugacuauucuaggugaugaggagacccucugguucuuaugagguagugaggugggggagggugagaacccuaaacauuaacgaugguguguucgcaggugggaaaaucaguaaagucggguaaagggaauuugggagugcugugcucaaguccuggcccugccacuuucuggggugcaagauacagcauugaauaggguggucaggguaggccuuauugggaaagugauauuugagcagacgaucuagaugucggcacauauugcuacuguuugaugguacuaauaugaguuugaguuucacuugcaaguauauauauauauauauauauauauauauauauauauauauauguguguguguguguguauauauauauguguauauauauguauauauauguguguauauauguauauauauauguguguauauauguauauauauguauauauauguauauauauguguguauauauauguguauauauauguauauauauauaugaaauuugguccauuuauuuaugcugaucaauuaauugauguugaaauuauaauugaauguuuuauuaauaaacagauacccacauacuauuuuuucagaaauuguuagguuuugggguuuucuuuagauuuugauuauuuuuauuugcuuaauuuucuuuuuucuuuuuuuuaauuuuauuuuuccauaaguuauugggguacaggugguauuugguugcaugaguaaguucuucaguggagauuugugagaaccuggugcacccaucacccgggcaguauacacugcaccauauuuguugucuguuauccagugcucaccuccuacucuuccccccaagucucuaaaguccauuguaccauuauuuuacucacccacauucuuuggccugagaugcugaguggucaugacucccagaucccuucuuguuucuguaucaaagaucuuuacuaagauccuggccuagggaaccuauucccuuuccucauccccaaugggagaaggggcuucuuccccagcuuauuugccaacucauaggaaagguaugaaggagaggacuguaguugucuugaagcuggucagauguugaagagaugauaauauuugcugaucaagagagacaaagcaaugcuggaagaagaggcuguguuaguuaacaccagcugcaauaaccaauaaaaccaaaaaucucuggcuuaagaguaugcaugagugagaaaucaacuucuaaaguacaacugguggccggaugugguggcuuaugccuguaauucuagcacuuugggaggcuguggugggagggucgcuugaccccaguaguuuaacgccaaccugggcaacacagugagacaccaucucuacuaaaaauaaaaaauaauaaagugaaacuggugaggggugcaaugagguggaguggugggugacucaaauauggcucgacuccaugcagucacucagggauccaggcuguuggaggcucucccugcuuaaacauguggcuuccaagguuguucuaagagccuacauugagacagcagcuggggaaaagggaaaguggagugggagguacuuaugaggguuccuggaaguggugaacaacacuucugccugcauucuauuggguggaauuuagucauguggcccaggcuagcugcaugggaggcugggaaauguagucucugauuaggcugccauuucccagucccacuugugaaucuuuagugggaagcucaccauguuugcaccagggauucagucuaccucccacucaugccucaacuauguaucaggcacugucguaaguacuuuacauaucagccuaccuaaugcaaacaacuacucagugggugcuuuauuggucacauguauuagugagaacauggaaacccagagccguuaaauaucuugcccaaggucacacagcuaggaaguggcagaguuggaauuugaauccaggaaaucuggcugcagagccccacgcuuaguauaaauucauuguaguuuagaaagaggcagaaggacccuaaaauuggcauaauccauuuuuuggucccuaaggaacugacugaauugacuacuuguaaaagugaguccuggacaggcaacaguggcucaggucuguaauuccaggacuuugggaggcugaggcgggcagaucaccugaggucaggauuucaagaccagccuggccaacauggcaaaacccugucucuaaaaaaauagaaaaauuagcuggguguggcggugggugccuguaauuccagcuacucaggaggcugaggcaggagaaucguuugaaccugggagguggagguugcagugagcaaagaucacgccacuuuacuccaacuugaaugacagagcaagacucugccucaggaccgccauggcccccuggguucuaggucagaguuucuccgccacagcacugaugacuuugggggcugcauuauuagcuccaaaaugggagcuauccugugcacugccucaacuuacuugaugccaguagcgcccgcgccccaguugugagaaccaaaaaugucuccacacauugccaaauguccccugggaggugaaaucaccccugguugagagucacuguucuagauuguuaaauauuaucuuacacucuagcacaaguccaaggcaaacugacuuagaaauuaccaaccuugcaaaaaauagaagauuucuuaaagucagugagcaugaugguggcaagcugcugaaaucacacccccagacauuagcagaugggaucuggacaguauucaucuaguuaaaaauugacaaggacugggacacugcaggcucuucaaaagagaaucauuugaauaacaaggggucaagacagggguaauuggugaaagccccugcucauaauuugaaaauauaaauaggcaucaugaaaauucauccugcaaaagucaaaagucgaaugugcaguguuauacaugaucaguugauuugggaggggaaauugcaugcacacacaugagagcuugcacacccacacacacacaccuguucaagugugugugccagugcucagugaggaccaucuccccaaccugucugaucaucuugcuuuggggugacccuaugggugaggcagaaauucuuggaucauaguuuucuaaugaauauuauaauuguuaacuucugaugggugcugacuuuuucaucuuugcaacacugcguagguauuuuuacucuccccauuuuacagaugagacaacugaggcucagaaagauugauuagcucuacacgaagccaggauccaggcuuagccuggcuccaggaaucauguuuugaguuacguagcuucccugauucugagggaccuccccacuucugaaaucuucuacuguuacuccccauggcccuuuccuauugaccggaggcaccccagcuccucacucgucccuuaucuuaugaaacaugaccaugaugucugaauucaaaggagagccugggcuuuguggggaaaacgaagcagaaaaagaaagguggagguuggugguuguuuuuggcauggugaggagccugucguugcuugaggaaagcaagaaaggagauugcuggggcuuggauccaucucugggugccugugggucugucuguaaaaaugagaacuggucgugcucauuagaggauuugaccguuaggccuugggauagcgauuugggaacuuuuuucugcuaagacaaagaauaauaugguucagguucauuuugcuccugcuuucccaagcccuacaucucuucugggcuuuuuuuuuuuuccuuuucucuccuucuucuucuucuucuucuucuucuucucauuuuuggaucuggacuucugcugacucaucucucugagcaaggaaggagggaggaagucagaauugcucauuaaccguuuucuuuagugacucagcugugauucacauuuuaauuaauggaggagaaaaaccugaucaguccuaaggcaucugcccaaucacgcauaacuccaggcuggugauaauaauaauacuugaaaaaagugggguguccugaauuaaacuauggcucauuccccacauuagucuugaggacuccaccaggcccucuaaguuccaggucucaauggggcucccugaaccagagcagcuaguccaagccccgagcagcauuucugcagaguuagucugaggucaggacaagaaacagaggcucaagcccuccugggaucgcaggaggaucaugggaauguaauauuguuuccugagcuggucuuuggcuauaaucccaggcucaagccuggccucccuccccucggggccugaaauuugucagagccuauugcaggggcagcuucugugcuuuuuguuugcccagagaaugagaaaaguccagauaaucaugaccgcuacuuccugagcacuuacuaugcaucagguggugugcucagcacuucucaugaaugaucacguugaauccucacucuguccacaaaaagaaagagcuuuuauauaauucuccaaccucccuaugaggaaacugaggcuuggcaauugcccaauguagacaauuaguaaauaaucaggcaggauauaaacccaacccuuucccaccugggagccagagcuugcaucuacuauacuucucugcuuuccagucagcugcaaagaaaaauuggaagcugauagcucauucaacaaacacuuauugaacccuuccaccugcucagcccuguucuagacaccagagauccaucagugaaccaaagaggcaaauccauggucucaugaaacugacaauuuaccugcccaaguguauuaguuacuguuuauaaguuccuauuaaguguauuagauaugcuugcagcuguaacaaagaaucccaacaugcauaagggcucaaaacaauaaaaauuucguucuugcacagauaaaguucaaaagguguauucuuuuuuuuuuuuucuuuugcgacggaguuuugcucuuauccuccaggcaugagugcaauggcccagucucggcucacugcaaccuccaccuccuggguucaagcauucuccugacucagccuccccaguagcuggaauuacaggugcccgccaccacaccuggcuaauuuuuuguauuuuuaguauaggugggguuucaccauguuggucaggcuggucuuaaacuccugaccucaggugacccaccugccucggccucccaaagugcugggauuacagccgugagccaccgugccuggccaaaaaaaaaauguauucuuaaacagcaggcaccucuccucuaagcaguaagucaggggcccaggcuuguuccauauuguagcuccucaucuucaacccauggcuuccaaagucuccaugcuucuugauaucaagccacagaagggaaaagagcaugagaagggcacaggagaaauguuucugggacagacccagaaguaguccauaugacuuccaucuaccucccacuggcuagagcuuacauggcggcacccacuugcagagcugggaaauggagucuaacugagcauccaggaaggagagacagacaugagucuuugcguggguccucacugagaaucaagcuccacauuuugaucgaugucaccagagcguacauggcggcgcccacuugcagagcugggaaacggagucuaacugagcauccaggaaggagagacagacaucagucucugcguggguccucacugagaaucaagcuucacauuuugaucugugucaccuccuugcaagcccuaccuuaggacaauuuuaagggacauuccuaucuucuuccacccuuaggacaguuuuaagggacacuccugaguucuuccacccaccuccucuguuucuugggcuuccagcucucaggauuugccuuugccuuacaauggggugaagcaagaaucuggaagaaugucucuccccacaauuugaagucuuauuugaaaaaaagcaguagagcaucccucccucuugagguagggaaaucuagaaucaaauccugcuucuccagacuuugaccucagaaacuggggggacuucaaggucuucaggugggcagcuuucaugaaccauucauuccucccaccucauaccaaucaggguccuaacaggaaaaagaauuaacuucuagaugguucaaaagaagaccaugccaugaagagacuccuuaaagagauaggaacaggugagagaaauagauaacggcuguuugagguccucagagagaagccaucgcgagcccuacauuuccuggaacccaguggaggcagagcugugcagaagggacuacugucagaaccagggagggagcagggaagcaauauuccaaucucuuucccuccccucaucuucugccagcgcuuccccucagccaaaccaaaccggaaacggagcaaagcauucugggaguuguagucuucaaggguccgccucgagggcacagagcccgcuggagcauugaccuagagggcacacagggaaugacuaguuugcaccaucaugugacggacugcacgcccucgauuauguaauccacucuauaauucaacugcagagcugcaugguacagcaggauagccacuagccacacgaggcuauuuaaauauaaauguacauucauuaaaauuuaaccaaaugaaaauuuuagccacugagccccauuucaaaugcucauuagccacacguggcucuuggcuaccauauuggacagaucagaauagaacauuuccaucaucccagaaaguucuaggggccggcgcagcugugguguaaccugagcccaugcauguuauggaauggagaagagagaaaacagcacaagaggcaguuuugaagggagacagagagcuguggaucaguagggaggagacucucuaggcaaaggagcaguugagaagcaagaaaguugagugagcugcuuugcugcgauggaggcuucccucacggggaagaguagagucagaaagcuuuaguucaaguucagcucugaaaugaaccaaugaguguucugacaagacaccuggccuuccggaaccuugguuuuguaguggccaagggcuugacccucugaagguucacugaaaaaaaucaacucacaaggcauauuaauuggagaaaaggcaggcagauuuauuuaauguguuugcacgagagccuucagaaugaagacccaaagcugcaggggaaauuguccguuuuuuaagcuuagguucaacaaaguauggacagcgguguagaaauaugauugaacaaaaaguguacaauguaaaugcuaauagacugaguggggaaacccaaaaagggcugucuugauucuccuuggucucucugagcaugcauuucuuccggguaugggacaagacccucucuggaauggagggggggcucucuugguucuccuuggucucucucagcaugcauuccuuccggguauggggcaggacccucucuggaauaagggggcugucuugauucuucuuggucucucagagcaugcauuccuucuggguauggggcaggacccucucuggaaugggauccuuauaaccuacggucaaauaacguaaguuagauaauuucuuuuuuuuuuuuuucuuuuuuuugagacagagucugauucuguugcccaggcuagaguacaguggcacaaucucggcucacugcagccucugccuucuggguucaaaugauucuccugccucagccucccaaguagcugggacuacagguaagcaccaccaugcccagcuaauuuuuguauuuuuuaguagagacaggguuucaccauguuggccaggcuggucucaaacugcugaccucaagugauccaccaccugggccucccaaaguccugggauuuguaaucccagcaugagccacugugcccagccagaucauuucuuuuucuuuuucuuuuucuuuucuuuuuuuuuuuuuuuuugagauggagucucacucuguugcccaggcuggagugcuguggugcaaacucagcucacugcagccucugccuccuggguucaagcaauucuccugccucagccuuccaaguagcugggacuagaggugcgcgccaccaugcccagcuaauuuuuguauuuuuaguagagacaguguuuugccauguuggccaggcuggucuuaaacuccugaccucaagugauccacccacgucggccucccaaagucccgggauuuguaaucccagcaugagcuaccacagcuggccagauaauuuuuuuauaacuaguuuuuacaaagaaagguggagggaaaguuagaguaacauuuuuagguguuagggcugacuuuggggaaaagaggucugguuucuacgacccgccuuagggaagagggauucuaguuuuuguggcuagccccaggggagaaugggacuaagagauagaagggcaggagaaggucagagaaaaacuuuugcuucuguggcugcuucggagaacuucauuuugggguauuguuuucugagccccaacaguuugcuuaucagugaaguggguauaggcgcccaccucccacagugacgaugcugugaacagggcuuuggaagaguagaacuaugaaauauuuguuguugccuuguggggaaauggucguuaaagccaaaauuguucaagagaagaagcaggaagaguuccuuucuuuccugcagguauccucuuaagcugagucuucagaauccccugacaacguuuaaucaacacuuuauuaaauucaccccaacccugcuucaaaccuucaccugguccucgagaucuuccaacuguuucuugaugaaguuagcaggcaauuguauggcgggaucaucaucucauguuuuguuuuguuuuuuuccuuuuuacccucugacuuugagaaauccuuguccuuuuacuuuuccaaaccugagagcauugcagagaaguuagaauugagcaggacaugggcuuaagacccagcccagccaugugcuagcugugugaacucgaagcagugaccccaccucucugaccuggaaaguagagggaaugauaggacccaccaccgccacacuuguagggucaucauggggauugaauaaaauaaugcauaagacuuggcccacagcaagcacucaagaaauguuagcuacuuccuaaauauauuuuuaaccuuuuauugaauauaacauacauacagaaaagcacauguaucauacaaguagagcuugagugauuuucaaaaacugagcccagucauguaaccagcgccuaguucaagaaacagaacauagccgagugaggcugaggcaggagaaucacuugaaucugggaggcagagguugcagugagcagagaucaugcuaucgcuccccagcgugggcaaugggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaagguaaagaaagaaaaggaaagaaagagaaagaaagaaaagaggaagacagagaaagaaagagaaagcuaaagaaagaaaaaaaggaaggaaggaaaauagggagggaagaggaggaggaagaagaagaagaagggggggagggagggaacagcugcagcuucgaggaaggaaggagggagggaaggaaggaaggaaaggaaggaaggaaaaaaaaacagcaccaacguuuagaaacccccuugugccucugaggucaccaguaacuccauccugacuucaaacagucuagauuaguuuugcuuguuuuugaacuuuaagcacauggggucauacagcaugcaugcauugacuucuuucccuugacguuguaugugugagauucaucugugcuguugcuguucauuuguucucaucgcugugugugcugaaccaccuguucauuuacucuacuaauggugggcaguuuggugcuuucuacuuuggggcuauuccagagaaagcuacuuugaacacacucagauaugucugugggugaccacucuucauauuucuaugggagauauuccuaggaccggaacaucugagucagagggaggaauugguuuagcuuugguaggaacugccuaacaauuggccgggcacaguggcucaugccuguaaucccagcacuuugggaggcugaggggggcaaaucacuugagcucaggaguucgagaccagccuggccaauguggcaaaaccccuggccaacauggcaaaaccccgucuccgcaaaaaaauacaaagauuagccgagcaugguggcgugugccuguaaucucagcuacucaggaaacugaggcaggagaauugcuugaaccugggaggcagagguugcagugagcagagauugcacuacuguacuccagccuggguggcagaauacaugaaacuccaucucaaaaagaagaaaggaaggaaggaagggaaggaaggaaaggaaacugcccaacaguuuucccaaguguuugggauggaaggaaggaaggaaggaaggaaaagaaacugccuaacaguuuucccaagugguuggaccaguuaaaacucccaccaccugugaaugagaguuuguuuuuauuuugcuccuggagugccucuccuguagcagguucccacugaaugucugggaauucaaauguaaugcacuuguucauuuccucaagagcuucacuccaucaauuggauucauccauuggcucucccaucuccacugacacuauguucucaccucuauuuggaagacauccugccuccaccugcccaagucacauuaucuucucauuccagccucucaaggagaguuuucucuuucaccaccuccucuagcccuggugauuggcaaggucucgcaacaguacccuucaaaacacucaugacugugaaugcacuggccuucacuaaguuucccauucuucucuuucuuucuuuuuucuuuucuuuucuuuuuuuuugaacagaguuucacucuuguugaccaggcucgagugcaguggcacaaacacagcucacuguagccucaaccuccugagcucaagguaucguccugccucagccuccuuaguagcugggaccacagacaugcaacguugugcccagcugauuuucuuuuuuuucuuuuuuuuuuuuuuuuugagacauggucucacccugucaaccaagugcaguagcaugaucacagcucacugcagccuugaccucccgggcucaugcgauucucccaccucagccucccgaguagcuggggcuacaggcacaagccaccaugccuggcuaauuuuuguacuucuuguagagaccagguuucaccauguugcccaggcuggucuugaacucuugggcucaagcaguccuccugccucagccucccaaaaugcugggauuacaggugugagccagcacgcccggccauggcuaauuucuucauuuuugguaaagacaggucucacuuuguugccuaggcuggucuugaacuccuggacucaagcaauccuccugucucagccucccaaagugcuaggacuaccgaugugagccaccgcacccggcaauuuccccuucuugacuucuccagagcucucaucccucucgagcuccugucucuucuagaaucacuuaccucaccaccuuaugggguuuuugccucuguuccuacuccucuuuauuuaagaaaacacuguacuuuaagagggcuucagaaaccacccgaaauagaaacauguccuuuuguucaauccuuuacuuuaaaagacaaauaaaaugaagaauugcucuccauguagaagguuaaggagcuugggaggaccuucugugaguggggagaacuuuacauuaaaggaaaaaaaaugcuggagaauagcugugaacccaggaagggagaaggacuuccuccacugaacuuguaaagcacaaacucuaaggcaaaaaaagacaugauuacaugaaaacuaagauauuuguucaaauaaagaugcaauuggggccaggugcgguggcucacgccuguaaucccagcacuuugggaggccgaggcaggcgaaucacgaggucaggagaucgagaccaucuuggucaacauggugaaaccccaucucuacuaaaauacaaaaaauuagccaggaauggugucacgugccuguaaucccagcuacuugggaggcuuaggcaggggaauugcuugaaccagggagguggagguugcagugagcugaaaucacgccacugcacuccagucuagcgacaaagcaagacuccguccaaaaaaaaaagaugcaauagcaggugguucgggaaccaaaccuuacauccagaugcugguugucccauuuccugugaauccuugggugaguuaucaaccucucugagccucaguuuccucgucaauaaaauggagaaaauaguaucuaccuauggaauuguugugaguuuugaaugaguuaauauuuauaaaucauuuagaauaggaauuagcacaugguaaauaguggauagaaucauaaaaaaaaaauugaucagggguuaacuucuaacugcuguuuguuauagaggucccuagcacuguguggucauuuuaaauuuagaugauuuagaauuaaaugaaauuuaaaacucaguucuucauucacacuagccacauuuuaagugcucaaaacccacaggugacuaguggcuaccauauuuggcagcacagauugagaacagauuuaucauccagaaaguucugucagacaguguugaucaaggcuacaugagggucugggugcaguggcucacaccuguaaucccagugcuuuggaaggccaaggugggaggaucacuggaggccagggguuugagaccagccugggaaacagagagaccucaucucuaccaacauuuuaagaauuagccaggcaaaguguugcaugccuguagucccagcuacucaggaggcugagacaggauugcuugagcccaggaauuugaggcugcagugaacuaugagcgcaccgcugcacuccagucugggugacagagugagaccugucucuaaacauaaaaaauaaaaauguagguggggcauaguggcucccgccuguaaucccagcacuuugggaagccgagaugggcagauugugaggucaggagaucgagaccacccuggcuaacaugguaaaaccgcguccguacuaaaaauaaaaaaaaauuagccaggcaugguggcgcaugccuguagucccagcuacucgagaggcugaggcaggagaauugcuugaaccugggaagcagagguugcagugagcugagauugcgccacugcacuccggccugggcgacagagcgagacucugucucaaaauaaauaaauaaauaaauaauaauaaaguaaaaauaaaaaugcaaagacuaccugagggaaugucugcaagucaaccagaauaacacagcaaccccaauaggaaaacaggccgaaaaugugaacaggcggaucagggaagugaagucugaaaagcuaaucagccuaugacaugguacucaaagucauuuguaaccagaaagauggaaaugaaagcaguaucucuguacaccuuuaauauuggggaaaaaauaugugaauaagccaaggguuuccagcgaugcgggcacagaggaaagucuugcaccacucaaagggguguggcccagggaggccacucuggagacauaucgguaguacucaguccagugagguccagcaccaucagcgcuuauguccccaggcauccaucccagggacauucuuaccaggucuguuaggggcagguacgagaaugcuuacuccagcaccaucuauauaaggggagcugaaggccaccuggugucccuccuggagaccaggaggcggcaugugacagcggcacccauggagcaccagaaugagugagagcuccagaccgcauauccgacagauacuacgggauggggcuuuuagaaauaugguuguugccgggcacgguggcucaugcgugucaucccagcacucuggcaggccaaggcggguggaucaccugaggucaggaguucgagaccagccuggccaacauggugaaacccugucucuauuaaagauacaaaaauuagcuggacgugguggcgggugccuguaaucccaacuacucgggaggcugaggcaagagaaucgcuugaacccaggaggcagagguugcagugagccgacaucgugccacugcacuccagccugggugacaagagcaaaacucugucucaaaaaauuuaaaaaacaaaaaauaaaaauaugguucugggugaaaacaggaaacaacagaaugugucuaacuucauccugcuuaugucaguuaaaaauagacacacucaaaauaucgcacguguuuuugcgagaaugcacuccuauaaggccaaauuaaacauucucucaguugucucugggagggagaagaaugaaaguaggguauagagagauauaggggaauuaaugcaugaaugaaugaagguauaaacaagagacaggcgucauacagaccaaagguaaagauaucccguaaccugaggagagcaaagaacuugacucugcauuugaagauucagaaaaugaauuucagaaauaguuuucucgccaggggguggcucacgccuguaaccccaccacuuugcgagggcgaggcagguggaucacuuaaggucaggaguucgagaccagccuggccaacaugaugaaacccugucucuacuaaaaauacaaaaauuagccaggcaugguggcaugugccuguaaucccagcuacucaggaggcugaggcaggaaaaucacuugaacccgggaggcagagguugcauugagcugagaucacaccauugcacuccagccugggugacagagcaagacuuugucucaaaaaaaaaaaaaaaaaaaaaaaaaaaagaagaggaagaaaucguuuuuucaagaaggggaaagcugggugauuuaagaaugaacuugaagaggaucacucaguccucaaccuaggaguggcaagaauauagacuguaugggaagugguucugcuccuugguacccaucuuagaaauauuuggccugagucuguaagaggcagguacuuuaucuaaccugagguuagggggccacuacauccccauccccuccccugcuuucuaaccaugcuaacaucuucucacucuccugucuccucuccuucucacuccccuaaucugccuauucacauuuugggccuguuuuccuauugggguugcuguguuauucucacugauuugcagacauuccucugugucaucuuuuuaauuuuguuuuaauuuuuagaggcaggaugucauucuguugcacuggcuguagugacguagcucacugcagccucaaacucuugggcucaaacuccuguccucugccuccacuucucaacugguaaccucacuucucuucaugaggucucuccagccccagggccuuugcacauguuccccucucuucugaguggcauaugguaguugcuccucuguaaauauuuauugacauccugacuuccaaccagcagagaauugaccuccuucccaugcucaggcuagugaaggcaugaguuuggcugaggucccaguggggaaggugagugggguggcagaguuaaccaggagcagcaugguagaauggguaaaaccagacguagcacgcaggcaccacauguuagcuggacaaguaguuuaaccccaugggucucaauuuccccaucaaugaaagggagaauagaacaagucccugguaagcagcauaaaaugagcucucagaauguaaaguaacaagcacacaaccuggaagagaauacauuuagugaauauuggcuccuuuaaucagcagguucugauaugacuuagcuacaauuaagaaaauaaaaauggaggccgggcgcaguggcucaugccuguaaucccagcacuuugggaggccaagacgggugggguggaucaccugaggucaggaguuugagaacaggcuggccaacauggugaaccccaucucuacuaaaaauacaaaaauuagccaggcgugguggcgcacgccuguagucccagcuacucgggaggcugaggcaggagaaacauuugaacccaggagguggaaguugcagugagcccagauugcaccacugaacuccagccugggcgacagagugagauuugucucaaaaacaaaagaagucuggaggccaggagguugguugcaggguugguuccuuggcucaacaaugucuccaaagaguccuuccaucuuuccacucuaacaucgucacuguaaggacuuuuuuuaacauuuaccacucacagccccaagacgacugcgucaguucuuucuuuuuuuccuucagacagagucccgcucugucgcccaggcuggagugcaguggcaugaucucggcucacugcaaccucugccuccuggguucaagcgauucuccugucucagccucccgaguagcugggauuacaggugccugccacugcauccggcuaauuuuuuguauuuuuuuuaguagagauaggguuucaccauauuggucaggcuggucucaaacuccugaccucaggugaugcaccugccucggccucccaaagggcugggauuacaggcgugagccacugugcccggccgaugacugccucaguucuaagguacuuacccagccauccacguagacagacacaaaagcauccggccaaagaagagggagaggaagggcugucucuuaccaugugacucaucucacggggaaaaaauccuuuuccagaagcacccagcagauuuuucacccagauccuguuaggccuacgaaugggucaugugacaagugcucuuauugcaaggaaucuugggaaaaagagacuauuaggcauuuucugccucuuugaugggaggugggcucugccaguaaggcggguaguggugguggcucuuggauggacaacugugucuuccauucuucuucuucuuuuuuuuuuuuuuuuaagagacaaggucucacucuguugcccaggcagaaaugcaguggcacaaucacagcucacugcugccucgaccugccaggcucaggugauccgcccaccuuagccucacgagcagcuggaggaguguaccaccauggccggcuaauuuuuauauuuuuuguagagauggggucucuuuauguugcccaggcuggucuugaacuccugagcucaaacaauccuccugccucagccucccaaagugcugggauuacaggcauaagccaccacgccuggacucucuucuuuaaauacugagccuuccaccucuucuagaauauacucuguuaauuaucaaccacacuuuucuacauuuuugcuucauuauucauucaguaaacauuuauugagugccuacuguaugccaggcacagcuuuaggugcuggagaugcuaugaacaaaacagaugaaaauuucuaaaaaauaaaauaaaaaauaaaaauaaauuuugcaaagccaggcacaguggcuuaggccuauaguuccaccuacucaggaguccaaggcaguaggaucucaugagacugggaguuugaguccagccugggcagcauacuaggacucugucucuaaaaaagaaaagaaggccgggcgcaguggcucacgccuguaaucccagcacuuugggaggccgaggcaggugaaucgcaaggucaggaguuugagaucagccugaccaacauggugaaaccccgucucuacuaaaaauguaaaaauuagccaggcaugguggcaagugccuguaaucccagcuacuugggaggcugaggcaggagaaucgcuugaaccugggaagcggaggaugcaauaagccgagaucgugccacugcacuccagccugggcaacagaaugagacccugucucaaaaaaaaaaaaaaaaagaaagaaagaauagaaaauaucugcccuacggggauggacaugcuagaacaucaaaguccaauggaacuuucugcacugaugaaguauguauguaugcaccagccacauguggcuugggagcacuuaaaacgugacugguacaagcgaauuuuucauuuaauuuaaaugaauuuaaaucuguauuuaaauagccauguguggcuagugguuacuuuauugggcggugcagcucucuaaaggccaagagauacaucaucaacuucucucccuugacccauauucaguucucucccacccugaaaaucuccucuccuacccaggcucacauuuccaguucuucuccucuuguucucccucaaccaucagcccccgcaagacugacgugacccugaugccguaugaaaugcauucuucauccuuuacucuuacucaccucugugcggcccuggagaccagugaccucuccuuucucaaaauacuuuauuucuguguguuuuuguuguugcuauuguuuuugggggguuuucuugagauggaguuucacucucaucaccuaggcuggagugcaguggugcgaucucagcuuacugcaaccucugccucccagguucaagcgauucuccugccucagccucccaaguagcugggauuacaggcucccgccaccacggcuggcuaauuuucuuguauuuuugguagagacggaguuuugccauguuggccaggcugaucucgaacuccuaaccucaggggauccaccugccucggccuuucaaagugcugagauuacaggcaugagccaccgcacccagccucaaaaugcuuuugaacuugacugucagguaugccauucuccacaccagucuccucccaugucugugucuucucccucuccacuggggacccuuggcuuuuuccacuucacucaucuacccuggguuaucuggucuuccauaacccuguccucugccacaccucacuuauucacccaccacaauauuuauugaguacucacuaggccaugaaagaugcuauacaaaaaaagccccuguccucguggagcugacauucuagaagaaagcaugaauaauaaauacgacuuaauaaacaguacggccaggcaugguggcucacgccuaucauccaaacacuaagagaccaagaugagaggaucacuugaauccaggaguuugagaccaccuugggaaacguacugggacccugucucuacaaaaaaaauauuaaaaauuagcuggauaggguaaugcaugccuguaguuccagcuacuugggaggacaagguggaaggauugcuugagccugagaggucaaguccgcagugagcugugacugugcacugcacgccagccugggugacagagugagauccugucuuaaaaauaaauaaauaaacaaacaaacaaacaauauaauuccagagagugaagaggcaggaucucuuuagcuaggaaguugagggauguucucucugagaaggcagaaucugaguuucaaccugaagaauucgaagaggccagcuaggcaaaagaugagaguugaaggaauggggacggcagaggagacagccaauauaguaauucucaauaaagcagaaagugagcuuuuccugcuggcagaacagaaaggaagucggaguggccaggguguugugggacaagguggucagcaggagucacaucacgcaaggucauguggucaugguagacuuuaaauuuuacuccaagccugauggaagccauuggaagauuuuaacuaaggagugacggaaaacuggcaucucaaacucaacaugucuacaacccaguucuugaucuuugaaaccuucuuccuccaucuuccccaucuccauugacagcaacuucauccuucaguuagcucaggccaaaacccuggagucacccuugauaccucucuccugcuccacacucagucuuuccauuggaagcccuaggggcugccauauuguucuccauagcacuucacaccgucugacauacuauaucuuuucccacuauugcuuuguccuugguagcaucuuuaggcacucucugaauaucuggcacauaguacgugcucacuaaauccuuguugaauaaaugaaugaacaucacuccgugguccuuucagaaccagagccauucuucucuuucuucaccaccguugccccucaccccgcccaacuagucacaggaguugaaggaugacacaguagagaacugggauucuggaguccuguggcuggucugggguucgaguucuuacucagugguaggaaccuccaugugggauuaacuuaucuggucuuuaguuuccuccucuguaaaaugggccucaaacugccaaccgcugggaugcagggaggauuugaugagcccaggcaggcucccuggagcacagcaaucaauggcagcuauauauaaaccggggccucuuuuguacucccacugccuuuguccuaguuccagcccucauuacaccagccugcucuugcggcucccuccuaacuucugcuccaucaccaccaaucuguccuuucagcugucaggcuugucuucugaacgccaacccuaaucacaucccuuccugcuccaaaaccuuacaugacucucacuguccacaggacaagacccagccucuaguugacagccuccacuguccagcuuacccaaccucuccccuaccacauacccugaguggagccuucugccuccauagggcuuucuuagccagagaagccucccuuaucuuccuguucuccuccuaauuccuucuuauccuuccagggaggaggcugugagguaaugcaucuugggagccagcugggauugcacaggguggugagauuaucugcauuuccgaggcuugaacaaguuaaggcaaugggaaaggucacacaaugagaaaaugcagggccaggauuuaacccgucugagauguucugacugugcuaugcugccuccccggacaugagcucugcgauaaugcuguccccaggcuguaaucauucccucuuucaucccugccuccucuaucccuggggucagagggacuuguaguugaaucucucacucacucauugguguggucucucccuaaagcaggguggaguuugucuuagcguuaucacugcauccagcacaaccucccugguccaggcuuaucagcguucaacugcgucaaugcaguugccuccuccucaaucucccagcuuccggccuugcccccuagagagaucauauuuuaauacaagucagauuacaucccuccuccccucagaacccuccauggcucacaccuuacucagagaaaaagccaaaguccucuccacaacccacaaagcccugcaccauccaucaccucacugccuucguccccucacacccucccccuugcucgcucugcuucagccacaccaacucaucucuguuucucaaauacaccaggcauggccuagcuauuaaaugcacgguccagccuggugcauuugaagaacacggaugaauugguguggcuggaacagagugagugagggggagagcgggaggaggaccuuugcaccagcuggaccuuugcaccggcuguuccauuugccuagaguuuucccugacauauucauauggcucacucucuugcuucccuugcuuucucccagucuuuauucaaaugucuauuucucugcacuugugcuguuugauacagucaccgcuggccacauguggccuuugagcacuucaguugaaacacaugaaaguguagaauauugaccagauuccaaggaaaaccaugugcaaaauaucuuuuaucucuuaagauacagggucucgcucugucuuccagccuggaaugcaguggcacgaucacagcucacugcagccucaaaaucccaaacucaagugguccucccaccaacagccucccgaguagcugggauuacaggcacacaccacaaugccccgcccauuuuuuuaauuguuauuauuuuuuuuaauagcgacaaggucuugccauguugcucaggcuggucuggaacuccuggccucaagcgauccuccugccucagccucccgaguagcugagauuacaggcaggagcuuuugugcccagcaggucuacgaucuucuuagaaugcuucaggcugggcauaguggcucaugccucaaauaccagcacuuugggaggccaaagcaggcagauugcuugagcucaggaguucgagaccagccugggcaauaugguaaaacccugucucuccaaaaaaaauacaaaaauuagcugggcuugguggcucccaccuguagucccagcuacuuaggaggcugaggaaggaagaucaccugagcccaggaggcggagguugcagugagccaagauugagccacugcacuccagccuagacaacagggagacccugucucaaaauaaauaaauaaauaaauaaauaaauaaauaaauaaauaaacaaacaaacaaacaaaccaauaaaugaauuuuaccuguuucuuuuuacuuuuuuaauguggcuacuagcaaauuuuaauuuuuuuuuuuuuuuuuuuuuuuuuugagacagagucacgcucugucacccaggcuggagugcaguggugugaucuuggcucacugcaaccuccaccucauggguucaagcaguucgccugccucugccucugaguagcugggauuacagaugcccaccgccacgcccagcuaauuuuuugcauuuuuaguagagauggaguuucgccauguuggccaggcuggucucgaacuccuggccucaagugaucugccugcgucggccucccaaagugcugggauuacaggcaugagccaccgcgccuggcuauaaaauuucauaaguagcucuuaauagauuucuccugggcagugcuggucuaaacacuuuuuuuuuuuuuuuuuuuuuuugagacggcaucuugcucugucaccaggcuggagugcaguggcgcgaucucugcucacugcauccucugucacccggguucaagcuauucuccugccuuagccucccaaguagcugggacuacagacacccgccaccacgcccagcuaauuuuuguauuuuuaguagagacggguuuucaccauauuggccaggcuggucucgaacuccugaccuugugauccgccagccuuggccucccaaagugcugggauuacaggcaugagccaccgcaccuggcuauaaaauuucauaaguagcucuuaauagauuucuccugggcagugcuggucuaaacacuuuuuuuuuuuuuuuuuuuuuuugagacggcaucuugcucugucaccaggcuggagugcaguggcgcgaucucugcucacugcauccucugucacccggguucaagcuauucuccugccuuagccucccaaguagcugggacuacagacacccgccaccacgcccagcuaauuuuuguauuuuuaguagagacggguuuucaccauauuggccaggcuggucucgaacuccugaccuugugauccgccagccuuggccucccaaaguguugggauuacaggugugagccaccgcgcccggcccuguaacacuuuuaacacugaacuguuugccuuccaggugguaaagagcaggugccuuuacugauagaaaugucaccacucccuucaucccgccagccccaugucacugacgcguccuuuccccuugcucugugguaacuuucuccuaagcacucaucgcccuaacaucugucauacagguauaccucagagacacugcugguuugguuccaggucgccauaacaaagcgaauauugcaauaaagggagucgugccuuuuuugguuucccagugcacauaaaaguuaugcuuacacuauagucuguuaagugcaugauagcauuaugucuaaaaaaaaauguacauaccuuaauuuuaaaauccaucaaggcugagcacaguggcuuguaaucccaacacuuugggaggccaaggcaggaggauugcuugagcccagggauuugaaaccaggcaacaaagugagaccccguuucuacaaaaaaauucuuuuuaaaaauagcuggguauggugacgcaugccuguggucccagcuacaugagaggcugaggugggaggcucacuugagccugagagauugagacugcagugagcugugaucacaccacugcacucuagccugggggacagagugagaccguaucucucaacaaaaauuaaaaaaaaaaaaaaaaaaggcugggcacaguggcucaugccuguaaucccaacaguuugugaggccaagguggguggaucacuugaggucaggaguucaaaaccagcccagccaacauggugaaaccccgucucuaugaaaaauacaaaaaaauagccgggugugguggugcacaccuauaagcccagcuacucgggaggcugaggcacgagaauugcuugaaccugggaggcgggggggagauugcagugagccgagauugcacugcugcacuccagccugggugacagacugagacucugucucaaaaaauaaauaaauaaauaaauaaauaaauaaauguuuuauuacuaaaaaaguuaacaaucaucugagccuucagugaguccucaucuugcuggugaagggucacuggcucaguguugaugggugcugacugaucgugggggugguugcugaagauuggggugccugugacauuuucuuaaaauaagacaagaaaguuuuccgcauccaucgacucuuccuuucacgaaagauuucucuagcaugagaugcuuguugacagcaauuuuacccacaguagaacuuuuuucaaaauuggagucaguucuuucaaacccugccacugcuuugucaacuaaguuuaugucauauucuaaaucucauguugucauuuuaacaguguucacagaauuuucaccaggaguagaauccaucucaagaaaucacuuucuuugcucuuccauaacaaguaacgccucaugcauugaaguuugaucaugaggcugcagcaauucagucacaucuucaggcuccacuucuaacucuaguucucuugcuaguuccaucacuucugcagugucuuccuccagugaagucuugaacuccucaaagucauccaugaggaucggaauugacuuccucaaaauuccuauuaauguugauauuuugaccuguucccacgaaucacaaauguucuuuuuguuguuuguuuguuguggauuguuuuuuuauuuuuaauugaguugaggucucacuauguugcccagacuggucuugaacucuuggccucaagugauccuccugccuugaucucccuaagugcugggauuacaggcaugagccacuggaacagccacaaauguuccuaaugguaucuagaauggugaaugcuuuucagaaaguuuucaauuuccuuugcccagaugcaucaaaggaauuuaucuauggcagcuauagccuuaugaaauguaucccuuaaaucauaagacuugaaauagagaauuacuucuugauccaugggcuacagaaugaauguuguggcugggcaugguggcucacaccuguaaucccagcacuuugggaggcugaggcagguggguaacuugaggucaggaguucaagaccagccuggucaauauggugaaaccccaucacuacuaaaaauacaaaaauuagcugggcaugguggcguaugacuguaaucccagccacuugggaggcugaggcaggagaauugcuugaacccucuugaagacagagguugcagugagccaagaucacaccacugcagcgacagagugagacucugucucaaaaaaaaaaaaaaauguuguguuagaagucauaaaaacaacauucaucuucuuguacaugcccauuagagguccuggauaaccagugcauugucagcaguaauauuuugaaagaaaucuuuuuucuggcuggguacaguggcucgcaccuguaaucccaccacuuugggaggccgaggcguguggaucaccugaggucgggaguucaagaccagccuggccaacauggugaaaccccaacucuacuaaaaauacaaaaaaauuagccaggcaugguagcaggugccuguaaucccagcuacccuggaggcugaggcaggagaaucgcuugaaccugggagucagagguugcagugagcugaggucgugccauugcacuccagccugggcaacaagagugcgacuucaucuaaaauacauauauauauauaacauguuauauguaauauaaauuauauauauaacauauauguaauauaaauuauauaucacauauaacauauaucauguguuauauauaucacauauaacauauguguuauauaucacauauaacauguguuauauaucacacauaacauauauuauguguauauaugucacauauauuauguguuauauaugucacauauaacauauuguguuauauauaucauauauaacauauauuauguguaguguaucauauguaacauauauuauguguaguguaucauauauaacauauauuauguguaguguaucauauauaacauauguguaguguguuauauauaacauauauuauguguuauauaucucauauguuauauauaacauauauuauguguuauauauuauauauauauuuuuuucugaguagaucucaacagugggcuuaaaauaucaguuauccaugcuauaaacagacgggcugucauucagucuucauuguuccauuuauagagcacaggcagaguagauucagcauaauucuuaagaccuuaggacuuuaggaaugguaagugagcauugguuucaacuuaaagucaccaggagcacuagcuccuaacaagagagucagccuguccuuugaagcuuugaagccaggcauugacuucuccucucuagcuaugaaaguccuagauggcaacuucuuccaauagggcauuucaucuacauuaaaaaucuauuauucaguguugccagcuucauuaauaaucucagcuagaucuucuggauaacuuacugcagcuucuccaucagcacuuaucacuucaccuugcacuuuuauauuauggggacaccuucuuuccuuaaaccucaugaaccaagaucuucuagcuucagauuuuucuucugcacuuccccaccucucucagucuugcugugggcuugcuguggauuaggcuuuggcuuaagggaauguuguggcugguuugaucuucuauccagaccacuaaaacuuucuccaugucagcaagaagccugucuuacuuucuuaucauucauguguuuacuagaguagcccuuuuaauuuccuucaguaauuuuuccuuugcauucacaacuuggcuaaccucuagcuuauggccuuuuguuuguuuguuuguuuuguuuuugagacagggucucacuccguugcccaggcuggagugcaguggugcaaucaccgcucacugcagccuugacuuccugggaccaagugauccucccaccucagccuccuaaguagcugagaccacaggugugcaccaccacacccagcuaauuuuuuuauuuucuguagagauagggucucccuauuuugcccaagcuagucucaaacuccuaggcucaagccauccucucaccucagccucccaaaaugcucggauuacaggcaugagccaccaucccuggcccuaucucagcuuuugacacgccuuccucacuguguuuaaucauuucuagcuuuuaauuuaaagugagagacgugcaacucuucuuuucacuugagcacuuaaaggccauuguacaguuauacacugaccuaauuucaauauuguuaugucucggggaauaggaaggcccaaggaaagcgggagagauggggaaauggccaguugguagagcagucagaacacacacaauauuuaucgaucaaguuugccaucuucuauggaugugguucguggcacccccaaacaaugacuauagucacaucaaagaucacugaucacagaccaccauaacagauguaauaauuauguaaaaguuugaaauaccguaagaauuaccagagugugacacagagacgcaaagugagcacacgcuguuggaaaaaaaauggcccugauagaccuccuugacacaggguugccacaaaucuucaauuuguaagaaacacaauaucuacaaauugcaauaaagcaaagcacaaugaaaugaagucuuccucggccggugugguggcucacguccauaaucccagcacuuugggaggccaaggcaagaggaucccuugagcccaggaguuggaggccagccugggcaacacagggagacuccaucucuagaacaaaacaaaacaaagccugcuuauauuuauuggguuuacucucagucucccccacacagagauagggccuggcuuguuauuagugcucaguugauguuugugaagugaaauacuaaggacuuaaccacugccuguucuuugcuguucaugcccugacagcuuuuaugugccagcacagaagaaaacaaggugcaagaagagaauagugaucucuaagucagaauuugaggaacccaaauuaguaccagaaagcugggaggagaagagaaaaauaaaguaaaucaaauuaaaaguugaaugggccaagugcaguagcucauaccuauaaucccagcacuuugggaggcugaggugagaggaucacuugaggccaggaguucuagaccagccugggcaauauagcaagaccccaucucuacaaaaaaaauuuuuuaauuuucugaauauguuguuguacaccuguagucccagcugcuuaggaggcagaggugggaggaucgcuugagcccaggagguugaggcugcagugagcuguuguugcaccacuauacucaagccugggugacagaauaagucccugucuccaaaaauaaaaauaaauaaauucauuuuuuguaaaguuguaugucauggccccugccuacucuggcuucaugacuugcugcuugaaccucaccauccaaaucccaguggugacaccaugucauuucuugaauuugccaagcccucuuucagucccaagcucucugucauggccacucucagccuggaaaguucuuuccccacuggccagauuucucccccucaucuaugggaacuugacuugaaguaggggguaucccaggcccuggacuaguuaacacgaccugcugugugccccucaaagccauugucuuccuagcugagaaggcaucacaccugcaacagauucacucauugugugcauguuuuucuuaaccacuucucuucugcaucagcuccauggggcagggauagucucauaugucacucuacccagcacauaggauacgcucagacgcccacuuguggaugguggaaaaggucagcccaaccuaauaugcccaucucuccucuagggguaaucuugagaaaaaaaguugggaacuugcuuuguguuaguuuaggaugacccagaauagauccugaaacaagaauuuagggcaauccuugugcaaguaguucaucugagaggugaccccagaaggguuggagaaggagaggggagguggggcaaggaagggugaguuguccuguaggcaacugagcuccguccuacugggagcccacguggaacucaccucuuaagugauccagaaugaagggugagggagcugcgguauugauccaccaacucccagcaaucuuugguugagggcugcucccuuaaaguucauucccugggccugccccagauuuggagacagcccuaaggcaagagguacagauaccaguuggccacagacugaaguguuaagacccaagccccuggauaaaacugaaaaaucaagccagauguggugguucccaccuguaaucccagcuacucaguaggcuaaggcaggaggauugcuugagcccaggaguucaaugcuguagcgagcuaugauugcaccacugcauuccagccugggcaucagagcaagaccccaugucuaaaauaaaaauaaacugaaaaauccccaaguuauuugcugugaccaaccuuccauuaaccacagacccucugguauucagcauuucuuguccauuauaugaaguucugaugacagucucuuuuauuguauugugccuugaccacgcacuguacaucacuuagcucugaaauggacauguucaggaaacagggccaggugggacccuguguuucaacagcaauacuuuuacaaaugaggucucaugacagggucuugcucggaggguuucuauggaagccucaucccaccuacugcuaucauccuuacuaacuugcauuuacaaaagggacucuuuuugaccagaggcuuggggucuguagcugccuucuagccagcugaugcuggcugguccacacaagcaggaucacacccauuuuuuuguuuucuuauuuauuucugaauagguuagcauaccgguaaccugugugccuggcauugugcugaccacuuuuugucaacuuacugaauccucacaacccuuggagguauugauacuauuguuauccagguuauacaaaagggggaaacugaggcacagagcagggaugucccuugcccaagguuacccaacuggaaaguggcagaucugggaucugaacccaugcaggcugggcucuuaacacugaacuacuuuccugccauuuguuaaagagccacaaaccaggccaggcaccauggcucacgccuguaaucccagcacuuugggaggccgaggcggguggaucaccugaggucaggaguucaagaccagccuggccaacauggugaaacccugucucuacaaaaauacaaaaaaaaguacccgggcaugauggcgggugcguaguaaucccagcuacucgggaggcugaggcaggagaaucccuugaacccgggaggcagagguugcagugagcugagaucacaccauuggagaucgcacuccagccugggcaacagagugagacucugucucaaaaaaauaaaauaaaauaaaauaaagagccacaaaccccgaaaggucugccauucccccagggccccaggccaccccacaaucuauugucauuguagguugugaaauauacugaaugucaccccaaccuugagccauggggaagauuccauuucucucauugcaacauuugugcaacaugaaccaucuguugggggucuucguaaaucaccuuuuaucccgugaggcagguacuguuaagaccauuuuacaggugacaaaacugaggccaguggugucgagucaccugccuguggucacccaaccaauacaggacagcuuggaaucccaagcacccccgcccugcugucugacccccaaaacccacccucuguucuccauucuggcuucuuucuuucagcaucuuggcgacaguugggacggaguuugaccuacggacgcugagggcaguucgagugcugcggccgcucaagcuggugucuggaaucccaagugcgugaguuuccgacccugacaagggguuugcucacgggccccaggagcccucaguuuccccuaugcagagcaucucaggaggccacauccugccaccagccugugugagggcagucucuucuuugggacucccuauagggaacccccuaggaauaugacuguagcuccccaugagcuccugaaagcaaacuaggagccacacccauuuauugagcaccuacugucuaucgggagccaugcuaagcaccacgugugaucucauucaguacucacagcccuaugaaguugauaggacugaugucucuauuuuauggagggggaaacugaggcucagaguggcugaaacauuggagcaggguuuuguggcugagaaguggcagaacuaggagugagcaagugugacuccaagccugggccguaccacugguggcaaugaccauucccauuuaaugagugccugcugcgugcagggcacuacagaaggacuuuacaugaauuaccuuauuucauccucacagucacccagcgaacacccauuuuacagaugagacgguugaggcuuaaggagguuaaauuacucaccugaauucuuagaguggacaguaaugagcucuaaaauucauacucauuccuugcugcuuucucauucuccacagauacaucuaguccccguuuaaggguggcugccauaugcagggucaagauuaaguguagguugagccaaaaaaaaauguaaaaagcaaaaauaaaacagggcuguccuuuuucuaucuucuugucuugguuaauaauaauaauuuagccaggcaugguggcucaugccuguaauuccagcacuuugggaggaucacuugaggccacaaguucgagaccagccugggcaacauugugaggaacaccacccccacccccccgccaauaucuacaaauuuuuuuuuuuuuuuuagaaauuagccagguugacugggcacaguggcucacaccuggaaucccagcacuuugggagaccgaagcgggcagauagagcgagcucaggaguuuuaagaccagccugggcaacauggcgaaacccugucucaaaaaaaaaaaaaaauuagcaggcaugauggugcacaccuguagucccagcuacuuaaaaggcugaggcaggaggaucugagcccaggaggucaaggcugcagugagcugugauagcaccacugcacuccagccuggacaacagagugagaccuugucucaaaaaaacagacaacaaaaaguuuaaaaacaaacaauuuauaggcugggugcaguggcucaugccuauaauccuagcacuuugggaggccaagguggauggguggaucaccugaggucaggaguucgagaccugccuggccaaaauggggaaaccccgucucuacuaaaaauacaaaacuuagccgggcgugguggcgggcaucuauaaucccagcuacucgggaggcugaggcaggagaaucacuugaacccggggggcggagguugcagugagcugaaaucacgccacugcacuccagccuggaugaaagagugaaacuccgucucaaaaaaagaaaaaaaaaaauuaaaaagcacuuacuaugugccagacauuauucuaaguauuuccauuuuuuuaaaguccuuuauccucccaacaagccugugaaguagucucuuuuauuaucaccauuuuacauuuuauuggcuucguucuuccgguucauugcuacccagguuuaaagaguaagauuucccagaggaucaccagcaggaucuuuuuguagaaagaagacacuucuauccaaggucucugcaagaucccagcagaugccugcaucauauuaaauuaagggccaucccaaaucuaauagucaaaagagccaggugcaguggcucacaccuguaaucccagcacuuugggaggccaaggcaggacgauugccugaggcuaggaguucaacaccagccugggcaacaaagugugacccugucucaaaaaauauauguauauuauaauagcaguaguaacaagagucucuguuuaaugaccaccuaugacuuaccagguacuucacugugugugaacucucucaucuaaucguaugagggagguacuauugcaguccccauuuacagauggagaagcugagguuuggaauucacuaguaaguggaugacuaggucagguucccuugaagcggauacuuagguggguguucagaugcaccugcuuuauugggggacggcucuugggagagacagcaggagaucagcaggguggggcuggggaauggauagagcagggacgcaauuucagcuggagugugugugacaccagaguuguccuccaaugcauggcaaggaugccggccuuuuguacuucuauagucagucacuguggaugggagguagagacgcaguagcucccaggugagauagcuuuugaucaccaagggcaauucuacuaagaagagaggcagcugggaggcauuagcaaccaacauccauagcagcuggagggcggguacaccagaaagaaaaugggaucuuggccagacaccaagaguauccagcaccuuaaccacugcaccacacugcaucuguuagcacccacauuacauuuuuuuuuuuuuuuuuuuuuuuugagacggagucucgcucugucgcccaggcuggagugcaguggcgagaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccagcacccacauuacauuuuuaagcccuuggaguggcauggccccucgagcuauccugacagcuucccucucuuacuguggucuccacccaucaagagccaugggaaguuccugcaaucaagaagcaaagccucaggcuauauguuugaaccuucauuuugaucauagacuuuccuaguagauaccauagugguuacaaacauaggauguugucaucguucagaccugaguuaauagccucaagaaaaaaaugguaguggaaccagguauggugaagugugccuguagucccaccuacucgggaggcugaggcaggaggcucgcuugugcccaggaggucaaggcugcagugagccgugaucaugccacuguauuccagccugggugacagagcaagcccaucucaaaaaaaaaaaaaagccaaugauaggcagagaaauacuaacuaaggcucuugcucugucgccaggcuggagugcaguggugcaaucacagcucaguacagccucaaccuccccagacucaagcaauccuaccaucucagccucccaaauagcugggacuccaggcacacagcaccaugcccaguuaauuuuuuuguauuuuguagagacaggguuucaccacgcugcucaggcuggucucaaacuccugaguucaagugauccacccgccucagccucccaaagugcugggauuacaggugugagccaccacgcuuggccagcuauuauuauuauuaacauucuucgagucuuacaacaguggaacuuuuagugcaggaugcgaauuucaguauuaaccccuuccucucccaaaaggauuugaagcccagaguaauucagccgccaugaaugaaccauuuguuagaugagaggcuacuggaggcugagcuugguaggauaagagcuugcauggggucccugauugaugacaauacccccagauuuaggucuucagaugcccaguugggugugucuucuguuccacugugucccuucggggacuguucccugccuucuuucuuuuugagauggaaucucgcacuuucacccaggcuggagugcaauggcgugaucucagcucacugcaagcuccaccucccggguucacaccauucuccugccucagccucccgaguagccaggacuacaggugcccgccaccacgcccagcuaauuuuuuuguauuuuuaguagagacgggguuucaccauauuagccaggauggucucgaucuccugaccucgugaucugcccgccucggccucccaaagugcugggauuacaggcgugagccaccacaccuggcccccugccuucuuauucaccaccaucuuucugaauuggguugcucagaacagagaaagcaacaucagcacaugggcaaacauggggcuucauuucagauggaccuggguucaaauccuaguucugccuuuuuuuuuuuuuuuuuuuuuuuuugagacagagucuugcucugucacccagacuggaguacaguggcgucaucuuggcucacugcaaccucugccucccaaguucaagcaauucuccuuccucagccucccaaguagcugggauuacaggcgcuggccaccaugcccagauaauuuuuuguauuuuuaguagagaugggguuucaccauguuggccagacuugucuugaacuccugaccucguuaauccgcuggccucggcuucccaaagugcugggauuagaggcgugaaccgccgccgcgcccugccuaguucugccauuucucaugcauucucugggugaaucacagcaucucuguuagccuugcuucccacuucuguaaaaugagagugacuuuacauguauggccaccucaggggcuugucacuagaagccagugaaauaauguugagucugguuccuugggguugaaauugggaccgccaaccgcuuuccuacccagagcagcaacuagccuauauggcggccuuuuaugaaugaggaaaagacaccgccucuuggcagaaaaaaaaaauuaagaaaauggcucccucuucugggugcaaguugcccaacacccaggaauauggcuccaaaagcaauggacucccaccccuuucuugcccaaaagaucaucaaauggaacagcaugucaaauaccuuuauuaaguacuuuaaaguuggcugggcucuguggcucaugccuguaaucccagaacuuugggaggcagaggcuggaagaucgcuugaggucaggaguucgagaccagccuggauaacauagugagacccugucucuauaaaauauauauauagauuuauuugagacagcgucuugcucugccacucaggcuggggcgcaguggcacaaucauagcucacugcagccuuaacgauccuccugccucagucccuagaguagcuaggacuacaggcaugcaccaucaugccuggcuaauuaaaauaaauaaauaaauaaauacuuuaaaguuaaaagugcuuuuuaaaaaauaauaaggccaggcguggagacucacgucuguaaucccagaacuuuggaagaccgaggcggguggaucacgaggucaggagaucgagaccauccuggcuaacacggugaaacccugucuccacuaaaaauaugaaaaauuagcugggccuacucgggaggcugaggcaggagaauggcguaaaccugggaggcggagcuugcagugagccgagauggcaccacugcacuccagccugggcgauauaacaagacucugucucaaaaaaaauaaauaaaauaaauaauaauaauaauaggggccagguaugguggcucacaccuauaauccuagcacuuuaggaggcugaggaguuugaguccuuggagaccagggguuucaggccagccugggcaacauagcaagaccccaucucuacaaacaaguuuuaaaacuuagccaggcaugguggugcaugccuguaguccuagcuauugcagggacugaggcaggaggaucaccugagcccaggagguugaggcugcagugagcugugauugugccacugcacuccagccugggcagcagugcaaaacccugucucaaaggaaaaaaaaaaccuaggaaguguuguucccaugauaaggaucagccuccguguggugcuuccuucaccauugcccaauccccaggcuccugggugcuuaauauucccucaggaacacaccugcuuugucugggagagaccugggcgucuugguggcgggguuuggggguacuugcucaugggcuuauggggccucucucuguguccccccagguuuacaagucguccugaagucgaucaugaaggcgaugaucccuuugcugcagaucggccuccuccuauuuuuugcaauccuuauuuuugcaaucauaggguuagaauuuuauaugggaaaauuucauaccaccugcuuugaagaggggacagguagguccacggagcaugaugcaucuuuccaguuuucuccuucagggacaagcucuugggaggauuaggcaggggugugcuucuuucuccuggcagcugggaggaccgucuccuucagagagcacuacaggagaggcagugagugaaauagccucugagaucuuagcuguugaaaggggugggguuccacagaaggugacccagcagagaaagaguuuauuugggaaugaucccaggaagcaccaucgggggaaugaggaagugagcagagaaagaagggaucuuuuaaagagugugcuaucaagcggguuaccacuuaaaacugggacuggaucccccugggcaccucugggagacagcaaagaacacacaacucagcuggucacgguggcucacgccuguaaucccagcacuuuggggggccaaggcggguggaucaccugagaucaggagucagagaccauccuggccaacauggugaaaccccaucuguacuaaaaaauacaaaaauuagcugggugugguggcaggcaccuguagucccaauuacucaggaggcugaggcaggagaaucacuugaacccgggaggcagaaguugcagugagccaagaucacaccacugcacuccagccuggcgaaagagugagacuccaucucaaauaaauaaauaaauaaaaauauaaauaaaaaaagaacacacaccucagagccgucccagccaaggggcaagggagcugggguauuuauacacuggcuucuuuuugacauuggugaggacugcuccuagagugggaauuaaugccuggcacaucuggcugaguggaacagguauucugggugcuuucagaccucgaccaguccugacuucuaaagcaagcaagaaguggggagaguugggccagaaaaggguuauugccucaaugcauugugagugguaccuuguggaaggugagagacagagaagauuccaggcacaggugccaugcuaaacgauaguucucauuuauuauaggaacccauggauuuauuuuguucucugcccugagugcugggugagaguacuggaugaguccuccuggucucccccaacccccaggauguaccagagauaccccaauugggaguccuggcaccaaccaaucagaaccuagcacucagcagcauucugccccucccugacuaugcccacauuaacccuucaguggcugggucuggggguagggugagccccggaaaagccaggcagcgcagagacacucucccagggcucagcucugaaccagcaguguggaagcaguguguccaccacgauccacacucaggaaccaaauagcccuuggauacguuuucaguuaaaucuuugccauccaaacucuagcugcuugcucucuaaagcuccagaaugaaauggaaucaaguaggaagggaugccuucaguauuucaguauuuggaccacuggccaucugggugcagacagacugaauagcaguucugguucugaugauuugggucaagggagcugugaauugaaggaguggauagaaggaaucaagaagcccaaaggggaacccaggugggcagagaaagagguuucaggccccuuauuugggaaaggcagccacagaagaagauucugucugggaguggauuuccacccacccucuccacccagugacccccaaguggauccgcagaggcagccccugagcccucccuccccacuccuccccacggggagggaaaacccacuggggaagguuuauuugcaaugguuggagguuuggguuuuuuuguggguuuugguuuguugguuuuuuuuuuccucuuuuucucuugcuccuccugucucuuucucuccugggcuugugaaguuugcucaauauggaauguccuaauuauuucuuuccccgaugaagaagguguuaauugaggcagagcuauuucugcuccuggccucgucacccaggcggaaaugcgagagagagagagagagagagagagaaugaauauggggcagggccucuuggaaaaaucagccgugagcagagaaaccaggacuccuggauccuagguuucugugaaguuuuauuuuauguuuuucuacccuagacuagcuaaaggagaagaggccaugggguuggcuuggguccgagugggguuuugaggggacagauguggguggugccaccagaggggaggaagccucgauuuaggagaaagacugaaaagcuagcucacgauuaaaaauauaagacgugugaguaagagacagauauauacagacacccaggcaguggguuaauuuuaaaauguauuuauaaccgaauuccucagacacucuggacgcuuguuuuucuagaagcaacgcucagaguguuucgugucggugguugggggguugagggggauugcaaagcugcuaaagauagacccguuuucaguagcauuccucagugucgggagcccaguuccugugugcccagcaccgugccaaucgcuuagaaggaagcaaagauaaaguggaaggcuuccugcuuucuaagagcuuccaaaauaguuagaggaaacaagaccccucauuugcagccauuuuuaacagugaaggcuaaugugugauuauacccacgccccccuaaauaugaaaauucaguagcuauuguaugccugaaaggggccaggugcaguggcucacaccuguaaucccagcacuuugagaggcugaggugggaguaucccuugaggccguuaguuugagaccagccuaggcaacauagccagacccugucucugcuaaaauaaaaauuuaaaaauuggccgggugcaguggcucacgccuguaaucccagcacuuugggaggccgaggcaggcggaucaaaaggucaggaguucaagaccagccuggccaacauagugaaaccccgucucuacuaaaaauacaaaaaaaauaaauuagccgggcaugguggcgugugccuguaguaccacauacuugagaggcugaggcaggagaaucacuugaaccugggacauagagguuacagugagccgagaucacgcuacugcacuccagcuugggcaacagagugagauuuugucucaaaauaaaaaaauuuaaaaauuagccaugaguggugguacaugccuauaguccuagcuacucaggaggcugaggaagaaggaucacuugagcccaggaauuggaggcugcaaggcugcaguaagcuaugauggugcccgcacuccagccugggugacaaagugagacccugucucaaaaaaaaaaaaaaaaagagagagaggaaggaaagaaggaaggaagggagggagggagggacuggggcuguguuaacugggcuacacaaagaggcuacauggagggugggaauugagccagacuuggacauggcguggagacagagaagauuccaggcacaggugccaugcuaaacgauaguucucauuuauuauaggaacccauggauuuauuuuguucucugcccugagccuuauguuuaaaagauuuuugccuuccaaccuguauuuaucaaauaauaguucauguaccaaguccagcauaagugaggaaggcguuuccaacaacuuaaguucauggcgaggcuagacuuggaguuucuauucagccagagcuugaaaggccaacaagauucauucauucagcauugguuuauuucccucugcugugugcucagucaagggagcagagaauuggugcugcgaagucuguagcacauacauugagagauauuuuuguugaguaggaagcuugaguuuacacacacucagcuguuuguuuucuuguccgacaaugccacggucgucuuugaaaaccuucaaaagcaucgcucacagaauaagguccucucagacccgcugugcugguaaaaugaggacacucccagaugugagcuuuccugccucccuaccccaucaauaccuuaagauuuggacugaccuuuagcguucagccugacugccaccuccccaggaagcugucuuugguuuccagcaaaaggggugucuguuggcacguuucucucuccuuguggcauuuucacagccugccuccugcuauuuggggagaaagcucagcuccuguuccuuacccuuaggcaaggguaggaacuguguguacuggugucccucacccccagaacagcucccugagcccaguacaucccaagaagaaaaaaaucagcaaggcuuauaggagaauaacacaaugcgcuugacaaauuuguccuaauggaugucggaagaaggcugcacuuaccagcuacaccaugcacacggcacauuuacuaaaacugacuauauuauggaccauaaaguuugucucaacagaggucaaaaagcugaaaaaaauacaaauacaaaacauauuuucugaccguaaugcaauuaagcuggaaaucaguaacaaaaagagaacucuaaaaguguuugcagauuaacagacaugccucucauuuauggaugaaaugauaugaugucugagcuuugcuuuaaaaauauucuaggcugggugcaguggcucacgccuguaaucccagcacuuuggaggccgaggcgggcggaucacuugaggucaggaguucgagaccagccuggccaacauggugaaaccccaucuccacuaaaaauacaaagauuauccagguguggugguggccaccuauaaucccagcuacuugggagccugaggcaggagaaucccuugaaccugggagucggagauuguagugaggugagaucaugccauugcacuccagccugggugacagaaugagacuccgucucaaaaaaaaaaaaaaaaaaaaauucuaguggcaaggcaaaguguuuggaggggauacagaggaauagaugaaacaaaauuugccagaaguaaauagguaagugucuaaauuggugauagguacauggugaaucauuauauuguuuuauacuucucucucgcucucucucuccccccguucucucccugucuuccucuccccucugucuucauauauauauauauauauauacacacacacacacacagacaccuaauaaguuuuuuuaaaaaacaaauacaucuaaauuacccauaggucaaagaagaaauaauaauggaaauuagaaaauauuuuacuugaacaauaaugauaaugcaugacaaaauguugagaugcagguaaagccacacuuaaaggcaauuuauagccuuaaaggcaguuaauccauccaucucaaaaguuuaggaaaagaauagaaaaaaaaaaaaaacucauggaaaacauaaagagaaaaguaguaaagcucagagaagaaauuaaucaauagaaaaccaauaauagacccccaaagccaaacauugaucucuuugaagacugaucacguuugucccaaaaguuauucguuccaacagcauuauagagucacuggucccuauuucucagagcugguuuucccugcuccuuccccugacuuuucuccccuucccuuuuguagaugacauucagggugagucuccggcuccaugugggacagaagagcccgcccgcaccugccccaaugggaccaaaugucagcccuacugggaagggcccaacaacgggaucacucaguucgacaacauccuguuugcagugcugacuguuuuccagugcauaaccauggaaggguggacugaucuccucuacaauguaagugaugcugggacaguguguguggacaaucagagucucagggagguggccuccugggaccagugagacuccaaggcugcaauggagggacccugagcugggaaaggcagcccaaggacaacacagccccacugaagcuggccugaggcucaggcuuuugaagauuacaggggcucaugagcagaacucuaacuauagggcauagaagucuggagggcccccagaugcaacaucauuuuucauugugcaaguguuuagauauaauuuuagauuuuugaauacggaaagguuaugugauccaaaaaccaacacagauaaaagauagaguaauaucuuuggacguaggcgaggggucccugcccugaggcucacccaguccuucuccagccauaccacuccccgugggaugagaaguuccuggagccaaggggaugugucuaccaagagcuugugccccacuuuguaggccauguuuuaaguuaccaggauccuggaauucccugcccauggccagauuccaugaacuugcgugcaauucucauauggaucuguucguaacccaacugagggccaaggacauccgagggguggcuguuaacacaaauguggccagagcuuggauguacaagcuggaaugcccacacauauguguggagccccucuggcaggacagagccaugacuaagaagagaaagggacaggacagggcuggcucuccccacaccuugacccagugcagauauccggauucuaaauuccacccugaccuuccaaaguguaaaggaagguauauuugcaaaguagaagcacacagcauguuuuauuuaguuaccuuuucaauauuuccccguaguauguggucugcuuuuguacucuugcccuagaucuuaaaaauguuagggauguuucuggaaagauguaucccugcccccacuugcaugcuacuuccucuucccacaauaugcaaccccuuuaguuccucagaauauccuuccaauguuuauuuaugcaauuauaauuauaagcauaaucgaaucuauguccuccccccucuuucuuaucccaaggaguagcauucuauacaugcuguucaauucugugauuuuuguuuucucauaaccacacguucuagagaucuuuccacugcaggacauggacagucucuucacgggugcacacuaguaugcccagcuaauuuuuguagagacaggguucuuccguguugcccaggcaggucuggaacuccugggcucaagcaauccucccgccucugccucccaaagugcugggauuacaggcgugagccaccacgccuggccuucuuuauucuuuugcacagcugcauagcauucuauuguguggcugcccauaguuuuauuuguuugccauuaagagaaaugcuugacuggcuuccuguccacugacauggaacaugaugcugcucugccaggagcauguugcacguaccucuucauacuuuugcagauauagcuaggggguuggagggucuccauucccagaagugggauugcaggaucaaagacuaaaugcauuuauaauuuuauuuuuggggaagauuuuuguuuuguuuuuuuggagacaaggucucccucugucguccaggcuggagcgcagugguguaaucauagcucacugcagccuuaaacuccugggcucaggugauccucccaccccagccuccugaguagcugggaccacaggcacacaccaccauaccuagcuaauuuuuaagaacaauuuuauagagauggggucucacuauguuucccaggcugcucucagacuccuggccucaagcaauccuccugccucagccucccaaagugcuaggauuacaggugugagccacugcacccagccuaaaugcauuuauaauuuugauagauauuuaggugugcaaguuuuaaaccccacucuguccucaccacaguucaccuucccucaccuacuaugcagguaagcaguccccaggcaggucacuugucagcagcuggaguggggcagagccaaggauucaggaucaaacacaaggaugccacaacuguagugaccccauagagcacccuggggcugcuccauacacacagcucuguugaccaguggaggucuccucuucaccugcccuaagggcugaaauuaccauugaaguuuaggccagcgguuggccugacccgggagcaauaccuggcuuccuccuccuguacauagagaagcugaacuuuccucuugguccuaguguauguuccuuaacaacccauuuaugccuaguguuccauuauuggaaugcuaauccugugggaguuauuuacauccugcugcucaaggucaucacuaaggucggauuuuucacacacacaaaaauugcaaccuccggcauaaauggguuaaggaauuuccccacuuguggguggagggagauuugcaaaaacucauccuuguaauccugaucaacaaaggcccguuuuaguugggaguaggcagcaaaaggagccacaugaacaguugcgccugucacgcacugcacaagaaugucauucauaucauagacaacauacgauuucuacuguuauccugauaauuuauugacagaaaaaaggauguggggaagggacaugguguucuaauuugcaugaaaaccucgucugaguguagcaucucugggaacaugcagcagauccgagcucaggcccucucuuggccgucaccugcaaacagcuuggacaaagggucagcccaauuggccaaaacucacuggggaauuuuuguggguucuagguuuuuacuuugcaaggcuggugugagaggagguuccagcaggaaaugaacccuccugagagggaaagagacugggaaauggagaaggcugggaacucagggagagaaugggaguggggaaugggagcugaaaaaaauugugagcauaaaaaagggauaugucacaggguuggaugaccagagaaagcgucuggggguucagauuaagaugcugggggcgugcccaguggugggacaggaagcaugaauuuccagagggcucgguuauaaacaucauuguccaauggguguuucccuuggaagccucuaagcuuagagcuaagccaccucuggggacacaaacugagugguuaagagcagagacucaggugucagccugucuggguuccuuccgacucuuccacuuccuugcugugcagccuucggcaaggugcuuggccucucugugccacuauuuccacaugugcaaaacgaagagaagcauagucccaccucacaaggcacgaggacuaaguaagguggauucgcaugaaguguuuagaacugauccuggcccggggugaccuccguguaagucaaauuccccacccugcaugguguuccuuuuagaaaugugcaugaauuuuucauuagaacagcuccagcagugccugaggaaguggagugaggugugagaggucuuacuuuauuccccucgcuggcccugcuauuaaccacuaacucagaguagcuuucuagcacuuuccacacauuuacaucccacccucguccuuugguuagcagcccaugcaaugauuuggccuuaaugugaaccuagaacacagcuucucgcccagggaugauuucugcccccaggggacacuuggcaguggcugcagacauuuuugguugucacaacuggaugggaagaaggaggaugcuauuggcaucaaguggguaaaggccacggaugcuacucaacauucuacaaugcacagcaucccccaccucugccccaccauagagaaugauccaggcccaaaugucaguaagguuucugucaggaaacccugggucagaagaccaagguuccuugaggacggggaugccuuauacugcaaucagcugucacucucugccucucucuggggcugcugugaucaccuggccugcauggacaaccccuaggagcagcccccauccagugccuggagaagucaguggauaaauaccccagcucccucccugucgggcguuuugcucugcccugcaucucuccagugggaucaggcucugguugcccgcaggguuaaccuggucacguacacacccuucacuugccaccuucccuucccugucugguauuuccugggaugaacuuuuagauuuauuuccuggggcugcuauaaugaagcaccacagacugaguagcuuaaaacaacaggaauuuauggucugacaguucuggaagccagaaguccaaccccaagauguuagcagagcugacaacacgccccucaaaagccuccgggggaggauccuucuuugcuucuuccuggcuuuugcugguuucccacaaucuuugggauuccuuggcuucuagagccuucauucuccauuccagucuucugucaucuaauagcauccucccagcccgggcacaguggcucacgccuguaaucccagcacuuugggaggccgaggcaggcagaucacuugaggucaggaguuugagaccagccuggccaacauggugaaaccccaucucuacuaaagauacaaaaauuagccaggcguggugggcgggugccuguaaucccagccacuugggaggcugaggcaggagaaucacuugaacccgggagauggagguugcagugagccaagaucaugccacugcacuccagccugggugacagaaugagacuccgucucaaaaaaaaaaaaaaaaaaaaaaagaaaaagaaaagcauccucccuucgugugucuguguguguucuccucuucuuagaaggacaucaguuguauuggaucagaaccuacccuacuccaguccaaccuaauuuuaacuaauuacgucugcaauuacccuauuuccaaauaagaucacauucugagguaccaggggguuaggacuuaaacauuuuuguguguguagcaggaggacguaauuccauuuauaacuccuccuaaauaaaacgacuugcaugugaacucuugucuggggcuucccaaagugagauaaccccucucucuaccccuaaaacaacgaguagcgucugucaaugccagggugcaggggcuaaggugcccaucuuugaguuucugcugaggaggacacagcugcuacguuggagcacucuuggguucugccuucgugcccagccaucucccuugggcuagcccugcccugggucuauccuagaaugagccucgaucuguuuggccauaggcaagcagagugucuggaaaucuuuguccuccaugacuggugcuggagccgaagccaguggguguggccuugccagccaacuccauuuacccagcucugaacaagcuaguaguugagaucaacggagaguccagacagucgcuccaagcaucuuggaauccauggacacagguguaccgcagaggcuucccaccuggguaggcagcccuuuguaagauccuggcaccacauuuauucucuuaacauccuuucaguuauccaguaaucauuuauugagcaccuacugugugccaggcaaugauuaggugauuggagacacugcaacgaagaagacagacuaaaaucuccacccugguaggagagacagaugcaaaugguaaacaugauaaauaaucaaucacccagaaagcaggagacacuaagcaaauguguauguacuaugggaagcccaauaggaacgaaagcuacacaagagaacaagugaugggugguuccuuagucuaggucaggcaaucagggagggcuucucagaggaggugauguuugagcagagaaggagggagccaggcagauguuuuggaaacagcauucucagcauggagaacaguggcagcucaccuacaggauguguuugauucccuuccagauuuuguauucguuucuuguuuuucucccuuggcuuccugguuuaaaugccuuuugaagaaaucuaagcucaacuaaucagcgaugcuguugaagguuuauaucaggauaugcaucccagaguuauuuacaaaauuagaacaaaacuggaagcaauugaaagccugacaauaggagaucaguuaaauaccguaugguccuuccguaugauggcauauuaugucaucauuaaaaaucgucugcugggagaauauuaaggauacaggggaaaggcucaccauauaaugaugagugggggugcugggcgcagugguucaugccuguaauuccagcaauuugggagucugagauggguggaucacuugagcccaagaguuugaggccagccugggcaacacagugaaacccaaucucuacaaaaaaaaaaaaacaaaaauacaaaaaucagccaggcauaguggcguacaucuguagucccagcuacucaggaggcugagacaggaggauaggaucacuugagcccuggagucagagguggcaauaagccgugaucacgccacugcacuccagccugggcaacagagugaaacccugucaaaaaacaaaacaaaaaaaaugaugagugggagaaacaaguuuuuaaacagggaucaaggaggccaggcaugguggcucacaccuauaaucccagcacuuugggaggccaaggcaggcagaucaccugaggucaggaguuugagaccagccuggccaacauggcgaaaccucaucucuacuaaaaauacaaaaauuagccaggcaugguggcgggcgccuguaaucccagcuacuugggaggcugaggcaggaaaaucgauugagcccaggagguggagguugcagugagcugugaucaugccacugcacuccagccugggcaacagagcgaaagcugcacgagagaagaagugaugcaugguucccuagucuaggucagccaaucagggaggguuccuaagaggaggugauguuugagcagagaaggaggaagccaggcagauguuuuggaaacagcauucccagcauggagaacaguggcagcucacccugucuagaaaagaagaaaugauaagaggggaaaaugaguuuuuaaaaaggaaucaaggggagguaaaccuuaugaucucaaagguacaaauaugaaaauauaaguaaagaaaaacuggaggacacuguaccaagcugaccuucggguggugggauuugggaaucuugauauucucaauacuucuuuguaucuucaaauuucucuaugaugaucacaguuuacuuuuuuuuuuuuuuuuugagauggagucucacucuguugcccaggcuggagugcaguggugcgaucuuggcucacuuggcucaccucugggguucaagcaauucuccuaccucuuccucccaaguagcugggacuauaggcaugcaccagcauggucagcuaauuuuuuguauuuuuaguaaaaaugggguuucaucauguuggccaggcuggucucgaacucguaaguucaagugauccaccaaccucagccucccaaauuggcuugagccaauuaaacuugucuugcuaaaugguuagcggggagaaagaagaaggucucgggucauuccuagaccaggaggcagggagaaagggaggagaaugaaccuuucuuaggcaaacaguguccuagguguccuuaucuuacauaaucugucgagagagucacacuaaaauaaaucauugauugauugauugauacaucaauaauaaauggccagccuugguggcucacaucuguaaucccagcuacuuaggaagcugaggugggaggauuguuugagacaaggaguucaagaccagccugggaaacacagcaagacucaucuuaaaaaaauuuuuuuuuuuaauuagccagaugcgguggcucacgccuguaaucccagcacuuugggaggccgaggcggguggaucacgaggucaggaauucgagaccagccuggccaacagggugaaaccccgucucuacuaaaaauacaaaaauuagccaggcgugguggcacacgccuguagucccagcuacgcaggaggcugaggcagaagaaucauaugaaccugggaaacagagguugcagugagcugagaucacgccauuacacuccagccugggcaacaagagcaaaacuacaucucaaaaaaaauguuuuuuaauuagccggguguggugguccaugucuguaguuccagcuacuugggaggcugaggcaggaggauugcuugagcccagcaguucaaggcugcagugagcuaugaucccgccacugcacuccagccugggcaacagcaagaccccaucucuuaaauaaacacauaaguaaauaaaugaucauuuuuauuuuauuauuaaauacacaagauaaaugaaaaacaggcaaaucuuucuuacaaaagaauuccauuuaaaguauguaaacuucacuccccacugccccaggagguggagacuaaucuccccuacuuugagagugggcuggauuuagugacucauuuccgaagaauagaguagguaaaggggaaaauagaaguuuuauagcggaggaacagauagauaccacuuuaaccaaaugaugaagauuaguaucccccagggauguggauauuauguaacccuugauuuuaugccuauauagcguucuucccaaaaacuccuaaucccaguuuuuugggguuuugcucugucuucuaagcuggagugcgaugaugcaaucauagcucacugcagcucaaacuccuggucucaagcgauccucccaccucaaccuccugaauagcuagggcuguaagcacauaccaucaugcccagcuaauuguauuuuuuugguagagacauguucucacacauugcccacgcuguccucgagcuacuggccucuagugauccucccaccccagccuccagagucacugggauuauaggcaugagccacugugaccagcccagaauuuuuuuuuaaggaguugugaugucguuuaagagaugugauucuucauaacacaucaacaacaagucccagcgauggguuggauaagucuugggauuucaugggaguauuaagcuuaaaagacuuugcaugauaucugugaacuauaugugauuucuguugguaaugggggucacugauucugcgguuugccaccuccaaucaucauggaagaaaauguuccacuuccagugaaaguaagaggaaguaaagggguaauuauuuucuaucuaaauucacgaacuccuugaauucuguccacagaccccuaaguguuuccuccccaaggugaaacugagagaaucuugccagugccuuccgcagucacuguggcuagaaaaccccucagaagaggugauaguuuagcagguaacuggaguucucaccauccgugucuggcucagcccccaucacaaccaguuacccagcccaaaaugucaguaguacugagguugagaggcucugcucuaggaggccaggccucucagaggaaggaggauugggguacuggcugggccucaagaugaaccuacccccuaagagcuuugggauggcgugaguuucuguccauacccaaggacuacaaaugcagguuuacuggaaauucugugccaaaagugagguccaacucacuucuaacugcuacaaaacaaaccuccaucaacauagcccaucucuguucuugaccuggaagcuccaagguauccacauggcucccaugcccacuagacgggccucuucccuggaccuuccugggccagagaaggcucuggguagccuuguggaaucaagaugggugaucagccacuuccucugugccacccuguuuuggcuacuucccuaggcaucagccugggauuccuugaugguaaaaauauaaaacucucugagcuagggccuuuaauauccccauuuuacagaugaagaaacugagucccagagcugugcacagcgauugagagucagaauucagcucugucucacucagugucaacauccucagauucugccauuuauagccucccacagcaaauaggauugagggcugcuucucugagcucaaggggauagaauggggaaccccaugaguacugcaacaaaacuguuugcuggagacaagagcugguggcucuguguuguucuagugacagguggccucauuucacagggacccccucacccuaugugccccauguggcucagaaaagccagaaauugucuccacucucacaggggaaggucccugacccccucuuugccagcugggccaaggcaaauuggggucacuucaugggguacaggaccuacccucucuugguugcccccaaggaggggauguggaggggcuggggaccuggcaggaccagggugucuugaguuaauuuggggcugccuuuagccgagggcuucugugugccuggcaucagcuuuacauugugucuugauccguaaaacagcccugugaggaaagauauuuuuaaccccaucuuccagaugaggaaacggaggcccacagggugacgugaccugccaagguccccuagccaagagugacaaagccaggguucacacacagcucuggacacaauucaucacccuucauccgucucucucugacucuuucuuuuucccucucucucuuugucucucuuuuuuuuuuuuuuuuuuuuugagacagcgucucacucugucacccaggcuagagugcaguggcgcaaucucggcucacuacaaccuccaucuccuggguucaagcgauucuugugccucaaccucccaaguagcugggauuacaggugcgugccaccacacccagcuaauuuugggggguuuuguuuuguuuugagauggagucuugcucugucgccaggcuggaguacaguggcgugaucucggcucacugcagccucugacucccagguucaagugauuccccugccucagccuccugaguagcugggacuacaggcaugcaccaacacgcccagcuaauuuuuuguauuuuaguaaagacgggguuucaccauguuggccaggauggucucgaucuccugagcucaugauucgcccgccuuggccucccaaagugccgggauuacaggcgugagccacugugccugccaauuuuuuguauuuuuaacagagacuggguuucaacauguuggccgggcuggucucgagcuccugaccucaagugaucugccugccuuggccucccaaagugcugguauuacaggcaugagccaccaugcccagccuuugucucuuuuauucuuguguucucucucucucuuccuucucuuucuccaccuccuucuccuucucucccuucuccucacccuucuuugugcuuuucucugugaguuucucuucuucucuauuucucuccuuuggugaaugucaauuagaaaagcagaaaaacugcguuuaauuugugaucauaaaugcaugucccuggccaggcgugguggcucacgccuggaaucccagcccuuugagaagcugaggcaggaagauugcuugagaccgggaguucaaaaccagccuggucaaaaagcaagaccccaucuuuaaaaaagaaaaauaauuaauuagcugggcauggugguguguaccuguagucccagcuacucgggaggcugaggaaggaggauugccugagcccaaggguuugaagcugcaccgagcugugauuacaccccugcacuccagccugggugacagaaccagacccugucucaaaaaaaaccuaauaauuaaaaauaaauaaauaaauaaaugcguguccccuggccagugguugcuaauguuuggaaucaccuuugacccaugcccuuuuucauucauagauguuugucuugaccaaaaucaaagcauuagacuuuggacuauaaaucacugguucauucaacaaccaucauugaaugccuacuguaugcagacacucuucuggacacagaggaguugacguguugguggggaaagccagugaucaguugggauaaaaagggcagacagcagacauuaaauaguuuaggcuuugugggccagauggucuccaucgcaacgacucaaucugcuccuguagcgugaaaguaacgacagauaaagcgcguaagugaaugagcauggcugugggccaauuaaacguuaaccuauaaaaacagguggcuggcccgcgggcuguaguuuguggaucacugccuuagagauaguguuagaggguggugagagguccgggauagaauaaaacaguagagaguuugugcauugucaagaugagagguugcaguucuucuuauacaccccgaauggccgggcaccguggccauuaugaucuauaauucuaacacuuugggaggcugaggcaggaggaucccuugagcccuagaguuuaagaccagccuaggcacauagugagaccccaucucuacaaaaaaaaaaauuuaaaaauuagcuggacaugguggagcaugccuguaggcccagcuacuugagaggcugagaugggaggacugcuugagccugggagguuggggcugcagugagccgaucaugccacugcacuccagcccggaugacagagcaagaacugucucaaaaaaaaaaaacaaaaaaacaaaaaaaacagaccugaaggaacaaaucauaugaaugcauuaaaguaucacauguauccaaaaaauauauacaucuaucagccuggcacgguggcucaugccuguaauccuagcacauugggaggccaaggcaggcagauugccugagcucaggagugcaagaccacccuaggcuacauggugaaaccccgucucuacuaaaauacaaaaaauuagcugggcaugguggcaggcgccuguagucccagcuacuugggaggcugaggcacaagaauugcuugaacccaggagacagagguuacaguuagccgagaucgugccacugcacuccagccuggacaacagagcaagacucugucucaaaaaaaaaaaaaaaaaaaaaaaaaaaaaaauauauauauauauauauauauauauauauauauauauauauauauauauaaucaauuaaaaauuuuccuuaauaaauaaacauuucucuccuucucucccuuggugaaugucaauuaauaaagcaacaaaacuauguuuaguuagugaucauuaauguaugucccuggcugggugugauggcucacacuuguaaucccagcacuuugggaggcugaggcaggagaggauaguuugaggccagcaauugcuugaggcuuuuugaaagacaugaaggagaugaagggagccauggagauaucucagggaacagcagccgagguagauggaacagccagugcaaagguccugaggcaggauguuccuggcauuugugaggacauguagcugcccagauguccaguggggagugagugaggaugaaggaaggagcugaugaaggaagaugauaaaauacuucauggaucagccaggcaugguggcucccgccuguaaucccagcacuuugggaggccaaggcggguggaucacaaggucaagaguuccagaccagccuggccaacauggcgaaaccccgucucuacuaaaaaauacaaaaaaguuagccaggcguggucaugcacgcguguacucucagcuacuugggagacugagacucgagaaucgcuugaacccaggagauggagguugcagugaguugagaucaccccacugcacuccagccuaggugacagagcgagacucugucucaaaaaaaaaaaaaaaaaaaaaaagacuucgugaacagacagccuauauaauuuaugauccaaaccaggacaguuuugagagugaaaggggaaaaagagcacugaaaaaauaauuagcaggccuggcaugaucuauaacggguauaaagugggacacacagccucucucacggucacugucagacuucagcuuuuucacacucaaauccacccccauguuuaucccauauacuggagaaacggguguucuccugagcugaguuuugggguuuuuuccuuuuguuuuguuuuguuuuuguuuuuuuaacauccuguauacuuuuucucaaugaaccaugcucaaaaaaauuagaggaaaauaaaccauaaaacagaaggcacugaaggauuuugcugggacucagccauuaguuuguuugaugaguauuuauggagcgcuuucuaagcaccaggcaccaccagcgauacugggaugaaucaguaacaucccucacccuugaagcucucuugggcccauuguuauuuacuuaaaauacuaugcaaguacggagaaggggugaagugggaaaaaaucaguugguuguaaaggccagaaugacgggucuagucccacccaugccaucugcacccugugugauccaggcacaucauguugccucucucagcuucaguuucuccauccaccaggcacagagauggcgggaaucgaggaagauguggggaguauuucaucagcccaaaaagacuuggcuaaugcgaccauaauucugccuucugccucuccuuucccagaaaaauagcuuaaucauuuggauuugggauaaacacauuuccuguguuuauuauuuaaaugauccaccaagcugggcaugguggcucaccccuguaaucccaacucuuugggaggcugaggagggcggauugcuugagcccaggaguucaagaccagccuggccaacauggcgaaaccccaucuuuacuaaaaaaauacaaaaaaauuagcugagcgugguggugcgugccuguaaucccagcuacuugggaggccgaggcacaagaaucacuugaaccugggaggcagagguugcagugagccuagaucgugccaucacacuccagucugggcgacagagugagauucugucccuaaauaaauaaauaaauaaauaaauaaauaaauaaaauaaaugauccaccaacaggaaccccaggaacauuuguauugacuaugcaacuaaugcuuagugagcaccuacuaugucccuggugcugaucuggacacugggauuuagacaggaaaaaucucuacccuggaggagcugaugaucaagaugacaaucuugaaaugcauaaguugacaagaugauucagacaguggaacgugcugggaagagaaugagaugucuggcugagcugcaggaaggggcaaguccuuuugauugagagguccaagaaggcuucucugaugggggcacaauggaucuaagguugagugauaagaagaaauuggccaagccaagaccuaaaggcagaguugcuccaggcauagguucagagaauggaaauaauuggcugauugugaucuugaacuugaccuuucuuuucuucugcuaacuuuggguuugguuuguucuugcuuuucuggcuccuugagguacguguuggguucuuaauuuguaauuuuuuuuuuuuuuuuuugcuuuuuugagacagagucucacuguggugcccaggcuggaguacagcagcaugaucuugacucacugcaaccucugccuccuaggcucaagugaaccucccacuucagcauccccaguagcugggacuacuggugcacagcaccacacccagcuaauuuuuuuauuuuuauuuuuuagagauggggucucacuguguugcccaggcuggucucaaaccccuagcucaagcgauccuccugccuuagccccccaaagugcugggaugagaggcgugagccaccacaucuggccucuguuuuuugugauguagguauuugaugcuauaaacuucccucuuaguugcuucuuggcccuuuagcuaaggucaaguguaaacuucccucagcacugcuucugcugcaucucacagguguugguguguugugucucuauuuucauucauuuccaaaauuuuuuaagucuccaucuuaauuucugcauugacccaaugguuguucaggagcauguugcguaauauccauauauuugcaucauuucugaaauucuucuugguauugauuucuaguuuuaucccacgguagucugagaagaugcuugacagaauuccaguauuuuaaaauuuguugagaguuguuuuguggccuaacauguggucugucuuggagaauguccaugugcugaugagaagaauguauguucuccaucagacaugcaagagacagacacuuucucaccugccucaugggauccauaaaagagucaaucagaaguuggcauuuaagaaagaccagaaggaggcugggugcaguggcucaugccuguaaucccagcacuuugggaggcugaaguggguggaucaccugaggucaggaguucaagaccagccugaccaacaaggugaaaucuugucucuauuuuaaaaaauacaaaaauuagcuaggugugguggcgggcaccuguaaucccagcuacucuggaggcugaggcagagaaucacuuggacccaggagguggagguugcagugagcugagaucacaccauugcacuccagccugggcaacagagcaagaccccaucucaaaaaaaaaaagaaagaaaaaaaagaaagaaagaccagaaagaggugaaggagcaagcuacagagauaucaaacuguaucaaucuggcugggcgugguggcucaugccugaaaucccagcacuuugggaggcugaagcaggaggaucacuugagcccaggaguucgagaccagccugggcaacagagacccccucucuacaaaauauaaaaauuuaauuaaaaagauguauuggucagggcagccaaguuaugcugcaguaacaaacauccccaaagccuccaugacuuuugacaacagauguauuuccugcucaugcuacauguccagugcagguuggcaguggggaagaagggggcucuguucagugcagucacuugagaccuagcuaaucaccuagaacauugccacuugcuauuccagaaggaaaaaaggaaugcuagaaggucccacacugaaaguucaaugcucuggcuccaaaaugacagcuauuuccacucacuccucauuggccagcacuuagcaugugguccucagccaaccccaaagggacucaggaaggaccaucccaccauauugcuggaaauauuugauggcagcauuaauggggaacaguguuccaggcaguggaagucuuugagcccuuggaagaaagacaaggcgaucucuagagcacauccuucccaauauuaaugaauuuaacaaaugagcaagccauccucccccacucuccuucccgaauucagacuugugcauaucccucccuuaacuugaacugccaaagaagagaugagaaccaggagaagagaucugugaccccaucuuugcugaugaacuaccacagaacagccauggcaucuccaguccuugugcuuguaaaauguacuuuucauuuugcuccugaacgaaauccacccacccccacccccaaaccagggaaagcucaucuccuaauccaaaacugcacccagccuuccaccaccuucuucccugggaauuguugauuccagaguauggaauugaauaauuggaugaguuuggaagagaaaaagugucucuaaaaucaggcagcagaagcccacuccccagagaggauggugcagaugagaguucaggagggagcuuggcuugggguugacgaucugagcuaugcagggaacuuggacacaccucucaaucagucauucaacagacaccacuuauugagcaccgacugugugccagauguuguccuagggggcugggaauacaggaauacagcagggaacaaaaaggacaaagccccucccucuugucgaauggacauuccagccaggaagacgagagaacaagagaaauaaguaaaguauauaggcggugaaaugcaaaugggaaaaaagaaacaauggggaccagaaaugaggggugcaauuguaaagggccaucaggggaggccucccucagaagguggcauuugaguaaaaaaccugaaggaggugaggggaaaccauguagcaaucucaggaaagagcauuccaggcagggagggacagccugugcaagggccgagguaggacugugcuuggcgugguugagaaacugcaaggaagccagguggcuggaaccgaaugagcgagggaaaaggggaggagauaaaagcaaggagaugggaggguuggaggcccccucugccauucaguaacugaguaacuucauuuauuuccuguagcuugaaccacaaagaaccacaaauagaguagcugaaaacaacagaaauuuauuuauucucucgcaguucaggaggccaggaguccacagaccaucaaggucagcugggccacagaccaucaagaugucagcugggccauggugccuccugagacuuggucugaaaucccuucuugccucccuccuagcuucuggugguuugccaacagugcuuggugguccuugucuuguagacguaucacccugaucccgccuucaucuccauuucacauggccuucucccucugugcaagguugucucugugcccagguuucuccuuuucuuauuauuuacuuauuuguuuguuuguuucuuuauuuuagacacagggucuugcucugucucccaggcuggagugcaguggugcgaucauagcucacuacagccucaaacuccuggccucaagcaauccuccuaccucagccuccugaguagcugggacugcagaugugagccacugugcucugcccagauguccucuuuuuauaaggaaacccgucauuuaggaugagguuccacccuaaugaccugaucuuaacuugauuccaucugcaaagacccuauuuccaauucauagguaccagggauuaggacuucuucaaugcaucuuuuuggagagacccacugcaacccacaacagaacugugggcauguaacuugaccucucggccaggcgugauggcucacaccuguaaucccagcacuuugggaggccgaggugaguggaucgccugaggucgggaguucgagaccagccuggccaacauggucaaaccccgccucuacuaaaaauagaaaaauuagcugggcaugguagcaagcaccuguaaucccaacuacuugggagggugaggcaggagaauugcuugaacccaggauguagagguugcagugagccaagauagugccauugcacuccagccugggugacagagugagacuccaucucaaaaaaaaaaaaaaaaaaaauagaccucucugugccucagcuuucucacccgggaggauggggauaauuauauacccacuccugggguucaugagaggauuaaaugagcucaaacaguccaagccuccacgugugucuguuguggugcuggguagcauguccuguggccagagguucccaagcuugucgaggacccaggcaagggcagauucgggucuuguuggcagcaccugagauggacgggcugccuugguauggaagggccucggcuguuuuucccuuucaguccugucccucucccccauccuccacccugucccugucaucugagccugcuccucgugauggcucagagucucccuacuggcggccggugcagaguuucguucccugggcuauauuuagcccugagaaaugggaacgagaacccucagccgccaaagugauggagagaggagcacaaagccagugcugccuucuguccagcaauguuccgcugacucgguucuuucuuccagaaccuuccagaagcaaagcauuggcauuucugagcucguuaaaacaaggaugugggcugguggcuggcacauucauuguccccagaaccugucuguguccaugauuaaagcugacuuuguuaguuuuauuuucagugcuuuuuuuuuuuuuuaauccauggcaaaacacacaugacauaaaauuuaccauccuaauauuuuuuuuaacuuuguaacauuuuuuaauugacaaguaauuguacuuauucaugggguacauagugacguuucaaugcauauaaugcguagugcucagaucaggguaauuagcauauccaucuucucagaccuuuauuguuucuuucuguuaggaacauucaagcuccuccuucuagcuauuugaaaccauuaauauauuguugucauccuaaccauuuuuaaggauacaguuucgugaaauuaaguauaauacauucacauuguugugcaacugucaccaccauccaucucccaaacuuuuccaucuuccaaauguaacucuguccccacuaaacgcgaacucccuguucccccucccccagcccuuggcacccaccaugcuacuuucuguuuuuauaaaucugacgacucuagggaccuccuauaaauggaaucauacaggauuuucccuuuuaugacugguuuauuucacauagcauaaugcccucaagguucacccauguugcagcacguaucagcauuuucuuucuuuuuaagguaaaguugacuauuaaaaaaaaacuucugccgggcucaguggcucacgccuguaauuacagcacuuugggaggccaaggcaggcagaucaggaggugaggaguucaagaccagccugaccaacauggugaaaccccaucucuacuaaaaauacaaaaauuagccaggcaugguggcgggcgccuguaaucccaacuacucaggaggcugaggcaagagaauugcuugaacccgggaggcagagguugcagugagcugagaucaugccacugcacuccagccucggcaacagaguaagacuccgucucaaaaaaaaacaacuuuuuaagaauugaaguagaauaaacauacagaaaaauccgcggauuauaagugaagagcuugauuaauugucacaaacuaaacacauccauguaaccagcacacaaaugaggaaacagaaacuucucagccccagaagccccccucauauccuguuccuagucacuaccuccccgcaaggguaccccuaccaggacuuugagcaucauucaccaguuuagccuguuuuguauuuugcauaaaugaagucuggcuucuuuugcuugacguuaacuuuuuaagaucucaugugaccuguggcauuguucauugcauguauccucucucuccuauugauaacaguguggauuguuugcaauuuggagcuaugaugaauaccauugcuaugaauguucuugugugugcuuucuguuguguaauuauucagaauuacuauuucggaauuacuaucuaauuguagugaucuuggaucaguaacuauccaagaauuacuggguguuggcaaagguacauacaguuauacacugcacaauggcauuuuggucaacaacagaucaaauauguaacaguggucccauaauggaccgaauacauaacagugauuaucauacaguauuuuuacuauagcuuuucuguuuuuagauucuuuuuuuuuugagacgaagucucgcucuguugcccaggcuggagugcaguggugugaucuccgcucacugcaagcuccgccuucuggguucacgccauucuccugccucagccucccagguagcuacaggcgcccgucaccaggcccggcuaauuuuuuuuguauuuuuaguagagacgggguuucaccauguuagccaggauggccucgaucuccugaccucaugaucugcccgccucggccucccaaagugcugggauugcaggcgugagccaccgcacccggccuguuuuuagauauuuuuagauacacuauagaguuacaauugccuacaguauuccauagaauaacaugcuguauggguuuguagccuaggagcaauaggcgagaccaugcagccuagguguguaguaggcuauaccaucuagguuuguguaaguacacuccaugauguuugcacaacaaaaugaccuagugacacauuuuucagaauguaugcccauuguuaagcaugacuuaauuuuagcauagaaacucucaaccaauuuuucaaguaguuguaccauguguuauggguuuuauugucucaccccaaaauucauauguugaaguccuaacccccaguaccucagaaugugaccuuauuuggaaauagauucauugcacauguaaagguuuugccauuggcaaaacugccguuauuuuugcaccaaccauagcaguuaagaugagaucauuaggguggguccuaaucuaauacgaugguguccauauaaaaaggggagauuuuggcacagagacaggcacacucacaggaagaaugccauguuuaaacaaaggcagagcucaggaugaugccucuacaagccaagaaucagcaaagauugccagcaaaccgccagaagcuaggagagaggcauaaaacagauucugucucacagcucucagaaggaaccagcccuucugacaccuugagcuuggauuuuuggccucuauaacuguaagacaauaaaucuuuguuguuuaagccaccuagguugugguuccuuguuacagcagccacaggagaugaauacagcauggugcccucccauuggcagauuaugaggguuccaguugcuccacagcuucacagacaccugguaguaaugaccucaucuuaacuucuuucucauuuuagccuuucuuccaggcagcagcagugucauacaugcuuuuaaaggugggcuuuuaaagccacacuugagagcccugcauucugcaggugucacagggugaucaacuauucaaaggcuaccccugcccugacagcuggaggcaaggcuucccagcacagagguuaagcccauggacucuggggccaggugguuagugcaaaucccauguccacuagugaauaacucugugaucuugggcugaugauuuugucuuucuaagccucaguuuccucaauaguaacaugggcauuauaacauagaggcaucaugaggauuaaaugacuaagugagcuaacauacauaaugugcuuaggaaggugccagcacaccauaaauacucuguaagugcuggcuuuuaucauucuuuucucucucucucucucucucucucucucucucucucucucucucucccucucucucucugucucucuuucucucuccaccccccaaccuccucuccuugauuuucuuccccucaucuuacuuccuucuugcuauaguguucuauuuucuguuucagagaguauucuauuuguggacuuuuuuccucuugaaaauugagcugaaacuucugagaauuuuuugugauuggcauuaaggcugcagggaauggagcagggagacacuugaggaaagggcucauggaccaucugucuggcuuggugauuucaccaggccaucagacucuguggucaugcaucuccucuaaggggagucuaugacuguguugggagaagagaaggaaccagggauuaauuaauccauuucaauagguuuuguguuuuguuugguuuacuuuuuccuucuccuucuggacuguggucugggaaguccucuuguguuucuuacuccauucccaggucaauuauguuaugugaggagaacauaauuaagagagagcuuuacccuuuggauguuuucuucagaaaacguuccuccauuucccccucugggaugccagagccccagaacuccacaagccaagaacauuuaagacagagccacaagagaaccgagcuuccccuucccucaccugucagguucuaucugagucccagucaacucucaccugcuuucccuccucacacccuacagagcaacgaugccucagggaacacuuggaacugguuguacuucaucccccucaucaucaucggcuccuuuuuuaugcugaaccuugugcugggugugcugucaggguaaguuucugcuacuccccaccccaucccacucacuccucuuugcuaacuucuuuccaaguagaggccauugaagcuuuguuuucauucacuagacagagaaaaggcuucuucccuuguuuggguuaccagacuguuauuagcaagccaugcacaggugcagagguuguguacugcuagggguacccagugagaggguucauaugggcuuuacuuucuuuacauuuuuuuuaaaaaccaauaguuuggguuuacuucucccccauuuuccaaauauaaaaucauagcauaugcucuaacgguguauuuuccugacccauauuguccucuauccccaagauuuuuuuggcuuaaucauaaaugggcuucauuuuucuuaccauaagaagucugggcacuuguaugguggcucuauggcaccaucagcaaccccagauucuuccagcuuuccauucugacaucuuuaccagaggcuuccaaucucguggauaccucauggucuuaagauggcugccucacgcccuccggauggccacuucauguuccaaacaggaaaaggaagaagggaaacaggaagaggugggaccuauggcagagaagccaaccugcugcagaaaucuuucauucauggcuuauuggucuaacuuaaaagagggcugaaauaauuauuagccaaaaguaugaagagaaugagaaugagguaugcagccaguggugguuggcauggcaugguuuuauccuuucgguuuuuuucuuuuuuauuguuuuuuuuugagacggugucuagcuuuauuacccagacuggaguguagggggcgaucauagcucacuguaaccuagaacuccuaggcacaagcgauccuccugccucagccuccugaguagcuaaggcaacaaguguaugccaccaugcccagcuacauuuuuuauuuuucauagagauggggcccacuguguuguccaggcuggucucaaauuccuggccuuaaaugauacucccaucucagccucacaaagugcugggauuacagacaugagccacugugccuggccuuuuucuuuaccuaggcacaguugucgggaaaugugugaagcuggcagaagcacccaucacuauaauaucccagucuuuucccagaaguccugacuccuccuguugaaaacuccugaccuccagggacuucugaauccccaaacacacacacacacacaaacacacacacacacacacacacacacacacaaacacacacacaaacguuuccuaacauuuucaaaacagccauacucuggcuuuucuaugcuucuccagggaguuugccaaagaaagggaacggguggagaaccggcgggcuuuucugaagcugaggcggcaacaacagauugaacgugagcucaauggguacauggaguggaucucaaaagcaggugaggcccuuucauccuggggcccagggauggagaucccaggccacggaguacaaagagagucaugcaguuuggagaaggcuaagcugggaggguuaugaugggaggagaaagagaaccugaauugguagucccaaauuuuaucaacaagaauccagagucugauaugaagaagucuaagaugaagccaggaucugacaucacguaacuugaauucugaaaucagacgcugguuuacaucccggcccugccacuuuuuacccaugcaccacacaucccuguaccuccguuuccucagcuguuacauggaggcgaugguagugccuaagucauaguacuauuggaguauuuaguaaaauaaucucagcugagucacuuggggagagaagugccugauacacgguaggcacauauuuauuuguucagccauuuaacaaacauuuagggagcaccugcugugugccaggcacugaucuaagcacugaggauaugggaguaaacaauacacaccaaaucccugcccucagagcucugauauucuaaugagagagauaaagcaaacaaauacaugucauguugggaacucccaaauucagagaaggaagauaaaacagacuaggaagauaaaacagaguaggaaguuggccgggcgcgguggcucacgccuguaaucccagcacuuugggaggcuaaggcgggcagauuuccugaggucaggcauucgagaccagccuggccaacauggugaaacccugucucuacuaaaaauacaaaaauuagccaggcaugguggcgcacgccuguaaucccagcuacucgggaggcugaggcaggagaauugcuugaacccaggaggcagagguuacagugagcugaggucgcaccacugcacuccagccugggcaacagagugagacucugugucagagaaaaaaaaaagaguaggaaguuagaggcaggguggucagggaaggcuucucuaaggaaguacccucugagcagagagaccugaaggacgugaagaaggaagcuguggggaugucaagggaaggggcauuccaggcagagacagcaagugcaaaggcccugagcuaggaacguauuugagacacagcaaggaagccagugcagcugaaacagagugagagguggggacagcuggaggagaggaagacaggaaggugauggagaucagaucaagcaggggcuuauaggcugugguguggacauugguuuuuauuuugcgcgagguggggagaauguuggcuauugcuacuguugcggagguggggcuugaagucacaaaccacccagcagcauguuuuuuggucgguugagcugucaccaucagucagcagagaauggggguggccgggcagacccuucuuccugguccaagggagaacucauccuccaaaugcaggagcuuaacucugugcucuuccucuucagaagaggugauccucgccgaggaugaaacugacggggagcagaggcaucccuuugaugguaacugcucuaaacccaccucaggggugggucccaggggagaagggagaagcugugguggggagucgggggagagcaggugacugguucuaaggaucuugcagaggguagacguuccucuuggaggaauuuuaggacuuccaugcagaguuucccuauucuggccuccacuuuuuuguuuuaaccauggaccugguuuuuucugcuuugugccuugguuuuucucaucugcaaaauggguaugauauaaacaauacccuagcucacgagauuguuucucagaaugauauucguuauggcaaauagaacaccugggauagugccuggcauggggucagcacguuucuguuugcuaaauaaguaauaauuccaccaauaauccaguuuacugugaacggcugcugucucccauguuagaaacuuaacgagacagaaccaugacuuucuuucuuuucuuuuuuuuuuaauugagacagagucucgcucugucacccaggcuggagugcagucacacgaucucaccucacugcaaccucuggcucccagguucaagcaauucucugccucagccucaugagaagcugagauuacaagcaugagccaccaugccuggcuaauuuuuauauuguugauagagaugggguuucgccauguuggccgggcuggucuugaacuccuugccucaaaugaucugcacaccuuggccucccaaaaugcugggaguguagaugucaauucaugguccccuggaaaccugaauaugaaaggagggaccauuaaaaagguguccaaaagcccaaccuccccagcauagcugggagucaggggacagacuguaagagucacuguguauccaaccugaggcuucaugaaaguaaaguuuccuagaauuuagagauaggguuggaugcggucugucuguggcucacaucuguaaucccaacacuuugggaggccaagacaggaggaacacuugagccugggaguucaagaccagccugggcaacauaaugagguuccgucucuacaaaaaauaaacuuagccagaugugggggcacacgcaccuauggucccagcuacucaggaggcugaggugggaggaucacuugagcccaagaggucgagguugcagugggcaccacuccacuccagccugggugacagagugagacccuguuucaaaagaaaaaaaaagaauuuagagauaggccagaauaauaugucugcaauauaauaauaacagcaauaagaaaaauaauaguacucccugaaaaaugcaacuucuugcuugagauuuaucuucucauacuuuagaaaacugguuagacaggggcugggcgugguggcucaugccuguaaucccagcacuuugggaggccaaggcggguggaucacuugaggccaggaguucaagaccggccuggccaucauggcgaaaccccaucucuacuaaaaauacaaaaauuagcuaggugucauggcacacgccuguaaucccagcuacucaggaggcuaaacuacgagaauugcuugaaccugggagacggaaguugcggugagccgagaucacaccacugcacuccagccuaggcgacagagcaagacucugucucaaaaaaaagaaagaaagcugguuagacagggugaugacuuuugauuaaaaaucugagagauuugagggaaauaaaagaacuggcacugcgucccagaagguuauaaaaugaauuuuauuaucuuaguuggggaggggagauuaccuaacuccccuaaaugaguuagguaaucuaacucauuuaggguaccuaaaucuuuuuauuggaagucuacaccugaacuugucugcuguggagccccugggguguauagcuugaauaugggggcagaaucccaaaauugcagccugccuagcgaguaugcuacaggucaagggguggacuguuuucauaagaaagugagguuucuuagaauuuaaaaauagaggcugaguggggcggcucacgccuguaauccuagcacuuuuggaggccaaggcaggcaaaucacuugaggucaagaguuugaccagccuggccaacauggcaaaaccccaucucuacuaauaauacaaaaauuagccaggcgugguggugcaugccuguagucucagcuacucaggaggcugagggaggagaaucgcuugaacucaggaggcagagguugcaguaagccaagaucacaccacucucugggugacagagcaagauucugucucaaaauaaauaaacaaauaaauaaauaaaccagaaggaaaauaguggcugagggcccagaccuggagucggacugaacccgacuugauucuugucuuuaccccuuuaagcaaagugauagugccaccuugaaccucaguuuacacaucugaaaaauggguauacuauuaguucccgugagaacaguugccgugagaguuaaauccaaggacacacuguguccauauggucuguguugcaaaaaggguaacgucuuuuucucuugccauguuuccauuguuggagcucugcggagaaccaccauaaagaaaagcaagacagauuugcucaaccccgaagaggcugaggaucagcuggcugauauagccucugugggugagucccuuccucugccaccuaucaguuguucaucaccuaucgcccaagagacaugguggggugggggcagagggcuugcaaaccgugcugccuggauuugggucucagcuccacccuuucccaccugugcguguguccugggcagauuacaucauuaugggaauaacauccgugccuagcuucucauuauuuugugggaauucaacuaaaugauccccaugaagcauggcaaaccagcaccuggcagggacgaagcucccagucaaguuggugaauguuugugacucauucgggaaguauucaugggggaccugcuuauauuaggugcuugguugcaaacaagacaaggcagucacgaggcugagcugggaggaucacuugagccugggaaguggaggcugcaauaagccauuauuguguuacugcacuccagccugggcacagaaaaaaaaaaaaagacacaaacugagccaggcacaguggcucacgccuguaaucccaacacuuugggaagcugagaugagcggaucaccugaugucgggaguucgagaccagccuggccaacauggugaaacccuggcucuacuaaaaauacgaaaaaaauuagccuguaguuccagcuacucuggaggcugaggcgggagcaucacuugaaccugggaagcagagguugcagugagcugagaucucaucacugcccuccagccugggcaacagagcaagauccugucucaaaaaaaaaaaaaaaaaaaagacacaaaccaaaucccuaccuacauggagcucacaguccagugcaggaaauagaaauuaaacagagaauuacacaaauaaaccuguaaugguaauggcacuucagggagaggcucugggcuuagcuugcucuagaaggauggggagcagucagggaaggcuaccuggaggaagugacgguuaagcugggaacugaaggauggguaggagaucacugugguggugauagcagaaggaacagugugagaggcagggcucagaccuuugccaccacaagggccagaguucgagggaggagggaacauuuauucuuucccuucucacuccucuguccuauugauucauuggcugugaugauguugauuuugaccuucuaaagugagaauguauuguuauuguuguuguuguucuuuaauggguuuuuguuuuuaauggaaggaagagcauccaggcagaggaaauaagacuggaauaagauugaggggagaaggaauuuaggcugcuugggaaacuguguggccgcaguuuagaggaagaaaggauggcaagagaaagaggaagggaggaagagaaggagggagagaagugaaggaaggagggaaguuaguacauccauguguuucugauccauaguuucugauccacuauuucguauuccccuuuuaucgcucgccccuaguuuauaaccuuauugcugaguuuaggcauaauuuccauugcgaucacauaucucguaggguggauacacuaugguuuguuuagccauagcucuauuauaggguguuugaguuguuuccaauaauuucucuuacgaagaacacugcugugcacauuuacguacaaugacuccccccacccuuugggcguauuuccuuggggauaauuauaggaucaaagauauuaacagcuuuucaacucauuauucaaagagccauucugaguuucaaaaacauggaacccauuuauaaaccugccaaguaugcauauguucauggauuccccacccaggccaucgaauauuaccaauuuaauuuccuuucccaguuaaguggguuuguaaugaaaccuuaaagcuuguuuucauuugcauuuuuaauuuccagccaaaacacgcuuuucuuuguaauggagaacucauucugcuuccacucgugugugcaucuguuuaauuuccuguaagcaaaugucaagaauuggagcgcucaguaggugucuugaguauuugaucaauuaugucugucucacguguuacguuaccuccauuguuuaaaaucuguuuuaugacgagguacagugguucacgccuguaaucccacugcuuugggaggccagugcaggaggaucuccuaagaucagccguucaagaccagccugggcaacauaacaaggcuccaucucugaaaaacaaaauguugaaaaacuuagccaggcauuauggcacacaccuauagucccaucuauuuaggaagcuaaggcaggaggauuucuugaacccaggaauucaagguugcagugagcuaugauugugccacugcacugcaacgugggcaacagagugagaaccugucucuuaaaaaaauaaaauaacauacauucuuaaaaaucuacuuugcuggccgggcgcgguggcucacgccuguaaucccagcacuuugggaggcugaggcggguagaucgcuuaaggucaggaguaggagaccagccuggccaacauggugaaaccgugucuguacuaaaaauucaacaauuagcugggugugguggcgugagccuguaaucccagcuacucaggaggcugaggcacaaaaucacuugaacccgggaggcggaggcugcagugagcugagauggcgccauugcccuccagccugggcaucaagagugaaacuccaucaaaaaaauaaaaaaucugcauauacauauauauguauauauauuuuuaauuuuuuuaauuuuuuuuuuuuuuucugagauggagucuugcucuagcacccaggcuggagagcaauggugccaucucggcucacugcagccuccgccucuguuaacaaggcaggugacauugcagcuuucuaaacagacccaaaacccaggccaguggcuuguucuuucauagccacguuugcuacaggcaaauccaccaaaacccaccucaucagccugauuacucaaaaagacaaagaaaggagcccccaaucuagccagugguuuucuagaccaccccaaaagagaucucuggaauuccaggauucuggcaaggaaucacauuuagcuuuauuuauuuauguaaagaaugcaacaauacaggcugggugugguggcucacgccuguaaucccaacauuuugggaagcugaggugggaggaucguuugaggucaggaguuucagaccagccuaggcaacauagugagacccugucucuaucaaauauuagcugggcauuguggcacacgccaguagucccagcuacucgugaggcugagguggaucaccugagcccaggaggucaaggcugcggugagccacagcaugccccugcacuccagccugcgugacagagacuucaucucaaaaaaaaaaacaaaaaaaaguaauaauacaguaaugcauauuucaaaguaaggugggagcuaugugguauuugcguucacguucacauuauaccacaguaugcacaguccuuuuuuuuuuuuuuuugagacagugucuugcucugauguucaggcuggagugcaguggugcaggcauagcucacugcagccucaaaccccuggacucaagugauccucccaccucagccucccaaguagcugggacuauagguguacacugcuacacucagcuaaguuuuuuauauuuuuuacuagagaugggaucucaauauguugccuaggcuggucucaaacuccuggccucaaacaauccuccuaccuccaccucccaaagcagugggauuacaggcgugagccaccacaccuggcccacaugcagucuuauauaauuggugauucuacugcgcuguugaaucaguugauaaacgcacuauaaagcagguucauuccuaauugaugaacuuacugcugaaauaaggaacuugaaucauuuacaugaaaaguugagccauguugcugaaaggauaucaauuuuuuuuucuuuuuuuucuuuuuuuuugagauggagucuuacucugucgcccaggugggagugcaguggugcgaucucggcucacugcaaccuccaccuuccagguucaagcgauucucccaccucagccuccaaguagcugggacuacaggugcacaccaccacgcccugccaauuuuuguacuguuaguagagaugggguuucaccauguuggccaggcuggucucaaacuccugaccucaagugaucugcccaccucagccuccgaaagugcugggauuacagguguuagccaccgcgccugacaggauaucaaauuucauuuagacugcaggaauacguucaagagaucuauuuuguacagccuggcgacuguauuaauaacaauguauuauauacuugaaaauugcucagagaguagguuuuaagcauucucaccgugagaaaagugauaagcauauguaauaaugcauauguuaacuagcucaacugagccacuccauaguguauacauauggucaaaauaucauguuaugcacuauaaauagauacagccuguaucugucaauuuaaaauaaaugaauaauaacuuuaaaaagaaaaauaacaguauggcugggcacgguggcucacaccuguaaucccagcacuuugggaugccaagacaggcuugaggccaggaguuugagaccagccuggccaacauggcgaaacuuugucucuaauaaauauacaaaaaucggcugggcauggaggcgggcgccuguaaucccaacuacuugggaggcagaggcaucacuuaaccugggagauggagguugcagugagccaagaucugcacuccagccugggugauagagugagccuuuauuuauuucuguaaagaaugcaauaauacaggccuggugcgguggcucaugccuauaaucccaauguuuuggaaggccaaggugagaggaucauuugaggcuacaggcgcaugccacagugcccagcuaauacuugauagagacacggucucgcuauguugcccaggcuggucucaaaacccuggcuucaaaugagccucccaccuuggccucccagaguguugugauuacaggugugagacacuguaccuggccuguauuaaaaaaaaaaaaaagaagaagaagaagaagaggaggaaagaagaagaaggaagaaggaagaagaagaagaggaggaggaggaggaaugggaaggggaaggggaagaagaagaggaggaaggggaaggggaagaagaagaggaggaggaaggggaaggggaagaggaagaagaagaggaagaagaagacgaagaagaagcacaaugauaaauaaguaaaauguggagcauaugaaaacaaaacaaaaaaaaguugauccauuaugaauggaagcugccauuguaacucugcuuuuuuaggaaaaccagaccccauuuagaugauuuuauuuguuuuuaaaggcagguucuugcucugucacucaggcuggagugcagugauaugaucauagcucucugcagccuggagcuccugggcucaggcgauccucccagcuuagccucccaaguagcugggacuacaggcaccaccacacccagcuaauuuguuguuguuguugauguuguuguugagauggggucuggcuauguugcccaggcuggucucaaacuccuggccucaagugauccuccugcccuggcuucccaaaguucugggauuacaggcaugauuuuuuauuaauuuauuugcagcugacaaaugguaauuguguauguuuauggagugcagugugauguuuuaaucuauguauacaucauagaaugauucagucaugcuaauuaacacauccaucgccucaccaccucaccguuuuuuguguguggggaaggcauuaaaaaucucuuagcaauuuugaaauaugcaacacauuacuauuuauuaauaaugcaauauaaauacacaauaauguauuaaugcaucacuaaaugcgaugcaaugcaaugcaaugcaauagaucacuaaaacuuacuccuccagucuaacugcaacuuauacccuuugaucaacaucuucuccuucucaaucccuccuccuccccugcagccuccaggaaccaccuuccugcucuuucuaugagaucaauuuuuuuuaguuuuaagcucccacaugugagaucauacuguaauugucuuucugugccagcuuauuuuacucaguauaauguccuccaguucugucccuguugucacacauuacagaauuucuuucuuuuagggcuguauaguauucuauuuguauacauaccacauuuucuuuauccauucauccauugugggacacuuaguuugcuuccauauuuuggcuauugugaauaaugcugaagugaacgugggagugcagauguucugaaaagacuuaaaugucagaccugaaaugguaaagaugcuccaagaaaacauaaggagaaagcuccauggcauuggucucgggaaugauuuuuuggacaggaccucaaaagcacaggcaacagaagccaaaauggacaaaugggaucguaucaaacuaaaaaauuugugcacagcaaaggaagcguucagcagaggaaagagacaaccuaaggaaugugagaaaacguuugcaaacaauacaucugauaaggagcuaauauccaaaauauauaaggaacucaaacaacucaacagcaagaaaacaacccaauuaaaaaugggcaaagacagcuacucgggaggcuaagaugugacgaucccuugagcccgggaggaggagguugcagugagcugacauugcaucacugcacuccacccugggcgacagaaggagaccgagacccugucucaaaauaaaaaauaaaaaugugcaaaggaucugaacauacauaucccaaaagaaaagacauacaaguggccaacagguauaugaauaaaaugcugaacaucacucaucaucagggaaaugcaaaucaaaaccaccauuagcuaucaccucacaccuguuagaguagcuauuaucuuuuuguuuguuuguuuguuuuuuguuuuuuguuuuguuuuugagagggagucucacucugucacccaagcuggagcgcaguguugugaucucagcucacugcaaccucugccuccuggguucaagggauucuccugccucagccucccgaguaacugaaauuacaggcacacgccaccaugcccagcuaacuuuuguauuuaguuucacuauguuggucaggcuggucuugaauuccugaccucaaaugaucugcccuccuuggccucccaaagugcugggauuacaggugugagacacugugcccagccuagaguagcuauuaucaaaaagacaaaugagguuuguugaaguucuaaccccugguaccugcaaauguggccuuacaugaaaauagggucuuugcaggugguaaucaaguuaagaugagaucaaacuuaauuaggguggguccuaaauccaaugacugcugucuuuauaagaggagaagcaggcugaccaacauggugaaaccccaucucuacuaaaaauacaaaaauuagcugggugcaguagugcacaccuguagucccagcuacucaggaggcugaggcaggagaauugcuuaaacccaggagguggagguugcagugagcagacgucaugccacugcacuccagccugggugacagagugagacuccaucuuacaagaaaaaaaaaaaagacaaaucauaacaagugcuggcaaggauguggggaaacggggauccauuuacaucauuuuaauaacacaggcucuauaugggugguauugaguucccagaguugccauuacaaaaugucacaaacccaguggcuuaaaacaacagaaauuucuucucucacaguucuagaggccagaaguccaaacugaaaucaaggugucagcagagccaccacguucccucagaagguuuuaggggagaaucuguuccaugguauuuucuuaguuucuggugcugccagcgauacuugguguuccucaguucauagaugcauaauuccagucucugccucuguugucauauggucuucuuucuguguuucuguaugcgauuucuuuuuuuuuuuuuuuuuucugagacaagucucacuccaucacccaggcuggagugcaauggcacgaucacagcucacuacaaccccaaccucacaggcucaugccguccucccaccucagccucccgaguagcugggauuacaggcgugugccaccaugcccggcuaauuuuuguauuuuuaguagauacgggguuucaccauguuggccaggcuggucucgaacuccugaccuuacgaucugcccaucucggccucccaaaguguugggauuacgggcacgagcccaccgcaccuggcccuaauuacuuuauuuuuuuguaaauuuuuuuuuguaaauuucauguagccugagcauacaguguuuauaauauauacaggaguguacaauaauauccuaggccuucacauucacucaccacucaacucacucccucaccaagagcaacuuccaguccugcaagcuccauucaugccaaguacccuaugcagcugaaccaccuuuucucuuuuauacuguguuuuuacuguaccuuuucuauguuuagauauguucagacacacaaauacuaugauguuacaguugccuacaguauuaaguacaguaacaugcugggcagguuuguagccgaggagcuacaaaccacguagccuggguguggaguaggcuacaacaucuagguuuauguaaguucacuuuaagaugcucacacaaggacaaaauugccuaacaaugcauuucucagaacacgucucccucauuaagccacacauggcuguauuacaauuuacauauaauuuuaagcguauauaaauugccagaaaucaccagaugaauccuuggcggugacauaccccuucccccaccauagaacauugcagacuggcccggacgcccaguaucucaugccuguaaugccagcacuuugggaggcugcagcgggcagaucacuugagguuaggaguucgagaccagccugaccaacauggcaaaacaccaucuuuacuaaaaauacaaaaauuauucggacgugguagugggcaccuguaguuccagcuacuugggaggcugaggcaggagagucacuugaacuugggaggcagagguugcaaugagccaagaucgugccacugcacuccagcccgggugacagaaugagacucuaucucaaaaaaaaaagaaaaaaaaaaaaaaaggaaaagaacauuucagacugguaccaguuacaccggcucuugaucccuugaauguggcugacccugaacuaggauguacuucauaauaacacguccggcugggaauacuuaguacaaaagaaagaguauaaaauaucuuuugaauccaccuugauauugauuccauguugaaaugguaauauuuuggauguauuggguugaauaaaacaucucaugaaagugauuuuuaaaaaucuagaaauugucugcaauuauaauuccagaccacagagaaaaacgagagacaggaauguauagaaaaagggaacgugggacaaagugaguaugaaauucaacuaacagaagugacagugccuagcaugggguccagcacuuaguagguguucaauuaauauucauuucccucucccuuaccagugaaggguaugccugucguggggaaugugucuucaggcugagugaucaggaaggacuuucucaauggcuggcacgugaaccuagucaugauuucagcucuugagguuguacuagaagauuuauauccaauaaucguaagguaccacuuagcaucacgcuaagauguauuaauucauuuaugccuuuggauggcccuuugagguaggaagugugguugucuccaguuuaccaagguggcuugcccaaggucaucugcugguuggugauuaagccagguuuucaguguggcuccagcaggagugggggcuggggaccuucuaccugcugugguuucucucucucucucucucucucucucucucucucucucgaucuguggaacauccccccugucccccaaggucccaagggucuuauuucuuuuggccaagcccuuuggagaccugcagaucuggacacaucuuugagaguuucaggaacuagggccagaaaugcugggcagggucaugaggagcugccacugggguugagaaggugauggacaugaggggaagggucuuugcagaaaggagaggcgucccuguaagcaggucacagccacugggccuggccaacugcagccgaguggaaugugccccugccccaugaccauaugccccaggugugcaauguggcggcccagagcacacacucugaaccaucuugacacaucuucacugguuacuagaccccccucagccuguuuccuuggcuguaaaauggggaugacgcuggucccuacuuccuagggcucugagcaggaguaaguagcuugucguauaaaacauguucccugcagugccuggugccugcuaaauguuccauaaacgucagcuguuauuuucauucaggggaagcugaaauccauauuuucauggaaaaucucccaguuuuuaaauguggaccaauaauuucagcuuucacaaacccaguaugagucgguauggccccuagggugccaacucaaaaucucuguugagaauuuugcugauaggaaguggccuccuuggagguguuugcuguguccugugucuggcaaguggggugguuuugauaaacgugcuggauggauguaugggugaauggauaaauggaggaaugaauggagaaacaaaugagcaaaugaauaaugaauggauggaugaauggaugagcgaauggauggaugaauggaugagcaaaugaaugauguacacacaaaggaauggauaaaugaugaaugugcuaaugaauuuaagaaugaugaaagaaugaaugaauaaaugaacaaauggauggaugaaagaaugaaugaauguacuaaugaaugaaucaaucaaugaagaaccauuuaaaaaugaaugcaacugaggguuuauaagaaaagguaucuuaagccugggcaugguaauucaugcuggaaucccaaugcuuagggacgcugaggcgggaggaucgcuugaacccaggaguucaagaccagccugggcaacacagggagaccucauugcuaccaaaaacaaaauuguuuuaauuaagcgggcauggugguacgugccuguagucauagcuacuugggaggcugaggugggaggaucgcuugaacccaggaguucaaggcugcagugagcuaggaucaagccacugcauuccagccugggcaacaaagcaagauccugucucaaaaaaaaaaaaaaaagauguauuuuagaagguaaauucaaucuguccaaaacugagcucugaccuuccccuaaaccugugcccauucaguggaugagagcuccaucccuuaagggguucaccaauucauccauuccuuuguauguacaucauucauucaccuuggcucaucccucucucuuacauccacaccguuccaucagcaaauguugaaucugucuuaaaugauucaucccaaauccuccccgcuuaacuaccacccaacuccagcccccauccaucaucaucaucacuugccuggauggguucagucaccuccagccuggucucccagcucccguccucaccucucacugucuacucucccacucggcagccagagggugccugugaacacccaaaucagguuccaucccuccucuacucagaacccuccacggcuccccccucacucaggguaaaagccaaaguccuccuugugguccaccaggccaugcaugaucugccugucaccucccugccuucaccaccuuccucuuuuccccucaaccacuccacuccagccacacugacuuccuugugcucuuccccaaaaaugucgggcagacacauucaugcuucaggaccuuaaauuugcuguuuccucuaccuaagauacuaaagugacaagucaacacacucaccuugaccaugcaauuuaauguugcagccuacccuguggacucuccaagggcucccagucccucugugaugcuuuacuuuuucucuuaaaaaaaaaauuguuauuuaaaagaacuugucucgcuguguugcccaggcuggugucaaacuccuggccucauacaguccucccauuccagcuucccaaaguacugggauuagaggcaugugccacugcacccaucccaacuuuuuuuuucccauagcacuuuucauuuuccaucccacuguuaauuuacuuauuacguccacugucugucuccuccccuuagagggucagaccccggaaguccaggcucuguugccuaauguauccugagccccuggaacagagccuggcacaaaauagguacucaauaaaugcauaagagcaaaacuauauguaggcagaggacacacccagcuuauuccucagugaucacuucuaaaguuaaauguccauggaaaacagucucauccacaucucuuucuggaggccuuccaagcgugcuccaugcagcucuguugccugccccugcaucagggaauggaggcucugcuuuauccugcccuguggugugacucccagaggcaucagauguggcugggagugggagacauggaaaauuggcuccugcaacagagaacuaucagccuucccaucaauugguuacuucuaauucuguuauuuuucaggggcacugucuucucauaagcuccaucuaugcaaaacuaagcccaugggucaugaugguucccucaggccagaggcuugcuggagagacuaauggauccccuggcuaaaaucugugcuugggcugcacauugguuaauuucuucugaaggaacagccugagccugacauucuccaucuuuucccuggcagguucucccuucgcccgagccagcauuaaaagugccaagcuggagaacucgaccuuuuuucacaaaaaggagaggaggaugcguuucuacauccgccgcauggucaaaacucaggccuucuacuggacuguacucaguuugguagcucucaacacgcuguguguugcuauuguucacuacaaccagcccgaguggcucuccgacuuccuuugugaguaucacccagccccaccccugccaacucccugaucccucccucacacccuuuuuccacuucucuuucucugguaguauguguaucuucuuugguccucauugaaucugcccuuuccuuuagccauuucuauaacugucacuggggccaauguuacuguugcuaugacaauggaacccaucucccuuagaccugagagcuggaagcuggaauucagaccaacaaaugcuccugugauuccuuucuaagagagagggacagaggggugcuggugaaggggauguuggaagagagacagagaaagacggagcucauaagauagacagauagaaacagaaacauacauguauuaauaauuuuuauguacaucucuggaaauguucauaacuuaugguuaagagaggaugccuuagaaauaaggaguggcuuauauguugcccucauuuucucuacuuauuucugacucuacuucucucuucuuucaaaccuucugcuucuuuccuguuagguuggugcaaaauuaauugcguuuuuugccuuuuuuuuuuuuuuuuuuaaccacaguuacuuuugcaccaaccuaauacuuccuccccugcccuuuuuggcuuccuuauucauucauagaacauccccuccaguaucugcgagagcguuuugcucccucaagguacaaggcccacuaaggcuuugcccucugggccuauucccagauucuaugugaguuagcaugagauaguaucaaaauugagggccaagugagggugaggaaaagcagcaaaagauggggagaugucugagcaggauuuaaaaaguaaagagcucgaggaaucaacaagagcagcgacuggggccaggcaugguggcucacaccuguaaucccagcauuuugggaggcugagguggguggaucacuugaggccaggaguucaagaccagccuggccaauauggugaaacccugucuuuacaaaaaauacaaaaauuagccagaugugauggugcacaccuguaaucccagcuacucaggaggcugaggcacuagaacugcuugaauccaggaggcagagguugcagugagccaagaucaugccacugcacuccagccugagcaacagagagagugucugucucaaaaaauaaaguaaaauaaaauaaaauaaaauaaagaguagugauugggcagugaggggggcagguggaugcccuggcuuuggcucacaggccccaaguaaggacuucucaaaacgucuuuugccuacuggcugucuaauuuauucacugaccuucugaccugguucagaauugacuuaggacagcaagaagagacagucuagucuuugaccuagaaaggcccgugagccuaguccaggccauugucuucuuauaacccuccuuguucccagucacguuggcugaccccccaggacaccccucaggaaccaguucuccuucccagggcccugaccuaguuucaaacuuaguaauuguuuuuagucccucuggagucucuuauaaaugaggacucuacuucguguuuuaacuuccucuaauacucuauuuuuaaucuccuauauucucucuacuaaucaucuuguacagucuguccugguucaggaacaagggacugagacuuccugccuggguccucagugucuauaaagguccuuuacucauucccacuuucccuuugagaaaacugagacacagagagguuaaguagauugcccaggaucacacauuagcuuggcaugauggcgggcgccuguaaucccagcuacuugggaggcugaggcaggagaaucgcuugaaccugggaggcagagguugcagugagcccagaucaugccacugcacucuagccugggcaacagagcuagacgccaucucaaaaaaaaaaaaaaaaaaaaaaagauacacauuaauuucagagaugucaaaauauaaacaaaaauguauaucuuggcaucagugaaguguaguuguuucucuggaucucagacuccacaucuaugugguagaaaccggauuugaugguccugaaaguucuuccagaugcaacaaugcuaaggauaaguaauucuuucaagucuugugcaucaccugcuaucauguuuccaugguaacugaggaacaagaucucagaaacucuucaguccucccagaguuacuucuggugggucuaggaaugugucagauguuacaaacagacuuccucugcugauauuuugguccuaggaacccuagaguuccccucagacacuaagaucuccuuagcguccuauaaauaaggagaaauuuuggugauaaauacugugaaggacuuugacggucaguucaaaacaccucuuaaaagcaugacauagcaaacacccuuggcaaauaucuuaguucauuuguacugcuauaacaaauuacccgagacuggguaauuugauaagaacagaaauuuauuuucucacaguucuggaggcugggaagcccaagaucaaggcauuggcagguuucccugucuggcgaaagcuacucucugcuuccaagauugcaccuugaacacuguauccucuggaagggaggaacacuggguccuuacauggcagaagguggaggagcaagagggacaaacuuccucugucaaccucuuuuauaagggcaccuaaucccauucaugagagcucuaccguaaugacuuaaucaccuccugaaggccccaccucuuaauacuguuacauuggcaauuaaguuucaacgugaauuuuggaggggacacaaacauuuaaaccaucacaaccaccaaacacaauuagcuuuguggccuuaauuagcuauaugaaauucauggaaguuaguuucaguccucugucucuuuccuuucuguaugcuuucugcuccucagaaacccuccucaucucuccuuucuauccauuaaguacccacgcccuuccuaacuccucaucuuccuacccuaccaagaaagcccucucagaaaaggaucugaugucagccauuuauuugcuggagcaaaugcauauccauguuuuaccccucccugaggcauuugcaauuuuaugcuugcucaucaaagaacaaaaggcuuugucuuacucaagacuuuuuaggucacucacaacacaggauuucuaggggacauaagacaaguuuucugaguuaggagaaaagccauaccuuagguggguugccugugucgcuccaacuaaguacuuaacuucaggauuacaaauaggauaucauuaugauuucuauuuccuuuuauccuuuggagcucagucacguagaaguagauuaaauauaauuguuagaucacagcacccuggcauuauggggccguuaugguccauuguuauuaugugaauuauucaguuaauuaguuuauuuuuuaaaugugauaaacacccaggaacccaccagucaacacaaaaguccuuggcaauaaucuauauccgauccuucucaucgaaccagggcaaaaacuacaagauggagacccacugauauuuuucucauuccuuuuaaaaucggccuaagguugguuagcuuguugguuggaggguagggcauaauuguugcuuuuuuuuuuuuuuuuuuuuuuuagacaaggucuugcucugucacccaggcuacaguaggguggcccaaucuuggcucacugcaaccuccaccucccagguuuaagugauucucaugccucagccucccaaguagcuggguuuacaggcaugugucaccacacuggcuaauuuuuguauuuuuaguagaggcgggguuugccauguuagccaggcuggucucaaacuccugaccucaguugaucugaccgccuaggccucccaaagugcugggauuacagacgugagccaccaugcccagccagcucuuccuuuuuaacagaggggaaacugaggcccaugggaaggacaccuuggacagggcguggccacagugggucauguauauaaucccagcacuuugggaggcugugcugggaggaucacuugaggccaggaguucaagaccagccagggcaacauagugagacccccaucuccacauaaaaauuuuaaaaagaaaaaagauaagucagaaguuggguguggugacacaugccuguaguucuagcauguuggaggccaaaucagggaaacuguuugaggccaggaguuugaaaccagccuaacagcauagcaagaccucaucucuacaaaaaauaaaaaguuuaaaaaugauaauaaaaggaaagucagagccaccuggaaccccuacccucagcaagccuaaccuccucucuguuuccuccuucucccuucuagacuaugcagaauucauuuucuuaggacucuuuauguccgaaauguuuauaaaaauguacgggcuugggacgcggccuuacuuccacucuuccuucaacugcuuugacugugggguaagugcucuuguuucuaagaguucauuucuccagcucuugccuggaaugacagauaccuggacacauuaaagggagaaagguaaagucaccccugaauaugagagacucagauggaugcagaaggaaugagaaaacaaucccaaacacuggcaaggauacaguguacccagaacccucaaccaccgccagugggaggaaaacguauagacccccuuuggaaagcuaagugggggacauaagacaaguuuuccaaguugggagaaaagccaugccuuagguggguugccugugucgcuccaacuaaguacccaacuucaggauuacaaacaggacaucaauaugauuucuauuucuucuuuuccuuuguagcucagucauguggagguagaugaaguauaauuguuagauuacaacacccuggcauuauggagccauuaugguccuuuguuauuuugugaauuacucaguuaauuaauuuauuuuuuaaaugugauuaacacccaguaacccacuaguccacacaaaaccuaaguccuggagaauaaucuacguccaauccuucucaucgaaccagggcaaaaacuacaagauggagauaugacccagcauuccauugcuaggaauucauccuagaaaaucucacccagauaccuaggagacacaggccagaaugucccugcagcuggaagugaaauuaagguuguucgcaaauaaguggagaaugccuggcccagggcagcccuaaucauuuaccauaguccuguuggucucagaaaggcuuaauaauuuauuuauuuuuuuuuauuuuuuguuuuuauuuuuuguuuuugagauggagucucguucugucacccaggcuggagugcgguggcgccaucucggcucacugcaagcuccgccucccagguucacuccauucuccugccucagccucccgaguagcugggacuacaggugcccgccaucauaccuggcuaauuuuuuguauuuuuaguagagaugggguuucaccguguuagccaggauggucuugaucuccugaccucgugauccacccgccuuggccucccaaagugcugggauuacaggcgugagccaccacacccagccagcuuaauaauuuauaauaacugaauguuguacuguuuucugccauuauagaaaauuauguuguuggagaaaacaaaauacauacaaacaagcaaaccuucccuacauaaaugacccaaguaguuaaagaauaaaaccaauuucuuuccauuaaaaagaaaagaaagccgggugugaugccucaugccuauagccucagcuauucaggaggcugaggcagcagaauugcuugagcccaggaguugaaaaccagcccaggcaacauagcaagacccugucucuacaaaaauuaauaauaauuagccaggugugguggugcacaccuguagccccagcuacucagaaggcuaaggugggaggauugcuugagcccagcaguuugaggcugcagugagcuaugaucacaccacugcccuccagccuggacaagagagugagaccccaucucuaagaaauaaaaguaggccaggcacaguggcucacaccuauaaucccagcacuuugagaggcggaggcagguggaucaccugaagucaggaguucaagaccagccuggccaacauggcgaaaccccgucuauacuaaaaaaauacaaaaauuagccaggcgucguggcacaugccuguaaucccagcuacuugggaggcugaggaaggagaaucacuugaacuggggaggcagagguugcaguaagcugagauugcaccacugcacuccagccugggugacagaaugagacuccgucucaaaaaaaaaaaaagaaaaauuuuaaaauguccugagcaaccuuguuuguaauaguuccaagucucaauauccguguaucccuuugcuguagaacagauaaauauuuuguggcauaucuauauaaugaaauacucugugacaaucaaaguccaccaacagcagccacaugcccaacaacaggaaugaaucucacccauguaacauggcacagaaggaggcaggagcuagcaacguaaguccauacaguucaugcaaaguucaaguggacaaaauuaaacucucucucucucucuacauauauauauauauauauauauauuuuuuuuuuuuuuuuuuuuuuuuuuuuuuuuuuuugagacagagucucacucuauugcccaggcuggagugcaguggcgcaaucuuggcucacuacaaccuccaccucccggguucaagccauucucccgccucagccucccaaguagcugggauuagaggcaugcaccaccacccccggcuaauuuuguauuuuuuguagagaccgggauucagcaauuugcccaggcuggucucgaaauccugaucucaggugauccaccugcccuggccucccaaagugcugggauuacaagcgugagccaccacgccccgccuuaaacuguauuuuuuaaggaugauacuugaauacguuaaaaaggcgaggaccuugaaaacacaacgcucgguaaaagaaaccaaacacaaaaggucaaguauugcauaauuccauuuguaugaaauguccagagcaggcaaauccauagagacagaaaguagauuagugguugcuagggucugggugagggagaguggggaguaacugcucauggggacagggccuccuuugggggugaugaaaauguuuuggaacuugauagaggugauaguugcagaauauugugcauguaccuaaaggcacugaauuguguaauucaaagugugaauuuuauguuaugugaauuucaccucaguuuuuuuuaagguaagaaaaugguuauuacaaaauucaggaugguaguuauaucacagugucucuggaaacuuccaggguauccacaugucccuuuuuauuuuauuuuauuuuuuauuuuauuugagauagggucuugcucuguugcccaggcuagagugcaguggcaggaucaugacccucuccugucucaaauuccuaggcucaagcuauccucccuccucagccuccuaaguagcugggacuauaggcacaugccaccaugcuugacuaauuuuuuuuuuuuuuguaaagucaggguuucccuguguuacccaggcuggucuugaacuccugggcucaagugaucugcccaccucggccucccaaaguuccagaauuacaggcaugagccacugcccuagccuucuccuaauuguugacauagguaguaguugcaugacauucacuuuguaauuauguguuucaggaauucucaggccugugggagcucuuaauaaauaaaaaagaggccaggugugguggcucacgccuguaaucccagcacuuugggaggccgaggcaggcggaucacgaggucaggaguucgagacuagccuggccaacacagugaaaccccgucucuacuaaaaauacaaaaaauuagccgggcgugguggcgggugccuguaaucccaguuacuugggaggcugaggcaggagaaucgcuugaaccugggaggcggagguugcaguaagcugagaucgcgccacugcacaccagccugggugauaagagcaagacuccaucucaaaauaaaugaauaaauaaaaauaaauaaauaaauaagaggccgggugcaguggcucaaugcuuuggaaaguggaggccaacaguuggagagaccaaagcaggaggauggcuucagcccagaaguuugaggccagccugggcaauacuagcgagacacuaucucuauaaaaauguuuuaaaauuagccagaugugguggggcacaccuguaaucccagcuacucaagaggcugaggugggaggaucacuuaagcccaggaggacagugcugcagugagcuaugauugcgccacugcacuccagccugggugacacagugagacccggucucuauagauaaaugaauggaugaaugagggggucaaggauccucacccggcuuccauuuggagggaggaguuugguugaguucuugcaagguugguaccuaggaaaugcuugccaguucuggagcccagacacugucccuggacaugagaccagguucucugcccuagguuaucauugggagcaucuucgaggucaucugggcugucauaaaaccuggcacauccuuuggaaucagcguguuacgagcccucagguuauugcguauuuucaaagucacaaaguaagucuuugggguuccuggacauuuguacaggggguggggaugggggacaugguggggccgccuccagaaaguugggaaagugagccucguguuucgagggcugacuccggggcccugccucccccgccuggccugaguccucgccuggccucugucggcagguacugggcaucucucagaaaccuggucgucucucuccucaacuccaugaaguccaucaucagccuguuguuucuccuuuuccuguucauugucgucuucgcccuuuugggaaugcaacucuucggcggccaguaaguccuucacaggaauuccaacuccugguucccuggggucaggcucagggaacacacaguccccuccaccgugcaggcugccuuccucguagcccagacacccauugcggucacccaaaugggcagggcccuggguaccacucaggguuuccuggggacagagaugauggagacguucguuuccuuggagaugagauacugagccacacccucagagcaccccggguggggccaacgugaaaugucuguguccucccugcagguuuaauuucgaugaagggacuccucccaccaacuucgauacuuuuccagcagcaauaaugacgguguuucagguacagccuccaccuggccccacgggccaacaccucucagugucacagaugaaagugccugcuccacauccaaggggcuucccugaacuccuccuucucuaccuggccuuuucacaccacuuugaaacacagauuuuaugguuaucauuauucaauuauggugaggccaacagaucaggagaugaaugucauuggaaagauaguuuguggcugggcacgguggcucacacccauaaucccagcacuuuggccagguacgguggcucacaccuguaaucccaacgcuuugggaagcccaggugggcggaucacuugagaucaggaauucgagaccagccuggccaacauggugaaaccccaucucuacuaaaaauacaaaaauuagccgggcgugguagcacaugccuguaaucccagcuacucgggagaugaggcacaagaauugcuugaaccugggaggcagagguugcagugagccaagaucgcgccacugcacuccagccugggcaacagagugagacuccaucucaaaaaagaaaaagaaaaaaaaaaccacuuugggaggucaagaugggaggacuacuugaggccaggaguuugagacaagucugggcaacauagugagacuccgucucugcaaaaaaauaauaauaauaauuagcugggcauggugauacauaccuccuagcuacuagggcagcugaaguggaaggauugcuugagcccaggagguugaggcugcaguaagcuacaaucacaccacuauacuccagccugggcgagagagcaaagcccugucucaaaaacgaaaagaaaguuuguuauacucacagauccucagagaaggagcacaccaugcaggaccaagcagagaagcaacagggucaagcaggaagagaaggaaaaugugggcaagaggcuugauugugguuuccaugggacggaaugggugaggcagaguaaacagcucgagacuggcuaguuuggaucauuucagugggcucuggggcagaggagcuguuccuacuugucuaggaccuggccuuggggugauuagggcagguggauagugcugggaagauaaaggaggugguugggauaugggcugguugggauauuguuugguuugcuuuuaaaaagccugcucagggcuaaauuguuuacuaccucuagggacuggcuagugcuggaccgggcagucccuccagagucagcaagaccccagaugcaucagaauaaagaaaauaaaaugcguggccaggccaaugaggugguucaugccuguaaucucagcacuuugggagaccaaggcgggaggauugcuugagcccaggaguucaaggcugccgugagcuccagccugcaccacagagcaaggcccugucucuuaaaaaaaaggcagagaaaaaaaauggcuaauacacccaucaaaucugaagauaccuuggucucauauuccagggugaucaacccaaagcaacuucugcacccaugugggcgcauucccugaggcuugggacuggcccagccgggaccuucagagcaucuuugguggauucuuucucuuugagggacugagaguguauagaaaaugugacuucacucucuccuucuccuggggagguaguuucuaaaugagaccccaagacagggaguugaagaggaaaccuuccaugaagggaaguucugagcccccacauaagcgauuuuuuuuuuuuuuuugagauggagucucgcucuguugcccaggcuggagugcgacggcacguucuuggcucacuacaaccucugccuccuggguucaagcgauucuccugccucagccucccgaguagcugagacuacaggugcauacuaccaugccuggcuaauuuuuguauuuuuaguagagacaggguuucacuauguuggccaggcuggucucgaacuccuggccucgugaucugccugccucggccucccaaagugcugggauuacaggcaugagccaccacaccuggcccauaagcgauuauuaauagcacugaucgcuagucauguaucuuuagcucagagguucucacccaaggacaagucuguccuccaaggacauguagcaaugucugcaagcauuguugguugucacagcuagggagagggugcuacuggcaucugguggguggagacuaggaaugcugcucaauauccuacaaugcacaggacagccccaaauagaauaaucuggccccaaauaucagcagugcugaggcuuagaaacccuguuuuagcagauucauguuuuuggaguucuuuaacauuuacuuuauccucauggggauauggauagaaggaaggaaguuggaucuuuuuuaaaggagcauguaggugcuguuugaauauccccuugguucuuucaguaugcaucagcacaacuugcgucugucaacaccuaauccuuugccuuggucuuucucugguccccugcucugcccccaaggaacugcaguccagcaguacugugaauuuuuugugccacaccuuaaaaggagcagccguugguggauaaauaccccagcucccucacccucaggugggaugaccccuagagcuccccagcaagaccaagccccgguuaccuacaguggaaacucgcuugaucacauacuguuuacguuccacccucuuuucccuuuucucacuucuccucuccccuacuggugcuuccugagaucaccucccagacaaaccacuugcacccgaacccuuguuccagggucugccucaggcagggggaccccaaacguguccuugugcuacauuugugcuauccacguaguagcuuguuuaaucaucaccaugaccacaugaggaacacagguaaauauuaaaauccugucuuagucugcucaggcagccauaacaaaauaccacacacuggguggcuuauacaggaaacauuuauucucucauaguucuggaggccgggaaguccaagaucaaaguguuagcaggguuaguuaguuccuggugagggcccucuuccuagcuugcagauagccaccuucuugcuguguccucauaugucaaagagagagagagagaguugugauguuucuuccuguucuuuuuuuuuuuuuuuuuuugagacaaaaaucucaaaaaaaaaucuauuuuuuuuuuaggcaaaucacauuuuuuugucacccagccuggagugcaguggcacaaucauagcucacugcagccucaaacuccuagguucaaacgauccucccaccucagccccuugaguagcugggacuacagaugggcaccagcuaauuuuuuuaaauuuuuuguaaagauggggucuugcuauauugcccaggcuaaucuugaacuccugggcucaagugauccucccaccuuggccucccaaagugcugggauuacaggcaugagccauggcaugcggucucuuccuguucuuauaagggcacuaauaccaucaugaagucccccaugaccucaucuaacccuaguuaccucuuaaaggccccaucuccaaauaccaucccaucauagguuagggcuucaacucaugaauuuggaggcgggcacaauuuaguccauaacaaauccccuuaaucacaucaaguaagacagaguuacaggagggucugugacuccuccagggucccauuuuccuagaagccaggcuaagagccccacgacgcaggaacggcccuuucuacucgcaaacaaagagaaaagccaaggagaagccaacacggagucuggcucugcaaaccgggcaggauuguuaaagaccuccugggcucggggauggggugggcggauuccggcuccacagcugcaucuccaaggggcccguggcugagagggggguuggcuguguguuucuuccuccccuuucagauccugacgggcgaagacuggaacgaggucauguacgacgggaucaagucucaggggggcgugcagggcggcaugguguucuccaucuauuucauuguacugacgcucuuugggaacuguauccuucauggagagagagaaggggacaggccuggaccucuggcagaggagagguugcaggggcucaagggaggguacugagagacccagauacccagggcccaaguggugucccaccagugguugcuuuuccugacucagacauuugcagacacccuccugaauguguucuuggccaucgcuguggacaaucuggccaacgcccaggagcucaccaagguggaggcggugggagaauguuucucuggcaaaguuaccaccugcccauggcagaucaggacgggggugggggugggggugggggugggggugggggcaugggaacaggguuagaacuuuugccggggaugcaccaugcaaagagaaggcgccucuccccccacucccagaaacagacugucccucaucaagcaaauucuacagccaagagggugggaagggggaaggcagugaggucgcugcaggaaacggauggcaaacucaaccaaaaggccguuuacagggaguaagcaggguuuccaaggaaugguguagcccccaggcuaguggaugggagagggagugcuguuauggggacccagucagagcuggggccaaggaaaaagggcugccaccagcccugggaccuuagagaacccagaaccauggcaaggcacagauggaguggccaauaaauguccccaccuucucucuuccucuggcuucccgcuggagccuccccuuagccaaacgcagcauguuaagagcuagccuccguccagccuaagccucuccccaaggacccuauuaaguuaagauuacauguaacagguacagggucuuccucucagcccuggggucucccucagcauugcagccccaccuccagugccucgagguauucaggacauguuugugaaauugaaccaaaccaagcagacguugccaacgcuccaucugccggcccuggcaggagggagagagaguuucccggccccagcucccaguggagggaagcggaagucucugccaucccaagcacacggccacaagccuggccacuguggagcuggcuggcauggcugagccgagggcugauccagccaugagcucauccaaguuccaagaguccauccuuaggggcuggugcaggaggguagcagaaggggagggagaaaggccaguucguuuaucuccugggagguguggacauuccucuccagauccacauucuuucuuucauugauccuacaagcauuucuuggucauuuaauacguguuuuuaauccuauucaguccucauggaaaccuuaggagccaaguucucugagccccauuuuacagauuucaucauucaguaagcacuuaaugagcaccuacugugugaccaaggcccuggucuaggacuuagggauuaagcagugaacaaaaaaaggcaaaaaucccugccuccguggagcagggauucaagaggggagacagacaagaaacaagauaaauuuguaaacauacguagcuugucaguuggugauaaacacaacagagaaaaauucaguagggaaagucagggagaguuggaauuuuagaugagaugugugucgcacagagagguugagagacuugcccaaggccacacagcaguaaguuguggagcugggauuugaacccaggccgucugggucugcagcuugugcucuuaacugcuguguaccaguugcuugaauuugggcauguuuuaugcucacuugggaaccugugggaaaugcagauuccagggcccagcacugguucuauagauuauuuggggagccugaggaucugcauuuuagguguuucugaggcagaugguccagagaccuagcucugaaaaaugcugggaauggugccaggagggguggggguggcccuaugagagcaggguggccagccagaucccaucuccauguugucucugacaguguccugaucugaccauuuccaaggugguaagguugcuccccguuccagugauucggagcacagcgggagagcugccugcaauggcaugacuuuucuuaugggcggguucauuucuggccauuucuuucucguugccuuuucuuugcuuuuucuuuguuggcuuuucuguuuuacgaaugaggcccugcaugaaggcugaagaaggauuuaaaguccaaaaacgucuuuuucuguauguauuuuuaaaaccucuucccccauucuccuccucucugaaccuaaccaccagugagcagcagcacccugggcaguuggcuguagcccaagugcccugcucuccucuccccaccgccuuccugucaugggggcugggaauauaaauuccucuccucauucuccuucugggggcuguugacagugcauggcaggggccaucggaugccaggcucuucugugugugaggguaguugguguuuuuugaaaguugguucagagaguucacauggcucagaaagccuagugagaggaaaaucuuugcacugcuuuccagcucauuaagacaggaugcaggggccaggcaugguggcacaugccuggaaucccagcacuuugggaggccgaaaugggaggaucauuugaggccagaaguucaagaccagccugggcaacauagugagacccugucucuacaaaaaaaaaaaaaaaauuaaauguauacaggcauaguggcaugcaccuguagucccaguugcuugggaggcugaggugggaggauugcuugagcccaggaguucaagguuacagugagcuaugauugugccacugcacuccaggcugggcaaccaagggagacucugucucugaaaacaaacaaaagaaaaaaaaauaggcugcaggaaagucuucauuguaggaagagaagggacauuuuuauuuuuuguuaucuggcuguguguuaaaauaggcuucauaaugaguuagaugucaaacuuauacacagaggggauagcaauacacuuaaccaauagcagguacccauuccaauuggggagccuugguucugauuggucgaaauauuucaaauguugccccuggucagcaacagggucagaagugaguccccaaggccuaguucauguuuugugaacaaagauuccacgugccuuuuaggacgagcaagaggaagaagaagcagcgaaccagaaacuugcccuacagaaagccaaggagguggcagaagugaguccucuguccgcggccaacaugucuauagcuguguaagugccccuaaucccugggaugcuacccuggcuccugaacguccacacuaucccaggcacagauuugggaagcagugggggugguccuugacagaacugagcuuuaggaagagacacuucuuguccuuccacccacuuucacucaauaaauauuugguuagcagcuguuauguacccagcacuguucuaacuucuggggauacagcauuaacaaggaggaaaaaaaaaaucccaccuguguguagccauucuagcaagggaaggagucaauaaauuagauaaauaaguaaauuauauauuguguuagaaggcgauggaacuacagagaaaguaggggagggaaauagcaaaugcugggagugaagagaguugugauuuuaaacgaaguugucagggaaggcaucaccuagaauagggguccccagucccggggcuguggacugguaccaggccgaggccuauuaggaacggggcugcacagcaggaggugaacagugagcaagcaagcauuaccgccugagcuccaccugccgucagaucagcaggcagcauuagauucucauaggaacacaaacacuauugugaacggugcaucugagggaucuagguugcgugcuccuuuuaagaaucgaaugccugaugaucucaggugaaacaguuucaucccaaaaccaccccccacaccuaggucuguggaaaaacugucuuccacaaaacuggccccuggugccaaaaagguuggggacugcucaccuagaagguuacauggccugaaggaggugagggaggagccacuggggggccuggggaagggcaucccaggcagagggaacagcauaggcaauggcccugaggcaggaacaugccugaugugaaggaggccugugugacuagaaucgaauaguaagugugaggaggugaaggcaaggaggugacaagcagauuacacagggccuucugggucaggggggaggacuugggcuuuugccccuagccaggugggagccauggaggguucuugagcagaggaggcugggaccugacucagaugcucacagacuccuagcauucaguggggaguagaggguggagagcaggagugggaggcugagauguggguugguucgccugggucauccauccaagcuacagugccuagcaaugcucuaaguccugugaccaugccacugcaggaaagagcaacagaagaaucaaaagccagccaaguccgugugggagcagcggaccagugagaugcgaaagcagaacuugcuggccagccgggaggcccuguauaacgaaauggacccggacgagcgcuggaaggcugccuacacgcggcaccugcggccagacaugaagacgcacuuggaccggccgcuggugguggacccgcaggagaaccgcaacaacaacaccaacaagagccgggcggccgagcccaccguggaccagcgccucggccagcagcgcgccgaggacuuccucaggaaacaggcccgcuaccacgaucgggcccgggaccccagcggcucggcgggccuggacgcacggaggcccugggcgggaagccaggaggccgagcugagccgggagggacccuacggccgcgagucggaccaccacgcccgggagggcagccuggagcaacccggguucugggagggcgaggccgagcgaggcaaggccggggacccccaccggaggcacgugcaccggcaggggggcagcagggagagccgcagcggguccccgcgcacgggcgcggacggggagcaucgacgucaucgcgcgcaccgcaggcccggggaggaggguccggaggacaaggcggagcggagggcgcggcaccgcgagggcagccggccggcccggggcggcgagggcgagggcgagggccccgacgggggcgagcgcaggagaaggcaccggcauggcgcuccagccacguacgagggggacgcgcggagggaggacaaggagcggaggcaucggaggaggaaguaaguggaggugaccucgaauccgcagaaugacgguaacauuaauaaugacaacagccaaaguagcacgugcuguguauuuguuuauaaaaauauauuauaaaaugcuguauuuggccaggcgcaguggcucacgccuguaaucccagcacuuugggaggccgaggcggauggaucacgaggucaggaguucaagaccagccuggccaagauggugaaaccccaccucuaauaaaaauacaaaaauuagccgggcacgguggcaggcgccuguagccccagcuacucaggaggcugaggcaggagaaucgccugaaaacagggggcggagguugcaaugagccgagaucacaccaccgcacuccagccugggcgacagagugagacucugucucaaaaaaaaaaaaaaagugcuguauuuggccaggagcaguggcucaugccuguaaucccagcacuuugagaggccgaggcgggcggaucacuugaggucaggaguuggagaacaggcuggccaacauagugaaaccccgucucuacuaaaaauacaaaaauuagugguggugcccaccuguauucccacuacucaggaggcugaggcgggagaaucaguugaaccugggagguggagguagguugcagugagcugagaucgugccaucacacuccagccugggcaacagagcaagacucugucucaaaaaaaaaaaaaugcuguauguuuuuguuuuuuugacacagggucucgccuguugcccaggcuggagugcaguggcagucauagcucagugcagccucuaccucccgggcucaagccauccgccucagccucacaaguagcugggaccacagacaugugccacaugccuggcuaauuuuuguagagacaguguuuuguagagacaggguuucacuguguuucccaggcuggucucaaacuccugaacucaagcauuccgccugccuuagccucccuaaagugcugggacuacaggguugagccaccacacucagccuaauuuuuuuaccuuuaguagaaaugaggccuggcucuguugcccaggcugguccccaacuccuggccucaagcaaucaucccaccucagucucccaaaguguucggauuagaggcuucacagauggggaaacugagagauugagugagcuccucaaggucauuccucuaaccaguguccuugaacccaggcucucuggcaccagaggccuugagcauuucagggaaacuauuaagagaagccccacugucguccagaauuauauagucuucuguguucuugcugugugacuuuugcaaagugacuucauaucucugggccucacacaauggaaauagugggaucuaauugggucauugccaggauugaaugagguaauguaugcaaagggccuggaagagcagcugacacauaauaagugcucgguaaauuuagagcauuuuuggccauuuucagccaacucuauuuaccuaaugcuauucuuuggaaguuugaaaagccacucuguugggaggccaaggugggaggaucacuugauaccaggaguuggagaccagucugggcaauagaggcagaccccaucucuauaaaauauaaaaaauuaaacagaugugguggcaugcaccugcagucccaacuacuugggaggcugaggcaggagggucacuggagcccaggaugucuaggcuaugaugagcuaugauugcaccacugcacuucagccugggcgacagagcaaggcuuugucucaaaaaauaaaauaaaaaauaaagaaaaagaaaaggcacuuugggccguuagaauugaagggagagcagaguuucaaagcuuuggaugcagcgggaugugguggcucaugccuguagucccagcacuuugggaggccaaggugggaggauccacuugagccccggaguucaagaccagccugcgcaacauagugagaccucaccuuuuaaaaauaaauaaaaauguuagaaagcuuuugaggcaucuuccaggccagcaacuuauccauucagaaccagcauccucuuuuucauaacgacauuuuguaauacuuucuagcagaugcuauagugauucugcauauagggacucaacaacuuacccauuaaaauagacaucguagacauuguccuauuacaaauuaaccugcucuuaguccucuuuuauauuaccaucagggcauaauauugauuuuuuuaaugauggguuuaagugauccuguuguaugacauaugagguaggccagcacuucucaaaaucuaauguguaugugaauccccagggaucuuguuaaaacacaaauuguaauuccguagggcuaaggacucaguggagccugagauucugcauuugcaacgagcucccagaugaggcugauacuacugguccagggaccacauuuugaguaaugagacucuggaggacauagugaaguaauucugauauguacaccauacacaaaaucaccaugaagugacaggcacaaaugauggcuaacucuggguuguguggacaauucaaaccacaugaggggaguugccagcagugucaagauguuccacaauguugaacaccucuuggcaaaguuccauauacaaaagagucuagucuuucuuccauuuauuuaauaguugcauugcaggaaaaugcaauguauauuaaaaacauacaaaaaauauguuguguucuuauguaaaagaguuagguuuaaacuaaaagcacaggaucaggugcaguggcucccaccuguaaucccagugcauugggaggcugaggaaggagaaucgcuugaggccaggaguucgagaccaaccugggcgacauaaggagaccucgaucucuacaaaagaaguuuuuuaauuagccagguguggcggcaggugccuguaguucuagcuacuuggaaggcugaagcaggaggauugcuugagcccaggaguucaagauuacagugagcuaugauuaugccauugcauuccaaccugggcaacagaacaaguccuugucucaaaaaaaaaaaaaagaaagaaagaaagaaaaaacccaaacaaacaagcaaacuaaaagcacagguaauuacaagcaagauuuuucaccucuuugagggacauuagaaagucaugaagaggaaaagauaagucuuucccauaugggacugucauguacaugguaggguauuuaguauaacugccuaccauucucuaagugccugcagugccccucaaucauuauguuauuagguuuccacguaguucuacaacaguuuucugaaaaccauuguucuaggucauucuuucgcuucaaucuucuccuauggguuuaugcauucauucaguuaguauuuacuaagugccuacuauauucuaagcucaugcugugaguucagucacacaacugcaagugaaguggucugagacauucugagaaauacgaccaagaaacugcucccagggucucagggcagguuuccagaggagcaaucugagaagggaguagaguguuucagucuaacaacagcaugugcaaaggcccugggguggaccagaaggaggccaguuugcaggacaugacuagugacgagaaagugacaaagaaauugaaggugcauugaugagacucuggggcugucagucacucaggggaaugagagaucaaaacgggaguuuagguggaauaaaguguuuaccacagcacucucuguauaguaaagaccaaugaagagccagguacaggccagugugaugguucacgccuguaaucccagcacuuugggaggcagagacagguggaucaccugaggucagggguucagaaccagcuuggccaacauggcaaaacccugucucuacuaaaaauacaaaaaauuagccaggcguggugguggacgccuauaaucccagcuacucaggaggcugaggcacaagaauuguccugcgaggcagagguuacagugagcugagaucacaccacugcacuccagccugggcaacagaacaagacucugucucaaaaaaaaaaaaaaaaaaaaaaagccagguacagugguaugcaccuguaaucccagcuacucaggaggcugaggcaaaggauugcuugagcccaggaguucgagaccagccugagcauuuagagaaugggaggccaguauacuaaauacccuaccauguacaagacagucucauauggaaaagaauuauccuuuccucuucaugacuuucuagugcuccucacacaggugaaaaaucuugcuuauaauuaucugugccuuuaguuuguugguuuauuuaggguuuuguuuguuuuuuuuuuuuuuuugaggcagggucuugcucuguugcccagguuggauugcaguagcauugcucauuuuagagaugagcaagaccucaugucuaaaaaaaaaagaaagaccaaugauuauuaauuacucuugcuauuauuacuaauauuacuguuauuaucagccuuauuaacagaucuacuguuauugaaggaggcagagugacagggacaaaaugucucucccuaacaauaugccaggaagaguuuuugaaagacaacaguaaacauuggaaacuacaagagcagcaaagccugguugugaaaggcaaggacuuuggggcaggcagucacauuccugcccuaucacuuccaggcugugugacuuucagaauuucacuccucucugggccuccauuuccucaucuauaaaaugaagauaagaauaguagcuaccuccuucucuggguauaagauuuaacugagccgggcgcgguggcucaugccuguaaucccagcacuuugggaggccgaggugagcggaucacaaggucaugaguucaagaccauccuggcuaauauggugaaaccccaucucuacuaaaaauaccaaaaaaaaaaaaaauuagccgggcguagguggugcacgccuguagucccagcuacucgggaggcugagguaggagaaugguguaaaacccgggaggcggagcuugcagugagccgagaucgcaccacugcacuccagccggggagacagagcgagacuccaucucaaaaaaaaaaaaaaaaaaaaaaaagauuuaacugaguuaguacguguaaaaugcuuugagugguuccuggcuuauaccaagagcucaauaaauguuagcaauuuuuuguagcauuuuggggucucacuauguugcccaggcuggugucaaacuccuggccucaagaaauucucccacuuuggccucccaaagugcuggauuuacagacaugagacaccaugccuggccauguuagcuauuauuaauaugaauauuauuaaguacucaaugaaugcuauuuuuagcaguaauaguaagcacucaggaagugucagcuaauacuguuaguaauacucucaucaauaaacauaaaaagcaauaaggacccagcuugcccaaaucccacagaugguuccugcucccucucuucuucagaggaagaaacuaucuccccacuuucacccccauagccucagcuggccagacccccauucugaaccaggggaguacugcuaauuccauuauuaauagacacaucaaacaaucuggccgggagagacauuauucauuuggcugauaaagagguucuaaggcucuuuggaaauaaaaguucaugaagauucaugcacuuuaagagaaaaaaauucaagaucagucauucaucugcuuuaaaaaaaguggcaaagauaaaacuuuauuugagaauauaaaauaauaaaaagacauuuucguucucuguugugacaaagccaguggccuucggaggucugccuuguacauuuuuccucuucuucagucauuccuugaggcuuuuugcaaacguacccuguguuuuucauucuccagcauauugauaauuuuuuuuuuuugagacauggucucgcuuugucauccaggccccggaguacagugguacaaucauggcucacugcagccuugacuuccugagcucaggugauucucccaccucagccucccgagcagcugggacuacaggugugcaugaccaugccuagcuaaucuuuuguauuuuuuguagacacaggguuuugccacauugccaaggcuggucuccaacuccuggguucaagcgauccucccaccucagccucccaaagugcugggauuacaggagcgagcuaccuugccaggccgaucauauuuuuuuccuuuuuauucacuuugucuucuccucauuccuaccuucaucugucuuucaguggcucacuccagugaaaaguggacugacgcacauucuauuucauauaauucaauggcugcuggccccagaucccccauaccagguggccgagcccaguggcccugcaggguggacaaaaugaggguggaacuuucccagacugucaguaaaaaucuauggaggacagagcuucugccucucccuugcaaccaggcagugccuucucccaggccuaucugcuugcaaagggaacuuuugccaagaccugcuccacucuagaauucuuaucucugcuguucgcauccuaauuccaccugcaucugucaccaugacaaccugcuccccaaaaggaacaggaagagagaugcuggacuuuugagcuccacaguuuauccugcauggggguagggagugguuaauuacuuagcacucuaauucuuacgguacccccaaugggcccaaguugguuuuuuuaaaaaaaaacagucuugcucuguuacccaggcuggagugcaguggcacaaucauagcucacuguagccucaaacuccuggacucaaaugaucuucccaccucagccucccaaguaacuggaacaacagucucgugcaacuacgcccagcuaauuuuuuuuuuuuuuuuuuuuuuuuagagauggggucucacuauguuccccagacugaucucaaacuccugggcucaagcgaucuuccuuccucagccucccaaagugcuaggauuacaggcguaagccacuguaccaagcugccccauuaaagcuuugaacaccagagagcccagcucagcuguuuuccagcuggguaacucuggguaacuuugccucucugaaccucagucuccuccugugugaaauggggcugaucacuauacccaucucggauggugguaguugcagggauuaaaugaguuaauacgugagguccuuaggacaggggguggggacacgagauaagcaauaaacaggaacugcuguuauuaucacccccacauaauccgaucucagggucugagugugccccaggcaagguguccacagcccucugcagaaggaugcccaagugaucagcuggcacaagaacgccacgcacagcagguguuaugcaacuggccaccuauuccaggcagaggaugccagauccccagggagaaggggguaggggugcagcuucaaaguuuucugccccuuuugaguucuccuuggagacacuuuggaaaugaaaccucccggaaauugauauuaggccucugcaggcugagcuuguuaaaauuucccaacaaacagagccaacagacgcucuacaaggaagcaaaaacaagacaaaacacauuggcagacccuuuuccaucugcucuugguagaugguauuccucuaagaaaaugccgccacgaguuucuccauggcuucuugagcugguggccaaaggauuuagguucucuuugaaauuauaacuuaacugggccugcuuuauggcagggauaucacucucugaaauguguauauauauguguauguauauauauacacauauauacacauauacauacacagggccaggcgugguggcucacaccuguaaucccagcacuuugggcggccaaggcagguggaucucuugagccccaggaguucaauaccagccugaacaacauagugagacccugucucuacaaaaauuaauaaaaauaaccaggcauggcagugugugccugcaaucccagcuacccagggugggaagaucgcuugagcccaggaguuaaaaguugcagugagcuauggucauaccacugcacuucagccugggcaacagagcaagacccugucucuuaaaaauauauuauuauuauuauacacacacagacacacacagacacacacacacauuacagaugaugagaaaauacucucagccagguuuucaugauacacaacuucucaaaaagcaucacaagcagguuagaauuagggauuucuuuguggacuguccaagauguugaggaaauauugguuuagaauuuaccucauuuaggccagaaaugguggcucacgccuguaauccuaacacuuugggaggccaaggccaauggaucucuugaagccaggaguuuuagccuggccaacauggcaaaauccugucucuacuaaaacuacagaaaaaaaaaaaaaaauuagccgggugugguggcacaggccuguagucccagcuacucuggaggcugaggcaggagaaucacuugaaccugggaggcagagguugcagugagccgagaucgugcauuacacuucagccugggugacagagcaagacuccaucucaaaaaauaagauagauaagauaaauauauauaauauauauguuauauauauaauauagaaacuacagaacaagugaucuuuguauguuuccagaauauaacagcgggacaggcauaggauagacguucccauugcaaaagggagaaauuggaagggauaaagaggucaccaguccuaagcaagugcuaaauccagcaagacaaaucccauuagguuucaaggccugagaauaauccucggugacucucagcucauuaacauacuuaguucucagagccagacucaaugagguuacggcccgcauguuaugggucaggaacugaggcuaaguaacucacuggagauuaugugguaaagaagguccaggaucauugcuucagucuccaggauauggggaagguucuacuccuguuaucccaaauuuuaaaaugugggaacuaaggcucagagagguuaagcaaaucacacaggguugcacagcuagugauguugcugagauuucccuguguguaguggcucaugccuauaaucccagcauuuugggaggcugaggcaagagggucgcuugaucccaggaguuugagaccagccugggcaauauagugagaccucaucucuacaaaaagaaaaauuaaaaaguuagccaggcgugguggcaggcaccugaagucccagcuacugggaaggcugaggugggaggauugccugagccugggagguggcgauuacagugagcugagaucgcgccacugcacuacaaccugggcgacagagugagacccugucucaaaaaaaaaaaaaaaaaaagacauugccgagauucaaacccaggucagccugucuucugaaaugucccucuaugacccacucacaaaacugagaaggcagaaaguugcuuggaccugucuauuuccccugugcagucucagagaaacaguggaacugccucgguuucuccuuccgggaaguauucauagaagcaucccacuuaccuacuuuggucugaaaauaaauuagcuugucucucuuccacuuacuaaaaacaccguggguuuuugcaaguuaaaaugcaaaaauaaaaugaggagaauggugcugguaguuuagccagugggaagcccucuggggaaagccagccuuuuauuuauuacuuauuuauuuauuuauucuuucuagauagauuuaugggaaaccagggcuguguuguccaggggucuguaguccagaaggcaucagaugggcuacuaagugagucuuuguccaccuguagauggcaagaggcagggcccagguguccauggcuuggagaggcagggguugaugggagguuugaggcugugggaucucuccuggggccucaguauccucaucuggauaauggggacauucuggccaggcacgguggcucuauauauccagcacuuagggaggccuauaaucccagcacuuugggaggcugagguggguggaucacuguaggccacgaguucaagcagccugggcaacauggcgaagcccugucucuacugaaaauagaaaaacuagcuggguauuguggugcacgcugguaaucccagcuauucgggaggcugaggcacgaggaucacuugaauccacgaggcagagguugcagugagccaagauccugccacugcacuccagccugggcaacagagugaggcucugucucaguuaaaaaaaaaaagaaaaaagaaaaagaaagaaagaaaaagaaaauggggguauucauuuaucauuugacaguaaguuuacccagcauugacugugugagaggcccuguacuaggcagugaaaacucagcuaagaauaagaaaguuaaaaacaagcugggcauugugguuuacgccuguaaucccaacauuuuaggaggccgaggaggaagaaucacuugaggccaggaguuugagaccacccugggcaacauagugagacgccagucucuacaaaaaauuguaaaauuagccagacaugguggcgugagccuguagccucagcuaccuggaggcugagaugggaggaucacuggagcccagaaguucaaggcugcaguaagcuaugauccugccacugcucuccagccugggcaacagaguaagacccugucugaaaaaaaaaaaaaaaaagaggccaggugcaguggcucacaccuguaaucucagcacuuugggaggcugagguggguggaucacuugaggucaggaauucgagaccagccuggccaaaauggugaaaccccaucucuacugaaauacaaaaaauuagccggucguaguggugggcaccuguaaucccagcuacucaggaggcugaggcaagagaaucgcuugaaccugggagccagagguugcagugagccgagaucacgccacuguacgacagagcaagaaaaaagaaagaaagaaagaaaagaaauaagaugauggggaguuguggaaaccuguccaugggcacgugaaggucuugaccucugaccaagaagugaacaggcuccucucaauuccaggcacugcagggaucugggacaugacuucuccaugaccaaacuguacccuuuccuuuucuuuuuuguuuuuuuggugacagggucucacucugucacccagacuggagugcaguggggcgaucacggcucacugcagccucaaccucccaggcucaagcaauccucccacuucggccucccaaguagcuagaacuacaggcacacagcgccacgcccgucaauuuacacauuuuuuguagaaauagggucucacuauguugcccaagcuggucuugaacuccuggccuuaagcaauccuccugccuccgcuucccaaagugcugggauuacaggcgugagccacugcgcccagcccaaauuguacucuugaaagauggaaucuuagcuaggauccugaacuguugccuuuuauccuaaaucaguuguugguucuuuuucauucacuugccuuccucagagagaaccagggcuccggggucccugugucgggccccaaccugucaaccacccggccaauccagcaggaccugggccgccaagacccaccccuggcagaggauauugacaacaugaagaacaacaagcuggccaccgcggagucggccgcuccccacggcagccuuggccacgccggccugccccagagcccagccaagaugggaaacagcaccgaccccggccccaugcuggccaucccugccauggccaccaacccccagaacgccgccagccgccggacgcccaacaacccggggaacccauccaaucccggcccccccaagacccccgagaauagccuuaucgucaccaaccccagcggcacccagaccaauucagcuaagacugccaggaaacccgaccacaccacaguggacauccccccagccugcccacccccccucaaccacaccgucguacaaggugagacccucugcucucacaucacugggcaggggaccuggcgucccuggagccagaggcucugcugagugacccuggacugugaccccaucucucuggccucagucuccuccccuggaaaaugggcauaggcguaguuuccuaccccacagggcuguggaggguucagugagauaauuugugcacagugccuggcacgggguuguguucagucggguuagcaauaucuucuacguccuuccuucccaaggggagccaggaagccaccccauuugaggagcaauaggguccucugauggaagcuugagggggucagaugauugauucucucggcccagcacuguccaaaagaaauguaacacaggccacaugcaaaugucaguuuaaacucucuagucgccacauuaaaaaaggggccagauguacuggcucaugccuguaaucccaguacuucaggaggccgagguagagugagccaagauggcaccucuguacugcagccugggugacaaagcgagacugucucaaaaaaaaaaaaaaaaaaaaaaaauggugaacugcuggguggauuaugucuuaaguucaucuagugucaguucuaugugagagauuuucaugaguuugcuggauaaaggcuuuccaugguccugagaccuaagauccuaaggucuugucacugugcccauuuuauagauguagggacugaggcucagagaggcucagccugcccgugggcacauaagcaggcugggcugcagaauggaagcuccagaggcugauggcuccucccccugagucaagagaggggugcuaaugggggcaugccaugcaguuuaugggaggucucaguauuucuaucuguucagugggucucuuggcacucucccuaccugccugcaagugagggugugaagguccaacgaggauaggggcaggucuguguuaauaucccaugagggccccaccgcacucaaggcuauagagugguugagagcaggcucucgggggccaggccgccuggguuccaaaugccagcucugccacuuccugcugugugaccuuagacaagucacuuuacuucucugugccucaauuuccucaucuguaaacaggagaucagaauauaucaaccucagggcuauacaaggguucagugaugucauaagaugccugguauauacagcaggcacuuuagaaaugucagccgcuucuugccugcccugggaguacacaggaguucccagagacuugugggaaauuguggagggagcccuguguugguucuugucccaacagugaacaaaaacgccaacccagacccacugccaaaaaaagaggaagagaagaaggaggaggaggaagacgaccguggggaagacggcccuaagccaaugccucccuauagcuccauguucauccuguccacgaccaacccgugaguauggcccccagcaagggcagggggggccuggggcucccaccaggguggcggaagucaggccagauagagggcaaugagugaguguugaccaccaugaguccagggauaccuuugaacaaguugaaaauggaugcuccuuccguaagucagguaagaugauuugucacaauauacuuuguuggaagagaccccuguccugccauccacuagaaaaucauuguuauuuaugacaauaaauaaacaaauuugucauaaauaaacaaauaaauuuguccuaaacaacaaauaaauuugucauaaauaaacaaaucuucacugugauguaagaggcacccccuuagaaauggcugccuugugcaguacacagccugaacaacugcacguggcagcccuaggaccugaacucuguuucuaaccuagacucuguaaggguuuagauucugggcggauagugucugaguuccauggccuucugucuugggcaucuuugaaauggauagacuauuuaggggagaaauuuaucccaugaaugucguaguggcucggagguuguuuuagaauugaaugucucccagggauauuucuugaaagccugaccgcucaaaaugcuucuugacaaugaaggaucaugucagauaagaugggggagaagcugcuuucuauaaucugccucuuggcaacucacccuggguaguaauaaauaaaaguaccuuuaaaguacuuuuuuauuuaguugacuuaucgauuuuacuaaggaaacacuuaugugguaucuacucagugccaggcacuguucugagugccuuaaaauuuuuuuuaauuucucugagguuguuacuaugcuuagcuccauuugacagaugaaaaaacugagguccagagacgugaauucaccugcccaaggucacacagcaagccagugggagagcuggaguuugagcccagacacuggcucuagccuccuuguucuuaaccacucagcucugcugccauucacacaaccuuaugaacuauuuauuauuggcuccacuuauuaagagguuaacuggcacaucccauuggcacauucaaggcucugauaaggccugcaauucauaauuucaauaacuaacuuuuuggagccccuaucaugagccaggcauaaauuaagucuugggucucaugauuuugugaaguaagcacuaguauuacggcuauuuuacagaugagggcaccaaggcacagaggggacaaguaacuugcccaaggucacacagcuaauuuuuaaaaagaaagaaagaaaucuacuuaacccauagauucacaauauuguuuggcccugggacauuuaauaucgaaaagccuuuuuaucuccuacagaauuaaggaccguauuucuucaaccuagcuuggggaucaagauacuucaagagggucguuugggagugauaggaacuuugcuaaacagggcaugugaaugucuucucucaccgagguccccucugccuucuugggguuccaggacccagagagggcccccaccuggaggaguuuaauaguuuguuguguaggaggccuuggggguuggagaucucaguagugguagguaacaugagauuauggaagaaaaggguuugugagccuguggucugaguggaccucugcacgcccaucugucuccaacagccuucgccgccugugccauuacauccugaaccugcgcuacuuugagaugugcauccucauggucauugccaugagcagcaucgcccuggccgccgaggacccugugcagcccaacgcaccucggaacaacgugagucccacagagcacaccccuuccuagccuggcugcucugccucaggccacuuucuccugcauccaaaaugcucauagguagggugggauguuggggucaccccuaggcauagcccuuauggcugcugguugagaggggaagcucugauuccuuggggaugcucuugggagcaagacauuccuugaggcaguuucucugugagccuggugggguggagguggcccagagugacuggggcugaaaauugcuggauucucuaauggaggcgugagacuagcaggauauggauguugcacauucucuacauggaauagggggguuacuggggcaggggcggugcucagaggugguccccuccgcaguagacauuucccuuuguacacgaagcuuugaaagaaacaacuauuuggcucagaaacacagccuaagcuuuugguuuuuaugaaagcaagccccuuugcggauggugggucuguugacaaccccuguuaauugagcacuugcugugucccaggaagaaacucagcaugcaguaucucauuuaauccucacaaugcgcccccccaaccccccgcccaggcauccccauuugacagaugggaaaacugaggcucaggggaaugagagagugguaaguggccuguccagggucacacagcagaauuccaacucugcaucccccaaagcucccacugcuucccccaacugucugcauuuacuaaucaccuacuguaugcuacggaugggugugcauagccccuuugaguccugacaagcaggaaugagugcaugcuugugguugagauggggaaaccgaggcaccaacaggcaagggcgugccucagucaugggcugcgggcagaggcuugaccccagggccugguagaggguggacugguggcuccuguuucccuccccagcucccucccccaacccuucccucccaacccagagccaaaaaaguguguuuucugcugguccaaggcucugcugcccuggcuaaguagguuaggacccaggcaaagcuggcgagccccaucccucaagcccgcccacagcuuaccaugcacuuucccuuccuucccaggccuggcaggccccccuggggaccugaugggggagauggaaggaaauaauuagaacgcagcuccuggaggaagcuagagccagugcucagccuccucacaguccgcuuaguugcuucccgcagccugguuucccccaggggccuccaggagccaggcguggggaggaggugucccuggagggguccacaaacccccugcugacgcgaggaugcugaagaaggcguugccuucggcagggagggcacaggcauggaugauccagggggcacggcagcucccagggcugaagggaaucuaggcagugcucagaccaggccccagggacuguuugcaaagagcguucagcuccccggcccccucccucguccaucucgcagucgaaacuucucuacaagaacacuguggccccauaacguucacaccacguaaccaccauccagggcaagaaauagaacaaaaacgccccacgcggcaugugccuccucgaucccccacccccaccgccuucuuucccucuagagcugcuggggacacugucuggagacauuuuugguugucacgacaggaggggggaggugcuccuggcaucugguggguggaggccagggauguugcucagcacccgccgaugcccaggacagcccccacucuagaggaugauccagacccaaauguccacagagcccagcuugagaaacccugccuuaccgguaaccacgaccccagcuucuggaaugagcguuuuuggcuucucucuuuuucccaccugcacaggcuuuuuuuuuuuuuuuuuuuaagagacaaugucucucucugucgcccagguuggggugcaguaacgugaucauggcucacugcagccucaacgucccgggcucaagugauccucccaccucagccccccagguagcuaggaccacaggcaugcaccaccacacccagcuaauuuuuaaaugcuuguagaaacgggccucgcuauguugccaggcuggucucgaacucuugaccucaagcaauccucccuccucagauucccagagcucuggaauuacaggcauguaauuccaauucuuacaugccuguaauuggccaacacuggccaauucuuaaaaacugaauuuauguuugcucuucuguaacauucaauaaaugagacacuucuaugcuucgcauuaaaugaguacauguugcuuuugcaggauugaugggcauucuuuuuuuuuuuuuuuuuuuugagauggagucuugcucugucacccaggcuggagugcaguggugcaaucuuggcucacugcaaccuccgccucccggguuuaagcgauucuccugccucagccuccagaguagcugggacuacaggcaggcgccaccacacccggcuaauuuuuguauuuuuaguagagacgggguuucacacuaucagccagacuggucucaaacuccugaccucaagugauccgcccgccuuggccucccaaagugcugggauuacaggcgugagccaccacgcccggucaaugagcauucuuuaugaugcuguuuugagauuuacuguguggcaugggauguguuauccauccccuguugacagauguuuggguuguuucuaagugugaauacuguccccaugccacgccccucaacauguuuccugagucaccuggacaguaauuucuccaggaggccagaugcaguggcucacgccuauaaucccagcacuucgagaggccaaggugggagcaaugcuugaggccaggaguucaagaccagcuugggcaacauagugagacccccaccucuaccaaaaaaaaaaaaaauuuuuuuuuuuuuaauuaaccgagcgugguggugcacaccuguggucccagccacuugggaggcugaggugggaggaucacuugggucuggaaggucaaggcuguagugauccauguucauaccacugcacuccaaccugggugacagagcgagacccugucucaauaaauaagaauuccuccaggguauaaaccaaaagcgaaguuucuagagcauauaauuugcaagugguuggccucaguaaaugcagcuugaauguuuauuggacaauaaacacagugacccuuugggaggccaaggcggguggaucaccugaggucaggaguuugagaccagccuggccaacauggugaaaccccgucucuaccaaaaauacaaaaauuaucugggcgugguaacacacaacuguaaucccagcuacucgggaggcugaagcacaagaaucacuugaacccaggagguggagguugcagugagccaagauggcgucacugcacucuagccuuggcgacagagcgagacccugucuccaaaauauauauaaauaaauaaaaauaaacacagugggccgggcacagugggccgggcucgcaccuguaaucccagcacuuugggaggccaagguggguagaucacgugaggucaggaguucgagaccagacuggccaauaugguaaaaccuggucucuacuaaaaauacaaaaauuagccgggcgugguagcaugcgccuguaaucccagacacuuggaggcugaggcagaagaauugcuugaacccgggaggcagagguuccagugagccaagauugugccacugcacuccagccugggugacagagugagacaccaucucaaaaaaaaauuaaaaaauaaaugaacgcaguggcccuugcaccaguagcucaugggaacuccuguucuuccacauccuugucaacacuugguacugucgacuguuucauuuggccgaucugcuggguguggagugagaucuuauugggguugugcuuggcauuucccuguaaugaaugagaucaagcacuuuuuuggauuagacugagccacaggaaauaacauuuucaaauagaugaaaaagaucuaaguauuaggaauacuugaaccuaauuuauuggucuuuugauuuccucuugcacagcuuauuaagagcuccagaauuagauucaccugacccccacggccugcccuuucccagcucccucucuuccuucuuuccuuccauucauuccuuuaguaaguauuugauaagcaacuacuaugugccagguacugagcgagccagggaggauugacaggguaugagauggucccugcacucccagagcccacaaaccaccaggccuuugaccaggcugugcccacugccucgugcaccugaaauacucucccaccaccauccccucugcccacccaggucuuucaagccaauccccuugcaccagccccucccuccaggaagucaccucacccugaccccaggcacucuggucucugauuccucuucaagcaccacauauaacaggaauauaaguuauaaccacacagaucacagagcccagcuccuccaggacccaguacagccccaacuguugaugcauucauucaacaaacauuucuugagcaccuacuguauuccugacccuguauuauaagcuggagacgccauggugacagacagacaucccuguccuuguggggcugacauuugggugggggagauggacaaugagauuaucaguaacuacaacaaauguucagggagugauaaguggccggggguguggugggcagagggaaggagagacuucguaaagaggaucucaagcaccaggagauggaauuuaaacagccggucaggggaguccucacugggaaaguguuauuugagcuaagucauaaaggaggagaaagacggaaucaaaugggaugugggggaaagcauuccagagagacagaacagccugugcaaaggcccugagguggaagcaucuuggggaacaaaaggaagugagcaagggagagaaugagaggaagugagggcagggagcugaauggucagaucgugcaggggcuugagggccucggggaggacuuugacuuuuaucccugaaugaggugggagccacggaggauuguaagcaggggaaggaugugccugacuucuuugguguucacagcgcccucugguggccauguucaguaaugcucagcccuugcagcuucuggguggaucugauuuuuuuuuuuuuuuuuuuuuuagacagucucugucucccaggcuggagugcaguggcacgaucucggcucacugcaaccuccgccucccacguucaagugacugucacgccuuggccucccaaguagcuggaauuacaggcacacgccaccaugcccagcuaauuuuuuauauuuuuaguagacacgggguuuugccauuugguuaggcuggucucgaacuccugaccucaagugaucugccugccucagccucccaaagugcugggauuacaggcucgagccaccgugcccagccgguguccaccccaugucuagcaccagccagacacugugccggcgcacccucaucuucaggccugggugacaccagaggugugcuaugguguguccuggacaggggcugggccagaggacauugcucguccaggcagaaacaucaggccuggggaggggcacaggaaaaaucaaccuacccuggcaggggccuggccuugaagcaggaagagaugccguggcaggaaguuggccccaguguuuaaaaaaaccacguagcaacuauuucucgcccaggaugcccaggaaagcaaggguacugggggauuagauccaucaccaagaaggauacagucagcccugaacuucucuggggccgcuucuaauccacuacagggcuuggggcaaauuuuaaaagguacccuucccguggguuagcgaacuggccuaguacagugauuuuuuuguuaggauuugcugccaucugcuggacaauuucauucacaacauacaaaucugcaguaugaaaagagaugggaggggcccuugugcagugcacgcccugcgcaacuguauauagcagcuguguuuccucuucuggguagaaacucugcuccccaguaggcgaucguuaguuuuaccggggcucugcuggaacaggccagugauccacugcucucuugcuuuuaucccuuacaggugcugcgauacuuugacuacguuuuuacaggcgucuuuaccuuugagauggugaucaaggugagugcagauuauaagugagaacacacgguaauuuuuuuuuuuaagcaagugcagggcugggcacaguggaucaugccuguaaucccagcacuuugggaggcugaggcaggcagaucacuugagaucaggagguugaggccagccuggccaacauggugaaaccccaucucuacuaaaaauacaaaaauuagccgggcaugguggcacaugucuguaaucccagcuacucgggaggcugaggcaggagaaucacuugaacccuaggcugcaaugagccgauguggaggcugcagugagccgagaucuugccacugcauuccagccugggugacacagcgagacucugucaaaaaaaaaaaaaaaaaaaagagcugggauuccaggagauccugagccuccaagaaugccccccuugagaggaugagucucccagaggauuagaaaugccugguguguuugaagagcagcaaggaagcugguguggcugggcggagugagagaacaguggggaaacgaaggacagagagaugaguggggaggugagggggcaccuugugccggggaucacagagagggcucuucggcucuuacuuugagugaggugagggccauagaguguucugagcagaggagggacuugauccagguguucacaggugcccuuuggcaucugugggaagccagaggaccugugagcaggugaucacacugguccccaugggcgaugacggggacaggaucaggcuggugaccaaagaagaggugagaaguggacagauucuuggaagguucuggaaauagagccagugaguuuugcugauagagccaccaaugagggauuugggacaaagaggcaucaaagaggaucccaaaguuuggaucuaagagccggcaagccagagcuggcuuccaucaggcaaaggggggccgccucauggggcaggggcuccccacuccucccuggaguccucuggccacugcccaucccugcaagaugagguggccucauuggcuucccugccucuccccgagaggcuagagaguggguggcagcaccccaggguggggaucagguggggguucugagcacccucucuucucccccacagaugauugaccuggggcucguccugcaucagggugccuacuuccgugaccucuggaauauucucgacuucauaguggucaguggggcccugguagccuuugccuucacguaagucuccucgcaaggguuccucuugccucuuuucccccaacccccagccugggccacacaucggauuacaggacauguucucagggucuagggauggggugugugggcuccggggacgugggagauaucagcaugccaccaggaagagcuucgauggcuuuuugcaugauguccauggaggaagaaggagaagggacccccccuccugccaaccuucuaccuccucacacagcaacgggccucagccacaucacuggccccuugcugugcagcuuccuguagacuagccucgccggaacaucucaucccccuacuacuccacaagcgccgcccaaaccgcugucucuuuggaaagucccuaaagagacaaucaggaaacgaaugugcaugagaauucugacccccucccuaugccugaaggccccguaguuguagaccuggugacucccuuugugugucuuucacuucuccuggcaguccuaggauucucugcccucugaaaggccaugugucauccugcagcuccaagauggcgccccaguuguaggcagccauuucaggauggcacccaagcucuuaguagucaucccaagauggcauccaaguucuggguggccauuccaagauggccccugaguucugagcuaucauuccaagauggccucugaauuugggguggucauucuuagauggucccugaguuccaaggugaccuucaaguucuggguagccauuccaggaugguccccaagcucuggguggcuauuccaagauggccccaaguucuaggcagccauugcaagauggccccugaguuccaggguggcccccaaguucugggcaaccauuccaagguggcauccaaguucuggguggcuauuccaagauggccucugauuucugggcuaccaugcuaagauggccucuggauucuugguggccauucuuacauggucccugaguuccaagguggccuucaaguucuggguagccauuccaagacgguccccaagucuuggauggcuacucgaaggugacccccaaguucugggcagccaucucaagguggcacccuaguucuggguaaccauuccaaaauggcacccaaguucuagggcaaccauuucaaaauggcccccaaguucugggugacuauuucaagaugguacccaacaggugaguggccauuagcccuuagggcccugauagcagacuuagcaguacauuccugaaguuguagacauuuggagcgggaugaaaaauaucuaaucagucuuuaaucaagaaacaaaucuuggggacccuggcugugcccaucauggugaaugauucccugacagguuuugaaaggaucuugacacauucacucccaucgugagagaaucaggggcuuccuccugugccucugccucuaggcucccuccugagccaaucuggaggggcccuugaauggucucccucaccaaacaaugaggacuugguuugucaggagggccaaaauaguggcccauuuccaguagaagggcuguuaaguaggccacacuuagauucuucucugggaacacaaugaggucaaguuguguuagaacaaaaaaucuccagaguuuuuggaugccucagagcuggagauguaucaugaagguugggaggcugauuauacuucuuucucuuucucuuucacuccuuccuccucuuucuccucucuuuuuguucguuuacucuuuucuuuuucucuucuccucucccuccccacauccuucccucuccucaaagcuuuucagugucuauuugacuacuagagcaaugcacgguggcuuacaccugcaaucccagcacuuugggaggcugagacaggcagauugcuugagcccaggaggccaagaccagccuggguaacauagggagaccccaucucuaaaaaaaaaaaaaaacaauuagccaggcaugguaguaugccugcacuagcagcuacacgggaggcugaggugggagaauugcuugagcccaggagguucaaggcugcagugagccgaaaucgcaccacugcaccccagucuggggaacacaggaagaacuugucucaaaaaaauaaaaaguuuaaaaaauuaaaaaucaaugaauuugcuauuuagaauauuaugcuuuauaugguuacugaauaauuuuaauagugaugaguacaaaaaaaacagguuuagcaagcuguucuguagguuaaaaaguaaauaaauaaauaauuaauuaaacaaaauacaaugcacaucaaauuaggggacaaagauugugacgaauaagacaaggaguccaugucuuuaaaauaugaaaagcaguuacaaaucaauaagaaacacuacuucucaauggauaaaugggcaaaggacauaaacagaaaucugauagaaugcuggcaacuaguaaaaauggagguaaaucaacccuuggaauucagagaaauguaaaauaaaaacgagauacaauucauucccuaucaaguuagcacuguucccgccgcacccccacacacacacaaaaaaugauuuuuuuagcuaauaaacagcauauauaagaauguauuauaauaggcugggcacaguggcucacgccuguaacccuagcauuuugggaggccaagggagggggaucaccugaggucagcaguucgagaccagccuggccgacaugacaaaacccugucucuacuaaaaaauacaaaaauuagccaggcaugguggcggaugccuguaaucccagcuacucagguggguaaggcaggagaauugcuuggacccaggagauggagacugcagugagccgagaucaugccacugcacuccagccugggugagaaagcaagauuuugucucaaaaauaaaaaaaggaauguauuauaauaaaauauacuuuucucccccucuaucaccuauuuaagcagguccuucaaguugucagguagacaucaugcuaugagaaaauuuaaauccugaaaagccagaauguuuuaccacccucagccuggaaugaauccuucuccuauggaaauaaccuacggguuucuccaccccucucugccuuucagccccuucccucccucuccccuccuuuucuuucucccucuuucucuuccuccuuuccccucucuucccucucucuucuucccucucucugucucuuucuguucgucuuucuccuuuuacccccucucaguuucuaucuuuuuauuuuccucuuucucucucucucucccucucuuucucucucacucccugcacuguugaugaccuauguccuugggugaugugggccuccccuggaccguguagcuuggagaaagcugacccucugucaucggucuggcaacagggacuuggccccccuacccugcauucugaugaggaaugguauucagacaaaggcagaucccaggacacaggaggacaugcucaggcagggacccccgccccuuuccucuggggcaaggucugcucagcagccuccaagauuccuagggcucaagagguggcagguagcucagggcacuagggcaggcaguggggugaauaugucacucauauccaccuguccacacacaaugcuuaccuuggccaccugugcccaggggaauggguuuuauccugugaauccucccagugaccaccacugaguguggcacagauaaaugguaccaagcccaagcuguucaggucuccaaugucacuuuccucucagaccucuguuguagcugacauacuguaaugcugaggagggccgggcacaguggcucaugccuguaauccuagcucuuucggaggccaaggcagauggaucaccuggggucaggaguucaagaccagccugggcaacauggugaaaccccaggcaacaugguaaaacccugucucuacuaaaaauacaaauauuagccaagcgugauagcaggcgccuguaaucucagcuacucgggaggcugaggcagaagaauugcuugaaccugggaaguggagguugcagugagccaagauugcaccacugcacuccagccugggcaacagagcaagacucugucucaaaaaaaaaaaaaaaugcugaggaggugacugucccaccuccauccuccgaguugaccaucacaauuuagggaggggaaugaccuacaaaggacccagaagcaagccuuucaauuguugagcuuuugccauuaugggccaucguuuacaacaugcuguuucuagguucucuggagguaaaauuagccuccucuuuuaaacaaagcuaaucugcaaaagcgaaccaaaaauucuuuuccaccagagaucaauuagcagaaugagcugggugcgauggcucacaccuguaaucccagcacuuggggaggccgaggcagguggaucacuugaggucagggguccaagaccagcauggccaacauggugaaaccccaucucuacuaaaaauacaaaaacuagcugggugugguggggagggccuguagucccagcuacucgggagggugaggcaggagaauugcuugaacccaggaggugaagguugcagugagccaagauugugccacugcacuccagccugggugacggagcaagacuccaucucaaaaaaaaaaaaaaaaaaaaaaaacagcagaaugauucuuuuggggaguugacuuuuuuuuuaauuucugaguuuucuuuuuaaauaucaaguuauacaagggcauucaaauuggccuacaacucacaggaauuuggcagccuguuugcagagucaagcuuuuacauuguucucaugaaauugguacaggcauaaagccacccuucacucuugaaaauccauuuugaauguuguuguuuuaauucuuaugcaagaaaaggaucuggauagggauuucaggccauccugucaacccuggcaggcuuguagaucaugcaggaacugggaggugugagauuuugccaguaggauccuggcaagugccugggacucucccaggguuuuggaagagccgacggacaugaguccaacagggagcaucuuuauaucauggccgaagggaugagagaggagacccucaaaccucacgccuaccacacccuccccaccccacugucaagaguccaucugguacugcuguuccucccccagggcagggcugcaggcccagcacagcuggccaggugccuugaucaagccauuccugcacaccuaagagccaaacugcuagaaaaccagaauaggagcuacugcuuuuuucccuaaaaaguuuuggaaucuucuccccguuacagguuucuggccucuuuugccugagaaggucucucacccuaugaggacuuugcuuauugucuuuccuuguuaucggauaguuggcacauuggaaggagcauggaugcucugagguucucagccugagcgcugaacucuccacccgccccccaccccccaccccaggguccucugcuuauuuccuuucuggucuuuuaacuugcuuugucuguccucugugcauauccccucauagacaaggcugagagccccacaaguauuagauugaccuuauuguuuuaagaaauugucccuccaggucuguuugauuucucucuagaugugcaaguccuuuagccucucugugccucaguuuuucccaucuagaugaggaaacugcggcccagagggacuguggagggaaguaaguccgacaagaucacugagguuggguucagcugucagaugcuacccaucucccagcccugaauacggaggcucacagugagcagaaugaugcucagcagccuggccagccuggguucuuugaggccuggcagggcugcgagauccaggggaagggaauaggggaagggagcauaagguuauucccuuccuuguugaaaggaaccuugccauucuggccuguuggggucaaagcaaggauucuucccccagugcugugauuguggccucgucuccgauaugggagaaaacuaucccuguggucccaccaagggauguauugaagcucuucugaagauguccaccccuccugcaccucacccaaauaucuguguguguguguccugcucaauucacugacugugucccuuguauccaugcgucuaccauaaacaccccauuucaugagccaucacacgugguaucacgcucugugcccaugcaucagggcggccaacugacauuucucagcagcuggcagaucaugauccugcccucaccgccaagaguccaucuggcgcggcuguucuucccccaaaggcaggaccgcaacuggcagagcgccuugaucaagcugcuccugcauacccaggagccaaacugucaggaagccaaagauggagcccucaggcugcuaucucuugauccucaucuucaaaacagcccccaccccugaaggcauuauuuuucuuguguaugaugaaauggaaagaagauuagagugcgagauacccacaccuggguuugaaucuuagucugucuucccagcugugugccugcccuugggcaggucacucuuuuucucuaggccucagcuuccucaucuggaaaauggucauaauggugcugucuucccauaggcaaaugcagugauguccagaagacucccauauuaaaccuaaagucagcagauuaggcaaaaaucacugucauugaaaacucccucaaucauccguaaagaagcuggguguggugucucucaccuguagucccagcuacuugggaggcugaggugggagaaucacuugagccagggaguucaaggcugcgguaagcuaugauugugcuacugcacuccagccugggcgacagagcaagaccacgucucuaaaaauauaaaauaaagccgggugcgguggcuuacgccuguaaucccagcacuuuggaaggcugaggcagccuggcaacagagugagaauccaucaaaaaaaaaaaaaaaaaaaaaaaaaguagaaucuauaugauucuacguaugcaauaauuccuagauacacugaauuugagaaccccaagucagacuacaggaaaaggagaugaggggguguggaggagaauccacuuggaauauuuguagacauuuaaaccauucuguguuuuaaaaaauaucacagccgggcgcgguggcucacaccuguaauccuagcacuuugggaggccaaggugggcggaucacgaggucaagagauggagaccauccuggcuaacacggugaaaccccaucucuacuaaaaauacaaaaaaaauuagcugggcgugguggugggcgccuguagucccagcacucgggaggcugaggaaggagaauggcgugaaccugggaggcggagcuugcagugagccgagaucuugccacugcacuccagccugggcgacagagcgagacuccguuucaaaaaaaaaaaaaaaaaucacuaacuuccagaggggucguggauggaaaauuccauagaguccgcuuggcgacaggguuuccgccauucugauggcggucaagucuuucuaaccuggaucuccagucauuguugaaggcgccuaaugagccccaagccugauuccaaugaaucacgagaggaccagcugcuaggugcugauagcuuuccccaggcccgcauuugcucagagggcuucagaguugcuucuaauuccaucccaagucagaacucuuugcugacccccuccuucauaaagagcaaagccaaggccauagcuuuuguuaaucaaacaucagaauuccacagaccugaguugguugguuguuuguuuuaagagacagagucuugcccaggaugcaguggcucacacuuguaaucccagcgcucugggaggccuaggcaggaggaucacuugagcccaggaguuugagaccagccugagcaacauaaugagacccccgucucuacaaaaaauggaaaaauuugccuguauuuccagcuacuugggaggcuaaggugggagaaucaccugagcccuggagguugaggcuacagugagccaagaucccgcuacugcacugcagccugggcaacagagggagacccugccucaaaaaaaaaggagagaaggagagagacagggucucccuauguuguccaggcuggucucgaacuucuggccucaagcaaucuucccaacucguccucccaaggugcugggauuauagcugugagccacggcacccagucugggccuguuuugcagaugaggauaacgagaggcagagucaggauucaaacccagguccccucaacuucaaagcucacaaccuuuuagacauucuaaaaccuugcagcuccacaacgccuggagaagagggguuucuccggcucuuggcagugacuuuccguggugaauucaccuuugguaacugacagcuuugcagcuguccugcuaccuggaaauuuggcuuucuuagugcuuucuugggcagugccaggugccugccaagggcgggggacugaauggaggugggggcggcuuccagauggaaggauggacaucggccagcgccaugagccugaggcucccccaacugcugcccgggcgggacucgggggugcucaggggugcguguguguacgugcguguucuguguucuuuuuucugaggccacuuacgaucugucucucccuccgaugccacaucaccaggagcaguacacgguaaagucucucucuaucuuucucucucucucucuuucucucucucucucucucauauucugucucucgugaucuguccccuggugcagccucguuaguucugggccuguuucuguggccuuguguccuugcugccgcuguccugucgcuucaaaugaccagaacucacucccugcgaaggaggcaucccaaagggucuugccaaugccuccgcccaugccccaccaguucuugcagagaacagaaggggcagagguucaguuucaauaggcaagcuggguggagcaguuaucagaagcaaugaaagugggccagacacgguggcucacgccucuaaucccagcauuuugggaggccgaggcggguagaucacuugaggucaggaguuucagaccagccuggucaacauggugaaaccccaucucuacuaaaaaugcaaaaaauuaucugggcuugguggugcacaccuguaaucccagcuacauaggaagcugaggcaggagaaucacuuaaaccugggagguggagguugcagugagcugagauugcaccacugcacuccacccugggugacagagugagacucugucucaaaaaaauauauaaaauaaauugaacaauaaaaaaauaaaauggccauggaaucguuuucagaugaggagaugcagaaugcccauggagacaugcucccaauugucacuuguuugggacaucaagauuuuagccaguuccaugugcaaccuggauguacaguuccuugacuuuuuuucuaucaacauguauucuaaaguucaauuucaaaaggaaacuuuagccaggugcaguggugcaugccugcagucccagccauuugggaggcugagacugaaggaucacuugagcccaggaguuggaggcugcggugagcuaugaucgugccacugcacuccccccugagauuccaucucuuuaauuuaaauaaaaaaaaaggaaacuauauuauccacuuacaaccagcauugcuaaccuaagauaaaucugcaacugcaaaaguaaauguaggccagacaugguggcucacaccuauaaucccagcacuuugggaggccgaggcagguggaucacuugaggucgggaguucgagaccagccugaccaacauggagaaaccccgucucuacuaaaaauacaaaauuagccggacgugauggcacaugccuguaaucccagcuacucgggaggcugaggcaaaagaauuucuugaacccgggaggcagagacugcugugagcugagaucacgccauucacuccagccuggguaacaagagagaaaugccaucucaaaaaaaaaaaaaaaaaguaaaucuaacagaaaccagacaauguuguugccuucaagcugggcucuuuguuaaaaggaaaauuacuaaguguuagggagguguuaaaggccuauuagcaucuaccugaggcuuccuuucucgcaaaagcagagcgucugaaagauacguggaaaagaaacuuaaaguauaauaaaaaagaaagaaagaaaaagaaaugauuaugccccucugagauccaauuauuuaaucugugccccuguucugccuaaaauuaucucagugacuguccaacgugugucucacacuugggggcacagccuugagaugauaaugaugauguuaguuuuaaaaagaaaaaaaaagguucagaguucugaauccuggaguauaucucugccuagcaggcuaaaauacaauuaucgucuuuguucccugaaaaaugaaaaaaauggaguccuuuaaaaagcaaauggugugaagaaugauguuuuugcacuggauacugagacccaucgugaugggggucucuggggcagcucugcucaugaccugggaggucacuguagggagauguuuucuaggugaccuccccacccaaauacuccaaccggaggcauucacguguccugagaccacacgccaggcgcaggcuaggggcuaggacaagaaucaagauuaaaggggaaauggccaggugcgguggcucaugccuguaaucccagcacuuugggagucaaggccaguggauuacuugaggucgggaguucgagaccagccuggccaacacggugaaacccugucucuacugaaaauacaaaaauuagccagguguggugacucaugccuguagucccagcuauucgggaggcugaggugggagaaucacuugaacccaggaggcagagguugcaguaagccaagaucaugccacugcacuccagccugggcaauagagcaagacuccaucucaaaaaaaaaaaaaaagauuaaagggaaaaugaacacagagaagaguagauuacacuguaagccuuugaagaguuuucugucuaaaaccagagaccgaagaaacaaacaaagauuaacuccgaaauagcacauaggagcuggcaggagccagagguaggcagucaggaaaugcugucggagggagcaacagguaauuugggcuuugaggaccggguaguucugugacuggagaaguggaggaagggcauuucuagcagcgggaacaguauaugcauaagcagacagaggcaaaagaauguggcuggggcuugagauauguagccauaaaugggaaugcaaaggugaagguaaguuggacuagauuuucaagagcauugaaugccaugcccagaaguuugcacuugcucuucugagaauucacgugcuccagaagaauucugagcaagagaaagagugacaaggucauuggcuuuagccacugugugcauaaaacauggaagaaaaggcagggaaugaggagcaaguugggagacgggugaggggggauggcacccaggaauggauggcgggauguuaaggaaggugacccacuggggauggggauggggauagagggcaggcaguugaccaugacucucagguuucugguguggacaacuggaugggucaugagugccaugaaccacaagcuauucauggucccacucaauacccuccucuuggggggccugagucaugguuggccaagggugucauggcaucucuggggucugcauugcuaagcucaguuccaacagaccuuggacugaacuucugugcaguccucucuggcaaagaugggcucagagacccuuggagcaaugcagcagagaccauggcagcagccacaucagcaucugaaaacagcggcacccgguuauuuucccuccuucagacucagggaauauggugggggaggggagauuugguauaagggccacuuuaaguaucuuccagaaucccauuggaagggggagaaaaucccauuuuuuuaagagcccacugauaccaccuuuaaaaagaauacacagggggccaggcgcaguggcucacaccuguaaucccaacacuuugggaggccaagguggguggaucaccugaggucaggaguucaagaccagccuggccaacauggugaagccccaucucuacuaaaaauacaaaaguuagcugggcaugguggcacgcaccuguagucccagcuacuuggagaggcugaggcaagagaaucacuugaaccugggagguggagguugcagugagccaagaucauaccauugcacuccagccugggcaacaagagugaaacuccaucucaaaaaaaaaaaagaauacauaggggaccacuaaacuccuagaccaagggcuuuuuugaaaauagcugugaccagguguaguggcucacaccuguaaucccagcacuuugagagggugaggagggcagauugcuugagcucaggaguuugaaaccagccugggcaacauggugaaaccucaucucuacaaaaagacaaaacaauuagccaggcgcaguggcgugugccuguagucccagcuacuugggaggcugaggugggaggauggcuuuagcccaggaggcggagguugcagugagccgagaucgugccacugcacuccagccuuggugacagagccagacccugucucaaaaaagaaaaaagaaaagcugugcagaaauggggguggggaaucagccaacccccuugugcugggucucagggacacccaauacagcugcucaggcccagccagauggcaaagggcccucaaccaacccugggaccagaaccacaaaaagccacguacuuacuggcucccgagcccaagcuuaacaggugaaauggaccacucuucaccaggaagggcagggcugugccaagcucaccccagacuucuaggccugggaggguagggucccauggagcugugggcugcccccuacccaaccugaccucugcuuccucucuucccuucuucccaccuaaacauuccuccacaguggcaauagcaaaggaaaagacaucaacacgauuaaaucccuccgaguccuccgggugcuacgaccucuuaaaaccaucaagcggcugccaaagcucaaggugagauugggagaugguggggugcggugggggggacugucaggguuaucauguacagcugagcagguuguacacugcucaaggacaacacauuaaaggaggugcugauaacauccuagccaucguguauggauauuuguauuauuacaacuucccagcagauggcaguaaagugagcugaccuaaaauaaucuguguauuauggcaguuuuucuuuagaugaagugucuugggguuaagauccuuuuuccuaauucgcaugaaggcaucauauggauuuaaaaggguauaaccgugaucugggaagcaggaacuagauuucuuguuccauaaaauuuugacuuuucaucuaccuauucuaggcucuaguaucucccauuccaaaauagcaugaaccagcauuucccaaaagccugucauucaaaaacauauauauauauuaagggaaauaaaauccagucauuagagcacccacuuucacucuaugcuucaccuggggguccccaguauuaucucuuauguaauauguuucuuuaaaucaagucacacccguaaucccugcauuuugaaagaccaaggcaggaguguugcuugagcccaggagaaugagaccagccugggcaacauaguuagacucugucucuacuaaaaauuaaagacagaaaacagauacuguuauggaaaucuaaccaaauauggcugccugccuaaggcuuugugcauugacaacugcucuuucuugguuaaagagggaaaaugucaaugguagguguuaacaugguagcaacuaaguaaaaauuucuccuucacucaaaaggauugagagaguuggaaaggaaguaacuuuguuaccuuguuuuucuguguugggcuccuguaucacuuaaaagcaucucugguaucccaucugggaguuuuagauccauagaaugccaggauugaguccaacuccuccaacgcuuauuucugaaagcuggggggaccuuacccuagugacuugacuuaugaccuugccuguaaaaugggaaugaucauggcaguauuuugguaugaugggccacuggaggcagaagguugggcagguccccagccccucaugcucucugucaacuccaccccacaggcuguguuugacuguguggugaacucacuuaaaaacgucuucaacauccucaucgucuacaugcuauucauguucaucuucgccgugguggcugugcagcucuucaaggggaaauucuuccacugcacugacgaguccaaagaguuugagaaagauugucggugggucuccacuuuccagcacauucccauuggaaccagcaggugggcaggggggaaguggcuagaggcauuggccacuugggcucagagacuggagaagugaugagccuuggaagugacucaguugcaaccagcuuggaucuuggguagaaagaaaaccgguuuuagaauuugagucaccacccagagccacagaaugagucauaagcaaauugauugaccuuucagccaccgccuuugucaugugagggauauuaauacacauccacaguuccuuacuugaaaucguuacaggcagauguguuucaaaguugagaauauuuugagauucccaugugggacaugacacccucagcugggucuaaggcagcccuauaaucaaacacaauauuucugccauaaaauguguaacuauuuacaucaaaugggguaaauaacaaguauaaagagcuucauguccaaucagaucagguuucauuaccaaauaaguuagguaagaggccaggugcaguggcucacaccuguaauuccaacacuuugggaggcugaggugggaggaucacuugaggccaggaguuggagaccagguugggcaacauaaugagagcccauccuacaaaauaaauuuuaaaaguuagcggggcaugguagcacacaccuguagucccagcuacccgggaggcugaggcgggaggauuguuuaaacacaggaguucaaggcugcaaugcacuaugaugguaccacugcacuccagccugcgugacagagugagacccugccucucaaaaauauauacauauaggccgggcgcaguggcucaugcuuauaaucucagcacuuuaggaggccgaggcgggcggaucaugaggucaggagaucgagaccauccuggcuaacacggugaaacccugucucuacuaaaaauacaaaaaccuagcugggcaugguggcagacgccuguagucccagcuacuugggaggcugagacaggagaauggcgugaacccgggaggcggagcuugcagugagcccagauugggccacuguacuccagucugggcaacagagccagacuccaucucaaacaaacaaacaaacaaacaacaacaacaaaaauauauauauauauauauguauauauauauauguacacgcacacacacauauguauuauauguguguguguauauauauguauguguauauauagugauauuguuaccaguguaaaguggcauuuugcaacacaugguagccuguuguuaucuugauggcuauuuauugaaauuaggaggaugccagaugucuggauaggagucuggaacuaacccuuguuuccugccuugaaaaggaguagcaaccucccuuagccugaugaaccucuaaauguccccuaugucucucugccuccuccuaaacucccuccaccccacccccagcaagccugaggcucucacccugaggacuagaaguuaucacguuggaagagggugcuggacccugggucagcucucccaccaggaguaagguugugccaucacccauggauuuaucucaaaguagaugcacacgucauccccuaugaagcacaggaacacaugguggcaggauggggagucacugcuucccaagcagucuaggcugguggaccacucuuccuuucccucccccugucucugauaaccaaagacaagugcaagacagccccucuuucccauuuacuaacaguccccacucucuguggcagaggcaaauaccuccucuacgagaagaaugaggugaaggcgcgagaccgggaguggaagaaguaugaauuccauuacgacaaugugcugugggcucugcugacccucuucaccguguccacgggagaaggcuggccacaguaaguggcccgacuggaaaucuauccaggaggagcccuggggagcaggaggauaaagggccugagagcuuagcaauaagaaaggucuuggaggccgggcaugguggcucacgccuguaaucccaacacuuuaggaggccaaggcagauguaucacuugaggccaggaguuugagaucagccuggccaucauggcaaaacuccauuucuacuaaaaaucccaaaaaaaaaaaaaaaaaaaaaaaaaaaaaagcugccaggcaugguggcucacaccuguggucccggcuacucaggaggcugagacacgagaaucacuugaacccaggaggcagagguugcagugagccgagauugcaccacugcacuucauccugagugacagagcaagacuauggccuccccgccuucaaaaaaaaaaaaaagugaggcugaaucauggacuuagucuuuauuuaaaauuuugagccacuugugguggcucauaccuguuaucccagcuacucaggaggcugaggugggaggaucgcuugagcccaagaguucaaggcugcagugagcugugauuaugccauuguacuccagccuagacaacagaaggagaccccuaucccugaaaaaaaaaaagaagaagaaauugauauuuguucaucauggacuuuuugcauuaauuuugauuuuuuaaaauauuggagcaaaagauuaucuugauuacugagauuuucaguacccccuuaauuugcacccaaaacaaaugccucccucccucaccucguccaaguaauggucuuucucucagaggucuuggaaaugccaggcuggaagcuugguagauuccagcaugugcccucagcauccucaccucccucccucucucagcaaauaugccaaccugaacaugcccuacuacccacucucagacacauccaguacucacacaugugggaauaaugcuaacccacaaggcaccuuugagcaaaguuuuuuuaaacaccuuucucaacagacuucauuuccaucugucugaaaaucaucgcaauagacuuaaaugauuuuguucaaacaaggcacugaaggaccaccugccaaaaaauugucaucaugaauacacaaaucuaucaugccuaucaugugaagguaucgcuuagacacagagccuuugagcagugugcaaccugcacuacuguacagagcugcugugcacuuacccacucucauauauauccccauuguaccuccugagcacccagcaccaccugugcucaaauacccacucuacaugcauacacccaccucuacucccuccauugccacaaccugucuuuaaaucccaacuuggccacuuauaaguggguggucuucagcacgucccuuuaaauugcugaaccucaaguuccucaugugcaaaguggagccaguaauaaccucccugggaggguugcugagccgguggggaugaauuguugaauauuguuuccagcacacagcaagcccuucaugcacagcaguagaaaugacugacauuggccaggcgugguggcucacaccuguaaucucaacaguuugggagaccgaggcagguggaucaccugaggucaggaguucaagaccagccuggccaacauggugaaaccccgucucuacuaaaaauacaaaaaaauuagccaggcuugguggcgcaugucuguaaucccagcuacuugggaggcugaggcaggagaaucauuugaacccgggaggcggagguuguagugacccaagaucacgccguugcacuccagccugggcaacgagagcgaaacuccaucucaaaaaauuaaaauuaaaauuaagaaauaacugacauuguugucagccuuucaaaaaacagcgacuacuuaaauuucuuuuucauuucccucuguuccuguucugccaucucacuuccacccucucuccaccuuccucaucaccccuugggucccugucucucuccuuccugccccuucccucucccugccccauuccuugcaggguccucaagcauucgguggacgccaccuuugagaaccagggccccagccccggguaccgcauggagauguccauuuucuacgucgucuacuuugugguguuccccuucuucuuugucaauaucuuuguggccuugaucaucaucaccuuccaggagcaaggggacaagaugauggaggaauacagccuggagaaaaaugaggugccacuuccaauuccaucuguccuuuaaaaacuggggacacacacaaacuuuaaaacacacacaacacccaggaaccccuuucuagggguaccugggggagggaacagaagcauugucccaaccgaauccagucuucagggcagcccuucauggaguuuccagaggaaacacaucauauaguguauguaucagucaguuuagacuagguuaugccgcaguaacaagcaaccccagauuucauugccaaauauccacaaagggacuuauuuuuugcucacacugcaugucaacaucaguuguggaucuugccaucuuuauucugguucccaggcuggcagagcagcagagcagccucccucugagaugcuccagaugaaaaagagaguaugucagacugagguucaguucuucaggcuugugcucaaaaauuacacaugucacuucugcucacauuucaucagccaaagcaagucacacauccauucugacaucaguggagugggcaaauacaaucuccccuagcgaaggguggugaauauuuaugaaugaaaagccaagccaggugugguggcucacaccuguaaucccaacauuuugggaagcugaggcaggaggaucacuugagcucaggaguuugagaccagccuggccaacauagcaagaccccaucucuacuacaaaucaaaaaaauuagccaggcaggauggugcacaccuuuagccccaguaacaugggaggcugaggugggaggaugcuugagcuugggaguucgaggcugcagugagcuaucauuaugccacugcacuacagccugggcaacagagcaagacccucucucaaaaaaagaaaaggaaagaaaauccaguccccugucuaccagagaguauagacaugacucuuugccucucuggcaucauccaagcuaaauagaggaccuagaauauauccucugcucccuugacccuuaagacuuaauaaccacuauuccuccuucucucucccucaaagagaaggagaagacgcagcaaaguauucaguaagaaagaaugggcugggcgcaguggcucacgccuguaaucuuaacacuuuaggaggccaaggcaggaggauugcuugagcccggaaguucaagaccagccugagcaacauagugagaccccaucucuaugauuaaaaaaaaaaaguuuuaauuagcugggugugguggugcacgccuguagucccagcuacucaggaggcugaagcgggaggaucacuugaguccaggaggucaaggcugcagugagcugugauugcacugcacuccagccugggugacaaagcaagcccgugucaaagaaaaaaaaaaaaaaaggaaggagggagggagggagggaaggaaggaaaugagagagagaaagaaaggagggagggaaggaaggagauagggaagaaggaaugaagaagaaagaaagggagcgaaggaaagaaggaagaagagagaaaggaaaggagaaaggggaaaggguggaaggaaugaagggaaggaaggaaaaaggaaagugaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggauuaggcuucaauuugauuuggcacacucgguagcugugucaccucaggcaagugguuuaaccuuucuaagccucuauuuuggugaucugcaaagugaggccauugauaguacccacuucccauguuuguauuagccaugcaauaauggggaaaugucagugcaaguuuuggcaguuggugacaucucaagcaacuguagcuguugggauaagaaagcaauggugagaaggaagagagagcccaggaauccuggcugggggcaagagaggcagagacucaagcagaagcacuugagaaccgcgacgaguuagacagagggugcccgguguacagccaccuuccuccugccucugccgcucucaccacuggccucucucccgcagagggccugcauugauuucgccaucagcgccaagccgcugacccgacacaugccgcagaacaagcagagcuuccaguaccgcauguggcaguucguggugucuccgccuuucgaguacacgaucauggccaugaucgcccucaacaccaucgugcuuaugaugaagguaagugccccacaccagcccccagcacuacuuaacccccaccucguuccugccucuacccugauaaaaugaaaccaucugcaguuucccagacagaccacacucuggaucaccucugagauuuuguuccugcuguucccucuaccugacacacuguucccaccacucccccggccagcuucuucuucccagcuguaccugcagaccucuuccuccagaaagccuucccugaccacccaagacugcuugaggugcccaucuuagcaggcauccuaucuuuaugucgccugccacaaaaaucugcgucagguugcaugacagugucccccacccauuuaugaugaccucagcccugaauuccuagaggccaacaaggaucuggcucagacggaacaagaagcucucuauaaauguuugauuaaugaaaugagggggcugggcgcgguggcucaugccuguaaucccagaacuuugggaggccgaggcgggcggaucaccugaggucacgaguucgagaccagccugaccaacacggagaaaccgcaucucuacuaaaaauacaaaauuagccaggcgugguggugcgcaucuguaaucccagcuacucgggaggcugaggcaggagaauugcuugaacccgggaggcggagguugccaugagccgagauagcgcaauugcacucuagccugggcaacaagagcaagacuccaucucaaaaaaaaaaagaaaagaaaaagaaagaaaugagggagaagggguaggugaggacccuaaaauccccagggcuaaggagcggcuuccaaaaaaaaacucugaaaaccuuucacccugugcuuuggacuccaaagcguggauucaagcccagcucuuccauuuaauucauuuaccuuuguacaagcaaccagugacuuucuggggacucaguuucccugucaauaaaaugggaaugauaauaagagcacauuugcccccuccagaggaggugagaggauugaaugagaaaguucaugcaaggaccuuagcuccuucucggcacuucaaaaacgaucaauaguggccgggcaagguggcucacaccuguaaucccagcacuuugggaggucgaggcaggcggaucacuugaggccagguguucgggaccaacuggccaacauggugaaaucccgucucuacuaaaaauacaaaaauuagcugggcgugguggcgcaugccuauaauaccagcugcgugagaggcugaggcaugagaaucgcuugaacccagggggcggaaguugcagugagcugagaucacaccacugcacuccagccuggguaacagagugagacuccgucucaaaaaaaauaaggaagccggggacgguggcucacgccuguaaucccagcacuuugggaggccgaggagggcgaucacaagguuaggagaucaagaccauccuggcuaacacggugaaacgcugucucuacuaaaaauacaaaaaguuagcugggcaugguggugggcaccuguagucccagcuacuugggaggcugaggcaggggaauggcaugaacccaggagguggagcuugcagugagccgagaucgcgccacugcacuccagcccgggugacagagugagacuccucaaaaaaaaaaaaaaaaaaaaaguauaauucagccaagcacaauggcguaugccuauagucccgacuaucaggaggcuaagguaggauugugaguucaagcccagccugggcaaaauaggaagaccccgucuaccaaaaaaaaaaaaaaaagguugggggagguuuuuguuuuuuuggaugugaaaagaagagccuaguccggcggagagcggggcuuuccugaacugugccuccuaccagugagguugcucagaccuugccuggggcuggaguguugccuggagaacagccaugaagcugccuccccacuucccacuucccaccccugcucgcugaccccugcuacuccugcuucuuuccccuaguucuauggggcuucuguugcuuaugaaaaugcccugcggguguucaacaucgucuucaccucccucuucucucuggaaugugugcugaaagucauggcuuuugggauucugguaaguaccaccuuggggcuacagcuaugggcuugggagaagcccaagggggaacaauggguccuggaugauggucucccaacguggccccaagaaccccaaccucaaggguggcuucaguauccugccaguggccacagauccuacuuaggcauucuuguguuugccaaggagucccagggagacccaaccugugaguguuaccauauggcugcuuauguauccaguuccucaaaaugaugggagucaucauggcugggagucuuuagcauccauuuuagagauaagaaaacugaaaucaggcugggcgaggugucucauggcuguaauuccagcacuuugggaggccaaggugggcggaucaccugaggucgggaguucgagaccagccugaccaacauggagaaacucugucucuacuaaaaauacaaaauuagccgggugugguggcgcaugccuguaaucccagcuacucgggaggcugaggcaggagaaucgcuugaaccugggaggcagagguuguggugagccgagaucacaucacugcacuccagccugggcaacaagagugaaacucugucucaaaaaaaagaaagaaagaaagaaaacugaaaucaggcugagcacaguggcucaugccuguaauccuagcacuucaggaggccaaggcaggaggaucgcuugaagcuaggaguucucaaccagccugggcagcaaagcaagccccugucccuacaaaaaaaaaaaaaauuuuuuuuuaauuagccaggcaugguaacucgugccuguagugccaguuacucaggaggcugaggugggaagauauuuugagcccaggagguggagguugcagugagcuaugaucaugccacugcaccccagccugggcaacagcaagacuccaucuuuaaaaaacaaacacagaggucaggcacagugacucacaccuguaaucccagcacuuugggaggcagaggcaggcaaaucacuugagccuaggaguucgagaccacccuggccaacauggcaaaaccccaucucuacuaaaacuacaaaaaauuagccuggcgugcuugugggugcccaugaucccagcuacucaggaggcugaggcaggagaaucgcuugaacccacaaaguggagguuacagugagcugagaucacaccacugcacuccagccugagcaacagagcaagucucaaaaaaauaauaauaauaaaaauaaauaugucuuuauuuuucaccagccacuaacuaaauuuuaacauuuccuuccaucuuaaagggagauaacaaacccuuaguauuaguauuaucaacccuuaauauuaucaacaugaccugugucacuuauaaacaucagauauuuucauacugcauuauaagagcugcagauaccuuaacauuuaauuugcauucaucauugcuuuaaaauguugcuugugauuaaaccuacagcuagaauuuguuacucaguguuuuuuuguuguuguucuguuuuguuuuguuugagacagucucgcuguugcccaggcuggagugcaguggcgcaaucucggcucacugaaagcuccacccccuggguucacgccauucuccugccucagccucccgaguagcugggacuacaggugccugccaccacaccuggcuaauuguuuguauuuuuaguagagaugggguuucaccauguuggccaggauggucuugauuuccugaccucaugauccgcccgccucggccucccaaagugcugggauuacaggcgggagccaccgcacccggccuacucaguguguuaauggagaaguauauucauuguuagaucgccauuuuuaaaacuuuuuuuuuuuuuuugagacacagucuugcucuguugcccaagcuggaguaccguggcacaaucuuggcucacugaaaccuccaccuccuggguucaagcgauucucccaucucagccuucugaguagcugggacuacagaugcacaccagcaugccaggcuaauuuuuauauuuuuaguagagacgggguuucaccauguuggccaggcuggucucgaacuccuggcaucaagcaaucugccugcuucagccucccaaaaugcugggauuacaggcaugagacacugugccuagccuuaaaaaauauuuugauagcuauuuuauuacaaaagguaaccuugaagcccuugcuauuuuguuaugcauuuacaagccuuuaugcauaaaauaaaauagccagcacuauucucacauggccaagguucauagcacacacacaaaaguauaguuggcugagugcgguggcucacaccuguaaucccaacacuuugggagacagagguggguggaucaugaggucaagagauccagaccacccuugccaacauggugaaaccccaucucuacuaaaaaguacaaaaauuagcugggugugguggcgcaugccuguagucucagcuacucgggaggcugaggcaggagaaucauuugaacgugggaggcggagguugcagugagccgagaucuugccacugcacuccagccugggugacagagugagacuccaucucaauaaauaaauaaauuaaauuaaauuaaauuaaaauuauuuuuuaaaaaauugggggcugagugugauggcucacaccuguaaucccggcaguuugggagcuugaggagggcagaucccuugaggucaggaguucaagaccagccuggacaacauggugaaaccccgucucuacuaaaaauacaaaaauuagccaggcaugguggcgugugccuguaaucccagcuacucgugaggcugaggcccaagcaucgcuugaaccugugaggcggagguugcagugagccaagauggcaccagugcacuccagccugggugacagagugagacuuugucucaaaaaaaaaaaaaaauuaaggugaagaaggcuuauacuagugggcugggacuugaagugaagugaauucuugaagguccccagugaguggccaaggugggacuugaaccaggacaucuguucucuugaccaccagcuuaguccaucccuuugaagagagugaccuacagucugggucucagccagggucucaggaaaccagguucccaccuuggcucacggaggugguuaggggcaucagcuuuagcaccagaguucagaucuugccucguccuauauaagcuuugucaccuccccaucauuaaaaggagccauccucccccuccaccucagcagagcccugguaaacagcaaauggacuaacgugcaucuagaggguugaggaugaagccuggccuggcaugggcacucaauaaaugcuaggggccaggcacgguggcugacaccuguaaucgcagcacuuugggaggcugaggcagguggaucgcuugagcccaggagucugagaccaaccuggacaacauagugagauucugucucuacaaaaaguacaaaauuagccuggugugguggcgugcaccugcagucccaucuacuuaggaggcugaggugagaggauggauucagcccaggaugucagggcugcagugagucgugauugagccgcugcaccccacccugggugacagagcaagacccuguaucaaaauaaauaaauaaaugcuaggaaagggauccuacuaauggaccuuuuuccuccaaaacaguggcuuucauuugguggagaugcuacuuauuagaagcacuugaggccaggugugguggcucaugccuguagucccagcacuuugggacuucugccaaggcagaagaauugcuugaacccaggcguuucagaccagccugggcaacauagcaagaccucaucucuagaaaacauugaaaaauuagccagcauaguggcacaugacuguuguccuaacuacuuaggcgaaggcaggaggauuacuugagcucaggaguucaaggcugcagugagcugcgaucacaucacugcccuccagccugagcaacaacacaagacccggacucuaaaaaucaaaaaagaagcacuuagggaaauuucuuaaaauuaaaugauacccugagcaaaccccuagauguucugauucauuugguuuggugaggugggagggaaucacugaaucuguaauuuauuauuauuuuuuuuuuuuugagauggauucucacucuguugcccaggcuggagugcaguggugcaaucuuggcucacugcaaccucugcuucccggguucaagcaauuguccugccucagccucccgacuaguugggauuacaggcgcccaccaucacgcccggcuaauuuuuguauuuuuagcagagacggggauucaccacgucagccagguuggucuccaacuccugaccucaggugauccgccugccucggccucccaaagugcugggauuauaggcaugagccaccguaccuagccugcaguuauuuuauucugaguugaucuucugcuggugaagugagucuuccacuggggccuggagcugcaucucccucacccugccaauccugcaagagccagcacugagcuuccccucugcuuucucuuuuuuuuuuuuuuuuuuuuuuuugagaugggaucuuacucuguugcccagccuguucuugaacucguggccucaagcaguucucccuccuuggccucccaaagugcuggaauuauaggcaugagccaccacgccuggucuccccuuucaguuuuaaaugaagccacaaguucccuguauaacauuugggagauagaggggagcucucuagccuagggguugaggucugugaccaaacgccuauaaaguugucuuuguuuggacucccccagaagcagagccugagacaaggauugagugcaaggaauuuaucugggaugcagggcaguaagggagagaggaagugacacagggacagaaaggcaaccaggaaagaguguauuauuaagccaguuccugcugugaacaaauggggcucaguuucaguggauaccuccaggaggcaacagagagcacauaccacagagucaucccaccucacagggagggaauuggaguauuuauccuccagugcccaucagacauaaucacaggccacucccaggggagcuauuaauucccuaacacuugugcagccacagagagacccugggcaaaguaguguaccucagguguguaguugagcuaugggcagggccccagcaacaccugccaaaaugccaaaagugccagugggaccugaauuccuuuuuauuuauuuauuuauuuauuuauuuauuuuuauuuauuuauuuuugacggagucucgcucuguggcccaggcuggagugcaguggugcaaucucugcucacugcaagcucugccucccagguucacgccauucuccugccucagccuccggaguagcugggacuacaggcgcgcaccaccacgccugccugauuuuugugugcguguauuuuuaguagagauggggauucaccauguuauccaggauggucuugaucuccugaccucgugauccgcccacaucggccucccaaagugcugggauugcaggcgugagccaccgcgcccggcccccugaauuccuuuuuuaggcaguugugaaacaacaacaucccaucuguugggcaccuacuguauauuccaugcucagcgacgcacauucauugucugauugcuguguuaccacugccuuccagagaagggcgcagaggccccaggcacuucgccuaggagggaagcacagcucuaaggucaggcuccuucucuguaagguagaggggcuacuucagggucacacugaccgccccaaccccugaccuggccucugcuucugcgaagaugcugagaaggcccuguguuuuguguuuugggucccacugaccccagaggggagggccaucucuuugacccagacucuuggauccaaacuggggugccacccaucaccaugucaguacccgguugaggggagucagagauagcaggagaccuugugggacuugaggcugugacuguucuccaaacaauguggaguauuuccauauuuuaacaaaagagaggccaggcgugguggcucacgccuguaaucccagcacuuugggaggccgaggcggauggaucacaacgucaggagaucaagaucauccuggcuaacauggugaaaccccgucucuacuaaaaaauacaaaaaauuagccaggcgugguggugggcgccuguagucccagcuacucaggagacugaagcaggagaauggugugaacccgggaggcagagcuuguagugagccgagaacgugccacugcacuccagccugggcgacagagugagacucugucucaaaaaaaaaaaacaaacagagagguuaugcuuguguuuccccuugagccagcacccagcccaggaaugcagcagucaggauagaucaagugaagcugcaguaacaaacagcccccacaucucagugacuuaaauugaugggaaggguuuuuuacauucagcagggaagcuguuugccucauaguuacccagggacccaggcucacagaguagcugccauucaaaauguuacuggucgccaagcccaggguugagaggcuagagaguccaacacugaccagaaagugaccacacugcuuccacacacagcacaucacugcaccuagacacacauggccccaucuaaacacaaggggaccaggaagugcgugugccugaaaggccccaaagccccguccagugccuguucugcacccuguuacuguccgccuccagaucaggaaauggaggcccagagagguuaagccacuugcccauagccacacagcugugguagcagagcugggauuugaacccagagucuccuuucuuugcgaguaugcugccaaccuaguggggaccugaacacagacugugggcucucugaggccuggguucaaauccuggcuuuacaucucugugcugcuagccucaggcagaugaguggcuugguuaccuccuagaaaauggguauaccugggagugguggcucacgccuauaaucccaacacuuuggaaggccaaagugagcagaucacuugaggucagaaguucgagaccagccugaccaacauggugaaaccccgucucuacuaaaaauacaaaaauuagcugggugugguggcaugcaccugugguccuaccuacuugggaggcugaggcaggagaaucgcuugaacccaggaggcagagguuacagugagccgagaucgugccacugcacuccagccuggaugacugagcgagacuccaucucaaaaaaaaaaaaaaaaaagagaaagaaagaaaaagaaaaugggugauaacccuucccuccaggaucuucaugaggagcucagugaugucauuuauaaagccccuggggucucgggagcccucaaaaaugcuggagagacaggccacagcucugaagagcagccccagcccuguggagcugaagcagggucuggaggcccccucuggggccaggccaaucaugggaaggcccccaggaguucccagggagggagacucagcacagaugaugucgaacagccuuuaccgcagcccuucgaacaaccauaacugucccgggcacuccgcugaugggcaacugugccucuaacaugcacccggccagccuagggggccgggaaccaagcccucuguuggcaucucugucuuguggguccccauucuagaauuauuuccgcgaugccuggaacaucuucgacuuugugacuguucugggcagcaucaccgauauccucgugacugaguuugggguaagucucccuccagcuucucucugggugacucugggcuggacgaggcaggcggcagggggcgggggagcggucccagaggcagugugucccggaagccauagcugcuugagccagcacuuggccaugaccagagagggagaacuggggccccggggacaagggcagccccucaggagggcauuguggggagauggggguaaccaaagcuuggcuguagggccagcacugaggggugggcuuuccugcauccuggccuaggaauuaauaaugcagaugaguacacugagggaacugagacacucaaaagcucugaaagcugagccggcucccaaacaccacccuaugucaggagcccagaaagaauggguuucaagucaauucuguuugaaccaacccucuccuaguuagugggcaggagagagccacagcccucaggccaguguggggacaccacucccagggccauagagggguccccagggugucuucccuccucuagccccgggccugggagacucucaacaugggagucucuggaccucucugugguggccccacaggccacauugcccuucuccuuuucuggaagacucagggccccagagguccuguccuagacccucuccuuggccaucugccaaugagcccaggcuuggggucccucaggagauuggggggaggguagaagauccuugcagggggaagcaauggucaaaaaagggugucaaagccaagggucaagggugauaccaaugucaucuuacuaacaauaaaaauaacaauagcucacgagaaucgcagccuugcugugugccagggaacugugccaagugguuuacguggauuggcucaggguagaggucuuggucucagcucguaagagaauucccucggaggguucaacugaaggcacccaaaugcagaccucacugguggaggggaagggaaggguacccacaaggguggcaagguguccagcgaccacccaccguggggagcugucaccugcccaggugcugaaguggggagggaaccugagccggaggccaggagaagccaccaagugggagcuguccugucaauguggagagacagagaccagggcccaagcaggcagagagcaauaggggagaaacaccccaaccuuucucuccccucaucccuuaucuccugccagagccucccauggcccaaaguaaaccggaagcaagcugaauaugaugcucagagcaggcagggaagucaggagaauagaucuggguguggucgggccugaggaagaggguguugccucauuucacagaugggaaaacugaccucagcugggcacgguggcucaugccuguaaucccagcacuuugggaggccgaagccggcggaucaccugaggccaggaguucaagaccagccuggccaacauggugaaaccccaucucuacugacaauacaaaaaaauuagccaggugugguggugcaugccuguaaucccagcuacucgggaggcugaggcaggaaaauugcuugaacccggaaggcggagguugcagugagcgacggucauaccauugcacuccagccugggugacaagagcgaaaacuccaucucaaaaaaaaaaagaaagaaagaaaacugaucuucaaugccuggggaagugagagacacucccaaggucacaaagccaggccugggugacuccugagaguacacugacagcuccuggggugucccagucagaucccccuacagaaaaggaucuguuugccugcucuuccguccuagaaggccaggaggggcuggggaacuacacaaaagagggggccauucuuugauauguccuacggcacccgcacccaagugauacacacuuauuugccuucagcuccagugagccagaauuuuccccuuccccucacccuaucccugaaaccuuccucuagaggguucuugcccacaugggggcucucuccacuggggugcccccaccuggucauucuccccuguccugaguuucuagagagggcuggagcuccagcuggcaaucaaaauaucuugccauccggcuacauacaagacagccuugaaccaaugucccuuugggucaagagguuagaaggaugguccagcuccccagaagggcaggugggguggaggaaguuagcugaaaccuucaaucaccaguaagagagcuguagggacagacuccaacagccuguucuccuggcuggcaggaagauggggcaugggguguucaugggacaucaggacccuugcaguagccaaacagcccccagcccucccuaccagcuguuugaucuuggacaacuugcgcuaucucuucucauguagaguggggcuaaccauugcaaccaaccucagacacuugcaagacucacagugaugcaugcacucaaaagacauucauugagcaccuacugugugccuggugugauuauaagugcuggagacagaacgagaaggaggggugccaaacaaaacagaccaagaauacagagugucugcucccauagagcugacauucuaaggagagagacgggaacuuuuuacaaguaaaagcaucaacaggccgggcaugguggcucacgccuguaaucucagcacuuugggagaccaaggcagguggaucacuugaggucaggaguucgagaccagccuggccaacauggugaaacucugucccuacuaaaaauacaaaaauuagccgggcacgguggcaggugccuguaaucccagcuacucaggaggcugaggcaagagaaucacuugauucucaggaggcgagagguuguaguaagccaagauugugccacugcccuccagccugggcgacagagugaaacucugucucaaaaagaaaaggaagaaaaagaaagaaagaaacgugaagugcuuggcacagaaccugccaggaaaccaggaguuugaaaauggugguuguuaacuauuacugcuguuguuauuguuauugugaauggguguguaguuuuguuagccagcccugaguuacagucaauuugagggaaagauaggggguggguguuuggguccuucugggacaauuaacucccaaccuggaguagggagaggcauguccuggcaggcaaggaggucucaguugccccuuucugccucccagguaagcccacuaguucugaggccagggcuuggccaggcugagacaggaaaugccagaugcuugggcgggcaggucccugggguuuagggggcagagggcaugcggcaguacuaaccagugcugucucagcugcugcccccaaguggcuggggugauguggguuugcccugugugcaauggauaaugacuguguuucuugucuugucucuuuucaugccugcucuuaaaacuguauauuggcgcaacgccgucugaaaaacucauccaaucaaaaugcacuaugaaauucauuuguucauccaugacauggucuguguguucauacaccaaugacuuaucucccaacccaccgccaccaccacccccacuccccgcccgggaaccgaaacccauugguuuuuuggcacugguuacaaaucaaccuaaaaaaugcugaacacgccuccccaacugcccccgcccgcccgcucccccucaucuucaacaucugcaucuagaauccgguuggucuuacuucuuucugaagucuaaaugccuuacauuaacugugaacgcaucuccucgcgucggcauugcaugccacacccugccucuccaacgugggaugccugacgcucuccucaacccuccgcucuccucugucugucuguccucccgcccccagccccugugccucccacuuccuguagacucugucucucuguuuuuaucggguucugaauggggguuuucuguuuggggugguuugcgucuuuugcagagaaagggauggguuuucccagcgcagcaccucucucuugccccaucccgcacacacauccccuacacucagagacaauagaggcaaauccacucccagccaccucucaccacuccugucccccauucagcuccauggaccccaggccccaggaaagcugccaacugucuccucgccccuccagcucucuccauccugcuguccccaauccuccaucucaagcccacaagaucuuuggccuugaccagcagagacuugacucuccaagucugauaaaggagaccugaaggccaggcagugugccggcaaagacucucaggcagaggaacucagaagugccagacuuggaucugguagcuucauguggggcuggcccacugaggcccucuccuggagccuugaacuguacgugcacacgcagucacacagucacugcacacagacacugcacacacagucacugugcacacacucagucacugcgcacacacugugcacacagucacugcacacagacgcugcacgcagucacugcagucacugcacacagucacuaugcacacacagucacugcacacagacacugcacacacagucacuauccacacacacagucacugcgcagacacugcacacacacugcacacacacaaucacugcgcacacacagucacugcacgcagaaacuggacacacagucacuaugcacacacugcacacaccacuaugcacacacacugugcacagucacuauguacacacacuggcacugcauguagucacuauggacacacacugcacagucacugugcacacauacacugcacacacugucacuaugcaaacacagucacugcacacagucacuaugcacacacacugcacacacagucacugcacacagagccacuaugcaugcacacacagucugcauucacacauugaacacacagucgcuauacacacacagucacugcacacacagucuaugcacccacacacugaacacacagucacugcauguacagacacugcacauagucaugaccucuucucuuuuucucacucauucuccaauucucucucucucucgcucuuuuuuuuuuuuuuuuuuagacagagucucgcucugucacccaggcuggcgugcaguggcacaaugucagcuaacugcaaccucugccuccccguuucaagcaauuaugaugccucagccuccugaguaccugggauuacaagcauguaccaccacgccaggccacuucuuguauuuuuaguagagacaggguuucaccauguuggccaggcuggucucgaacuccugaccucaagugaugcacccgccucagccucccaaaguguugggauuacaggugugagccacuacaccuggccucuaauccucauucacuguuccugucucugugucucucacauacagucaugcaugcaugcacgcaugcacacacacacacacuggcccucucugcuacaucuacccacccuguacccccacuccaguacauacugcacacaucucucucccucccccacuucucagccccuugcacaccccuuguucuguuaaaucucaacugccucugccccucuccuacccaccaaugaggcccuuagagggacgccccaauggcaucuuugcccuggaaucaucccuucccugcuggcaauacacaugcauucacccaccaaacauuuaaugagccccuauuuggugccacagauggaauuaugggcagaagcagacaccauuacuguccccucuuaccacauacagucaggugggggaggcaggcaucggucaaauaaccccuugacuccacuuaaaauuauaccugcacugcgagcugaaggaugagcagcauuaacaaggcagagagagaugcacagagcauuccaggcccaggacagcacaugcaaaggcccuguggugggacggaaccugugaggggucaggaucugcaagcgagggaauguggcugaugcaaagacagccgagaaaggcuggccuggagacagccgaagaaggcagaaggggacaggacccggggcuggggagggcggggcuauauuguggaauaugggcuuucuccuaagcaccaggaagggccugggaggauaggaagcaggggaggcgcgacuggucaugugacuagacaagcucgcucugguugcagggcagggaacagcuugacaggaggcugggcuggaggugggcaccaggaaucgcagcaagagaugacaguggaggagagagaacagugggaggguuguccucugcaggacccagggaaagaucaggucugaacugagaugaggugccugggagcagucgggucuggcuuaaaacugggagauaggcugagcacggugacucaagccucuaaucccagcacuuugggaggcugaggcaggaagaucaccugaggucaggaguucgagaccagccugaccaacauggugaaaccccaucucuccuaaaaaauacaaaaauuagccaggcgugguggcaggugccuguaaucccagauccucaggaggccgagacaggagaaucacuuaaaccugggagguggagguugcagugagccgaggucgugccauugcacuccagccugggcaacagagugagacucucuuaaaaaaaaaauacugggugauagaggugagcgagugcaaggaaaggaccagguugggggaagagaauaggugugggcauagcaaguuugaggugccuuuaggacaucccgaaauaagucagauaggcagguguugugggggcugcagcuuggagcugaggucuacaaguaguaggacuuuucuggagcccuuagguggguggucuccauauccuucugagcacuugaggaacaucugagcacagcacuggaaaagaaaagaccacaaggacgcuguccucaugucuuccaggggcugugucccacccccaucacauucuagccaggaaguucaggggagguguugaagagaggaagcugcaccucccaagccauggauugaaauguggaaggcaggaagagggaacuugucagaaguucugggggcaguggaaagaauugguacugaugcaggaagagauggaggguggaugagggcagacuaguacccuucccccacugccccaaacccuucccgucuccaccccuaccugccucaugugucuccucccccacuuggcuccaagaagggaagcauguuuucugcacgcaucucccugccagaucccuggcuuuuuugcaugguugcaagcuuccccugcucuccuccaaaccccccuccugaggcugcuuccaggguccgccugccuucgcaugccuggccgaguccacauguuaugauccgccccaugaaagggauggcuuguacucugggguugaacgggagggggcuggggauaccugagccaucggccccauccccagguggagcuggguggccaggcagggaugggggucagggcagcagggcacagagagugacucuguuagccaagcuggguuuggggcuuguucgaggcacuggagacauucucacagcacuugagcccaguguggucaggguaggaucccccagcccccuuccccauccuagaggccuaaggacgcacugaugugucccagagagcauccuagacauugccaucaaacccagaggccucagaaauuccuugaacuccaguccuugccucucagcucccaggccaaagccagcacaagacacagaucuggcagccagaaagcccucuggaagccaccaaguaggaugcccaugucacccaaacuaggacacuuuugaaacaggagggaggcugugacuguauggucacccugugccauuuggggggugaagguuagaccaaguuaaaucuugcuacguggccuguagcaaauccuacaaaucccauagaacaagucugauuaagccccuucccuuaguguggagagacccucuacuccuccugccuucacccugcuggguacuggccagcgaaggaggguuuccaugucugccugaggcuggggucucaaacucaaaugccucugggggccaggcagacaccagucaaccaggaaagcaagugccauuucuaaaacgugaggacccuggaaaacuggagaucauguggccugcuuccagggagcaaucgcagcaggccugggguugccagaaagccagauuggugggcaaaaucucuugauuuuuaaacaauggcaauaauuuuuaauuaaaaacaaggacaaaugaaaaaacacugcucgggcccaacaaaacaguuuuauuagcuagauuuggcccacucgugacuucgagagucccaccccccccaccaaggucccuugaagccccacaauggccacuuaacucuagcuggucuccucccugacucuccaacucucuggcccccugguucuucuagcuugggugggaggaggcagaggcagugacuagacaggggguuuuugagcagaggcaguggccacccagggagguccugggggcagggauggccccaccucccggcccccagcacccgccccuuggugggcccgggcugauuucugagcucacccacccaugggagcugagugcuuccugcuuccugcaggccuggucccgugcuacuccacccagccccagaagcugagaagccaucccugagaggggggaaaagggccccaaaugcaucuucuccgacucagcgggcagcgaggacucacccugcagccgaacagucccagcucccucccguccuccccauucccgcucgccaaggggguaagaaaagaugcucuuccgcuucucccaauuggcucgagccgcugcuccucuuggccguggggugaggucagggcgggcaggagcgggugggcagcucggcagggcagggcagggcagggugcccggugagucccgugacagaugcauuucuggcccggagcguaacaugcccucggaacccgcacauguccaccaggccugacugugcuggcgaccuccacccccacccccgcccugguguuugugcaucguacacguaugauagauuccgcaacuugaccggcuuguguccuuucgucucagugcauuugguuguugggagaaacaaaaaccaucucgauuuuuuuccugauuggaugauucggauauauuuucuuuuucuuguucuuuuguuauuucuuccccauccccguuccuuuuuccuccuuucuuuuucuuuucuuuuccccauuguggguggggcuggcagggagggcuuaugcuuuugaguugaugccuuuuccucccucccacccucucucucccaacauuauuccuuuuucgaguuuuuccucugcaucauugcauuaauagugcuuucucucucccuccuuauuuggggucuggcuugcuuuuuuccuguugguuggcuucauguaggggccucugugaguggugacagcucugagccuuuugggguggguggauggucaccccucuuccuccaucuccccagaauaacuucaucaaccugagcuuucuccgccucuuccgagcugcccggcucaucaaacuucuccgucaggguuacaccauccgcauucuucucuggaccuuugugcaguccuucaaggugaguccucgucccugcugcuggcccagggcugagaagacaggugacccucaugcucuggcugaauguagaagucagauuggaagugccucugugauguagucgugcagagaaucuguuaucuccaaggcuguugucaaacuuccugucccuggugugucuucagagcuguaagggccucauccuagagcccccagagaugcccaccagcccuggaaggacucuggcacguggcauauggccacccaacccaguggggcagagcacugggacaagggaggaagacagugcggcugagggacccccagcacucuucuucauugccuuuuuucccaccaggcccugccuuaugucugucugcugaucgccaugcucuucuucaucuaugccaucauugggaugcaggugagugucgugucccuaagguucccagagccucccaaggagggcagccacccuuagaaaggggugggucagaggagccugguucacagaagcagccauggagguugagcuggguuucccagaagccacuggaggaauggcagccccuggucgucacccuccaauuccacagguguuugguaacauuggcaucgacguggaggacgaggacagugaugaagaugaguuccaaaucacugagcacaauaacuuccggaccuucuuccaggcccucaugcuucucuuccggugagaaggggaccugcucugauaauucuguuuccgugggguggggugccugccuucauccuucuguucccauagaggauguacccuccucuuccaaugcaagacgugcccuccuccuucucuucuggcaggggcgcgcccucacccuucuuuuccgguagggggcgugcccuucucuuccgguaggggacgugccggccuucucuuccgauagggggcgugcccuccuccuccuuuucugguguggggguggccagaugugcucuuauccuucuuuucccgugaggcuggaaaugggugucguggggggcccaggaauccuagcagggcagaagcagagggcccugggacauagucaucaaggucauuuuccaggcauuaucucugaaucuuccugaccacccugugaggaagggauucuuggcagcccuauccgacaaauaagaaaacaggcuuacagaccgugaggcuugauucuuugguucaucaucuuggcugcacacaaaaguuccuucacucguucaguguagguuuuuugggggggcuuuuuuuuuuuuuuuuuuuuuuuuuggagauggagucucgcucuguuccccaggcuggaguacaguggcgcgaucucggcucacugcaagcuccgccucccggguucacgccauucuccugccucagccucccgaguagcugggacuacaggcgcccgccaccacgcccagauaauuuuuuuguauuuuuaguagagucgggguuucaccauguuagccaggauggucucgaucuccugaccucgugauccgcccgccucggccucccaaagugcugggauuacaggcgugagccaccgugcccagcccuuuuuuuuuuuuuuuuuuagauggagucucucucuguugcccaggcuggagugcaguggcgccaucucggcucacugcaagcuccucuuguggagguguauugagcaccuacagcaugccaggcagggcugaaaaacgaggaugcaccaggaaauagagaaaagagacauuuuaagcacuuuggaagcuaacauccccauggggaagacgaauaaucaggaaacaaauuauagaggaugcuggaaaaagauaaaauucaagaauaaaggggaauagggccaggugcagugacucgugccuguaauccuagcauuuugggaggccgaggugggaggaucgcuuuagcccaggaguuugagaccagccugggcaacauagugagaccccgucucuacaaaaaaauuguuuuuaauuaacugggcauagugccacacaccuguagucccagcuacuugggaggcugaggcaggaggauugcucgagcccaggaguuccaggcuacaguaagcuaugauugugccacugcacuccagccucggcaacagagcgagacucugucucuaaaaagaaaaauauauuuuuuuaauuuuuaaaaaaaguuacagagguagauaguggugauaguugcauaauaaugugagcuuacuuaaugcuacugaauuguacacuucaaaaugguuaaauugauaaacuucaugcuguguguauuuugccacaguaaaaaauaauaauguuuuuaaucuaacaacaaaaaaagaauagagggccggcagguuaugccucucugaaagugugacauuugagagaaauuggcaagggagggagucaguggguauauggggaagggcaggccaagccgaggggacugccuguguaaaggcccugaggcaggaguauggcuggcauguuugaggacugugaggagcccagcauaccuagaacagagugaucuagggagaauauaguaugagaugacugucaccuucauggaggggagcuuuuuuuuuuuuuuaaucugagacagaguuucggucuuguugcccaggcuggagugcaguggugcgaucucggcucggcgcaacuucugccucccagguucaagcaguucuccugccucagccucccgaguagcugagauuauaggugcccgucaccacgcccagcuaauuuuuguauuuuuaguagagacgggguuuugccauguuggucaggccguucucaaacuccugaccucaggugauccacccgccucagccacccaaagugcugggauuacaggcaugagccacugcacccggccugaagggagcuuuuuuuuuuuuuugcuuuuuuuugagacagaaucucccucuuugucacccaggcuggagugcaguggcgcgaucucagcucacugcaaccuccgccuccuggguucaagcgauuuuccugccucagccucccaaguagcugagacuacaggugagcgccaccacaccgagcaaauuuuugguauuuuuaguagagauaggguuucaccauguuagccaggauggucucaaucuccugaccucgugauccacccaccucagccucccaaagugcugggauuacaggugugagccaccgcgcccagccaagaggggagcuuuuaaagcauaacagugaccagccugagcaaugcagugaaaccccaucucuacaaaaaaaaauaguuuaaaaauuagccaggagugguggcgugugccuguaguccccagcuacucaggaggccgaggcgggaggaucaccugagccugggaaguugaggcugcagugagcagugauugugccacuacacuccaaccuggguaacagagcaagacccugucaaaaaaaaaaaagagagagagagagaaaagaaaggaaaagaaagagagagagaaggaaaagaaaagaaaaaaacauaucaguguccucaaaucccacccuagaccaacugaauccaagucugcugggguggggcacgggcauugguauuuuuucaaagcucucuguggacuucagugcacagccaagaaugugaauucccuucucucagcucccaguaaaaggaggugguccaccuggggcuugccuggccagcuccagagcccaagugcucaacgugugugcuccaccuccuggggaggcguugguacccagucagggcuggguguccgagucucugauuucucccuguccucaggagugccaccggggaagcuuggcacaacaucaugcuuuccugccucagcgggaaaccgugugauaagaacucuggcauccugacucgagaguguggcaaugaauuugcuuauuuuuacuuuguuuccuucaucuuccucugcucguuucuggugagucuguggacacugugagggccgucugggcucccuaagccuggcuuccuuucaggggaguggguuucuguggaauguggcugugucgaaggcuuguucccuccaaggcuucucugaaccagccugggaucaggugacccugagcgucucaaacucagcacuguugacauuuggggguggcugauucuuugggguggggccaucaugugcacugcaguguauggcagcaucccuguccuccccccaccagaugcuggcagcacacgccacccguuccuccuguugugacaaccaaaaaugucuccggacauugccaggugcccccagggggugggggugggguugggagugggggccagaauucccccauuugagacucaaugaaauauuucagcugggcguaguggccgaugccuguaaucccaacacuucgggaggcugaggugggagggucacuugagcccaggaauacaagaccagccuggacagcauggugugaaacccaucucuuuaaaaaaaaaaaaaaaaauugaauuagcugcacacguggugcugugcaccugcagucccagcuacucaggaggcugaggugggaggaucacuugagccuuggaggucgaggcugcagugagccaugaucacaccacugcaccccagccagggcgacagaaugagauccugucucaaaaacaaacaaaaacaaacaaaaaaaaaaaaaacauugcgagggaagaaauaccucacuuuggccuuguugggggcagaugugggaggauuuggggucacagugguucucuugguguuggucccuguuucagaagccuccccucccucucacugacucuguuucuuuccaucauucuuggucuuugucucucucucucuuuuuuuuuuuucuuugaaauggagucucacucuguugcccaggcuaaagugcaguggcgagaccucagcucacugcagccuccaccucccagguucaaccgauucuucagcuucaaccucccaaguagcugggauuacaggugcacaugccaccacacccagcuaauuuuuguauuuuuaguagagacaguguuucaccauguugaccaggcuggucucaaacuccugaccucaagugaucuguccaccucggccucccaaagugcugggauuacaggcgugauccaccgugcccggccagucuuugucucuuuguaucucucucucuccaucucucucuguuucucucuuccucuuccccaucucuccacuugaucucucucucacuggaccuccuugugugagugagcaucaccucuccauuccccagucucuuucugucucugucucauuuccuuuccccaucuucucucuaucccucucuccaucugggccucuguguacaugucuuugggucugucuguccgucugucugucuguauccuucucacucacucauucauucccucggucucugcccccauucucucuugguccccgggguccccacagaugcugaaucucuuugucgccgucaucauggacaacuuugaguaccucacccgagacuccuccauccugggcccccaccaccuggaugaguacgugcgugucugggccgaguaugaccccgcagcuugguaagaagucaccccgaauccuccagccacaauacucaccucucccuggaacuggaacacgggcuaggucaggccccagacucuggagcacugaacuccugggguccuagcaggggucucacagguucagucaggagagaagauauaagaaucaucacccuugcauaccccagauuaaacacguagggugccaacccugcccaaacccuggacuuucugggaaaugagggagggcgucaaccaugagauguccugaagagcccucuccuccuacgagucucuccugucucucacugugaagucuccagauggugaggaugcauuagccaggcuccagggagaaaaccaacagcaucccagccucaguucucuugagaguguggggaggagggcuggccuacccuuggcagacaggauuggcagcaacaucagaguagcagaacucagcucccacugggacccgugaaccugggagugagaggacauacaggccaggggaggacgcagagccucaggggcccaugcaucuuuguggccacaaagggagugggcgcucccaucuggguagacaccagaggggucccucuccacugacgggcaaugguuucagaggguggguuccaccuugugcacguguauugagugcccacccaacaccaagccuugaaggacacucagaggcuuuaucugaauaccuggaacccaccagccacuaacugaggauuuaguucaggcuggucuuggggccugaagaagcauuacuggggggcccucagcagccuaagccccaucuuccucuggccucagcaccagagaggaggccgucacgaggaaggugggcaggagguggucuuggcuauucccauagccucaaacaaguacuccaugagaccgagaggcuggggagagccgugggucuggggcugggcuuuggcugguuccuaacucuuccucuuuugauuuuaggucacagcaauuggaugcuguccccaaggccucuauuccacaagcccccccccaccccuguagcccauguagacuguggaggaggcagaugcagagagagccccaggggaggugcccugcagucccgaacucgacugacauccuacaccccugggucuccccagugucugggaauguacuggggaccuucacuuguccccagucucucccacuccuucaagccagggacaccccagccucgggcaucaugaccucgcugugugcccagggagcccgugugaacccauugccugcacuaacccccuuucuucuccuuucagcggucggauucauuauaaggauauguacaguuuauuacgaguaauaucucccccucucggcuuaggcaagaaauguccucauaggguugcuugcaagguuugacuuccacuaaaaccugcuagcauccauggaaugaguguggcuugggguucuucaauauauauauuucauauauauauauauauauaucucucucucucucuaaaaaaacagagccaucucucuuucuugcauuaaacuagaaaacucucuuagccaacagaaugcagucauguagacucgauaaagcauggaacauauuuccuccuucccuucagccuucagccaucuuugcuugcucuuagcugaagcugcccauccuggggucuccacggcaccccaaaucagauacauccccugggggauuguaacuuugcauuucucccccaaccaucaccuccacucucucccccuccaccccucaccucccaaagccccuagcccuccuccccucccuggcacuggccccugcuccccaccuaggcccccucagagaccagccucagccaaaccagagaacgugacccaacuguagaaauaacagugauggccgggcgcaguggcucaugccuguaaucccagcacuuugggaggccaaagcaggaggaucgcuugagcccaggaguuugagaccagccugggcaacauagcaagaacccccuucucuauaaaaaauuagccaggcauuguggcgcaugccuguagucccagcuacuugggaggcugaggcagaaggauugcuugagcccaggagguggaggcugcagugagcuaugaucacaccacugcacuccaacccaggcgacagagagagacccugucucuuuaaaaaaaaaaaaaaaaaaaaaaaaaggcaaugaacaaaagcauggcucuacgucuuccaaagugagaauucucccuccccuccgcaucccuccagaacuguagcucagagcccacgcugaaucugacuuuucucuuuucucucucucucccugcucccgagcagugaaguaaucuuuuuuuacugaccuuuucuuccauuuuuuuuccuccucuuuuccauugauuugaaauaucuauuuuaucauucucugcaucuuucucucucuauuuuuucggcucguguggauuucuuuuuucuuucuucuguuucuccccaccucucuuccuuugguucucuguucccauucccguuuuguuuuuuuguuuuuguuuuuguuuuuuucauuuucggugcugccaggggccgcaugccuuaccuggacauguaucagaugcugagacacaugucuccgccccugggucuggggaagaaguguccggccagaguggcuuacaagguagacuacccuugccgaccaccgacguccaggcacuggguuuuuuuuucuucuucuucuucuuuuuuuuuagugcugaccagaaacacccggccgacucucuuuuuccaacguuucucuucuuuuuuguuuuugauucuuuuuuuucuuuucucgagucaacugaucaugaccaucccuugauucuaagcagcacacuguguccguccuuucugaugagugucuucguguuuugagacuccauuauggccgacaugccggggggagggggaggggagcgcccagguccccuugcaccuggucucccagguaccaaauuggaaacaaacacgcuucuucagggagucaaaacccaugcuucccacuucugcccacccagagcggcccccaugcccaggcuggggcaggcgccuugcagagaggggcuuuagcccccgaaagcaggcgaggucccggguccccgccccugccacgcacaccugaagcugaucucugaccuagggccuuggggauucgagaccuuccaaggagcaccaagaaccucucuuccccucccuuccuuccccuggaguuucguccccagcccccgucccuaauccccccaagacaccccaacaugccucuccauuguuccagagugggcaggcggccgcagcuggaccccuggacgguggcacacugaugcaggccaugcacgcugccuuggcggggccuggggcgggcaggcaccauggccgacgggggguggugcaugcuggcugagagagcgagcguccugccgccaagcggcuggcccgggccaccccuccagaucccuguccuggaaucucccuuggugcccaaggacagaugcucuguucccuccauucauccacaagaaguucagggaugaccuuuaaagauucuccccacccaaaaaguauuaccccaucauccuauucucccauccaccuugaucuucccugcgucccuauccaucaaugcuauuuguaccugccccguguugccaccucauuccuuuccuuccucugugcaccccuccucaccuaaccuauaugucuccccuccuucucaaucaaagccggggacaagguugucccaccagcaucucagacaaugagccucuccuggcaccugucgcucugugccccucccugccgcccccccccccccccccgguuuuccucaagucgcuucucucagucucugcuuagaugaaugugugcgcaugugcaagagagggagggcgagcccuuccucuccuggucuuugugcaggaccaccauggguccauaagacaacuuugugcaaauuugaaaaaggcacccuuuccacagaacaugccuguuggaaaauuguugcaaucuaccaauguggugagaacaagacacuuuuuuucuaucaccugggaagcuguuauauuuaauauacaaaucgggggcugggcgugguggcucaugccuguaauccuagugcuuugggaggcugagacgggaggaucacuugagcccaguucgagacuagccugggcaacauagcgagaccccaucucuacaaaaagaaaaaauauuuuaauuaauaaauaaguacauaaaucuaucauuuccaagaugggagcccuuugugcgguguacaaccugcacaacugugcacaguggcccagucuauguguguuucucuauuucccaccuccuuccccacccuacccccaguguccccuccaguguccugcucuggauuuaccauaccccuccccaucuucaacucuguguuuccugcccacuugugucugaauccccacccaaguugcccucaccccccuucucugugccacuucagccugggcuggugcacaccagcccagcauccucucccaugccaccaagcaugguggacagagccccugccugggacauggggaaucuuuucuucccugggcuggaagggagugccccucaccccuucccccugccauugcacagagagccaagaucuggacaugccccugagauacacuucccacggagcuaugaaugagucucgagauuccgucugcaugcgccccugucugugcuguucugugucacagccucgcugcaugccugcgaggggccugccccgucaguggggggcugccugccugcugcuucucagaggaaugauguggucugugcccaucugcucuguccuggucugggccaagccagggauuggguguggggagccaguggcaccccccaccagcggcugugguccuggcccccucagccuuggcuguugcaugcacugcucaaauccagcuugugcucuuuuucuuuggggucagacugaaacggggccauccagaagaacucuggggcagggcggggguggggcaaggguugaggcaaacccuggaaaugccagcucucaggucaagcaggugggggaaaaaaggagagggcaggggaccagaaguacaagagagccuuuugugcccucccugcgggccaccaagagaaacugaguacugggacagguaaccuaaguaagagacaccucagccgccacagcuuucagaguucuuccugggacucccuggguaggggcgggcgcggcucacgggagacccaggagggaugccugggaaugacugcgcuugccuuggguuuucuguagcggcuucugcggauggaccugcccgucgcagaugacaacaccguccacuucaauuccacccucauggcucugauccgcacagcccuggacaucaagauugccaaggguaaggaagggacaggggcgggcacagacaggcgugacaggguggaaccggggaucucccucccuaccccaaacuagaggaucugcugucaccacccggaucuucauucacucuuccauucauucguuccacaggguuuuuugggguuugggguuuugguguuuuuuuuuuuuuuuuuuugagacagagucuugcucuguugcccaggcagcagugcggugacaugaucgcaagucacugcagccuugaccucccaggcucaagugauccuuccaccucagccuccccaguagcugggacuacaggcacacaccaccauacucggcuaauuuuuuuuuuuuuggugugacaauuucccucugucacccaggcugaagugcaguggugugaucuuggcucauugcuaccuccgccucccggguucaagcgauucuccugccucagccucccaaguagcugggauuauagguacccaccagcacacccggcuaauuuuuuauauuuuggguagagaugggguuucaccauguuggccaggcuggucucgaacuccugaccucuggucucaaacuccugaccucaagugauccaccugccucgaccucucaaagugcuggauuacaggcgugagccaccaugcccaaccuaauuuuuuauauuuuuuauagagaugggguuucaucagguugcccaggcuggucucaaacuccugggcucaagcaguccucccaccuuggucucccaaaaugcugguauuacaggcaugagccaccacacccggcccauuuggcagauauuuagugcacuccuucaaugugccagagacccguccaagcaggggaggacccagcagcuuacacuuuagauggauggggaggccgccacugaggagguaaggcagugucucauggaucccuggggggaaggugcuccaggcagaaggacuggcaaaggcccugacagaggggugaacacaggacacccggggcauugagcugacucaccuucugagugagggcacgccacgcagguucagagcagaggaggaaccugacccaacucacauuugaacagguucccuccggccacugaggggaugggagaccgaaaggaggccagugugggggcugcugauaucaucuggguggagacagggcggcagcuuagaucuagggguaggcucgacgugguggcucacgccuguaaucucagcacuuugggaggccaagguggguggauuacuugaggucaggaugaccagccuggccaauguggugaaacccccgucucuacuaaaaauacaaaauuuagccagacguggugguggguacuguagucccagcuacuagggaggaugaggcagaagaaucgcuugaaccugggaggcggagguugcagugagccgagaucacgccacugcacuacagccugggugacagagcaagacucugucucaaaaauuaaauuaaauuaaauuaacuggacaugguggcauaugccuguggucccagcuacucaggaggcagagaugagaguauugcuugaagccaggaguuugaggcugcagugagucaugaucgcaccacugcacuccagccugggcgacagaacgagauccuagcucaaaacaacagaaagaaaaagaaaaaaacauuuuuuuuaaagcugagaaggggcugggcgcaguggcuuacgccuguaaucccagcacuuugggaggccaagguggguggaucacgaggucaggaguucaagaccagccuggccaacauggugaaaccccaucucuaccaaaaauacaaaaaguagccgggugucauggugggcgccuguaaccccagcuacuccggaggcugaggcaggagaaucacuugaaccugggagacagagguugcagugagccaagaucgcgccacugaacuccagccuggaugacagagcaagacgcugucucaaaaaaaaaaaaagcugaggccgggcacgcuggcucacgccuguaauagcagcacuuugggaggccgaggcgggcagaucaugaggucaagaaaucgagaccauccuggguaacacggugaaaccccuucucuacuaaaaauacaaaaaauuagcugggugugguggcacgcaccuguagucccugcuacucagaaggcugaggcaggagaauugcuugaacccgagaggcagagguugcagcgagccgagcuugugccacugcacuccagccugggugacagagugagacuucaucugaaaaaaaaaaaaaaaaaaagccgagaaggcuggacaugguggcucacaccuguaaucucagcauuuuguugaggccaggcacagugguucacgccuguaaucugagcacgcugggaggccgagguggguggaucauuugaggucaggaguucgagaucagccuggccaacguggcaaaacccugucucuacuaaaaauacaaaaauuagccgggugucguggcgugugccuguaaucccagcacuuugggaggcugaagcggguggaucacuugaggucaggaguucaagaccagccuggucaacauggcaaaacccugucucuacuaaaaauacaaaaauuagccaggugugguggcggguaccuguaaucccaguuacuagggaggcugaggcagaagaaucacuugaacccgggaggcagagauugcagugagccgagaucacaucacugcacuuuagccugggcgacagagcaagacuccaucucaaaaauaaaaauaaaaauaaaaaauaccgagaaauucccccaaagaccuagcucagggcucacucuccaucauuagggggaaagaagaagaggaggccagggaggcgggcagagaccagggcagugugggcuccuggaggcagcuucuauguuuaaaagggcggcuucaggaggaaggggaccaaccgugucaggcacugcccagagaccaaggaugacaaggaucacaagugacuggucaucauggucacuuugaccagugcagcuuuggcggaggggucagggguccccugucuggagugcauuucggaggcccgaaaggggaugugaugugauuuggcagcugauuaaggacagcagggcagagagacaggcgcacaauugccagaagaaacggggaccugaggcucacgccuguaaucccagcacuuugggaggcugaggaagguggaucacuugaggccaggaauuugagaccagccuggccaacauggcgaaaccccaucuccacuaaaaauacaaaaauuagccaggcaugguggugcacaccuauaaucccaacaacuugggaagcugagcacaagaauuacuugaaccugggaggcagagguugcagugagccgagaucaaaccauugcacuccagccugggggacacagcaagacucugucucaaaaaaaaaaaaaaaaagaaagaaagaaagaaaagaaaaaacaaaugggaccagaaaaaaggagugggugggagaggagcagguggauagucccacacaugggaaggugcugagcccagcugaaaccacuaguaagucaggaggagggaagacugagccucgagacauaugugccuuccagggucuugagggaaagaagggaggaagagccaaggccacguggcaagacucaaggaggaaguggcagggaaggugggggacuggagggguggaggacagauauuguuaaugccaggaacaaagugaagguaaagagagcacaaggaaguugggagcaguggcucacaccuguaaucccagcacuuugggaagccaaggcaggaggaucacuugaggccaggaguucaagaucagccuggccaacacagagagaccccaucucuacagaaaauuuuaaaauuagccagguguggugaugugcaccuguagucccaacuacuugggaggcuggagugggaggaucacuggggacugggaugucaaggcugcagugagcuauaugaugaccacagacauagcagcuuaagacacaccuauuugucagcucacaguccuguaggucagaaguccaaaaagcuggacugggcugucugcugagggucucacgaggcugaaaucaaggugucagccaagcugggcuccucucuggaggaucugggggagaaucuacuuccagguucauucagguguuggcagaauugaaguccuuguggcuguaggacugaggucuuguuuuaucacuggcuuuuuagcuuuuugcuccuggaagugcauguaauccuccaugugcucucauucucucugacuuccccaucugccacccagcagagacaauacugugcuuuucaagggcucaccugauuggggcaggccuacccugaucaucucuguauuuugaggucagcugacuugauauuuuuuuuuuuucuugagacagaauuucacucuuguugccaaggcuggaguauaauagugugaucucaguucacugcaaucuccgccucccagguucaagcaauucuccugccucagccuccugaguagcugagauuacaggugcccaccaccacgcccagcuaaauuuuuuuguauuuuuaguagagaugggguuucacaagguuggccaggcugguuuugaacuccugaccucaggugauccacccgccucagccucccaaagugcugggauuacaggagugagccaccaugcccagcauuuucuuucuuuuuuuuuuuuuuuuugaaacggagucuuguucugucacccaggcuggagugcaguggcgcaaucucggcucacugcaaccuccaucucccggguucaagugauucugccucagccucccaaguaggugggacuacagaugcgugccaccacgcccggauaauuuuuuguauuuuuaguagaaacgggguuucaccaugauagcaggauggucucgaucucccaaccucgugaucugcccaccucggccucccaaagugcugggauuacaggcgugagccaccgcaccgggccuccgguauuuuaauuauaucugcaaagucccuucauagccugggcaauggucccuagauuaguguuugaauaaacagaaucuuggcagaagggcagcuuuugaauucugccuaccacaguuccuucguuuguacaacgggucuaacaacacccccacucuuuguauguaaugccaucguaacucagcuucuguggcacucugagaaucuguguucaggggucccaaaaccacccacagguucagugauucccuggaagaacucagaacugagaaaaguuuuuauacucacaguuuauuacagugaaagaauauagauuaaaaucugcaaagggccgggcacgguggcucacgccuguaaucccagcacuuugggagggcgagguaggcagaucacuugaggucacgaguucaagaccagccugaccaacauggugaaacccugucucuacuaaaaauacaaaaauuagccaggcgugguggcuggcgccaguaaucccagcuacuuggaaggcuaagguaggagaaucacuugagcccaggaggcagagguugcagugagccgagaucccgccacuucacuccaggcuggacagagugagacucuauuagaaaaaaaaaaaaaaaaaaaaucugcaaagggccuggcaugguggcuuacgccuguaauccuggcacuuugggagggcaaggcgggcagaucacuugaggucacaaguuugagaccagccuggccaacauggcgaaaccccgucucuaccaaaaauacaaaaauuaggcauggugccagaccccuguaaucccaacuacucaggaggcugaggcaggagaaucgcuugacccugggaggcagagguugcagugagcugagacugugccauugcacuccagccugugugacaagaucaaaacucuguccaaaaagaaaauuagccaggugugguggcauacaccuguagucccagcuacuccagaggcugaggcacaagaauccuuucaacccaggagauagagcuacauuaagccaagaucacgccacugcacuccagccugggcaacagagcaagacucugucucaaacaaacaaacaaauuccaaaaacauaaaaugcgcaaaggaagggcaucuggggaaggguccaggagacaccaggugcgagcuuccaguugucugccuccaguggaguugcacagacaacgcuuaauucucccugcagugugugacaacacgcaccguguacugccaaccagggaagcucaccugagccuuggugccccaggguuuuuauugaggguuugucauauaggcagggcugacguaguuacucagucuccagucccuccagaggucaaacugauaccacguggcccaagaccccaacgauaaaucgcauuguuagaaugaacuguauggaaaauuauccaggcguggcggcgggcggcuguaaucccagcuacuggggaagcugaggcaggagaaucacuugaaacuaggaggccgagguugcagugagccaagaucgcaccauugcacuccagccugggcaauagagcaaaaacaccaucucaaaauaaauaaauaaauagaaugaacuguauuggccggguacagugacucaugccuauaaucccagcacuuugggaggcugaggcuggaggaucguuugaggccaggaguucgagaccagccuaggcaacauagugagacccuaucucuuuuuuuuaaaaaaaaaaaaaaaaaaaaaaaagaaugaacuauacaguguggcccaaggcccccugcuaaauaaagacacucuucaggcaggacauuucaaaggcuuagagaucaccucccaggagcaagucaaugggccaguccuuucaucggaaugugcaggguuuggacaacacuagccuacugagcuaguccuuacugcuuagcaccccagcuucuaugacaccuacuggauucccuuccugaggguuucaaagacuccuggagaugucucugaauuuggcugucacaguuguuacuuguaccccagaugccacucaguucccugaagacaaugaucccccagauuucucagccaggagccccuccaccucuuguccucagugggugccaggccucauccuggaguuccacagcugagccaggcucucgggguuacggaaggucaagaggguguggggacaacaauggaagagugauaacaguggcagcccuuugagcagaugcgggucucaggagaacauaacgcgcuuucuuuucauaguucagcucacuuucuaagcacacugagcuuccuuuccagcaggcuaaggggcugcaaaggggguacagauuaaccucauucuucagauucucaaaaauggugucaccauucauugcuggagacugggagaaagggggcaaguccaucucauucucucugucucugucucucucucucucuucccuguccaucuguuucucucucccacccaccccucuguucucucugcccagaagaaucucuauuuugguuuugguuuuguuuguuuuguauuguuuugagacggagucucguucugucgcccaggcuggagugcaguggcgcagucucaacucaccacugcagccuccaccucccagguucaagcgauucucaugccucagccucccgaguaguugggauuacaggcgcacgccaccacgcccagcuaauuuuugcauuuuuacuagagacugguuucaccauguugaccaggcuggacccuauccucuuucaagccccccaccccaggcauugagggcagagccaacuaccugccugaaccaauuagcauauuaaacguaaacccaguuagcauauccaaauagcagcccacagugacauucugacugucagaauguggauugcuugagcccaggagcucaaggcuucggugaacaaagauugugccacagccugggcaacagaguaagucccugucgaucgauagauagaugauagauagauagauagauagauagauagauagauagauagauagauagauaaauuuuuaaaaaaaauaauaggccaggcacaguggcucaugccuguaaucccagcacuuugggaggccgaggcaggcagaucaccugaggucaggaguucgagaccagccuggccaacauggugaaacccugucucuacaaaaauauaaaaauagccaggcagaugucuguaaucccagcuacucaggaggcugagguaggagaaucgcuugaacucugaagguggagguugcagugagccgagaucaugccauugcacuccagccugagugacagagcgagacuccaucucaaaaauaauaacaauaauaaaaauaauaauaaaugcucuggccccaaaguggcacauuacauggugcacaccccauuagcaaggacucaucacauggcccugccaaccacaggaggaacccccccauguacucagguaggagggccaggaaacaccgucagagagcuuuaaugacucaccccaugacuggggugagggacgagggacuggcugcaggccaagggcauguccguggcaguggagacuugggaaaggggaaaagaccuccucugagccacgcacaguggcuuucaucuguaauuccagcacuuugggaggcugaggugggaggaucuugagcccaggaggucgagacugcagugagcuauguuugugccacggcacucuagccugggcgacagagcaaaacccugucucaaaaaucaaaauaaaaccaaaaccaaaacuuccucuguuggggaugcuccagggcgucccagccuugaacagaugggucacugcaguaauaauccuauggcagacacugucccaaggcugcacgcacguuacuuugaucaucaaacaaccaggugauagccaggcaugguggugcgugccuguagucccagcuacucaggaagcugaagcgggagaaucucuugaaccugggaggcggagguaacagugagucgagaucacaugacugcacuucagccugggaacagagagagacucugucaaaaaaaaaaaaaaaacaggccagacgcgguggcucacgcauguaaucgccagcacuuugggaggcugaggaggguggaucaccugaggucaggaguuugagaccagccuggccaacauggugaaaccccgucucuacuaaaaauacaaaauuaguugggcgugguggugcacaccuguaaucccagcuacucgggaggcugaggcaggagaaucgcuugaacccaggaggcagagguugcagugagcugagauugcaccauugcacuccagccugggcaacaagagugaaacuccaucucaaaaaaaaaacaaaaaaaaaacaaccagccaggcgcgguggcuuacgccuguaaucccagcacuuugggaggccgaggcguguggaucacccgagguuaggaguucgagaccagcuugaccaacauggugaaacuccgucucuacuaaaaauacaaaaaauuagccaggcaugguggugcaugucuguaaucccagcuacucgggaagcugagacaggagaauugcuugaacccaggagucggagguugcagugagccaagcucgugccacugcacuccagccugggcaacagagcaagacucugucuaaaaaaaaaaaaaaaacacacacacacacacacaacaaccaggugaggcaaguacucuugcuaucaucuccauuucacagauggagaaacugaguuacuaagugguagaguaaccuaagucaugcagccgauaacugggagacaagauugggacccaggucgcccagcuguucuccaugccgggcugucuccugcacagcugcuccaugguccuggccccaccgaaaaccagagcccacaaggucauuccagcagcacugcccagggccuccucugggccaggccguuggggaacuggagaccccauggggaccagaaagauuggggucucguucucgggagccuauggcuuugcagcugacccagaguccagcugacacccaggcaggcagucagggucugucuacacccccauugcaggaggagccgacaaacagcagauggacgcugagcugcggaaggagaugauggcgauuuggcccaaucugucccagaagacgcuagaccugcuggucacaccucacaaguguaagagcugagcccagcccugggauccaauccaccaggacagauggagggggagggaaaggggaggccuggggagaguguuggccugggcugguauacacagggacccaggacaagggccccaaagaggccugcccuuggugagcucaccgugugugugcccccagccacggaccucaccguggggaagaucuacgcagccaugaugaucauggaguacuaccggcagagcaaggccaagaagcugcaggccaugcgcgaggagcaggugcgcuguucgccgcucuggggacaucugggcuggggacaguggcuugcaugucaccacgggaaccaacuggaauaugaggguggcugagccccagggcaggucccugaaaaguaggggcugugcacagcagcucacaccugcaaucucagugcuuugagaggccagggcagagggaucguuugagaccaggaugagaccacccugggcaacacagugagacuccaucucuacaaaauaaaacauuagccaggcaugguggugcacaccuguagucccagcuauuuaggaggccaagaugggaggaucacuugaggccaggagugggagaccagucugggcaacauagaaagacccauaucucuacaaaaaaaaaauaaaauuagcugcauguggcgccaugcaccuguggucccagcuacuugggaggcugaggcaggagaaucacuugaaccugggagguggagguugcagcaagccaagaucaagccacugcacuccagcccgggugauaagagcaggacucuaucucaaaaaaaaaaaaaaaaaaaaaaaaaaaaguucuugccaaggacacaucauguggauucauucuucauucagcugcuccaccaacacuuauugaguauuacugugugcagggcgcuguucucaguccucggggaugcacccauggggaaaauaggccagaaucccugcccucagggagcagacauuccaaguggggaaaugccaaugguagcaaaugacugaaucgugcaacauccagcaaagagaaagaaagugucgugggggaaaguggagaagaauccagaagauaggaguauccaggggaggaggggaugcggugggaaauggguaguuggggagccucccugagaaagugacaugugagcaaaggcuugaaggaaaaggggagagggagugagcuaagcaauaccuggaaggguguuccaggcagaggaaacagccagugcaaaggcucugaggcuggaccgugccuggguuguuuggguaacagcaaagaggccagugugguggaaaagagcagggaggagacaagggcaaggaggugacagggcagauccuucagggccaugggagcugcaggaaggacucuggcuuuuuccccaagcaagugggagccauggaggguucuaagcaaaggagggauaggaccugacucaagugcucaugggcgcccucugguggcucuuguggaacagugggguugaagguaggagcgggagaccugggagaaggugccugcagugagagaugaggacgugggaccaggcuggggcuaugacuuggguggaggagugagaagugguccaguucugcguggaauuggaagggucuagauggaugagaccugagagaguguguguguguguguguguguauacuggggaugucgcaaugccuucuggguaccaccgucccaccaccccacccuuguccacacacugcucucugccccauuccccaggaccggacaccccucauguuccagcgcauggagcccccguccccaacgcaggaagggggaccuggccagaacgcccuccccuccacccagcuggacccaggaggagcccugugagugucaccccugccagggagguggagugugggggugccgugguccccacguucuggaagcugcccaagcgcccacugcuaccccggccucugucccccaugcaggauggcucacgaaagcggccucaaggagagcccguccugggugacccagcgugcccaggagauguuccagaagacgggcacauggaguccggaacaaggccccccuaccgacaugcccaacagccagccuaacucucaggugccucugucccccaacuccccaauggcucccagggcccgggugguucagguggaagggaucugggccccccacacacacacaccugcagcucccucccucugcagacaccagggaucuggaggucaggccccagagcucaucuggcuuugccaucugcuccgcaguccguggagaugcgagagaugggcagagauggcuacuccgacagcgagcacuaccuccccauggaaggccagggccgggcugccuccaugccccgccucccugcagagaaccaggugagggcuuucaccacugcccuggggcuggaccccucacucugcacuggguagggccaggcccccccacaagcagcccagugcauccccucccugccggacucaggccuggguagggacuccuucagucucugaagcagucugcaggccccacccaccaccuggucacaccuggagcaccugcagacccuccucccucacagaggacagagaggaaagugcucccccuggggcagagggcaguggccacugcaaaauggucucuggcugcccugguuggaggcugcagacaggggagguuguggaagauuugugggugcagcaggguucaacagggccagcugagaccugccacgaagaucaccccuacacaaacacacacacacaugcucaacauacaugcacacacaugugcagcugugcgccuacucagaugcuugcauacacacacgugugugcacgugggcauauacacacugcacauguacucacacaugcacacauguacgugcacacgugucugcauaugggaacuuggcagguccuaggauacaguagcagagucuggggugggucugggggcagcugggcucguauuuucugucuggucucugugggagucauuggggggcacaggggugugugcuugaugugugucuguguguggccgcuucacccagcugccaggcccaccugcaggugaucccguugccuuggacucaugggacagagggcccagaggcauagcuggcugcccacccggccugaacagcgggggcccaugcacgcagcccgccucuggaggagaacagggcauggcugugagagccuggcccgggugcguggcauguguggcuguggcgagcuuuccgugugccguguguggcgucugcacggggcaggaggcugugcugugccuggcuggaccagggucaccugagggccuggccucuggcugcugggaacguggguuggggagcacccagcgugcaugcugcugcucccucaggaccgagcugcugggccccaggagaggguugggacaagcccagcugacggccaccacauggaagcuuugagcaucggccggagccagggguuggggugugcaucgcaugaggcagagcccagggccaggggcucgaggcugcgccguccugucuuucggucccaugccucugccauuugucugucugcaucuccugucugucuccucuguacccaugggaauagaggacgcccagccccgggggccugggacacccacccgccaggacuuuaacuuuucuuuuccucccugccuucucccuccgauuucucuugaugccagugccacuccccuccuuggcuucuucuccaugcaccaccuccucacucucccucuugccuuuuauauuuauuuucuucuuucuguuuuuucugugugcaccaucccauggggcugugacagaggagaaggggccggccacgugggaauaaccucaguguauguaccgcgccugcccagcgcccagcagggcuccggcccccucuuccuccccacccccccuccagggagucccgucaucucucaccguccccggaccccacccuuucuuuggcaaucgcacccucuccccuccauggagcccaauccuugugugugguguccugugugugccccucacccauaagcccuggugggcggggccauccccauccucaccccuacccccuuuucuucagggccccccacgccggaggacacuggcucuccaagagccuggcccacucugcaccucuuucuggggggcuucuucuccugacaccaccaccaaccccugguccugcagcuccuaccuggagcagggccaccagcgcucagcugggcuggacccugggaggcgggcgucugccccaucucccuccuucccuccucugccugcugcagagaaaccugugugucagggcuugacccagggaugaagcaccagggaaaagagugggcccccagagccuccagugccuggguaucccccacccccacccagagcucccuagcuugggccucaccagaaggacucagacuugugggggcagcgagcacagccccguuagccgggaggacccaaagcugccaugccgggcaccugguccugagcccauaggucagccagccacagucggaggcuucucacccucccaggagagcaagcuggggcagggaugagugcggcaguccagggcucccagguuugcacccuggauguggagagggcuucccucuggccagccugagccugcccaacuguggcugggcccccaggacuggagagugaggaucagaucuuucuggucagaacccaggaugggcucaaaaggagcaguccugucucugagggacagaggaauccucaggcuccacccucagaggccuggccacacccagagcccugauugaucagggggagccaaggccccauggcauccccuggccccugccccaggauggucacaccgcagucaccgaaggccaccaccaggcugccacaauggggcaggaaggaccgggaccacuuggugcuagcugcugaccccagcccaccggccuguccccucccccagaccaucucagacaccagccccaugaagcguucagccuccgugcugggccccaaggcccgacgccuggacgauuacucgcuggagcgggucccgcccgaggagaaccagcggcaccaccagcggcgccgcgaccgcagccaccgcgccucugagcgcucccugggccgcuacaccgauguggacacaggugggcagcccuguggugcucagggacaagcagaacagaggagaggagaggggaggagaaggcagggcggaggagacacuaaggaagaagaaagggagaggccuccauggagaggggacagagggggccaggcagcagcugcaggaaccuggguacuacccccuccccccaacccacugaccugccucgguucaggggaucucuagggcccccacaccuuccagguggccuccugugugugcaucugccccaccucucccucacgaccaccugugugucugucugacccucacccggcccaggcuuggggacagaccugagcaugaccacccaauccggggaccugccgucgaaggagcgggaccaggagcggggccggcccaaggaucggaagcaucgacagcaccaccaccaccaccaccaccaccaccaucccccgccccccgacaaggaccgcuaugcccaggaacggccggaccacggccgggcacgggcucgggaccagcgcuggucccgcucgcccagcgagggccgagagcacauggcgcaccggcaggugggugcggcugcaagugaccccaggcugggcucggccgggaggcggggaggagagaaggggauaccccauccaacagccacucuaggcaaagguccccggaucccggcugugaccaccucccauccugcccccaagccaccggggugcccggcggccggagcggacacggauccccaccacaccagcugccuaugcuguccccccagcccccuugcccacccgccgcccccuccccgccgcccgcagcugcuugcuccucgguuguggaucauauuugaguucugggccgugccgcccgaccuuucacuuuccuuuaacccggcuucuguuuuuguuucaauuaugauuucuguccucuggacgccugugaguaauuuuugaaacuucugcuauuuuuaaccccgaaacuuacaaaacuccauuucucauuucucuuuucacuuuguuguguugguuuucgacuccuccccucccugucucacucccccuccuccccucccuccucccuguggcuguugcuuuuuuccauucaauguccuguguccccccucuccuccuccuccuccuccucccccucccccuccucccucuccucccggccccucucccuucgcuccccucucuuccucccaaucccgugucuccuuugauuuuguuguaucuuuuuuuuugauuuccuuuguuucaauuuucguguagggcaguaguuccguaaguggaagcccagcccccucaacaucugguaccagcacuccgcggcggggccgccgccagcucccccagacccccuccaccccccggccacacguguccuauuccccugugauccguaaggccggcggcucggggcccccgcagcagcagcagcagcagcagcagcagcagcagcagcaggcgguggccaggccgggccgggcggccaccagcggcccucggagguacccaggccccacggccgagccucuggccggagaucggccgcccacggggggccacagcagcggccgcucgcccaggauggagaggcgggucccaggcccggcccggagcgagucccccagggccugucgacacggcggggcccgguggccggcaucuggcccgcacguguccgaggggcccccggguccccggcaccauggcuacuaccggggcuccgacuacgacgaggccgauggcccgggcagcgggggcggcgaggaggccauggccggggccuacgacgcgccaccccccguacgacacgcguccucgggcgccaccgggcgcucgcccaggacuccccgggccucgggcccggccugcgccucgccuucucggcacggccggcgacuccccaacggcuacuacccggcgcacggacuggccaggccccgcgggccgggcuccaggaagggccugcacgaacccuacagcgagagugacgaugauuggugcuaagcccgggcgagguggcgcccgcccggccccccacgcaccccacgcacacaccccacccgaggagccgcgcagaggccgcgggggcccagcacagagggcccgggagagggccagccgggagaccccagacucuggagaggccagggcugggccacaagggugucccgcagagacccucggccaaaagagacccuccugggcagccacggcgccccccaaccagccccgauccccccacccacgacaggggcucucgggugggaggcagggagcagacaaaccacacagccaagggauuugaauuaacucagccauuuuuggagaacuuuggggaacaugaaaaaaaaaaaaaaaaaaaaaaaaaaaaacauuuuuaaaagaaaaaacggggagaaaaaaauagcuucuauugaugaguuuuaucaucucaauugaaucuuuccuuucccugaugaagacagcugguggccgagugcggcaaagaagccagaaggaaccagaaucccagugcccuacacccaccaccagacacacucacacccacacacguucucagacacacacaagagugcuugccgguuauaccaaacccuacuauuacugccugcagaaaucaauuuaaaaaaauaauaauaacaauaaacaauuuuaaaaaggacaaaaaaauuaaugauugagaaaagaggcauuuuuuucugacauuugguccugcuugaaacaacaaaagaagaagaaaaacccaccaucaccaccgauuccuuugcuucuuuuuuccuuuuuuccuaccuuguuugaaaaccgugggcuugggacugugaauuauugcaugacauucaaaaagaaaaaaaaaauaaaaaaaaguugaaucaaa

SEQ ID NO: 191916 - RNA, 4911 nt, Homo sapiens
ggaggccgcauagaagagagggaggaauuacugaacaggagagggggauuggaagaccuagggagguccccuucauucugagaaaagaaggggucucuugaagacuaaaaaggugggagauccugcuggaugggaggagggccacuguggucuaagcuugguugggguggcacugaagggacauagaggacaugguucugaugggaggggggcuccuagguuggaggcaggcccugauggucuccugggauuugaacguccuuggccacugccccagccuccuccucagcugcacuuucccuacucugccuggcacugcuucuuggguaugcacugggugggugccacccuaagcucacagaaagggauggcugaaccccacccuaugccugccagcucuuaucucagguggacauggacugcaggguccacaugcgacccaucggccugacgugggugcugcaacugaccuuggcauggauccugcuagaagccuguggagggagccgcccacuccaagccaggucccagcaacaccaugggcuggcagcugaucugggcaaaggcaagcugcaccuggcaggugagcaccccagacccugccucaccaccaacacccagaaacccacaccuacccugccaugacaauguuagaauuuccuuaugagaggggccuagcauggccaccaaggugggaggcacggauagugcugaagaaugguggauaagaauuagacugccuggguucaaaucccaacucugccacuuuguagcugugugauccugaggaagucauuuaaccucucugggucucacauggacccccaaaaagagagaaauaacaaauauaccucgcagagcuguuguuaagauuaagcauauaagcauaugagcagggcucgguggcucacgccuauaaucccagcacuuugggaggcugcagugggcagaucauuugaggucaggaguuugagaccagccuggccagcauggugaaaccccugucucuacuaauaauacaaaaauuagcuggacgagguggcaugcgccugaaaucccagcuacuugggaggcuuaggcacgagaauuguuugaaccugggagguggagguugcagugagccaagaucacgccacugcacuccagccugggugacagagugaggcccugucucaaaagaaaaaaagaaaaaaaaaaaaggaaaaggauuaaguauaugugucacuaccaggcacaugacaaguaaguugauuauuauaaacaagaaaugauuauuacuacuugaagcugcauuugcauuccaaaggaagggucuuaaguuauggguuugugaggauugauguaauuguugucuccccuguccaggggauccccaggccucaguucccaaaccuuaccugaauauccaagacccuagcucacaggguuccccuuugccaggaccuuguugucccucagagauggacacaacagagacaucgggcccuggaaaccauccagaacgcuguggagugccgagcccugagugaguacagcacccuccaccguuuucucgcguacuuugcccauugcccaggaacucccucggguccugacccauccgacccuaucucucccaacguccagaugcgaauccuuccuggaacaccuccaacgugcccuucgcagucgcuuccgccugcggcuauuggggguacgccaggcacagccgcucugcgaggagcucugccaggccugguaggagacgcgggggcaaggggcguggguugugacuugggcggggaagagggcggagccugcaguuugcuuggccuucuguguaaaggggaguggccuccaacagggccaagguuuaagagaugcagcuuaauguuuagagcccagguagauaggggcgaggcaugagaagcccccagcuuuuaagauaccugccauauggcaauguggcuuuucauagcccugcgauuucuuuucuuuucuuucuuucuuuuuuuuuuugagauggagucucacugugucaccuaggcuggagugcaguggugcaaucucggcucacugcaaccuccacuucccggguucaagcgauucuccugccucacccuccugaguagcugugguuacaggcgcacaccaccaugcccggcuaauuuuuguauuuuuaguagagacgagguuucacuauguuggucaggcuggucucagacuccugaccucgugauccgcccgccucggccucccaaagugcugggauuacaggcgugagccaccgugcccggccuuuuuuucuuuuuuuuuuuuuugagauggaguuuugcucuugucgcccaggcuggagugcagugacacgaucucagcucacugcaaccucagccuccuggguucaagugauucucccgccucagcaucccuaguagcugagauuacaugcuuccgccaccacgcccggcuaaauuuuguauuuuuaguagagacgguguuucaccguguuggccaagcuggucucaaacuccugaccuaggugguccgccugccuuggccucucgaagugcugggauuacaggggugagccaccaugcccagccaggcccugagauuucuuaaggagugaguccucuugauugaaaagauaagguaaaagggugggugccuguaaucucagucguuugagaggucaaggcaggaggauugguugaggccaggaguucaagaucagccuggggaacauggcaagacccagucucaacaaaaaauuuaaaaauuaauuagacaugggccggacguaguggcucaugcuuguaaucccagcacuuugggaggccaaggugggcagauccccugaggucaggaguuugagacaagcuuggccaacguggugaaacaccgucucuacuaaaaacacaaaaaugagccaggcgugguggugggcgccuguaaucccagcuacucgggaggcugaggcaggagaauuguuugaaccugggaggcagagguugcaggaagcagagauugggccacugcacuccagccuggguaacagagcaggacuccaucucaaaaaaaaaaaaaaaaaaaauuaaucggacaugauggugcgcaccuauagucccagguacuugagacacugagguggaaggauugcuccagcuugggaggucaaagcugccauaagccaugcuuacgccacugcacuccagcuugagucacagagcaagacccugacucaaaaauaaauaaaaggaaaacgaaagagugggaaaauaugagggacuggccuguaacuaauggucugaggucuguagggacaaggccaguugugacguggcccagaguauggaaagaucugauagaauauggggcagggugaaaucuggagagaugggguuaguuagcaggggagugguucuaaaaggcggggccuggauccgaggugggggcauauagugaacacagucuagaagagccagaaucgcgcuggaauguaacuacaaaggcuuuacccaccucuccacucgccaucuccagguucgccaacugcgaagaugauaucaccugcggcccgacuuggcucccacucucagaaaaaaggggcugugagcccagcugccuuaccuauggacaggugagcguggggcagaaggugaagggaagagacugagauccuccccaccaaguuauuuauuuauuuauuuauuuauuucugagacggaguuucauucuugucacccaggcuggagugcaguggcgcgaucucagcucgaugcaaccuccgccuccgggguucaagugauucuccugccgcaaccucccgaauagcugggauuucaggcgcaugccaccaugcccagcuaauuuuuguauuuuuaguagagucagcguuucaccauguuggccaggcugguuucgaacuccugaccucaggugauccgcccaccucggccucccaaaguguugggauuacaggugugagccaccgcccccggcccccaccaaguucuuucuuaccgugucuagaccccagagaccggauugguacuccccaggucccugcucccacccuucccuagcccaaccuccuacuggguugugcccuuugaccccaaaagcucucgaaguccagauuugcccuucccaagaaaccauuccugcucuggguccauccacauuuuacccuggaggacccagaagcccagucacucucuacaaaaccccagccuugauacagaccucucugcgcgccccccaacugccccaacccugauucaucccgcuagggcccaguaagaacauucacccuccccaaggaccugcccccacucacguuccgcacauagacucccaggccgcacgcuccggcucugaccccaaucccuaaggaauuuacacauuuuucccuucccgaggccacgccccccacgucucuggacuccgcccacuagggccuuaacuccacuuuuuccuagaccuucgcagacgggacggaccuuugucgcucggcucugggccacgcccuaccgguggcugcuccuggagcccgucacugcuucaacaucuccaucuccgcgguaccucgucccagaccaggacgacggggccgggaagcucccucccggcguucccgcagcccucgcaccuccauccuggacgcugcgggcagcgggaguggcaguggaagcggcagcggccccuagcggacgcguggcccugaguugggggagcgacccuucccccagccccgccccucaggacacccagaaccccaccccucguccucucggccuucuguaauaguuuugagaugucugucccuccucccuggagcuccagagacccaccccucuccagguuaucccagaaaugacccaacucucucacuuuucccucuccccuuugaauaaagucgccagcuagagc

SEQ ID NO: 191917 - RNA, 10832 nt, Homo sapiens
gcaguuuaagaucauuuuauugaagagcaagaggugggagagguagggggcaacuacagcuccccaccagccccaccagggggaauggaccccucccugccuccugcccaaguggcucccccuguauuaugggggggacuuugugcaaacucugccccgaggggguggggaggguggagggugagugugaaauggcagcgguuggggcuggcagcugugcuacugggcacuggggggcuuguagggcuccaggaggagggccgagaagguguugaccuugucugccccccgcaccucaugggguaacagcggcagcuucacgauguggaagucuucauacagguccuccaucugcagccagggcagaggguagaaggcaguggucagggggcaggaaggcagagacagaguguggaucaauagaagcgguaaagcuagaaagcuuccagagucagggagagaauauagggcaggagcuuaaggugucauaagugggagcugcaucacuauggucagagaucacugggcuagacccccugcucuccagggucacagggaccuaggccaggccagccacaguccucuauggccggaauaagggugaaggaucugaaaugugggggcaaagggcaggaggcuagagggcagagggccagaugguggagcaaaagaucagagaauaaaggggcagaggugccucugcugagccagugcugggugggugggcacaccugguccagauacuuggccuggaucuugugacgggccucacacaucuugcagggcuucucggggucggggaagacgagcugguugacaauuauauugugugugucaaucuugcacuuggccagcuccuggaucagccucucugucucauacagggacaggaacucagcaaugcauacgcagaugaaaguugucugcuccuacagggcacgagagaggacagugaggggcggggucugccccuguccucagcccccgggccucucaccgccagccagaccaccacucacaggguccuugaacuguucgcugacugagcggaugacgggcagcgucuccuccagcuuggaggccagcuggucugcguucaugucccccaggcccagcauguugcacaucugcaggggggaugugggagggcucauagcuuaccugcggcgaccuccuggguuggggguucacuaaacacccgagggaugacuccugauaccucccagugguuaaaggcucaggcccauaagcagauuccugggguuggucaaauacuagcuuuuccauuucuuucuuucuuuuuuuuuuuuuuuugaaauggagucucacucuguugcccaggcuggaguacaauggcgugauuuuggcucacugcaaccgccgccuccuggguucaagcgauucuccugccucagccucuugaguagcugggauuacaggcgcgcaccaccaugcccggcuaauuuuuguauuuuuaguacuggugggguuucaccauuuuggccaggcuggucuugaacuccugaccucaggcaauccaccugccucggccuugcgaaguccuaggauuacaggcaugagccacugcggccggccucagcuuugccauuuuuagggaaccauagcuaaggggcuugacccuccuggagccucaguuuccccaucucuaaacuuuaccucccagaucuguuguaccagaugagcugaagcauauaaugugcugagaauagugucuggcacacaguaagugcucaguguuaccaccugaggcacagguccccacaggggacacgcacacacccacacgugcacauacaccaugguggguggugcugguggugugcagcacugugggggcuuuaggguugucaucguaauaauaacccaugggggcugggcacaguggcucaugccuguaaucccagcacucugggaggucgaaguggguguacugcuugaggccaggaguucaagaccagccugggcaacauggcaaaacccuaucucuacaaaaaguacaaaaauuagcugggcauggugguacaugucuguagucccagcuacuugggagguagaggcacgagaaucacuugaacccacgagguggagguugcaaugagccaagaucgcaccacugcacuccagccugggugacagagcgagacuccgucucgaauaauaauaauaauaacccauggggcacucucaugaucuccauuugcaagacaaggaaggugaggcccagagaggugaagugauuugcuugaggucacacagcaguugggucacauggugaguguagaggguuugaaggcagguugccugguucuggaaugugcuuucuggcucugucuaggguauuuagcgggcaggggcagggacacugaguccugccugugggggaggaaagacagcuccgucccauccccuccagggagaaguccagagugagaaggggugggaaggaaagggaauuguuagugcgcauuugagggucugggggcccgggccuacucccacucccggcugccuggauggugcaggugggggcccccgccgccugccugugagaugaaagggcugaucugguucuugaucugcauaagccggcccaggccccgcuccacgaugguggggaaguugagcagccucaggguguggcccgugggugccgugucaaauaccaccaccgagaaguucaugcccuucaccagccugaggggagacaggggucaggcccucuguguccgcucuuccccuuccccaggcagcccccaccccugcuggcugggccugaccucaugaccucggcauagcucauggccucaucgaugccgggaaaugcgcucauggccuccugcaucaucuucuugcccaugcucagcauguuguccuccucgaagaacucgucaggcagcuccgccacgcccaggcuggggucaaucuccugggggccaaagggaugagacugagguugcugcuacugcugggggagccuucccaccugggcacagggccagggggagccuuccuacccgggcacagggccagagggagccuguggugggcugugaccacaggcauuucauuaggucacggcuggggggacccugagguaguacuuaggguuuuguaugguugcauaaagggucaaaaacaaggggaaaauugcaagcugugcccagggcccucaaagggaagcugaaacccacugcgggccauuuacacugcuacuccccacuugcaaccugccacuugcaaccccagauacucccaugacugggccaugaccucuuccggaucaucaucccuccacugagagacucccugaccacccuaaguaacagcacagauccaccgacaccccugcccugccuuccuuucuccuuaagguuuagcccuuaggagcugggcaggauagcucacgccuguagucccagguacucaggagaaugagaugggaggaucgcuugagcccaggaguuggacaccagccugggcaauauagcaagaccuaucugaaaaaaaaauuagcccuuccucacaucccucaugauucccuuaucauguuuaucaucugucuccauagcaggaaugucugccccucaggggcagggguuuuaccaucuaguucacugcuguguccuuagcgcuuagcaugaacagugccuggcacagaggucgucagcacauauggggaauccagccaggcgcgguaccucaugccuguaauuccagcccuuugggaagcggaggcgggcagaucaccugaggucgggagcuugaggccagccuggccaacauggugaaaccccgucucuacuaaaaauacaaaaauuagccaugcauaguggcgggugccuauaaucccagcuacucuggagguugaggcaggggaaucgcuugaacccgggaggcagagguuacagugagccgagaucacgccauuacacuccagccugggugacagagggagacucugucucaaaaaacaaacaacaaaacaaaacacaaacauguauguagaaucuaugaagggauggccauggcuggggucccuggccagucucagacucaaugccucccucuuuuuuuuuuuuuuuucccgagauggaguuuugaucuuguugccuaggcuggagugcaguggcgcgaucucagcucaucacaaccuccaccuucuggguucaagcaauucuccugccucagccucccgaguagcugagacuauaggcaugccccaccaugccuggcuaauuuuuuuuuuuuuuuuuuuuuuugagauggagucuuggccgggcgugguggcucacgccuguaaucccagcacuuugggaggccgaggcaggcagaucaccugagguuaggagaucgagaccauccuggcuaacacggugaaaccccgucucuacuaaaaauacaaaaaauuagccgggcgagguggcgggugccuguagucccagcuacuugggaggcugaggcaggagaauggcaugaaccccagggggcggagccugcagugagcugagaucacgccacugcacuccagccugggcgacagagcgagacuccaucucaaaaaaaaaaaaaaaaaaaaaaaagagauggagucucgcucugucacccaggcuggagugcagugaguagcugggacuacaggcgcccgccaccacaccuggcuaauuuuuuguauuuuuaguagagacgggguuucacuguguuagccaggaugguggcgaucuccugaccucgugauccacccaccucggccucccaaagugcugggauuacaggcacgagccaucacgccuggccaugccuggcuaauuuuuguaauuuuuuuuuuuucugagauggaguuucacucuuguugucuaggcuggacaauggcgugaucuuggcucacugcaaccuccgccuccaggguucaagugauucuccugccucagcuuccugaguagcugggauuacaggcaugcgccaccaccccagcuaauuuuguauuuuuaguagagacggggcuucucuauguuggucaggcugguuuucaacucccaaccucaggugauccacccaccucagccucccaaaaugcugggauuacagguaugagccaccaugcccggccaaugccucccucuuuaucuuccuccucugucaccucuucuugguaacuucaugggucccauggggaaguacccaacucgcuggccuuaggggucauucccuguuggggagcuugcccacucaucacugcacccucuucuuaugcuucauauauuuuaagcuucuuuggacuacuucauccccucaccuggccccuguaaacugucaguguuccucuuggcuggcacccuuauccagcccagccuccacagguucccucugcaaacacucccuuuccccuugcuguuggcaaaaucccccacucugguuacuuccagcuuuuuuuuucuuucuuuuagagauagcgucuuggccgggcgcgguagcucacacuuguaaucccaguguauuaggaagccaagccaggcagaucauuugaggucaggagauugaaaacagccuggccaacauguugaaaccccgucucuacuaaaaaaaaauacaggccaggcgcgguggcucacgccuguaaucccagcacuuugggaggccaaggcggguggaucacgaggucaggagaucgagaccauccugguuaacauggugaaaccccgucucuacuaaaaauacuaaaaauuagccgggcaugguggcaugcaccuggagucccagcuacucgggaggcugaggcaggagaaucacuugaaaucgggaggaagagguugcagugaaccgagauugcgccacugcacuccauccugggcgacagaauaagacuccgucucaaaacaaacaaaaaaaacccccccaaaacaaaaauuagccggaugugguggcgggcgccuguaaucacagcuacuugggaggcugaggcaggagaaucgcuuaaacucaggagguagagguugcagugagcugagaucacaccacugcacuccagccugggugacagagugaaacucagucucaaaaaaaaaaaaaaaaaagauaccaucucauacauagcucauugcagccucaaacucuuaggcucaaaugauccuccugccucaaccuaccaacuuacugggacuauaggcacacaccaccaugcccagcuaauuuuguuuguuuuuuguagagaaagggucucccuuuguugcccaggcuggucuugaacuccugaccucacgugauccucuugucucagucucugcaagcacugaaaugauagguauggcuuucuagcucuuuaguaucacugcacuugagggccgaacacuccugaagaguauucccaucuugcuccucacccuuuuggagacggagucucgcucugucauccagguuggaguacaguggcacaaucucgacucacugugaccuccgccucccagguucaagcaauucuuugccucagccucccgaguaucugggauuacaggcgcccaccaccaggcccaacuaauuuuuuuuuuuugagauggagugucgcucuguaucccaggcuggagugcaguggcaugaucucggcucacugcaaccuccgucucccagguucaagcaauucuccugccucagccucccguguaacugggacuacaggugccggccaccacgcaaggcuaauuuuuguauuuuuaguagagacgggguuucaccauauuggucaggcuggucucgaacucccgaccucaggugaucugcccgccucagccucccaaagugcugggauuacaggcgugagccaccgugccuggcuuauuuuuguauuuuuuuuuuugagauggagucuugcucugucacccacgcuggagugcaguggcgcgaucuaggcucacuguaagcuccaccucccgcguucacgccauucuccugccucagccucccgaauaacugggauuaaaggcacccgccaucacgcccggcuaacuuuuuguauuuuuaguagagaugggguuucacccuguuagccaggcuggucucaaucuccugacuuugugauccgcccaccucggccucccagagugcugggauuacaggcgugagccaccaugcccagcuaauuuuuguauuuuuaguagagauggaguuccaccaucuuggcuaggcuggucuuuaacuccugaccuucugauccaccugccucagccucccgaagugcugggauuacaggcaugagccaccacgcccgcccuugcuccccucuucugaacacaaaucuccaaugggcacuugaugauccagacaauucugguucccccugcuaccuuaauaaguguuuaugugguauuuucucccuccucaaacuucuaucccauucacugcugagacccuugccuguuccuuggugagaaagagaagccauuggcugccaacacccucaucucugcccgggaagugccccaauuccuccuguuucccucccagucccugacccuggcagcgcccaaguucugggucuguaugcuggauggagcucaucccaccugaggacuguccucugccagcauccucacucugcagcaucucuuuauuuuauuuuauuuuuauuuauuauuuuuuguugagucucgcuccguuguucaggcuguaaagcaguggcgcgaucucggcucacugcaagguccacuucccgcguucacgccauucuccugccucagccuccggaguagcugggacuacaggugcccgccaccauaccuggcuaauuuuuuuguauuuuuaguagagaugagguuucaccguguuagccaagauggucucagucucuugaccuugugaucugcccgccucagccucccaaagugcugagauuacagaugugagccaccgugcccggccuuuauuauuuuuuugagacagaguguugcucugucgcccaggcuggagugcaguggcgcgaucucagcucacugcaagcuccgccuccgggguucacgccacucuccugccucagccuccugagcagcugggacuaaaggcgccugccaccaugcccagcuauuuuuuguauuuuuaguagagaugggcuuucaccguguuagccaggagggucuugaucuccugaccuugugauccacccgccucggucucccacagugcugggaugacaggagugagccacugcgcccagccaauuuuuuuuuuuuuugagacgugagaaaaccucgucucuacuaaaaauacaaaaauuagccgggcauggugguaggcaccuguaaucccagcaacuccggaggcugaggcaggagaaucucugcuuccuggguucuagcgauucuccuaccuuagccuucugaguagcugguauuacaggcaccugccaccaugcccagcuaauugguuuauauuuuuaguagugaugggguuucaccauguuggccaggcuggucucaaacucuugaccucaagugauccgcccaccuuggcuucucaaagugcuaggauuacaggaaugagccaccaugcccagcccucacacagcuuuaaaugccacccuugagacagugacuuccaaaucaaugccaaccuccucugggcuccagacucacauaaacaagcuacugucaugauguuuacacuuggauuuccagugggcaacucagauucacuguggacaaaaugaaauucuuuauuuguucauucuaaaccuacuccuuuccuaguuuuccccaucccagcugcucagagagacaagaaagacauguaaucaauucauuucuuuuucucacccaaguaaucuuacugguuuacuuccaaaauacaucccuggugcgaugugguggcucaugccuguaaucccagcacugugggaggccgaggcagucagaucacuugaggucaggaguuugagaccagccuggccaauauggugaaaaccugucuccuaaaaaaaacaaaauuaacaggcagugguggcgcaagccuguagugccagcuacucgggaggcugaggcaggagcauugcuugaaccugggaggcggagguugcagucagccuagaucggguuacugcacuccagccugggagacagaggagucuugagugucuaaaaaaaaaaaaaaccucaagucugacuacuucucccccaacauucugccuccaccagaguccaggauguugucaucucucaacugguuacacccccaaucuccuuguuaguuucccugcuucuacccugacugacaauuaaaucuccaccuggccgucaaaggguacuuuucaaacaugaauuuggccacgacauugcccugcuuaaaacaaacagcuucccguuaauaaccuggagucaaugccaaacuucuuaguggcccauaaggucccacaccauguggcucugauuggucucuccaacuucuccuuccccuacccuggcucacuaagcuucaggcacucuggugugcuuccugcucugcaauuccucauugguucccuugugaguauguugaggaaggagugaaacacgagagacacaggauauagaguggauaggacacgguggcugcuggugugugcgcacaagaaaggcuggaagaggcuuuucccagaagugggggcuaagcccuguuccacucaccauagcaaagagguugucauagccuuugaccuugguaggcaccuuugagaacuucuggucaaaagcaucugagauguugugugcugggucuguggagaugaucagaacacucucacgccccuuggagagcuggacugccaggcugcagcugaguaauggaaaagucaaaagauaggggaugaggggaugggcucuguucccugggucugcaaggggagugguagguucccuggagcaggugacccgaaucagcaggggccuugagaggagaguauggguuauggugggauugagccucagucccuacaaaggaacccucucugauuuaucuccugaccccucuauguggacuagagagguaagguucagcugacugagucugucuggccuagugccugcuucuuuuuugcugggcacaguggcauggcccagcgguccagccagcauagcuugacuccgugcccccuuccuuaauaagcuaaggggucuccugcauucccuaguaagcacaggaugguucagucugcuuguccaggauaaucuguccaacggacaccuccugccuguagcugccugggacagucucaucacgugcucucucccucgcuuuccacccucacucucgccuugggcauaaaacaccaagguucaccaaacuaggauugcuuguucuggugccgcccucacccacaacucuggauucacucagguacgguccagcugauggggauaucuaagugcuuccccgucccccgggcgcugaguucacugugguucggcacuugagccccaacacggaugguccaacucagagggugcuagggcugcauugaggucuuucucauuugcuccagguaacuuccagagagugaaacccaaagacccccgccagcccccaugccccggucgugguggaaaagccgguccuuggccuccccuucgcccagugguauauccuacacgccuccuggcccccgccgcagccuccuuaccugcagguggucuugcccacaccacccuugcccccgacgaagauccacuucaggcugcgcugcucgaugauguugcuaaguguaggcuccagcggcuccacaucaggagcaucuucgaacuccucugccucaaccccccacccggccaccccugccgccauuuuggaacuggcuc

SEQ ID NO: 191918 - RNA, 9029 nt, Homo sapiens
ugcggucccaggaaggucuuacccccucuucuauuuauuaauuugcagacccagccccuccccuacuuuuuggucagcuacgucucuagaauaagaugguaucugaaguccuuccaugucugugucucgguccuugguccuguugguggguccccuggcuucagccugcuccauccucugccucauaggccuccucucgccagcacuggacgcugccucccauggcggucagcaggcagggcucuguugggugguaggccagcgacugcaccacaccggaacccacaggcagggccagagccagcgcacccuguggagcgagggguagggagugguuaucuguggcugggcuguacccugguuucugaggucccugggcaccccccaucucaguccugccugaagcccucagucaccucuccccgaccuucagccaccugccucuaauugccuccuagacacugcaaaauuaaucuaccucagacugagccccucaguagcucuguccuaccagguguucaggccgcaagucuugggagccucuuauugauuuuuuauuuuuuaaaauagcagagauggggucuuaccauguugcccaggcuggucucgaacuccuggccucaagugauccuccugccuuggccucccaaagugcuaggacuacaggugugagccaccaugccuggcuuugggagucuuuuucuuuuucuguuuuuuuuugagauggagucuugcucugucgccaggcuggagugcaguggcgccaucugggcucacugcaaccuccgacucccuaguucaagcgauucuccugccucagccucccgaguaggugggauuacaggcacgcgcuaccaugcccagcuaauuuuuguauuuuuaguacagaugggguuucaccauguuggccaggaugaucucuaucuccugaccucgugauccaccccccucggccucccaaagugcugggauuacaggugugaaccaccaugccuggccgggagucuuuuucuuguaccacauguuccucuaucaguuauuccucuuggcucugcuucuagaccauguccagagacugcugauuuucugccacuaccauguuuggagcaugccuugcucacagcuugccuguucccugccaccagcugggcuccauccuguccauuuggcagccccaaugauccccacuuccccuggucccaacacaauguaaacaguuccucaagcaagccaugcuuccucuuuccaccuugaaaaugucccuugaugugccugcccuccaaggcaacuucuguucuacugggcccauaagaaauagguggaacauucuugcuaccuuaguuccuaaagcaagagcuuguccgccaagucuucagggcccccccgguucccuccauccucuuaugggccuuaguuccccuggccaagcccagcgcugaugucuccuuugccgagauucccccggcucugaccccacuacaccaggauggucuguuucuggccugacuccccaccaggcugggacaugucaaggacagggcucagggcuugaaaccaugcacagggaugcuaagauguagcuccaguuucuugaaugacugcagcccuaucucacccaagguuagacauggccgucggcucccccuugcccaggggucagugccaguugcucggccuggcaucugcagcccagccugaccccggaucuugccgcaccugccgccacccugaagccuuuguuuccugacugaugcaugcgcaggcuacaccucuuaacauaugcuguucccuuugccuggaaugcccuuccugccucaucuucucucuagcccaagcugggcacggugucucaggccuguaaucccagcacuuugggaggccgaggcgggugaaucacuugaggucaggaguuugagaccagccuggccaacauggugaaacccugucucuacuaaaaauacaaaaauuagccagguauggugguaggggccuguaaucccagcuacucaggaggcugagacaugagaaucaccugaacccuggggggaagagguugcagugagcugagauggcgccacugcauuugccugggcaauagucucaaaaaaagaaaaaagggccgggugugguggcuuacgccuguaauccuagcacuugggaaggcugagguggguggaucaugaggucaggaguuuaagaccagccugaccaacauagugaaacccugucucuacuaaaaauacaaaaauuagcugggugugguggcacgcaccuauaaucccaacuacucaggagacugaggcaggagaaucgcuugaacuugggaggcggaguuuacagugagccaagauugcgccacugcacucuagccugggcgacagagcaagacuugucucaaaaaaaaaaaaaaaaaaaaaaaaaagauccuagccuucaggcccuggagugacugagguaaggacagggcugagauggggcaggcaucuagguaugaaguagggcugggggcaccucaccuccaccaggucccagaagaacaccuucccguccucagaacagcugaccacaugugugucacgcucgcucaggcagcaguccagcuuguauuccugguucuuauggcccuuguaccuaaggguggacaggaucggggggcuugguccucuccaggggugggagaggagggaaggggauccccacgaccacaaggacucacucgcccagcagcuccccugugucuuuguccaggagccgcaauguggaguccaggcuggacaccagggugcacugcccaucccggcugaagcaggugcaggugauggggccuugggggaaggguggguaggugagugaggguggggugccccugguuggccccccaucuucccugccugucccacauccccagccacacucacugcccacguagucugagaagagcugccccauccuuaggucauagcgucucacgcggccauccacggagcugcaggagaggguagauccagcgggaaccuugacuacacucacauggcuccaggcagcccugugccuucccagcccagugggccugcucuuccagugcacaggaguggaauucugaagcucuggccuugagacucaggcccagggccaauuacguccuacuccaucauuuccaagacccacacccccuuuccaagcccuuggaguccuucugauucccccuuuucuuccuuuuguuugagacagaguuuugcucuuguugcucaggcuggagugcaauggcaugaucuuggcucaccggaaccucugccucccggguucaagagauucuccuuccucagccucccgaguagaugggaauacaggcaugcaccaccacgcccugcuaauuuuguauuuuuaguagagacgggguuucuccauguuggucaggcuggucucgaacucccaaccucaggugauccgcccaccucagccucccaaagugcugggauuacaggugugagccaccccaccuggcccaauucccccuuuuccugcauucuccagcuccuccuccucaguacucagucccaccacuuuccccacuacccagcaccagcaucuagacuguucuggucucccugcaccccccacagccaccagagggagcacuuuucaaaguacaguugacccaugaacaacacgguuugaacugaacgcguccacuuauauguggauuuucuucugccucuaucagcugugagacaccaagaucaaucccuccucuuccuccuccucugcuuucucaacacgaagaucuuuaugacgaucucuucacuuccacuuaaugaauagaaaauauauuuuuuccaccaggcgcgguggcucacgccugugauuccagcucuuugggaggccagggcagguggaucacgaggucaagagauggagacccuccuggccaacauggcgaaaccccgucucuacuaaaaauacaaaaauuagcugggcgugguggcacgcgacuguagucccagcuacuagggaggcugaggcaggagaaucgccugaaccuagaaguuagagguugcagugagccgagaucacgucacugcacuccagccuggcaacagagcgagacugcgucucaaaaaaaacaaaaauucuuccuuaugauuauuuuuauguauuuauuuauuuaauuuauuuacuuauuuugagacggagucuugcucuaucgcccaggaguguaguggugcgaugucggcucacagcaagcucugccuccuggguucacuccauucuccugccucagccuccugaguagcugggacuacaggcgccugccacuaugcccggcuaauuuuuuguauuuuuaguagagacgggguuucaccguguuagccagaaugaucucgaucuccugaccucaugauccgccugccucugccucccaaagugcugggauuacaggcaugagccacagcgcccggccuauuuuuauuuauuuuuagaaaucauuuuaucuuuuuuuuuuugagauggagucucacuuugucgcccaggcuggagugcaguggcacaaucucggcucacugcaaccuccaacucccggguucaggcgauucuccugccuccgccucccgaguggcugggauuacaggcucccgucaccacaccuggcuaauuuuugcauuuuuaguagagacgggguuucaccauguuggccaggcugaucucaaccuccugaccucaagugaucugcccaccuuggccucccaaagugcugggauuacaggugugagccaccgugcccggccagauuauuauuauuuuguagacagucugucuuucacccagcauggagugcaauggugccucgaacucuuggacucaagugauccuuccacuucagccucccaaguagcugggauuacagcugugugccacugugcccagcugagaguagguuuuaaucugagcaugggggcagcuaugauuccccguagcaccuggggugagaccagguccuggcuccacucacccugccaggaucucguggucugacaccuucacacuggacacgccaucucuggccucauccagcgucugcacuggcucaggccuccgugagcggcaaucccaacagcggauacuggaaucaauagagccugugaggccagcaugauggugaggucagguuuggagggggagggcagcacccugggcccccgugcuuaggccccagacucaccggacaggauaacuguggccucuucauuaaacugcaccguguucaccuucugagaaaguuauugccacucagaggaggcuggacuuuggaggacugggauaaaggcaggguucccagugucgguuaaagcaagggcgaaggggaggugaaagguuuugggggaacagcaaggacagggguuggugacugccuagccuggcaugcggagugggggaucgucaucuggggaagggauccuuacgguguaauggggguggccgugucaccaccuaugcgcuaauacggguccccuccacucaaaugagggucuccaggcuuucacucaccccugcguggccccggaauuugcgcacgaccugcccugaugccacaucccacagaaccaccgccuuguccccgccgccggagcagagacuacuguugucaaaggagcuggaguaaaggaggaggaggaucagcaucgaccucggaucccagccucagcgcucccaucccagccugguccccggcucacccggccgcauccagcaccucguagccguggccgcuguacguccgcagcagcgucccccgaagcggguuccacagcuucagcgucuugucacugccgcacgucaggcaguaauugccauccacuggggaacaccaggcggggguuacugggccgucgaucucaggaggcgggaggaggacccggaaugaagacgaaggcgcucaccauuaaaucguacggcucgcacugcccccugcccgcaguccagcgucuucaaccguuucugcggcagcucuggaggccgcggcuuuggcucagggaaagccaugcucccaggacuccuuccuugcagccuuaaaucggucuguacggaaaauuccgcgccuuagaaacccacgcuuggguguaaccuuauuauuguucuuccugaccuacuuccuguuuaucacuuccggguucaucauuuuggcauuucggugaucggguuggaacuauugaagcccgcuuucagguucuuuuccccauuuucccuuugaaaggaagacuucuggcuucuccuaaaucuccguucucuggguaaggggaguccaagccucugucaugaggaacggaaaugcgagggccucggguguuacucuaaaauccgcccucagcuugcacgccggaagcugcgauuccugcagcggaagaggcgugaucuggccuucgacucgcuauguccacuaacaauaugucggacccacggaggccgaacaaagugcugaggugaggaccccagcgucgugggcacggguucggguuguggguguggaucggggcccugggaagcgccugucuaucccgggggcaggaccugagcgccccugacccucgagccugucgcagguacaagcccccgccgagcgaauguaacccggccuuggacgacccgacgccggacuacaugaaccugcugggcaugaucuucagcaugugcggccucaugcuuaaggugggcgggguugagcuucuauggguguaguuggaccugagaacgaggcccgggggcggguuuggaaugaagcggggugucuugucauugcugauggggcgggaccugagaucggccgggaguggggcugcgaugacgcugggccgagaaagccccagucuuuggugaagucaaggauucgagucagguuggggauguggcagauuggucugcgaguggggccaggcuuugaagcaacuuggagaggaguuguggaaaaagggcagggucuuaagcaugugggaugucagagucucucuugguccugagagacgcaggccagacaguaggacuagaaaccacguaucuagaguaugccaugagcaggugggacugaggaauuccggguggggcaaggucccagcugcaucagauggaaucagugggcaugaucuggugucuggaaagguggcuucggggacucauuguugugccuuucacuaaccugcccacccacuuaccuuucccuagcugaaguggugugcuugggucgcugucuacugcuccuucaucagcuuugccaacucucggagcucggaggacacgaagcaaaugaugaguagcuucaugugagacuugcccuacagaacaagugacucuugaguaagggguggggggaccccagccuggccauccuagacugacaccucucuccugucucaggcuguccaucucugccguggugauguccuaucugcagaauccucagcccaugacgcccccauggugauaccagccuagaagggucacauuuuggacccugucuauccacuaggccugggcuuuggcugcuaaaccugcugccuucagcugccauccuggacuucccugaaugaggccgucucggugcccccagcuggauagagggaaccuggcccuuuccuagggaacacccuaggcuuaccccuccugccucccuuccccugccugcugcugggggagaugcuguccauguuucuagggguauucauuugcuuucucguugaaaccuguuguuaauaaaguuuuucacucuggcugucagccucuucuguucagugggguguuccuccuaccuggcgggaagggcucuagccccauaggccugguguggggccccagucuggaggcuucuggcuguucauuugcuuacuucauaaaccuugugucuuaagucaggugcuagggacaagacagugacuucugcccucuggcaacucaccagauggcccugcugaccuagauaaucuaggcuuugguuuccuuuuuuuuuuuuccuuuuuaagaaagaaaauggucuugaucugucaugcaggcugagugcaguggcacaaucuauguucacugcagccucaaacuccugggcucaagcaauccucccaccucagccugccacguaacugggaccacaaaugcgugcuaccaugcccaguuaauucuuguuuuuuuugagacagaguuuugcucuuguugcccaggcuggagggcaauggcaugaucuugaucucggcucacugcaaccuccgccucccagguucaagugauucuccugccucagucucccaaguagcugggauuacaggcaugugccaccaugcccagcuaauuuuuguauuuuuacauuuuguguaaaauuacaaauuuuguguuuucaaacccgucucuacaaaacaacccauguugcccaggcuggucucaaacucccaggcccaagugauucaccagccuggcccucccaaagugcugggauugcaggcuugagccacugcgccugcccugggcuuuguuuucuuaucagagaaugaacugguaggaauugggaaaggcaugaaagacucgggguccuuccccacuugucagacccucuuuucucuccggaacacccagggauccuucucaaccaggcuggaucccaucccugguacuccagggguauuuacccaacgucccaauccccacaguauaggacucuucaucagauccuccucuuaggcaagcuagguccuuccaggacccuagcgcugaagguccaugggacggacacccuggauucccauggacacacuacaccggcuaggaaaacccggcccccuuaggaaaagcacuucugcuccuaccggcauuaagaggcauuccgucuuggaauuccggcauuaagaggcauuccgucuucauagcccgugagacgccagugucaccuuuagcccaaccagugcccugaggguggcauuuuccuaccuuccuguaacgacccccgggauugcccagggcuacagccucucucccgugagccuccagaccgcgcc

SEQ ID NO: 191919 - RNA, 9029 nt, Homo sapiens
ggcgcggucuggaggcucacgggagagaggcuguagcccugggcaaucccgggggucguuacaggaagguaggaaaaugccacccucagggcacugguugggcuaaaggugacacuggcgucucacgggcuaugaagacggaaugccucuuaaugccggaauuccaagacggaaugccucuuaaugccgguaggagcagaagugcuuuuccuaagggggccggguuuuccuagccgguguaguguguccaugggaauccaggguguccgucccauggaccuucagcgcuaggguccuggaaggaccuagcuugccuaagaggaggaucugaugaagaguccuauacuguggggauugggacguuggguaaauaccccuggaguaccagggaugggauccagccugguugagaaggaucccuggguguuccggagagaaaagagggucugacaaguggggaaggaccccgagucuuucaugccuuucccaauuccuaccaguucauucucugauaagaaaacaaagcccagggcaggcgcaguggcucaagccugcaaucccagcacuuugggagggccaggcuggugaaucacuugggccugggaguuugagaccagccugggcaacauggguuguuuuguagagacggguuugaaaacacaaaauuuguaauuuuacacaaaauguaaaaauacaaaaauuagcugggcaugguggcacaugccuguaaucccagcuacuugggagacugaggcaggagaaucacuugaaccugggaggcggagguugcagugagccgagaucaagaucaugccauugcccuccagccugggcaacaagagcaaaacucugucucaaaaaaaacaagaauuaacugggcaugguagcacgcauuuguggucccaguuacguggcaggcugaggugggaggauugcuugagcccaggaguuugaggcugcagugaacauagauugugccacugcacucagccugcaugacagaucaagaccauuuucuuucuuaaaaaggaaaaaaaaaaaaggaaaccaaagccuagauuaucuaggucagcagggccaucuggugaguugccagagggcagaagucacugucuugucccuagcaccugacuuaagacacaagguuuaugaaguaagcaaaugaacagccagaagccuccagacuggggccccacaccaggccuauggggcuagagcccuucccgccagguaggaggaacaccccacugaacagaagaggcugacagccagagugaaaaacuuuauuaacaacagguuucaacgagaaagcaaaugaauaccccuagaaacauggacagcaucucccccagcagcaggcaggggaagggaggcaggagggguaagccuaggguguucccuaggaaagggccagguucccucuauccagcugggggcaccgagacggccucauucagggaaguccaggauggcagcugaaggcagcagguuuagcagccaaagcccaggccuaguggauagacaggguccaaaaugugacccuucuaggcugguaucaccaugggggcgucaugggcugaggauucugcagauaggacaucaccacggcagagauggacagccugagacaggagagaggugucagucuaggauggccaggcugggguccccccaccccuuacucaagagucacuuguucuguagggcaagucucacaugaagcuacucaucauuugcuucguguccuccgagcuccgagaguuggcaaagcugaugaaggagcaguagacagcgacccaagcacaccacuucagcuagggaaagguaagugggugggcagguuagugaaaggcacaacaaugaguccccgaagccaccuuuccagacaccagaucaugcccacugauuccaucugaugcagcugggaccuugccccacccggaauuccucagucccaccugcucauggcauacucuagauacgugguuucuaguccuacugucuggccugcgucucucaggaccaagagagacucugacaucccacaugcuuaagacccugcccuuuuuccacaacuccucuccaaguugcuucaaagccuggccccacucgcagaccaaucugccacauccccaaccugacucgaauccuugacuucaccaaagacuggggcuuucucggcccagcgucaucgcagccccacucccggccgaucucaggucccgccccaucagcaaugacaagacaccccgcuucauuccaaacccgcccccgggccucguucucagguccaacuacacccauagaagcucaaccccgcccaccuuaagcaugaggccgcacaugcugaagaucaugcccagcagguucauguaguccggcgucgggucguccaaggccggguuacauucgcucggcgggggcuuguaccugcgacaggcucgagggucaggggcgcucagguccugcccccgggauagacaggcgcuucccagggccccgauccacacccacaacccgaacccgugcccacgacgcugggguccucaccucagcacuuuguucggccuccguggguccgacauauuguuaguggacauagcgagucgaaggccagaucacgccucuuccgcugcaggaaucgcagcuuccggcgugcaagcugagggcggauuuuagaguaacacccgaggcccucgcauuuccguuccucaugacagaggcuuggacuccccuuacccagagaacggagauuuaggagaagccagaagucuuccuuucaaagggaaaauggggaaaagaaccugaaagcgggcuucaauaguuccaacccgaucaccgaaaugccaaaaugaugaacccggaagugauaaacaggaaguaggucaggaagaacaauaauaagguuacacccaagcguggguuucuaaggcgcggaauuuuccguacagaccgauuuaaggcugcaaggaaggaguccugggagcauggcuuucccugagccaaagccgcggccuccagagcugccgcagaaacgguugaagacgcuggacugcgggcagggggcagugcgagccguacgauuuaauggugagcgccuucgucuucauuccggguccuccucccgccuccugagaucgacggcccaguaacccccgccugguguuccccaguggauggcaauuacugccugacgugcggcagugacaagacgcugaagcuguggaacccgcuucgggggacgcugcugcggacguacagcggccacggcuacgaggugcuggaugcggccgggugagccggggaccaggcugggaugggagcgcugaggcugggauccgaggucgaugcugauccuccuccuccuuuacuccagcuccuuugacaacaguagucucugcuccggcggcggggacaaggcggugguucugugggauguggcaucagggcaggucgugcgcaaauuccggggccacgcaggggugagugaaagccuggagacccucauuugaguggaggggacccguauuagcgcauagguggugacacggccacccccauuacaccguaaggaucccuuccccagaugacgaucccccacuccgcaugccaggcuaggcagucaccaaccccuguccuugcuguucccccaaaaccuuucaccuccccuucgcccuugcuuuaaccgacacugggaacccugccuuuaucccaguccuccaaaguccagccuccucugaguggcaauaacuuucucagaaggugaacacggugcaguuuaaugaagaggccacaguuauccuguccggugagucuggggccuaagcacgggggcccagggugcugcccucccccuccaaaccugaccucaccaucaugcuggccucacaggcucuauugauuccaguauccgcuguugggauugccgcucacggaggccugagccagugcagacgcuggaugaggccagagauggcguguccagugugaaggugucagaccacgagauccuggcagggugaguggagccaggaccuggucucaccccaggugcuacggggaaucauagcugcccccaugcucagauuaaaaccuacucucagcugggcacaguggcacacagcuguaaucccagcuacuugggaggcugaaguggaaggaucacuugaguccaagaguucgaggcaccauugcacuccaugcugggugaaagacagacugucuacaaaauaauaauaaucuggccgggcacgguggcucacaccuguaaucccagcacuuugggaggccaaggugggcagaucacuugaggucaggagguugagaucagccuggccaacauggugaaaccccgucucuacuaaaaaugcaaaaauuagccagguguggugacgggagccuguaaucccagccacucgggaggcggaggcaggagaaucgccugaacccgggaguuggagguugcagugagccgagauugugccacugcacuccagccugggcgacaaagugagacuccaucucaaaaaaaaaaagauaaaaugauuucuaaaaauaaauaaaaauaggccgggcgcuguggcucaugccuguaaucccagcacuuugggaggcagaggcaggcggaucaugaggucaggagaucgagaucauucuggcuaacacggugaaaccccgucucuacuaaaaauacaaaaaauuagccgggcauaguggcaggcgccuguagucccagcuacucaggaggcugaggcaggagaauggagugaacccaggaggcagagcuugcugugagccgacaucgcaccacuacacuccugggcgauagagcaagacuccgucucaaaauaaguaaauaaauuaaauaaauaaauacauaaaaauaaucauaaggaagaauuuuuguuuuuuuugagacgcagucucgcucuguugccaggcuggagugcagugacgugaucucggcucacugcaaccucuaacuucuagguucaggcgauucuccugccucagccucccuaguagcugggacuacagucgcgugccaccacgcccagcuaauuuuuguauuuuuaguagagacgggguuucgccauguuggccaggagggucuccaucucuugaccucgugauccaccugcccuggccucccaaagagcuggaaucacaggcgugagccaccgcgccugguggaaaaaauauauuuucuauucauuaaguggaagugaagagaucgucauaaagaucuucguguugagaaagcagaggaggaggaagaggagggauugaucuuggugucucacagcugauagaggcagaagaaaauccacauauaaguggacgcguucaguucaaaccguguuguucaugggucaacuguacuuugaaaagugcucccucugguggcuguggggggugcagggagaccagaacagucuagaugcuggugcuggguaguggggaaaguggugggacugaguacugaggaggaggagcuggagaaugcaggaaaagggggaauugggccaggugggguggcucacaccuguaaucccagcacuuugggaggcugaggugggcggaucaccugagguugggaguucgagaccagccugaccaacauggagaaaccccgucucuacuaaaaauacaaaauuagcagggcgugguggugcaugccuguauucccaucuacucgggaggcugaggaaggagaaucucuugaacccgggaggcagagguuccggugagccaagaucaugccauugcacuccagccugagcaacaagagcaaaacucugucucaaacaaaaggaagaaaagggggaaucagaaggacuccaagggcuuggaaagggggugugggucuuggaaaugauggaguaggacguaauuggcccugggccugagucucaaggccagagcuucagaauuccacuccugugcacuggaagagcaggcccacugggcugggaaggcacagggcugccuggagccaugugaguguagucaagguucccgcuggaucuacccucuccugcagcuccguggauggccgcgugagacgcuaugaccuaaggauggggcagcucuucucagacuacgugggcagugaguguggcuggggaugugggacaggcagggaagauggggggccaaccaggggcaccccacccucacucaccuacccacccuucccccaaggccccaucaccugcaccugcuucagccgggaugggcagugcacccugguguccagccuggacuccacauugcggcuccuggacaaagacacaggggagcugcugggcgagugaguccuuguggucguggggauccccuucccuccucucccaccccuggagaggaccaagccccccgauccuguccacccuuagguacaagggccauaagaaccaggaauacaagcuggacugcugccugagcgagcgugacacacauguggucagcuguucugaggacgggaagguguucuucugggaccugguggaggugaggugcccccagcccuacuucauaccuagaugccugccccaucucagcccuguccuuaccucagucacuccagggccugaaggcuaggaucuuuuuuuuuuuuuuuuuuuuuuuuuugagacaagucuugcucugucgcccaggcuagagugcaguggcgcaaucuuggcucacuguaaacuccgccucccaaguucaagcgauucuccugccucagucuccugaguaguugggauuauaggugcgugccaccacacccagcuaauuuuuguauuuuuaguagagacaggguuucacuauguuggucaggcuggucuuaaacuccugaccucaugauccacccaccucagccuucccaagugcuaggauuacaggcguaagccaccacacccggcccuuuuuucuuuuuuugagacuauugcccaggcaaaugcaguggcgccaucucagcucacugcaaccucuuccccccaggguucaggugauucucaugucucagccuccugaguagcugggauuacaggccccuaccaccauaccuggcuaauuuuuguauuuuuaguagagacaggguuucaccauguuggccaggcuggucucaaacuccugaccucaagugauucacccgccucggccucccaaagugcugggauuacaggccugagacaccgugcccagcuugggcuagagagaagaugaggcaggaagggcauuccaggcaaagggaacagcauauguuaagagguguagccugcgcaugcaucagucaggaaacaaaggcuucaggguggcggcaggugcggcaagauccggggucaggcugggcugcagaugccaggccgagcaacuggcacugaccccugggcaagggggagccgacggccaugucuaaccuugggugagauagggcugcagucauucaagaaacuggagcuacaucuuagcaucccugugcaugguuucaagcccugagcccuguccuugacaugucccagccugguggggagucaggccagaaacagaccauccugguguaguggggucagagccgggggaaucucggcaaaggagacaucagcgcugggcuuggccaggggaacuaaggcccauaagaggauggagggaaccgggggggcccugaagacuuggcggacaagcucuugcuuuaggaacuaagguagcaagaauguuccaccuauuucuuaugggcccaguagaacagaaguugccuuggagggcaggcacaucaagggacauuuucaagguggaaagaggaagcauggcuugcuugaggaacuguuuacauuguguugggaccaggggaaguggggaucauuggggcugccaaauggacaggauggagcccagcugguggcagggaacaggcaagcugugagcaaggcaugcuccaaacaugguaguggcagaaaaucagcagucucuggacauggucuagaagcagagccaagaggaauaacugauagaggaacaugugguacaagaaaaagacucccggccaggcauggugguucacaccuguaaucccagcacuuugggaggccgagggggguggaucacgaggucaggagauagagaucauccuggccaacauggugaaaccccaucuguacuaaaaauacaaaaauuagcugggcaugguagcgcgugccuguaaucccaccuacucgggaggcugaggcaggagaaucgcuugaacuagggagucggagguugcagugagcccagauggcgccacugcacuccagccuggcgacagagcaagacuccaucucaaaaaaaaacagaaaaagaaaaagacucccaaagccaggcaugguggcucacaccuguaguccuagcacuuugggaggccaaggcaggaggaucacuugaggccaggaguucgagaccagccugggcaacaugguaagaccccaucucugcuauuuuaaaaaauaaaaaaucaauaagaggcucccaagacuugcggccugaacaccugguaggacagagcuacugaggggcucagucugagguagauuaauuuugcagugucuaggaggcaauuagaggcagguggcugaaggucggggagaggugacugagggcuucaggcaggacugagauggggggugcccagggaccucagaaaccaggguacagcccagccacagauaaccacucccuaccccucgcuccacagggugcgcuggcucuggcccugccuguggguuccgguguggugcagucgcuggccuaccacccaacagagcccugccugcugaccgccaugggaggcagcguccagugcuggcgagaggaggccuaugaggcagaggauggagcaggcugaagccaggggacccaccaacaggaccaaggaccgagacacagacauggaaggacuucagauaccaucuuauucuagagacguagcugaccaaaaaguaggggaggggcugggucugcaaauuaauaaauagaagaggggguaagaccuuccugggaccgca

SEQ ID NO: 191920 - RNA, 18352 nt, Homo sapiens
aacuguuuuauaaaccuuuauuggaaaggcuacaaacuuuauauugccaccacauuucuuauguuuaaagugguuguggggaaguaaccuuggauacaaaacuacuaugcuguugaaucuuacccaggcuuguuguaaaauauuuuuuguacaauggagguagaguggauaggucaauaauuuaaaccucacaggacuugauuagugucagcacaccuuuuuucauucagguuuucagguucuagcagaccuagaaauaaacuacaaauacuagauuuaggcucagggauggcauuuaauacauuuaaaauuuuuaguuuucaguuuuccccauuuguuccuuuauaaauguaaaauugugcaucugaugucucuuuccucaaauaaguguguucuaaaaauaccuacugagugaaaugguaaaaaccagaugauggaaagagaaacacaacauccguuucaucaauuuuaccugauuuuucucaaaccagccuuuuuuuuuugcuuauuuuuaguuugaaauauaaauaacuacaacaaugcauauuucaguugccuucauucuuaaauucugaauaagcaucuuacuuuucuauaaaacauuacagaaacucaaaauaauaaucaauggcuucuccaauuccaaauauucaacuuaauggagacagcaucuuuuacauuuaaugaaaacagaggauuugaacacguucuaugcagacaugguuuuacuauagauuugcuguuaccuuauuuuuuuaaggggguggugguagggagauacagaagucaggcuagcccagugcuugggaguuacagcacucaagacacccuggccucuacagagcaucacugaagccacugaagacugucucuaccagccuuuugucuuccaagacuauaagaugggcauaggccugagauauaagcuucaggccaauggguuuuuaugggcuguuuaagaaccaguacuaaggauacauucuuuuauguuuuuccuucuaaaaaugugacacaaaagaauaauuuacaccaaccgcuuuuuauuaucgaguuucagaaaccuuucacaagaugguaaaaaaaaaaaaaaagaaaaaagaaaaaaaaaacaaaaccaaaaacaaaaaaacuuuacaaccacagcuaauguaauuuuuuccauuguucccagucagcuccaaacccauugugugcaaagcccauuuuuuuccaugcaucuaaaugauagauacaggcuaugaaauucuuuauucuauuuguagcagcuuaugcaggugcagccaaacacaaagcuucaggacaaauuguacaaacuuuacaaugugggauuuaaauuuaaaauaugaaacauaaaaaucuacacaaaacugauaaaaaucaagcacagauaccaggauugaaacuuauaauaauccaugugugaaagggagucuuguuuccuuucaagugcuuuauucugcuauggaacagucaaaaugaagauguaaagcuuugugguuaguuuaaauuauacacucuguagauacuauaccaauuuuaaaaguuauacauagaccaacagaugucccucaguucaucuggauugauaagacacuccagcuggauugcugagaacaaaucaggcaaauguggaaagaaaauccaccugugcaauuuguuugcagaguuuacugaugggcacacugcacuccagguccaugauggcugcugcuuucuucaucagagcuaucauuauaggcuucacgccucugaccaccuccugagccucgagugcuaucaaauuccugaagcucuaccuccucuguuucuccaauuauguuaggaacuuccggucuagauggcagaagaucuucuaguuccuuuauuaaaacaaacaaaaaccagguugguuguaauauuuucaucaacuuuccuuuugauacauagaauccagugucuguuuaagaguuuaaaaaggggcuggguguggugguucaugcuuauaaucccacccagcacuuuggaaggcugaggcgggcggauaaugaggucaggagaugagaccagccuggacaacauggugaagccuugucucuacuaaaaauacaaaaaauuagccaggcauggugguggguaccuguaauccuagcuagucagaaggcugaggcaggagaaucgcuugaaccugggagguggaaguugcaguaagcugagauugugccacugcacuccagccugggugacagagcaagacuccaucucaaaaaaaaaaaaguuaaaaaaaggaauguggacuggacuuugaacucuaaguaaaagaucacaaacucaucacucacaggccaaauucugcagacaucuuuugugcaacccaucuauugcuuuaagaaccaaaaaaaaggucauuaucugccaauacuuaaacauuagaaaguuucuacaggagacacaccuuccugcauccggcauggacaccagcuuacgauaaagggguagugguccugcccucugcaaaugaggaaccuguucucuccagggagugcuacuccucaucaccacccacaccgggucuacuuuacuccucuacaauucccugcuuggccccaucaacauuuacaccagcaauaccccauuuccuaacaacuaggaaagccuaccaaucacacaaauauacuuuaaaauugaaaguaacaugacuauuaagaaacuugaagucggcugggugcaguggcucacgacugcaaucccagaacuucgggaggcaggaggauugcuugagaccagucuggacaacauagcaacaucucuauaaaaaguuuuaaaaagcauuagccagguguggugguacacacccguagcaagccaugaucaugccacugcacgccagccugggcaacagagcgagacucucuuaaaaagaaagaaacuuggcugggugcaguggcucacgccuguaaucccagcacuuugggaggccgaggcagguggaucaugaggucaggagaucgagaccaucgaucuaacauggcuaacauggugaaacccugucucuaacuaaaaauacaaaaacaaaauuagcggggcgugguggcgggugccugcagucccagcuacuugggaggcugaggcaggagaauggcaugaacccaggagguggagcuugcagugagcugagaucgugccacugcacucaagccugggugacagagcaagacuccaucucaaaaaaaaaaacaaaaacaaacaaacaaaaaaaccccauaaacaaacaaacaacaacaacaacaaacuuaccaggcaucguggcucaugccuguaaucccagcuacuuggguggcuaaggcaugagaaucacuugaaccugggaggcgggggguacagugagccgagacuacaccacugcacuccagcuugggugacacagugagacugugucucaaaaaauuuuuuuuaaauuagccaggcauggcaacacacaccuguagucccagcuccuugggggcugaggugagaggaucgcuucagcccaggaggucgaggcugcagugagccacgaucacaccacuacaccccagccugggugacagagacccugucuaaaaaaccaaaaaccgaacuccaaacuuggaagucaacuguuguuuaauuuaaagaacacuuacagaaagcuugucuggguugauccaguuguuuucaggaaacugcacaucaaacuuuauguaaagaucaccuuuuucaaagggauuacgauacugcggcaucccuucaccucgaacuacacgaacacacccuauuauuuaagaggaaaugauuaauaauuuuacccaaaagagguguucaauuuuuuuuagaguuaugcaguauaaaaaaauuacaaauuguaauuuuuuucaaaaauacuugaaaaccagaaucggacaaaaucaagauuuaccugguucaauuacuuugccagggggguauuucaccacaaucugacguccaucaaggugcuuaaaugugaacugaaauccacauagagcuucaacaaguccuauuuuauaugucaugugcaaaucauucccaucucucugaaauaccuauaaauaaagcacaaaagaaauacauuuucuuaaaaauuauggagguacacccugcagcauuauguuccuugacuuaauuucaaaaccuuauuucuaccacucacugcaaauccaaagugccacugucccuagugcccuaaaccgcauuaggaaagcuagcuauucccaaguaguaugugagaaacuuccaugaggaagguguacuggaacugguaaacaauggcauauauaagagcaacagaacugaggcccucaaaacagugccagguauauucugcaacuauugcccacuuucagacucugccucuggugaaaaagguacagaaugcccagagggcuccuacagaacaggcucacccuggagugcuccccagacaugaucguaacagggaaggggggaggguccaagaucaacauaaaacccaacaucaaccaguuaacacccagccagcaaagucaaguggcucaauuccgugcuucacacacauaccaacaagucucacaucucacuaaaaugcaaaacuggcucauucaauauuacacuauaagccuauggacuagguaaugcaaaagguauugagaauaagcacaaagaauguuucugagccuucaauguguaggaaaaauacauccaacuucacacgcccaaccugcaauuuuugcuuagauuuuacaauggucacucuucuuguaaagaacaauccuggccgguucacuuauagaaaaucugguagacagguucuuuuccuauguuacucuccuaaauuuacucauuaaacaaaguuaaaccauuaccuuaaccaaugauucucuaagugugguucuggaccagcagcuucaggaaacuuguuaggaacacauauucuugggccccacuuccauuccugccagaaacaaggcaggcaagauccagcaucuguaguccuaacaagcccuccaggcaauucuugugugugugcuaaaguuugagauccaagaagguauguuauguaugcacauauauucaaguguuccucacaaugggaccaauaguuuuuuuaaugcaggauuuuucaacgcauuaaaaaugcuaaguaggccaggugcaguggcucacaccuguaaucccagcacuuugggaggccaaggcaggcggaucacaaggucaggaguucaagaccagccuggccaauauggugaaaccccaucucuacuaaaaauacaaaaauuagccaggugugguggcacgcgccuguagucccagcuacuuaggaggcugcggcaggagaaucacuugaaccugggaggcggaggcugcagugaaccaagaucacaccacugcacuccagccugggcgacacagcgagacuccaucucaauaagaaaaaaauaaaaaaauuuaaaaaagcuaaauauagggucagagcuuugggaggccaguucaaaacagcaacauagggagacaaaaaauuaaaacauaaacuaggcuaguugaggcaggacgaucccuugagcccaggauuuggagccugcaggggcagucccuccucauuaaugauccagccacugcacuccagccugggagacagaaggacauccugucucuuaaacauaauaauaauaaauuuaaaauaaaugcuaaguauacuguaaaaugccaguguucuaagaaccaucuuaccaaauauccuuuguuaaagucauacuauuuuaggaugcaugcaguggcucaugccuauaaucccagcacuuugggaggcugaggcagguggaucaccugagguccuggucaucauggcgaaauucugucucuacuaaaaauacaaaaacuagcugggugugguggcaugagccuguagucccagcuacuugggaggcugaggcaggagaaucacuugaacccgggagguggagguugcagugaacagagaucgcgccacugcacuccagccugggugacagagugagaccccauuucaaaaauaaaaacaaaaauaaaaaguggggcagggcacgguggcucacaccuauaauccuagcacuuugggaggccgagguaggcagaucacuugaggucaggaguuugagaccagccugggcaacaugaugaaaccccaucucuacuaaaaauacaauugcgccacuacacuccagucugggugacagggcaagacugucucaaaaaaaaaaaaaagaaaagggaacaggaagagauacacaucacguucuuguacaggagaguucaacugaaagugauuucaauaaaaaaugauuaugauuaucaggaugguuguugcagcagagcggggaagcuaaacaauuugauguuaaaaguuuaaacagaauaaacaagcaaggaugccagagaguuucugaaaaacaagauuaaugaggagggaccaccaagcacuagaccagaaaacacuuagaagucauauuucugaauaacaaaaguacagguuauagaggcgugacuaacaucaccagguucugugguuugaugcuguacaagugcacuaugguaaccagaccaccgagacacacaaacaggcacacugacaagugacauggcaggaugaugacuauagaugauacagcacucccaagaaggaacgagacaaacuuccauucuaaccuuuaccaucuucuauuuucuacuuuagacaacuagcuacaucugccuucuguugaaaauuccaugccaauuccacugcugccaacaauuuucagagaugaguuacuucccaacaccuccccacaggccccaagaaagaagcuuauucauaaucucauuugacucuuuaauauccaaaaaguccagggaagccaaagcuaguaaacggggcccagaccuuaaguccuuugccuccaaauccaaugaucuacuuuuaaaaacccaauuuaauuaugcagcaacauuaaaaacuaaacuuagggauaaaaaagguuuuaccaucaguuugacaugccucaaaccaaaaaaaagucauccuuccucugcaaauaagcauuccuucuucacuuccuaucaugcugcugcacugccagacaucauuugacaacgaaccccaaacgacuccaaggauucuaucaaugaaaaugcccaggcacugucuguaccauuuuacaacacagucuaaccuccaagcagaauuuccaauuauuuagcugucuugcuagcuuucucccucauauuccugguaugguggugugcacagcagcaagacugaaggaacaaggaaguagcuaaaauguuaacaaauagcaaaucuuguaaauauuucauucuacaagacccaaaggcagaauucuaaaaacuacucuuacuuuuugacaaccgaggagacguuugcuaucuguaggguuggcaauuuccacaaaaagccaaaauacauaauuuguagcuuugcugagucaugaaagcugacuagcaugcccugauuguccaggagaucaagucugaccuugugagggauuacuaccaaauuccuaaaaccugcaucucaauauggcuuuguuguucucuauuggauucuuaaagugauuuuuaaaauuuacucuauuugaagaaaugaucaccacagaaggacgaucuccuucuuuaucaaauauaaccuuuaaauuauaaaugauaaucagcuugcccaccuuuuuagaauuaaaaagaauaaccuuucacugaacauaauacaaauuuaccauuucuccguguucauugggcuuaugcauaggagaaaauuuuagggcaaacuaaaaaggugguuaaccugugauguaaugauuuucagaggaacacaugaguaaaugugaucaaguacaaagcuagaguccuaucaagugcuucuaacauucaagaauuuaggugauuacuggagggguuuuucaugaauaguuccagauuuauucuuugaguagggucuacaguauacaauauggacauuaaaaauauacaagugcaauguuaaaaucaaaauaacauacacuaggcugggcacuguggcucacaccuguaaucccagcacuuugggaaguugagacaggaggaucgcuugagcucagaaguucaaaaccagccugggcaauauggcaagacccugucucuacuaaaaauacaaaaaaaaaaaaaaccccaaaaaacaaacaaacaaaaaaauagaugggcaugauggugcaccaguugucccagcuacuugggaggcugagaugggaggauugcuugggcccaggggcgaagguugcagugaucccagaucacaccacuguacuccagccagggcgacagagcaagaccaucucaaaaacaaaaaccccccaaaacauacacuagugaccacauucuucagaagcuucuaaaaaaauauuuuuuuuaaaaaaaaucccagaacccuuucaaggauagcucacuuggguacccaauaaguaaaaaccaaaucgacagagcagcagaguuucacagugaaaauacaggcugccuuagaucaacugguccaacacccagugcccuuauuuucauaaacaaagaaacugagacaguaagauuaccuaugguuaaaguguuagucaaugaccaggccagaggagaaucgcuugaaccugggagguggaggcugcagugagccaagaucgugccacugcauuccagccuggguaacaaagcaagacuccgucacacacacacaaaaaagaccaaggccaggcgcgguggcucccgcuuuuaaucccagcacuuugggaggcugaggcaggcagaucaccugagguugggagcuugagaccagccugaccaacauggagaaagccugucucuacuaaaaauaaaaauuagccaggagugaagaagcaugccuguagucccaacuacucgggaggcugaggcaggagaaucacuugaacccgggaggcagagguuguagugagccgagaucgcaccauugcacuccagccugggcaacaagagugaaacuccaacugaggggcagggggaagaaaccaagccaggacuaaaacugacucuuacagugcuucuaacugcaccugccuuguuagucuuucuuacacaagcccgucuuaggaacucaccaugaugcccuuaacuucaccaguguucaguguugcuccagggacuccaaacagaucuaaccuauuucucacaagcaagaaguacuucugaauaaaacaaaauacaaaaaacuaaaaaaaggaaaaucaccucauguucuuucuccuguagcaaaagaacaaugucuccggguuccacuccuggggccuggucugcuuccccagugaauguaauucucuguccauguuucaugccuuugucuacguggacuucaagaaucuugacuucuuuaaucaccuucuucccuucacauuuuuuacagcggucuuuuucauuaauuaccucuccuggaaagagaagucauugaaacuuucagcaagaguacuauacuguacucuuaauacccuuauucuuuaaauaugcuuucuggacuucuuuuaaucacuaccuaaauuuuuauucaaagcagcauucugaggccaagcacaguggcucaagccugcaaucccagcauuuugcgaggucagggugguaggaucacuugagcucaggaucugagaccagccuagcaacacagugagaccuugccucuacuacaaauaaaaaaaguuagccggcgugguagugcacaccuguaauccuggcuacuggggaggcugaggagggaggacugcuggaguucgaggcugcaguuaguuauaaucaugccacugcaccccagucugggugacagugugaggccaugucucaaaacaaaacaaaaaaaagcacuauucugaauaacaaaaacuuacaucuuacuacugcagacugccugaaggacucagcuucccacuauuucagaauguaauguauccauaccauguuuagggcaacacagcuuuucucuuauaauuaugguauuaaaaagcaaaaccgugauuauacauauuauagugugaaaaaacugcgucacuuucuaauggcuaauuaccagcacauuugaaggcuuagaaagaaguguauaacugauuauuuagggacuguuucuguaacaguacuugugcaaaguauguucugcaaaacacguucuucaaaaugguaauaguggccgggcaugguggcucacaccuguaaucccagcccuuugggaggcgaaggcgggaggaucaccugaggucaggaguuugagaccagccuggccaacacggcaaaaccccgucuccacugaaaauacaaaaaucagccgggcgugguggcaggcgccuguaaucccagcuacucaggaggccgaggcagcagaaucacuugaaccagggaggcagaggcuucggugagcugagaucacgcaacugcacucuagccugggcaacagagcaagacuccgucucacaaaaaaaaaaaaaaaagaaaaaagaaaaauguaaugguacaugagaaagauuucaguuaacuuugguuucuugauagugggaguuagcaauuauaauaaaauaaaagcaggccaagagugguggcuaacaccuguaaucccagcccuuugggaggcuggggcaggagaauuacuugaacccaggaguucgagaccagccugggcaacguggcaaaaccccaucucuacaagaaauacaaaaauuagcugggcgugguggcaagcaccuauggucucagcuaauuguggggcgaggggcugagguggaaggauugcuucagcgugggcgguggaggcugcggugagccgagagugugccacugcacuccagcccaggcgacagcaagacccuaucuccaaaaauaauaauaauuuaaaaaaauaaaguaaaaugccaagacucuccaggaaggaaauaucauauguaacuucucauaauuaucucaucacuuccaauagcaauuuggaaaaggaugcuauugaacuauacugucaaauaugguagccacuaucaaccuguagcuacuuguuuauguuuaaauuaauucaaauuuaaaauaguucuccagucacacuagccacaugugaaauaugcaguagucacaggugauuaauggcuacuguacuggacacugcagauacagaacauuuccaucaucacagaaaaaaauucuauuggauagcacugcucuagaauggcaggggugggaggagcuauguguuuuuauaauuaaaauuuuaaucagaacacagccauauccaugugucuguggccauaaaagcacuaaaaggucagagaugaguaguugugacaaaaacuauuuggcccacaaagacuaaauuauuuacuucuguaaggacagcuucaaucucaagaucaauucugaaaagcuaacuaaagguuacagugaaaucuuccacuuaucagaauaacuaaacaacuacuuguuuaguuauuuauuauuugauuauuugucccuuuguaguuuaaaagguucuaugugauaaaggagauaguccuccuaugguggucauuccuacagagagaguaaauaaaagguuauauuugauaaagaaggaaauagcaaagggacaaauaaucaccuugcuccucuuuucugaauuaaaaagagucaccuuucacuaacacaauacaaaucuacuguuucucuauguucacugggcuuaggcauaauggaguaauuacuuucacacuuuuaucuuuuauuuuuugcaacagggucuuguucugucacccuggcugaagugcacugguaugaucacagaucacugcucccucgaacuccugggcucaagcaauccucccgccucagccucccacgcagcugggaccacagacaugcccugagccccucauuacauauuuuuccacacuuuuuuuuccuauaguaaugaggucucccuauauugcccaagcuggccucaaacuccugggcucgagcaauccaccucugucucccaaagugcuggaauuauaggaaugagcuaacgcacccggccuccuuuuucuuuaauaagauguauacaaauacccuuugaaauaaaaaauuguaaaccucuccaauaucugcauucccaauccauuccaacauaaaagcagagaaguacuggcacacauaccuucuccauuacaaucagagcacacagacugcaucuguuguaccaucccuggagccagcugucugaucaugaugcgcacaccucgaccucgacaagcacuacacuuuuggacagcuccagacuuuccgccuuggcuaaagcaagcacaaguuaugcauuagguuuuuguccacaaaccacuccaauaagcuaugacacacagaaauugugcuuuuaccuucaucuucaaccccaauaacuuguauuuaaauugacuuccagaaguaucagaaaacauucugcuaagauuuuuuuacuuauuuauugagauggagucucacucugucacccaggcuggagugcaguggcgcaaucuugguucacugcaaccuucaccucucggguucaagcgauucuccuaccucaggugauccacccgacucggccucccaaagugcugggauuucaggugugagccaccgcacccagccguaaguuuuaacuuauaacaauuuuuacgugguacagacauucagugugauacuuaaaagaacagacaaaauguacccaauaaaccagaagacacacuuacccacugcaugcacuacagagcacauucuugcuaaguuguaguuugguugucuugccauuauacagaucuucuaaagauacucuggaaagaaaagaaucggcuucaaucaaauuuugccacauuuugucaaauacaagauauaaguaacagcugauacagcaaauucguuaucaacuuuuaaaacagaauucaaaaacaccucauaaucucacauuaaaucaauuaaacugaggcuuauauuauggcucaaauuaacagaaauauuuuaugacuacagacaguacauauaugauacccaaagccagagccuauagcaucaggccaacaauuugcugugguggaauuucugauaaagcugaugacuucgcaaacucaaauaucacaaccuucuguucugaggcauaagcccuccaccuaacuccuaauaaaaacccuucagaagagguacaauuauuauucccauuuuaugugauaaaacugaggcacagaacagucaaguaacuugcccaagaucacauagguaucuggcuccagagucccuguuuccuccauggacaauuuagaaaggcuacaaaguuauauuucggcuuaagggagucacuuagauggcauaugucuuaaaaaaaauaaaaguggcccuaccuauaguaugacagaaaggagggauagaauaguuuuucaugccaggugcaguggcucaugccuauaaucccagcacuucgggagacugaggagggaggauugcuugagcccagaguucaagaccagccugagcaacuuagagagaccucaucuuuaccaaaaaauaaaaaauaauuagccagguguaguggcaugucugaagucccagcuacccaggaggcugaggcaggggaauugcuuaagcccuggagauugaggcugcagugagcugagaucguaccacugcacuccagccugggggacagagugagacaaguacuuauguguggaguuuucuacuuguggcaucaugauggugcucaaaaaguuucauauuuuggagcauuucagauuucagauuaguaauggucaucccguaaugaucugcuuuaaaauccugggaguuagaggaacaaaaaaauaguuuaaaguauuuuacaaagcaccuauacuauuuugugauauucaaacuuucuuaaaauuguuauucucagaaacuuaaaacuguuguaggcaggauaagaauaccacacguauggacaaaacauuaccaacaacacugucaaauaaugaccuaucaacagcugagcuuuagaccaaaacgcuuguugcaucuuguauacucugcauaacaaaucauuuaaagaaaaucggcuuucuuccccuacauauuaaauuacaauugguaugcacaaccaguauccuaagccagagaaaaauacacaucucaacaaagaaggccaaggaaggaaaaaugcagguaaugguuuggcaaggcuggcacucuccacuaguggggccuaaacuggcacaaucccucugcaaggcaauuuaguuguauuuaucagccucaaaacacucaugccugccugggaaucucugccaaggagaaacaaagcucuacauaaagauacucauagcagcaguaucuauuacagagaaaaaaccugggaauacccuauauaaaagguaaauaaaucauagaaugcaguauuauaaacauaguauuuguaauaacaggaaaaucugaaauguuaaaacagcagaaaacuuucacuauauagcauaacuuuuuuuuaaacaugaagaacuauaaaguacagacagcacucuuuugacccuauuuucuuuuuagaccauuucuauauuaaagaaaaauauaaacgaauuaaccugcacugcacaaauauuaccauuggaaugguauccaaauguuaauuucugaggguaaauucuuuuaaaaaacaaauuuaaggauucaaugagacucaaaguuaacagauaacaugacuuccucuaauuuacucaaguguauaaacuaggauauuaugaaauauuuuaaauaaguaccugaacuucggccacugacauuugcuaauaaaaucauuuauugguccaugaaaaaaagaaugggaaaaaagaccucccagauuuugcaaagugaaacagcuauuuucauacuggagagggcuuguggauucacagucuaagaccaaggucaggcaccauucauguguuggcagguuaaggucaggcuggaagccagcaagcuccauggaaaccaacucagaagaguucacacugaggaucaaguaaugagugacucuaacauguacacaaaguaggcagacagucacucauuuuuaguuuuuaaauaaaagguaacuuggaagauucauauacuucaaagaaaauaggcugggcgcaguggcuuaugccuguaaucccagcacuuugggaggaugaggcaggaagaucacuugaguucaagaccagcuuggccaacauggcgaaacccugucucuacuaaaaaauacaaaaauuagccgggcauggugcgggugccuguaaucccagcuacuuggggggcugaggcaggagaacuucuugaaccugagaggagggggaugcagugagccuagauggugccacugcacuccaacccgggcgacagggacuccauuucaaaaaaaaaaaaaaaaaaaaaaaaaaggucgggcacaguggcucacgccuguaaucccagcacuuugggaggccgaggcaggcagaucaccugagguugggaguucgagaccagcaugaccaacauggagaaaccccaucucuucuaaaaauacaaaauuagccggguguguuggcauaugccuguaaucccagcuacuugggaggcugaggcaggagaaucgcuugaacccaggaggcagagguugcagugagcugagauugugccacugcacuccauccuggacaagagcgaaacucggucucaaaaaaaaaaaaagagagagagagaaaaugaucuucacaguugaaauuuuaaguccuauaauaacaagcagccucagaaccauauaaaaccaccuuccucucauuaaaaaauaucgacuguccuuuuaagagcuacagcgaaauagaaacauucagauaaucaaauucaauuuagucaccaaaagaagacaaggcaaauggaaguuuuucuaaugaaggacagaacacucuaugagauuuuucaucuacugagucauuaucccacuugacaaaaaguacuuaauuuuuuaaaacaacaaaacaagauauucacuugaguggaugcaucauguccucuccucuucuucugccauuucgacuucuacucugauugcccaugaagccgaacaaucccccaccaaaaaugugagagaaaauaucauccaugccaccaccuccgccgcugccuucccgaagaccuugcucuccguaucugucauauaacucacgcuucucaggauuugauaguacuucauaugcaaaacuuauuucuuuaaacuauaaagaaaagguaaaaauaaaaauaauugcauuuucaaguagaagaguggggagaagcuacaggaauccagaauccauuuaauucuaaaaaaaaaaaaaaagggacaaguuaccuuugacuugauucugguucuauuuaccacccaccgcuccucagaaugguaguacucuuauucuaaaacuaaaauacucuugacauuaugaaaauguggcugugugggcauaguuggauuuuuuuccugcaacauuccucuuuuucaaggagggcaauuuaaguuaaagcuaaaacccccggaauaaaaaaggugcaaauaacuuacuuugucuccugcauuuggauucuuaucaggaugauauuccuuggcuaacuuucuguaugccuuugaaaauggauaaaaacaaaaaagguuauaacuaaacaccaguuaaaaguuuuguaauaacuuaauauccacuuuucugagaaguaauguucuagaguuauaaccuuucaaaaauauuuucuauucguagggauucuucggcacuuucucgcgauacuguuuacuaauguaauauaaccaaguagacagcagcuauacuugaaaacagguuacagugacgugaaaaccagauaaaacaaugaagcaaugccacagggaaaaacaaaacguucaaacauuauccauauuuuccuauugucaagugucuuugauggccaaguaaccagaccaagacgacccuaauaaauucgagauaaaugacuguuaagcuuugcggacugcaaaacauuacuauaaaucaagcuaaagucacaauuccugcucccgauggcucacgccuuccuucuaacuguaacaucaugaaaaaguaaaggugguccuaguuagcgucuuuugguguuuuauuugcacguggugguuaacuggggucgugguggcaacuucggugguagagaaguugcacacacucucaacgagguguuuggguccuaaagcacuuaaaucuucauucacggaggcucgugaauuauauaauacagacuagcauuuccgguaagguaacaggaaguccacuguacucuucucacugccuaaggagcauucucauuuuucucggcuuacaaaucuggaugcucuuagccuggugaggaugcuguggggcuuaaaugccucgugugcuuugaaauccugagaugaaagauaucgcagcauugcaaauagcaauaauaaggccuucuauuuauguuuacuguacacucaggcguuuggcugggaccacggcuuauuccuaagcagguacaggacauuagcauuaccugcccaaagaacaaugcauccaaacacagacccagcuaccuccgggucaaugggcgagggacgcagagagggaggagcucccgcagccggcggccgcggaacccaggaaacaaccccauccgcccgaggcgcucugugggggcggccucgaccuccccgccguuccuccccgcggagcaccagacccggggccgacggccgcggggcggacagcuucucucucggggccgggaugcgcugagcaccucgguccaaccuguuuuuccgggguggugaccucgacgcgaaggaccgggcgagcugcugccucccgggggauaccagcccccggcgcucguucaaggagggaggaaggaagggcucccaucguguuugcgcaggagugaguuuuauuugcugcaucugcgggcgggcggggccggcggccccaaggucagccgaggccggagugcgcggcucgcggcgaggccggucccgccgccgccgccgacucccagcccgggccagucacggccggcgccggcucgcgggcagcccaguagcgcggccuggcugaagaagacaucccuggccgcgcaggccccgcgccccucacacccgcccggcccgcucccagauaccuucuucagcucguucucgcuggcgccgggcgggacgcccaggaugucguacagcuucgugucagccacguuagccauggcggccggccgggcagugcucggggagaagguggcgaagcagacagagcggagucgggcccacaagcggcgucggcggcggcacaggccgagggagacagcgagggggaagcgggggcggggcugaacuuugacccagcgc

SEQ ID NO: 191921 - RNA, 5339 nt, Homo sapiens
uuuaauuugccagauauucuuuuaaugagaauuauaaaagaccaaaaacauuuuuugcaaacugccuuuuuaaacaaaugauuugcuuuuaauuacaaauacugugcaugacgaugccuucuucugcaaaaccaauaaauacaagaacaaauuuuaaaauaugugauuuguccaagauaucugaaaaaggaaacaaaagccugauuugcaguauuuauaaaaaucaauuuauucucuaaccuuucaaagauuaagcucaaaggugugacucaucuguagaagacagaaagagagcaccuuauagaugcuuuaaauagcuuuugauuauuuuuccgaugucaccuuuacuuucuggaacucauggcuucacaaaauagcugauuuuaaaauauuucuaaugaacugauuaaugggggaaaagaaaauauugaacacguuauaaauuuuuuaccauaaacaaauaugcauaucaaaagauacuaacuuuaaaaugguacaaaaaaaggaaaaaccugaauuacagaaaagucaaauuuauuuaaugaaaaacuaaaauuaauaaaaauuagcaaauacacacaaaaaaagcacacagcagcacuauguauugacucacaaagggaaaagcaguggcccaugaccacucaagauggcuugucaguuaaaggaaaaaaacccaaacacgcacacacccacgcaggcacacacucccacgcaaaaacaaacuuuuucaacaauacaaucaaucuacaacaaacacaaaacucagaauuauuuuacaaugcuuccuuucuuaauacaaaagaugcccaucuuggguguauauacauauauuuuuucagugguuuacuguugacuuauuuuuaaauauauuaguguuacuacaugcaacuguuuccuguauuuaacagccuuucuuuuuauuuaccuucaugugucuagcuuccaccuaccgaaagaguuuuagguuggcagacagaugggugccuuauuuucugugaaacugaaguuuuaaacacuggccagaaaauguuugauugccauuucaacacauggaaauaguuacauugaugccuaaauugccauuuucugcaaaaagcugugcaaugcuggugucaaagacuagacagucgcuauucauaauggcuguugcaauuccuucaugaauagaucgaggagucgcuucccaagucaaucgucgccuaugaccauuuagcucaagucgguaagcaaaauuuucagcuugcuugcguguuccuaucagcuguacgauugcgaagaacugcuggugaccaucguauuuuuccuguuucucuaagacuaacaugaagugaaagccaaaacaggacugcaucaucacccagucaacagcaccaggaagauuaaugucuguagcaagaaaaacuauauccucucccuguaggguuguaauggacuuaugcugaugcaucagauggggcauuacagcauccagagagccuugccauuuacaggaagcaccagggcacggacaggaauaaggccuaaacucacagagcucuucauggucugcuuuuucuguguguggcagaguuauuucacauccagaagacgcauauuuacaggggaaaaguacugaauuagccacuuucuccauagccaaguugcgaauggaucccaaagggccccggcaaguuggacaacaugugagcuuugggcgacaguugcuacaaacaagauggccacucugacauugaagaaugggcgguaacacauagucaaagcagacuggacacucaaaaagacucgccaagucauuguuggaugcaguugugccagucagggcaggcacccucugggaugguggacacuucgagguaccgguagguaaugcuguagcagucugacggcucauuucugaaauaaauacauaaggaggcaggagaaaaauaauuauaaccaugacuuacuuuauaaauaauguuuacaugccauaaguccuuuuaaaguuucauacaaaauuuacugagcaaaagaggaagaaaaauaggauuaaaaaagauauuaaaaaaauaaaauuacacugaaugugcacuuuauuaggaucuguacacuggauaagcucucuuuucaaaauguuccggaaaacauguggaacucccuuaaucgucuuuggauagacuacauagaauaauaaaugcuaaaauagaaaauggaccauaaacaacuaaagaaacuauacaaggaacugaaguuuaaucgaauccguuuugcuaggacucucccugaggcucccuuacucuauuucuuucuaauuuggagucagcuguugauagguacagggaguuacaggugaacuccuguauaaaaucggcacucuguauccacacggucugcauccgaggacuucaccagccauggauugaaaauauucagaaaaauuuauaaagaauacaaaauuuuuaaaauacagucuauaacaacuauuuacauauuguuuacauuguauuaaguaauccagagaucacuuaaauuauacaagagaauaugcacauacaaauaugacaccauuuucuaucagggacuugagcauccucagguuuugguauggagaaggggguccuagaacuaauccgaggauaccgcggauugaauguaguuccaaugccaaagaaucagaguaucaccuuccauuaacucuucuuaaugguaagcaauuaucuacucuagagguguauuuuggaaaugaggggaagggucacaaggggaaaggucugcugccaucccauuauccaucucuaucuaauuaagucuuccccccaaauuaucaccagccagguauuaaucuuauuuccuacugaucagugcccaccucaagagugaggggauguacucgcuagugaagguggcgaaaauauaaaaauaaauaaaaacacaacuaaggugaagugaggcaugggagaaauggagggccaucucaaaacuuuuuagucugguagagaaaguauaucuuucuguucuacuuucaauccacaauaugugucagacauaaugaacaaaggaggacagucaggaagagacaaugaaaaaggaaagaauaaagaugauagcacggcagagauauaugccauacugggggugggggauggagucaacaggugaagaaccccuugcagccuaggguucuccagcguugcugaaaacauucaucagcagaguaauaaacauuauuuaacagguaaauaucaucuggaagaaauaaucgacaauguaacuagccaggcugagucaaagauaaaacaagcaacuuuucccaggaagcuaccugggcuggaaaauggcaggccacuauuugucuugggggugaaaaaaaagaucagucaauguccuaagacugcacuccuaguaacucuacuaagccauaaucuuuuuuuuuuuuuuuuuuuuuuuuuuuugagauggaguuuugcucguugcccaggcuggagugcaauggcgcgaucucggcucacugcaaccucugccucccagguucaagcaauucuccugccucagccucccaaguagcugggauuacaggggcccgccaccaugcccgacuaauuuuuguauuuuuaguagagacgggguuucaccauggcuggucucgaacuccugaccucgugauccacccgccucggccucccaaagugcugggauuacaggcaugagccacugcgcccggccacuaauccauauuacaaaauuaaagccucaaaauuaauguuuuaucucaauuauagucauucuguugcaaggaacuuuuaagaagcaauguugguuaccaaugugaccaaauaaaugcaacuuagguuuagauuacccaagugguuaccaacugauagcuuaaaugagggcugagggugacggaaaaaauaaagauuaauuccacgucacuaaacggguauuuuaaaguuccagaggcaacaaaagugacaauuccaucguaaugugucucaucauauggacucagaacaugaaucaacucucaaucugaagcccagugugacccagguauucuguccccugacaaaggacuauaagggagcucuccuguaauccaguuucccucucaguagauucuuuguacauaugacauccauuuuaugucacuuguaaaacagugggcucagcauugccaaaacacccuggcuguaugcuguaugccuacugcaugguccaguuuacuucaguaagcagcguaacaauuacaaagugguuccuugggcaaaaaacagucuagucaaccaaugccuuucaaauuacuaaaucaaaccaaagaaucacauccaagggcaguaaacucaguuuauauuuaacacaauauagcuacggaccaagcaaaacacuguuguucacaauuucuugaccuagcaauaguuauacauuuaucaacaacaguucgggcucacauuacaauauaucuuugccauuuuccaaacacuacagaaagcacauuuuaacuccuauucaaagugugaaaaagaagcgaaaugugaacgguauuucuugggaacggagguauuacaggacagcaacugcuaaagccucucaaagcuccaaggguggaacccagcuccaucuugaaacagaaaaggaaucccaaccacacaggcgcccugcaguaggaaccaaggacagcccugcagaagucaugacguaaccugaaguuugauuuaaacagaaaaaagaacagcagcccaaaugaaacaugacugagaaccucggaaacgucucgauucugcugcagccauucccuaagccaggcagguuccacugacuaauagcguucaaguuucacagccucagcaaaccauccucuuaaugucaauaccuuuucucuuccuuguccuggccgcugguaaacaugugaacaagacuccccuccaggaguacagagaagguggaguagccuuucccgucaugagaagucaggccacgcauugcguuucccccaagaaguaaaggaacaggccccuccugggcucuuucugcuccuaagcacagaagacccaaauucgcgucugaggucaggauccaaauaccauuuacuucucagaagcaccaguuacagagguggagaaaggaagccuuuccauccccaggaggcaaccacaccucccugugagcucaaauucgacugcaucuccaaaaaugggagccacagcugcgcuguccuccaaugugcccuaagcuuucgucugucucccaaguuuguuuucuccagauucacuggguaggguccugcccagcuccaguggaggccacggaugcagggggcgacgcgcuggcugagaaggaagugcgcucccugagccagc
